United States Patent
Turgeman et al.

(10) Patent No.: US 11,732,272 B2
(45) Date of Patent: Aug. 22, 2023

(54) POLYNUCLEOTIDES AND POLYPEPTIDES OF PLANT AND BACTERIAL ORIGIN FOR PROTECTING PLANTS FROM PATHOGENIC FUNGI

(71) Applicant: EVOGENE LTD., Rehovot (IL)

(72) Inventors: Tidhar Turgeman, Givatayim (IL); Ada Viterbo-Fainzilber, Rehovot (IL); Eyal Emmanuel, Rehovot (IL)

(73) Assignee: EVOGENE LTD., Rehovot (IL)

( * ) Notice: Subject to any disclaimer, the term of this patent is extended or adjusted under 35 U.S.C. 154(b) by 7 days.

(21) Appl. No.: 17/046,110

(22) PCT Filed: Apr. 10, 2019

(86) PCT No.: PCT/IL2019/050399
§ 371 (c)(1),
(2) Date: Oct. 8, 2020

(87) PCT Pub. No.: WO2019/198075
PCT Pub. Date: Oct. 17, 2019

(65) Prior Publication Data
US 2021/0163979 A1    Jun. 3, 2021

Related U.S. Application Data

(60) Provisional application No. 62/656,377, filed on Apr. 12, 2018.

(51) Int. Cl.
C12N 15/82     (2006.01)
C07K 14/415    (2006.01)
A01N 63/50     (2020.01)

(52) U.S. Cl.
CPC ......... *C12N 15/8282* (2013.01); *A01N 63/50* (2020.01); *C07K 14/415* (2013.01); *C12N 15/8216* (2013.01)

(58) Field of Classification Search
None
See application file for complete search history.

(56) References Cited

U.S. PATENT DOCUMENTS

| | | | |
|---|---|---|---|
| 5,773,696 A * | 6/1998 | Liang | C12N 15/8282 536/23.6 |
| 9,359,615 B2 | 6/2016 | Morel | |
| 9,485,994 B2 | 11/2016 | Leveau | |
| 9,732,354 B2 | 8/2017 | Thomma | |
| 2012/0010077 A1 | 1/2012 | Dellaporta | |

FOREIGN PATENT DOCUMENTS

| WO | 2006085965 A2 | 8/2006 |
|---|---|---|
| WO | 2006091219 A2 | 8/2006 |
| WO | 2018131037 A1 | 7/2018 |

OTHER PUBLICATIONS

Matsumoto et al (2011, GenBank Accession No. BAJ94611).*
Viaene et al, 2016, FEMS Microbiol. Ecol. 92, fiw119, doi: 10.1093/femsec/fiw119.*
GenBank ATCE01000044 (2013, https://www.ncbi.nlm.nih.gov/nuccore/ATCE01000044.1.*
Baysal et al., (2013) A proteomic approach provides new insights into the control of soil-borne plant pathogens by *Bacillus* species. PLoS One 8(1): e53182; 12 pages.
Brewer et al., (2014) Mutations in the *Arabidopsis* homoserine kinase gene DMR1 confer enhanced resistance to Fusarium culmorum and F. graminearum. BMC Plant Biol 14: 317; 15 pages.
Devi et al., (2000) Lipoxygenase Metabolites of α-linolenic Acid in the Development of Resistance in Pigeonpea, Cajanus cajan (L.) Millsp, Seedlings Against Fusarium udum Infection. European Journal of Plant Pathology 106: 857-865.
Dowd and Johnson (2016) Maize peroxidase Px5 has a highly conserved sequence in inbreds resistant to mycotoxin producing fungi which enhances fungal and insect resistance. J Plant Res 129(1): 13-20.
Haack et al., (2016) Molecular Keys to the *Janthinobacterium* and *Duganella* spp. Interaction with the Plant Pathogen Fusarium graminearum. Front Microbiol 7: 1668; 17 pages.
Hjort et al., (2014) Bacterial chitinase with phytopathogen control capacity from suppressive soil revealed by functional metagenomics. Appl Microbiol Biotechnol 98(6): 2819-2828.
Hu et al., (2013) Overexpression of the Tomato 13-Lipoxygenase Gene TomloxD Increases Generation of Endogenous Jasmonic Acid and Resistance to Cladosporium fulvum and High Temperature. Plant Molecular Biology Reporter vol. 31: 1141-1149.
Lanubile et al., (2017) Molecular Basis of Resistance to Fusarium Ear Rot in Maize. Front Plant Sci 8: 1774; 13 pages.
Li et al., (2009) Purification and characterization of a novel antifungal protein from Bacillus subtilis strain B29. J Zhejiang Univ Sci B 10(4): 264-272.
Li et al., (2015) Transgenic Wheat Expressing a Barley UDP-Glucosyltransferase Detoxifies Deoxynivalenol and Provides High Levels of Resistance to Fusarium graminearum. Mol Plant Microbe Interact 28(11): 1237-1246.
Mackintosh et al., (2007) Overexpression of defense response genes in transgenic wheat enhances resistance to Fusarium head blight. Plant Cell Rep 26(4): 479-488.

(Continued)

*Primary Examiner* — Anne Kubelik
(74) *Attorney, Agent, or Firm* — Raphael Bellum PLLC

(57) ABSTRACT

The present invention relates to polynucleotides and polypeptides derived from plants and bacteria which are associated with increased resistance of plants to pathogenic fungi and/or Oomycetes. The fungicidal polypeptides of the invention are particularly effective in combating fungi inducing root rot and stalk rot in plants. The present invention further provides methods of using the polynucleotides and polypeptides of the invention for controlling plant fungal/Oomycetes pathogens and for producing transgenic plants having increased resistance to the pathogens.

12 Claims, 8 Drawing Sheets

Specification includes a Sequence Listing.

(56) References Cited

OTHER PUBLICATIONS

Perochon et al., (2015) TaFROG Encodes a Pooideae Orphan Protein That Interacts with SnRK1 and Enhances Resistance to the Mycotoxigenic Fungus Fusarium graminearum Plant Physiol 169(4): 2895-2906.

Shin et al., (2008) Transgenic wheat expressing a barley class II chitinase gene has enhanced resistance against Fusarium graminearum. J Exp Bot 59(9): 2371-2378.

Sasaki et al., (2015) The cold-induced defensin TAD1 confers resistance against snow mold and Fusarium head blight in transgenic wheat. Journal of Biotechnology http://dx.doi.org/10.1016/j.jbiotec.2016.04.015; 15 pages.

Song et al., (2015) Exploring the genomic traits of fungus-feeding bacterial genus Collimonas. BMC Genomics 16: 1103; 17 pages.

Theis and Stahl (2004) Antifungal proteins: targets, mechanisms and prospective applications. Cell Mol Life Sci 61(4): 437-455.

Tundo et al., (2016) Pyramiding PvPGIP2 and TAXI-III But Not PvPGIP2 and PMEI Enhances Resistance Against Fusarium graminearum. Mol Plant Microbe Interact 29(8): 629-639.

Wiersma et al., (2017) Identification of Pm58 from Aegilops tauschii. Theor Appl Genet 130(6): 1123-1133. Abstract.

Yadav et al., (2010) Characterization of the *Escherichia coli* Antifungal Protein PPEBL21. Int J Microbiol 2010: 196363; 8 pages.

Zhu et al., (2012) Overexpression of wheat lipid transfer protein gene TaLTP5 increases resistances to Cochliobolus sativus and Fusarium graminearum in transgenic wheat Funct Integr Genomics 12(3): 481-488.

Zuo et al., (2016) A Deoxynivalenol-Activated Methionyl-tRNA Synthetase Gene from Wheat Encodes a Nuclear Localized Protein and Protects Plants Against Fusarium Pathogens and Mycotoxins. Phytopathology 106(6): 614-623.

Database NCBI [Online] Feb. 24, 2017 (Feb. 24, 2017). Putative lipoxygenase 5 [*Aegilops tauschii* subsp. tauschii], GeneBank Accession No. XP_020178139. URL: https://www.ncbi.nlm.nih.gov/protein/1149845435; 2 pages.

* cited by examiner

FIG. 2A

TAACACAAGTGTCGAATAGGAAATTCACGAGCTGTCAAAAACCACATGAGGTT
TGTTTTTGACCCGCGACCGCGAGCTTGCTAACGCAAGGTTTCAGTTCTCGCCG
AAACGAAACAAAATGACGGTGCCGCGCTTGCGCTGTCATTTTTTGTTTTCGA
CGGCCAGGCTGAAACTGTATGGCTGAGGATGTCACTGAGCTTCTTGTTTCCTA
GTGAAAATGGTAGAGAGCAGTTACTTGTTCACGTGAGAGAAGAAACTAAAGAG
AAAATAAATTAGCCTTTCTGCCTTTGTGACTGTTTTGAACTTTTGATATATAT
ATCCAGCCTTCCGCATGCTATATTTGAATCTCAATAAACGGTGCTAGGGGGGT
TTTAGCAAAAGTACTTCAATGTTCAATACTGTCTTAATAGACGTCCTTCTCTA
ACATCAAGGAGTACATTGCGTACGGGCCCTATTTATTTCGGTTTTTGGCTGTT
AGAATCGGCTTTTGGCAGCCAAATATTTTGTTTTTCAGATTGCTTACATGAGA
ATCGCGTCTGTAAAAATCGTCTAAATCAACGTTAATATAAAATCCTAAATTGT
GCAGAGCCCTCCACCTTTCTTAACACACAACACAGGTCTCAGGATATTCAAAT
CCATATAAGAGCTAGATTATTCAGTAGTCCAGATTCCGACCAAAACTCTTTAG
GATGCTATCACAAACAAACATGTCCATATTCTTTCGTGATTTTAACGTATCGT
TTTCGTGCCCTCTAACCAAAACACTCCCAAACTTGTTTTCGCTTTTCGAAAGG
AGGCTCGAAATTATGAAACTAAATTTTAGGAATAAAGACACAATTGCGACACA
AAAATAACCTTTTTTTACCCAACTTCACACCACCATATGTAGGTCTTCGTGCT
ACCGGATTTGCCAACACCTATAAAATTTATGTCAGGTTGTCACGGCTTTACTA
TTATCGCGTCTAACTTCAAACACATCTGGAGATGCATTGATCTCGC (SEQ ID NO:45)

FIG. 2B

GGAATACTTTGGCAAATTCTGCTCTGTCCTTGCAACCAAGCATAACATACAA
GTGACCGAAATAGACAAGCAAAGTATATCAGAACATTGTCAAATTGCAAGTT
GCAACAAAACTGAAGCAAACACAATGTAGAAACCATTCGGAGCATCACAGGG
GTTGGTAGCAATCTGAGATACATGATTAAAGGAATGGTTTAATAGTACATGC
ACAATTAAATGTTTCTTTTTGTTTCCAAGCTAGGCTATGAATTGTCCACGAT
CAAGCTAAAACCCCCTACCCACTAAACAGGAGACTGCTAGGCAGGGCGAAC
AGGGAGCATTCCTGCATGTAAGCAACCAGCCAACCAAATCACAGCCATCTAT
CATTTCCTCTTCTTAGTAGGTGGTTGGGGGACATCATCGTCATCATCCTCTT
CCTCTTCTTCCTCCTCATCTTCCTCATTGTCACCATCCCCATCATCATCGTC
GTCATCATCCTCCTCTTCATCCTCTCCACCATCATCATCGTCGTCACTTCCT
CCTTCACCGTTGGCTGCAGGATCGTTATCATCGTCGTCGTCATCTTCCTCCT
CATTCCCATTGTCATCTGATCCCTCATCACCACCATCATCTTCTTGGTTTTC
AGCATCCTCATCGTCTCCCTCCTCATCATTATCATCATCAGACTCTCCATCA
TCCTTGTTCTCGAAATCAGTTGCATTTTTGTTTTGCTCAGAATCCTTGTGG
AGAAGGAAACAAACAATCCTCAGCTTTGGGAGACGAAAAAAAATGCCCATGG
CAATAATGATGTGGTACATGTTTTGACATTATGCACCAGTGGGCATTACCTA
TTAATCAAATTCTGATCTCCACCAGATGTAAAGATTTCATTATGAAGAATCT
GCACAAGAAAGTCAAAACAGTACACAGTATTAGCTAAGACGAGGTATATTTC
CAATTAAAAGTGCACGAACAATGCAACAATGGTTATTCCCGGGCTTTAAAGG
ACATAAGACACG (SEQ ID NO:46)

FIG. 2C

AGATGCATTGATCTCGCGCG     (SEQ ID NO:43)

FIG. 2D

AGATGCATTGATCTCGC        (SEQ ID NO:47)

FIG. 2E

ATTTGCCAAAGTATTCCGGG     (SEQ ID NO:44)

FIG. 2F

GGAATACTTTGGCAAAT        (SEQ ID NO:48)

FIG. 2G

ATGGCTTACCGCGCCTTTGCTACGCTGCTTGCAGTGCTAGCATTTGTGGGCTTCG
CTTCAGTTCCCCGTGGTCTGGCAACTGACCCGACCCAGCTCCAGGACTTCTGCGT
TGCTGATAACAAGAACCCTGTGCTGGTGAACGGGGTGGTGTGCAAGAACCCGAAC
ATGGTGAAGGCAACCGACTTCTTCTCCACGATAGTGCCGGTGGCGCCAAACGGGC
AGGGCTCCGCCGTGACGCCGGTGGCGGTGAACGAGATCCCGGGGCTGAACACGCT
GGGCATCTCGCTGGCGCGCATCGACTTCGTCCCCGGCGGGCAGAACCCGCCGCAC
ACGCACCCGCGCGGGTCCGAGATCCTGACGGTCATCCAGGGCACGCTCCTCGTCG
GCTTCGTCACCTCCAACCAGCTGCTCAACAACACGCTCTTCACCATGCAGCTGAA
CATGGGCGACGTCTTCGTGTTCCCGCAGGGGCTCATCCACTTCCAGCTCAACAAC
GGCAAGACCCCGCCGTGGCCATCGCCGCGCTCAGCAGCCAGAACCCCGGCACCG
TCACCATCGCCAACGCCGTGTTCGGGGCCAAGCCGCCCATCCTGGACGACATCCT
CGCCAGGGCGTTCATGCTCGAGAAGGCCACCGTCGACTGGGTCCAGCAGGCGTTC
GGCGCGGCACCAGTGGCCGGCGGCGGCGGTGGCCTGCCCGGAGGAGGTGGCTATC
CCGGCAGCGGTGGTGGCCTGCCCGGAGGAGGTGGCTATCCCGGCAGCGGCTTTCC
GGGCTACCCCGGCCGTAGCtga (SEQ ID NO:50)

FIG. 2H

TAACACAAGTGTCGAATAGGAAATTCACGAGCTGTCAAAAACCACATGAGGTTTG
TTTTTGACCCGCGACCGCGAGCTTGCTAACGCAAGGTTTCAGTTCTCGCCGAAAC
GAAACAAAATGACGGTGCCGCGCTTGCGCTGTCATTTTTTTGTTTTCGACGGCCA
GGCTGAAACTGTATGGCTGAGGATGTCACTGAGCTTCTTGTTTCCTAGTGAAAAT
GGTAGAGAGCAGTTACTTGTTCACGTGAGAGAAGAAACTAAAGAGAAATAAATT
AGCCTTTCTGCCTTTGTGACTGTTTTGAACTTTTGATATATATATCCAGCCTTCC
GCATGCTATATTTGAATCTCAATAAACGGTGCTAGGGGGGTTTTAGCAAAAGTAC
TTCAATGTTCAATACTGTCTTAATAGACGTCCTTCTCTAACATCAAGGAGTACAT
TGCGTACGGGCCCTATTTATTTCGGTTTTTGGCTGTTAGAATCGGCTTTTGGCAG
CCAAATATTTTGTTTTTCAGATTGCTTACATGAGAATCGCGTCTGTAAAAATCGT
CTAAATCAACGTTAATATAAAATCCTAAATTGTGCAGAGCCCTCCACCTTTCTTA
ACACACAACACAGGTCTCAGGATATTCAAATCCATATAAGAGCTAGATTATTCAG
TAGTCCAGATTCCGACCAAAACTCTTTAGGATGCTATCACAAACAAACATGTCCA
TATTCTTTCGTGATTTTAACGTATCGTTTTCGTGCCCTCTAACCAAAACACTCCC
AAACTTGTTTTCGCTTTTCGAAAGGAGGCTCGAAATTATGAAACTAAATTTTAGG
AATAAAGACACAATTGCGACACAAAAATAACCTTTTTTTACCCAACTTCACACCA
CCATATGTAGGTCTTCGTGCTACCGGATTTGCCAACACCTATAAAATTTATGTCA
GGTTGTCACGGCTTTACTATTATCGCGTCTAACTTCAAACACATCTGG*AGATGCA*
*TTGATCTCGC*GCGCTTGAAAATTTAGTTATTAGGTTGGTAAAAGACTAGGTTAGG
TAAGAAATTTGAAAACAAAAATCCATGGGAGATGTTTTTACGTAGAAGAATAGTG
AGAATTTGAGAAACTTTATTTCCTAAGAAACAAAGAAAGTTTTGGTGAAATAATT
GAAACGAAAAATTCGAGAAACTAGAAGCCCGATAATGCCCTTCTCCTCTACCAAC
TACCAGCGCAGTCACTCGCCTCTGCACACGTCGCTGATGCTCGTCTTCCTTCCTT
CCCATCCTTTATAAGGCCCGGCCGCGGCTCTGCTCGCCTCTCCTCCCTTCCCTCC
CGTACCGTATCAGTCTCCCGGATTCTCTCCGGTTCGTGGGAGGGCCAAAGCTTCG
AGTTAGGAAAACCCTACCGCTGTGGGAGTAGCCTCCGGCGatggcttaccgcgcc
tttgctacgctgcttgcagtgctagcatttgtgggcttcgcttcagttccccgtg
gtctggcaactgacccgacccagctccaggacttctgcgttgctgataacaagaa
ccctgtgctggtgaacggggtggtgtgcaagaacccgaacatggtgaaggcaacc
gacttcttctccacgatagtgccggtggcgccaaacgggcagggctccgccgtga
cgccggtggcggtgaacgagatcccggggctgaacacgctgggcatctcgctggc
gcgcatcgacttcgtccccggcgggcagaacccgccgcacacgcacccgcgcggg
tccgagatcctgacggtcatccagggcacgctcctcgtcggcttcgtcacctcca
accagctgctcaacaacacgctcttcaccatgcagctgaacatgggcgacgtctt
cgtgttcccgcaggggctcatccacttccagctcaacaacggcaagacccccgcc
gtggccatcgccgcgctcagcagccagaaccccggcaccgtcaccatcgccaacg
ccgtgttcggggccaagccgcccatcctggacgacatcctcgccagggcgttcat
gctcgagaaggccaccgtcgactgggtccagcaggcgttcggcgcggcaccagtg
gccggcggcggcggtggcctgcccggaggaggtggctatcccggcagcggtggtg
gcctgcccggaggaggtggctatcccggcagcggctttccgggctaccccggccg
tagctga

FIG. 2H (Cont.)

GCCAGCGAGAGACGCAGGATAAAGGCCGTAGTTTTGCAAGGCGAGTAGAGCAGTA
TGTCAGTAATACAGCATCTATGGCATGTGCTTTTGCTCGTCCAGTTCATGAGCCC
CGTTGTGTATTTGGTTTCCGTTTTCTTGGTTGGAGTTTTTAGTTCCAAGGTCCGA
TCATGTTTTGATCCCATAAATTCTCTTCCAGCCTTCGAGCAACTGAGTCCATCTT
CCTAAGTCATCAGCCCCAGCGAGACATTGAAGCATGGGGAAACTTAAACAGTATG
GTGATGATTAATCTCAGCATTTTTTTTCTTGCAGCAATCAATATGGACTTTGCTT
AAAATTTCGTTGTCTTTTCAAAACGATATGCAAGCAAATGGAAGTGATGTTCTT
TGAAACTTTGTTTCAATGCTATAGCAAAGGTTTGCATTTTACAAAGTTCGGTTTA
GTGACGACCATTTAGATGACATAGATTATGCTTTTCGTATTTTGGTAGCTTCTCG
TGCGGACGCGCGGTCATGCCTAGCATGCCGAAGACCTTGTCATATAGTGAAGGA
ATTGCGGTAGCAATTAGTTCATTTTTCCCTAATCCCCTCCAATCACTTTCTCACC
AAACAAACTCCAAAGGTCGTCACCGAAGGGGACGTTCCC**GGAATACTTTGGCAA
AT**TCTGCTCTGTCCTTGCAACCAAGCATAACATACAAGTGACCGAAATAGACAAG
CAAAGTATATCAGAACATTGTCAAATTGCAAGTTGCAACAAAACTGAAGCAAACA
CAATGTAGAAACCATTCGGAGCATCACAGGGGTTGGTAGCAATCTGAGATACATG
ATTAAAGGAATGGTTTAATAGTACATGCACAATTAAATGTTTCTTTTTGTTTCCA
AGCTAGGCTATGAATTGTCCACGATCAAGCTAAAACCCCTACCCACTAAACAGG
AGACTGCTAGGCAGGGCGAACAGGGAGCATTCCTGCATGTAAGCAACCAGCCAA
CCAAATCACAGCCATCTATCATTTCCTCTTCTTAGTAGGTGGTTGGGGGACATCA
TCGTCATCATCCTCTTCCTCTTCTTCCTCCTCATCTTCCTCATTGTCACCATCCC
CATCATCATCGTCGTCATCATCCTCCTCTTCATCCTCTCCACCATCATCATCGTC
GTCACTTCCTCCTTCACCGTTGGCTGCAGGATCGTTATCATCGTCGTCGTCATCT
TCCTCCTCATTCCCATTGTCATCTGATCCCTCATCACCACCATCATCTTCTTGGT
TTTCAGCATCCTCATCGTCTCCCTCCTCATCATTATCATCATCAGACTCTCCATC
ATCCTTGTTCTCGAAATCAGTTGCATTTTTGTTTTTGCTCAGAATCCTTGTGGAG
AAGGAAACAAACAATCCTCAGCTTTGGGAGACGAAAAAAATGCCCATGGCAATA
ATGATGTGGTACATGTTTTGACATTATGCACCAGTGGGCATTACCTATTAATCAA
ATTCTGATCTCCACCAGATGTAAAGATTTCATTATGAAGAATCTGCACAAGAAAG
TCAAAACAGTACACAGTATTAGCTAAGACGAGGTATATTTCCAATTAAAAGTGCA
CGAACAATGCAACAATGGTTATTCCCGGGCTTTAAAGGACATAAGACACG (**SEQ
ID NO:49**)

FIG. 3A

GAGCCACCGGGAGTAGGCGC    (SEQ ID NO:51)

FIG. 3B

GGGCGACCAGCGCTCCA    (SEQ ID NO:52)

FIG. 3C

ATGCCGTCGT CCACGATGCG CCTGCTGTCC AGGCGCACCG TCACGCCTCC ACCGCGCCCA
CGCCACCGCA TTCCGCTCAC CACCTGGGAC ATCTCCTTTC TCTCCGCCGA CTACATCCAG
AAGGGCCTCC TCTACGCCAA GCCGCCGTTT CCCACCGACC GCCTCCTCGA CCACCTCCAG
GCCTCGCTCG CCCAGGCGCT CGACGCCTAC TACCCCGTCG CCGGCCGCTT CGTCACGGAC
CAGCACCGCG ACGCCAACGG TCACGTCCTC GGCTGCTCGG TCTCCATCGA CTGTGACGGC
CAGGGGGTCG ACATCCTCCA CGCCGTCGCC GACGGCGTCG CCGTGGCCGA CGTCATCCCG
CCCGACGCAC GTGTCCGCG CCTCGTCCAG TCACTCTTCC CGCTCGACGG CGCCGTCAAC
CACGACGGCC ACCACCTCCC ACTCTTCGCC GTCCAGGTCA CCGACCTCCA CGACGGCGTC
TTCCTCGGCT TCGCCTACAA CCACGCGCTC TCCGACGGCA CCGCACTATG GAGATTCATC
AACGTATGGG CGGGCATCGC GCGCGACAGC CCCTCCCCAT CCCCAGCTCC GCCGCCGCCG
CCCTTGCTGG AGCGCTGGTC GCCCGACGCC GGCCCAACCA CACCGCCGGT CGTCCTCCCC
TACCCCGACC TCACGGGGCT CATCGAGAGG CTGCCCCCGC CGCCACTATG CGAGCGCATG
CTGCAATTCT CGGCCGAAAC CCTGGAGGCG CTCAAGGACC GGGCGCGGCA GGAGCTCCTG
GCGGCCGGGG ATACGGCCGG CGCGGCCGCC GTTACCAAGT TCCAGGCGCT CAGCTCGCTT
GTGTGGCGCT CCGTCACCCG CGCGCGCCGC ATGCCGCTCG GCCAAACAAC CTTTTGCCGC
GCCGCCATCA CAACCGCAC GCGCCTCCGC CCGCAGCTTC CGCCGGAGTA CTTCGGGAAC
ACCATCTACG CCATCGCAAC GGAGGCCGTC ACCGCGGGGG ATCTGCTGGA GCGCGGCCAC
GGCTGGGCCA CGGCGGCCGT CGGCCGCGCG GTGGCGGCGC ACACGGACGA CGCCATCCGG
GCGCGCGTGG CCGCGTGGAT GGCCAACCCT GTCCTGTACA ACCTCAGGTT CTTTGACCCC
AACGGCATCA TGATGGGCAG CTCGCCGCGG TTCGACATGT ACGGCGGCTG CGACTTCGGC
TGGGGCCGC CCTGGCGCC GCGCAGCGGC AGGGCCAACA AGTCCGACGG GAAGGCGTCG
CTGTACCCCG GCCGGGAGGG AGCCGAAAGC ATCGCCGCGG AGCTTGTGCT GACGTCGGAG
CACATGACGC TGCTGGAGCA AGACGACGAG TTCTGGGCGG CCGTTTCGCC CGACAGGCCT
TTTCCGCCGG CAGCGCTAGC CGCCCAGCCA AAGTCAGACA GACACtga(SEQ ID 53)

FIG. 3D

ATGCCGTCGT CCACGATGCG CCTGCTGTCC AGGCGCACCG TCACGCCTCC ACCGCGCCCA
CGCCACCGCA TTCCGCTCAC CACCTGGGAC ATCTCCTTTC TCTCCGCCGA CTACATCCAG
AAGGGCCTCC TCTACGCCAA GCCGCCGTTT CCCACCGACC GCCTCCTCGA CCACCTCCAG
GCCTCGCTCG CCCAGGCGCT CGACGCCTAC TACCCCGTCG CCGGCCGCTT CGTCACGGAC
CAGCACCGCG ACGCCAACGG TCACGTCCTC GGCTGCTCGG TCTCCATCGA CTGTGACGGC
CAGGGGGTCG ACATCCTCCA CGCCGTCGCC GACGGCGTCG CCGTGGCCGA CGTCATCCCG
CCCGACGCAC GTGTCCCGCG CCTCGTCCAG TCACTCTTCC CGCTCGACGG CGCCGTCAAC
CACGACGGCC ACCACCTCCC ACTCTTCGCC GTCCAGGTCA CCGACCTCCA CGACGGCGTC
TTCCTCGGCT CGCCTACAA CCACGCGCTC TCCGACGGCA CCGCACTATG GAGATTCATC
AACGTATGGG CGGGCATCGC GCGCGACAGC CCCTCCCCAT CCCCAGCTCC GCCGCCGCCG
CCCTTGCGGA GCGCTGGTCG CCCGACGCCG GCCCAACCAC ACCGCCGGTC GTCCTCCCCT
ACCCCGACCT CACGGGGCTC ATCGAGAGGC TGCCCCCGCC GCCACTATGC GAGCGCATGC
TGCAATTCTC GGCCGAAACC CTGGAGGCGC TCAAGGACCG GGCGCGGCAG GAGCTCCTGG
CGGCCGGGGA TACGGCCGGC GCGGCCGCCG TTACCAAGTT CCAGGCGCTC AGCTCGCTTG
TGTGGCGCTC CGTCACCCGC GCGCGCCGCA TGCCGCTCGG CCAAACAACC TTTTGCCGCG
CCGCCATCAA CAACCGCACG CGCCTCCGCC CGCAGCTTCC GCCGGAGTAC TTCGGGAACA
CCATCTACGC CATCGCAACG GAGGCCGTCA CCGCGGGGGA TCTGCTGGAG CGCGGCCACG
GCTGGGCCAC GGCGGCCGTC GGCCGCGCGG TGGCGGCGCA CACGGACGAC GCCATCCGGG
CGCGCGTGGC CGCGTGGATG GCCAACCCTG TCCTGTACAA CCTCAGGTTC TTTGACCCCA
ACGGCATCAT GATGGGCAGC TCGCCGCGGT TCGACATGTA CGGCGGCTGC GACTTCGGCT
GGGGGCCGCC CCTGGCGCCG CGCAGCGGCA GGGCCAACAA GTCCGACGGG AAGGCGTCGC
TGTACCCCGG CCGGGAGGGA GCCGAAAGCA TCGCCGCGGA GCTTGTGCTG ACGTCGGAGC
ACATGACGCT GCTGGAGCAA GACGACGAGT TCTGGGCGGC CGTTTCGCCC GACAGGCCTT
TTCCGCCGGC AGCGCTAGCC GCCCAGCCAA AGTCAGACAG ACACtga

(SEQ ID 54)

FIG. 3E

```
Seq_Id_No_20_maize_KO_gene_CDS         CCCTTGCTGGAGCGCTGGTCGTCGCCGGACGCCGGCGCCAACCACACGCCGCCGGT
Seq_Id_No_21_KO_anticipated_ch         CCCTTGCTGGAGCGCTGGTCGTCGCCGGACGCCGGCGCCAACCACACGCCGCCGGT
Seq_Id_No_18_rev_maize_KO_gRNA         ----TGCTGGAGCGCTGGTCGTCGCCC-----------------------------
Seq_Id_No_19_rev_maize_KO_gRNA         -------TGGAGCGCTGGTCGTCGCCC-----------------------------
                                              ********************
```

POLYNUCLEOTIDES AND POLYPEPTIDES OF PLANT AND BACTERIAL ORIGIN FOR PROTECTING PLANTS FROM PATHOGENIC FUNGI

FIELD OF THE INVENTION

The present invention relates to polynucleotides and polypeptides of plant and bacterial origin which are involved in enhancing resistance of plants towards pathogenic fungi and/or Oomycetes, particularly to fungi inducing root rot and stalk rot in plants, and use thereof for controlling plant diseases associated with the fungal pathogens and for producing genetically engineered plants having increased resistance to the pathogenic fungi.

BACKGROUND OF THE INVENTION

During all developmental stages, plants are exposed to an extremely wide range of biotic and abiotic stress conditions leading to plant diseases. In the production of crop plants, damages caused by biotic stresses, particularly by pathogenic agents, which may be further enhanced under conditions of abiotic stress, pose a major problem and significantly affect the crop yield and profitability.

Many plant diseases are caused by plant pathogenic fungi, and damages to both monocotyledonous and dicotyledonous crop plants are of billions of US$ loss in yield in the U.S. only. For example, stalk rot, caused by a complex of *Fusarium* spp. and other fungi is one of the most serious challenges in maize production. At present, the majority of both inbreed and hybrid maize lines are susceptible. *Fusarium graminearum* (Fg) and *Fusarium verticillioides* (Fv) are the two main causal agents of stalk rot caused by *Fusarium* spp. in maize, but more than 10 additional *Fusarium* spp. can cause stalk rot. Natural infection is initiated by a mixture of the local *Fusarium* spp., but typically during the progress of the disease one species predominates. Gibberella stalk rot (caused by *Fusarium graminearum* Schwabe) is more prevalent in maize grown in cool regions; while *Fusarium* stalk rot (caused by *Fusarium verticillioides*) is most common in dry, warm regions. *Fusarium graminearum* and other *Fusarium* species are also responsible for *Fusarium* head blight (FHB) of wheat, which is a major disease problem for wheat and barley production worldwide, and for various root rots in wide range of different hosts. *Colletotrichum* spp. infects many grain crops such as barley, wheat, sorghum and corn. *C. graminicola* is one of the other major pathogens causing mainly maize stalk rots and being capable of infecting many other parts of the corn plant. It has been suggested that *C. graminicola* behaves as a wilt fungus which efficiently colonizes and moves through the fiber cells that surround the vascular bundles and underlie the epidermal cells in the stalk rind. Movement through the mostly non-living fibers may allow the fungus to avoid host defenses, providing a base from which it can invade adjacent parenchyma cells.

Powdery mildews are fungal diseases caused by different species of fungi in the order Erysiphales that affect a wide range of plants including cereals, grasses, vegetables, ornamentals, weeds, shrubs, fruit trees, broad-leaved shade and forest trees.

Traditionally, plant diseases have been controlled by agronomic practices that include crop rotation, the use of agrochemicals, and conventional breeding techniques. The use of chemicals to control plant pathogens, while being effective, increases the production costs, and moreover, is opposed to by the public and government regulators due to the increased awareness to the harmful effects of such chemicals on the ecosystem and animal health.

Upon the plant recognition of an agent as a pathogen, an array of biochemical responses is activated by the plant. As of today, it is acknowledged that the initial plant response involves induction of several local responses in the cells immediately surrounding the infection site. In the hypersensitive response, cells contacted by the pathogen, and often neighboring cells, rapidly collapse and dry in a necrotic fleck. Other responses include the deposition of callose, the physical thickening of cell walls by lignification, and the synthesis of various antibiotic small molecules and proteins. Genetic factors in both the host and the pathogen determine the specificity of these local responses, which can be very effective in limiting spread of the infection.

Resistance to *Fusarium*, as an example, is a polygenic trait and can be seen as consisting of two major components: (1) resistance to initial penetration, and (2) resistance to the spreading of the pathogen in host tissue. Though there is no evidence of complete resistance to *Fusarium* stalk rot in maize, genetic variation for resistance exists within maize germplasm. Resistance to *C. graminicola* is also primarily quantitative, although a few sources of major gene resistance have been described.

The constantly growing volume of research regarding the mechanisms involved in plant resistance to pathogens and the genetic basis of such mechanism, together with advances in biotechnology have presented new opportunities for protecting plants against pathogen infection through genetic engineering.

Many genes have been identified to participate in the plant defense mechanisms. For example, Sanghyun S et al. (2008. J Exp Bot. 2008:59(9):2371-8) showed that transgenic wheat expressing a barley class II chitinase exhibited enhanced resistance against *F. graminearum* in greenhouse and field conditions. Zhu X et al. (2012. Funct Integr Genomics. 12(3):481-488) described that overexpression of wheat lipid transfer protein gene TaLTP5 increases resistances to *Cochliobolus sativus* and *Fusarium graminearum* in transgenic wheat. Perochon A et al. (2015. Plant Physiol 169(4):2895-2906) reported the functional characterization of an orphan gene (*Triticum aestivum* Fusarium Resistance Orphan Gene [TaFROG]) as a component of resistance to *Fusarium* head blight (FHB). Zuo D Y et al. (2016. Phytopatol. 106(6):614-623) showed that a deoxynivalenol-activated methionyl-tRNA synthetase gene from wheat encodes a nuclear localized protein and protects plants against *Fusarium* pathogens infection and mycotoxins. Dowd P F and Johnson E T (2016. J Plant Res. 129(1):13-20) showed that the maize peroxidase Px5, the pericarp expression of which has been shown to be associated with resistance to *Aspergillus flavus* growth and to insects in a set of inbred plant lines has a highly conserved sequence which enhances fungal and insect resistance.

Many defense response genes are induced in wheat and other plants during *F. graminearum* infection and may play a role in reducing FHB. These response genes were thus investigated in an attempt to produce resistant wheat lines. Mackintosh C A et al. (2007. Plant Cell Rep 26(4):479-488) examined overexpression of the defense response genes alpha-1-purothionin, thaumatin-like protein 1 (tlp-1), and beta-1,3-glucanase in wheat, and reported that all the genes reduced at least part of the disease symptoms. A beta-1,3-glucanase transgenic line had enhanced resistance, showing lower FHB severity, deoxynivalenol (DON) mycotoxin concentration, and percent of visually scabby kernels (VSK)

compared to a control plant. Sasaki K et al. (2016. J Biotechnol 228:3-7) also showed that overexpression of TAD1 (*Triticum aestivum* defensin 1), a protein induced during cold acclimation in winter wheat and encoding a plant defensin with antimicrobial activity, increased resistance against *Fusarium graminearum* in the transformed wheat plants.

Various additional genetic manipulation of gene expression for improving resistance to pathogenic fungi has also been reported. For example, Brewer H C et al. (2014. BMC Plant Biol 14(1):317) showed that mutations in the *Arabidopsis* homoserine kinase gene DMR1 confer enhanced resistance to *F. culmorum* and *F. graminearum*. Tundo S et al. (2016. Mol Plant Microbe Interact 29(8):629-639) produced transgenic plants with a combination of genes encoding proteins involved in inhibiting the activity of cell wall-degrading enzymes (CWDEs) secreted by pathogens to breach the plant cell-wall barrier. They showed that pyramiding polygalacturonase (PG) inhibiting protein (PGIP2) and TAXI-III, a xylanase inhibitor that controls the activity of xylanases, enhanced resistance against *Fusarium graminearum*, while pyramiding PGIP2 and pectin methyl esterase inhibitor (PMEI) did not reach the same effect. Li X et al. (2015. Mol Plant Microbe Interact 28(11):1237-1246) demonstrated that transgenic wheat expressing a barley UDP-glucosyltransferase detoxifies deoxynivalenol and provides high levels of resistance to *Fusarium graminearum*.

Among others, International Application Publication Nos. WO/2006/085965 and WO 2006/091219 disclose methods for protecting plants from plant pathogenic fungi by enhancing fungal pathogen resistance in a plant using the nucleotide sequences disclosed therein. Further disclosed therein are methods comprising introducing into a plant an expression cassette comprising a promoter operably linked to a nucleotide sequence that encodes an antifungal polypeptide as well as transformed plants, plant cells, seeds, and microorganisms comprising a nucleotide sequence that encodes an antifungal polypeptide or variant or fragment thereof.

U.S. Pat. No. 9,359,615 discloses plants which overexpress a p33 kD or BURP protein, or an ortholog thereof, and exhibit an increased pre-formed resistance to pathogens, particularly fungal pathogens.

U.S. Pat. No. 9,732,354 discloses new gene that is able to provide plants with resistance against pathogens, particularly *Verticillium*, *Ralstonia* or *Fusarium*. The gene is typical for Brassicaceae, but may confer resistance to other plants. Further provided are host cells with a nucleotide construct encoding the protein and methods for enhancing the pathogen resistance of plants.

International (PCT) Patent Application Publication No. WO 2018/131037 to the Applicant of the present invention discloses polynucleotides and polypeptides associated with increased resistance of plant to pathogenic fungi, particularly to fungi inducing root rot and stalk rot in plants, and use thereof for controlling plant fungal pathogens and for producing transgenic plants having increased resistance to pathogenic fungi.

Intact microorganisms, particularly bacteria, which can survive on or be toxic to fungi, have been used as biocontrol agents. For example, U.S. Pat. No. 9,485,994 discloses methods and compositions for control of pathogenic fungal or Oomycetous infection. Particularly, the patent discloses an antifungal or an anti-Oomycetous composition comprising bacteria of the genus *Collimonas* and bacteria of the genus *Bacillus*, together exhibiting a synergistic antifungal or a synergistic anti-Oomycetous effect, and methods of use thereof. However, it is difficult both to apply biological organisms to large areas and to cause such living organisms to remain in the treated area or on the treated plant species for an extended time, and therefore use of intact bacteria as biocontrol agents is still limited.

Therefore, attempts were made to identify bacterial proteins and genes encoding same responsible for the biocontrol activity. Targets, mechanism of action and prospective applications of anti-fungal proteins of various organisms, including bacteria are reviewed, for example, by Theis and Stahl (Theis T and Stahl U. 2004 CMLS, Cell. Mol. Life Sci. 61:437-455). Proteomic approach taken to investigate *Bacillus* strains having anti-fungal activity revealed the presence of lytic enzymes, cellulases, proteases, 1,4-β-glucanases and hydrolases, all of which contribute to degradation of the pathogen cell wall. Further proteomic investigations showed that proteins involved in metabolism, protein folding, protein degradation, translation, recognition and signal transduction cascade play an important role in the control of *Fusarium oxysporum* (Baysal O. et al., 2013. Plose One 8(1):e53182). Li et al., (Li Jing et al., J Zhejiang Univ Sci B 10(4):264-272) describe the purification of a particular antifungal protein from *Bacillus subtilis*, designated B29I, which exhibited inhibitory activity on mycelial growth of *Fusarium oxysporum*, *Rhizoctonia solani*, *Fusarium moniliforme*, and *Sclerotinia sclerotiorum*. Yadav et al. (Yadav V et al., 2010. Intl J Microbiol, Article ID 196363, doi: 10.1155/2010/196363) described the isolation of an antifungal protein from *Escherichia coli* BL21 (PPEBL21), predicted to be alcohol dehydrogenase (ADH). Additional example of enzymes having a significant role in the antifungal activity of bacteria includes chitinases (see, e.g. Hjort K et al., 2013. Appl Microbiol Biotechnol DOI 10.1007/s00253-013-5287-x).

Song et al. (Song C et al., 2015. BMC Genomics 16:1103) explored the genomic traits of the fungus-feeding bacterial genus *Collimonas*, and Haack et al. (Haack F S et al., 2016. Frontiers in Microbiology 7 Article 1668) investigated the molecular keys of the interactions of *Janthinobacterium* and *Duganella* species with the plant pathogenic fungi *Fusarium graminearum*.

However, as of today, there is a need for further developed methods and compositions for protecting plants from fungal pathogen.

SUMMARY OF THE INVENTION

The present invention provides isolated polynucleotides, constructs comprising same and isolated polypeptides useful in conferring and/or enhancing resistance of a plant towards pathogenic fungi and/or Oomycetes. The present invention further provides genetically altered plants and plant cells with enhanced resistance to pathogenic fungi and/or Oomycetes and methods for producing and selecting same as well as compositions comprising the polypeptides of the invention useful in protecting plants from the pathogenic fungi and/or Oomycetes.

According to one aspect, the present invention provides a method for enhancing the resistance of a plant or a part thereof to at least one pathogenic fungus and/or Oomycete, comprising modulating the expression and/or activity of at least one polypeptide at least 80% identical to a polypeptide having an amino acid sequence selected from the group consisting of SEQ ID NOs:326, 360, 308-325, 327-359, 361-506 within at least one cell of the plant or part thereof, thereby enhancing the resistance of said plant or part thereof to the at least one pathogenic fungus and/or Oomycete compared to the resistance of a control plant. Each possibility represents a separate embodiment of the present invention.

According to certain embodiments, the method comprises modulating the expression and/or activity of at least one polypeptide having the amino acid sequence selected from the group consisting of SEQ ID NOs:326, 360, 308-325, 327-359, 361-508. Each possibility represents a separate embodiment of the present invention.

According to certain embodiments, the at least one polypeptide is encoded by a polynucleotide comprising a nucleic acid sequence at least 80% identical to a nucleic acid sequence selected from the group consisting of SEQ ID NOs:40, 80, 22-39, 41-79, 81-301. Each possibility represents a separate embodiment of the present invention.

According to other embodiments, the at least one polypeptide is encoded by a polynucleotide comprising the nucleic acid sequence set forth in any one of SEQ ID NOs:40, 80, 22-39, 41-79, 81-305. Each possibility represents a separate embodiment of the present invention.

According to certain embodiments, enhancing the resistance of the plant or part thereof to the pathogenic fungus and/or Oomycete comprises enhancing the expression and/or activity of at least one polypeptide compared to its expression and/or activity in the control plant.

According to certain exemplary embodiments, the polypeptide the expression and/or activity of which is to be enhanced comprises an amino acid sequence at least 80% identical to a polypeptide having an amino acid sequence selected from the group consisting of SEQ ID NOs:326, 360, 308-325, 327, 329-347, 349-359, 362-506. Each possibility represents a separate embodiment of the present invention. According to some embodiments, the polypeptide the expression and/or activity of which is to be enhanced comprises an amino acid sequence selected from the group consisting of SEQ ID NOs:326, 360, 308-325, 327, 329-347, 349-359, 362-508. Each possibility represents a separate embodiment of the present invention.

According to certain embodiments, the polypeptide the expression and/or activity of which is to be enhanced is an endogenous polypeptide of the at least one cell. According to other embodiments, the polypeptide the expression and/or activity of which is to be enhanced is a polypeptide heterologous to the at least one plant cell. According to certain embodiments, enhancing the expression and/or activity of the polypeptide comprises modulating the expression of an endogenous polynucleotide encoding said polypeptide within the at least one cell of the plant or part thereof.

Modulating, according to certain embodiments enhancing, the expression of the endogenous polynucleotide can be affected at the genomic and/or the transcript level using a variety of methods that induce the transcription and/or translation of the polypeptide.

According to certain embodiments, enhancing the expression and/or activity of the endogenous polypeptide comprises subjecting the at least one cell of the plant or part thereof to genome editing using artificially engineered nucleases as is known in the art.

According to certain embodiments, isolated nucleic acids which serve as promoter or enhancer elements may be introduced in an appropriate position as to enhance transcription of the endogenous polynucleotide. According to some embodiments, the regulatory element is selected from the group consisting of, but not limited to, a promoter and an enhancer.

According to certain embodiments, the polypeptide the expression of which is to be enhanced is encoded by a polynucleotide at least 80% identical to a nucleic acid sequence selected from the group consisting of SEQ ID NOs:40, 80, 22-39, 41, 43-61, 63-79, 81, 83-301. According to some embodiments, the polypeptide the expression of which is to be enhanced is encoded by a polynucleotide comprising a nucleic acid sequence selected from the group consisting of SEQ ID NOs:40, 80, 22-39, 41, 43-61, 63-79, 81, 83-305.

According to other embodiments, at least one mutation may be inserted within the endogenous polynucleotide as long as the mutation results in enhanced expression of the encoded polypeptide. Any method for mutagenesis as is known in the art can be used according to the teachings of the present invention including chemical mutagenesis, radio-mutagenesis and site directed mutagenesis, for example using genome editing techniques.

According to certain embodiments, enhancing the resistance of the plant to the pathogenic fungus and/or Oomycete comprises reducing the expression of at least one polypeptide compared to its expression and/or activity in the control plant. According to certain exemplary embodiments, the polypeptide the expression and/or activity of which is to be reduced comprises an amino acid sequence at least 80% identical to the amino acid sequence set forth in any one of SEQ ID NO:328, SEQ ID NO:361, and SEQ ID NO:348. According to further exemplary embodiments, the polypeptide the expression and/or activity of which is to be reduced comprises the amino acid sequence set forth in any one of SEQ ID NO:328, SEQ ID NO:361 and SEQ ID NO:348.

According to certain embodiments, enhancing the resistance of the plant to the pathogenic fungus and/or Oomycete comprises reducing the expression and/or activity of at least one polynucleotide compared to its expression in the control plant. According to certain exemplary embodiments, the polynucleotide having reduced expression comprises a nucleic acid sequence at least 80% identical to the nucleic acid sequence set forth in any one of SEQ ID NO:42, SEQ ID NO:82, and SEQ ID NO:62. According to certain exemplary embodiments, the polynucleotide having reduced expression comprises the nucleic acid sequence set forth in any one of SEQ ID NO:42, SEQ ID NO:82 and SEQ ID NO:62.

Any method as is known in the art for reducing the expression and/or activity of a plant endogenous protein and the polynucleotide encoding same can be used according to the teachings of the resent invention.

According to certain embodiments, reducing the expression and/or activity of the polypeptide comprises down-regulating the expression of the endogenous polynucleotide encoding said polypeptide within the at least one cell of the plant or part thereof.

According to certain embodiments, reducing the expression and/or activity of the polypeptide comprises modulating the endogenous polynucleotide as to encode a non-functional polypeptide.

According to certain embodiments, expression of the polynucleotide is affected at the genomic and/or the transcript level using a variety of molecules that interfere with transcription and/or translation (e.g., antisense, siRNA, Ribozyme, or DNAzyme) of the polynucleotide. Inserting a mutation into the polynucleotide, including deletions, insertions, site specific mutations, mutations mediated by artificially engineered nucleases (including zinc-finger nucleases (ZFNs), transcription-activator like effector nucleases (TALENs) and CRISPR/Cas system) can be also used, as long as the mutations result in down-regulation of the gene expression or in the production of non-functional protein. Alternatively, expression can be inhibited at the protein level using, e.g., antagonists, enzymes that cleave the polypeptide, and the like.

According to additional aspect, the present invention provides a method for enhancing the resistance of a plant or a part thereof to at least one pathogenic fungus and/or Oomycete, comprising enhancing the expression and/or activity of at least one polypeptide at least 70% identical to a polypeptide having an amino acid sequence selected from the group consisting of SEQ ID NOs:2635, 2444-2634, 2636-4252, an active fragment and/or a variant thereof within at least one cell of the plant or part thereof, thereby enhancing the resistance of said plant or part thereof to the at least one pathogenic fungus and/or Oomycete compared to the resistance of a control plant. Each possibility represents a separate embodiment of the present invention.

According to certain embodiments, the method comprises enhancing the expression and/or activity of at least one polypeptide having the amino acid sequence selected from the group consisting of SEQ ID NOs:2635, 2444-2634, 2636-4252, an active fragment and/or a variant thereof. Each possibility represents a separate embodiment of the present invention.

According to the certain exemplary embodiments, the fragment comprises an amino acid sequence selected from the group consisting of SEQ ID NOs:4661, 4647-4660, and 4662-4799.

According to certain embodiments, the at least one polypeptide is encoded by a polynucleotide comprising a nucleic acid sequence at least 70% identical to a nucleic acid sequence selected from the group consisting of SEQ ID NOs:783, 592-782, 784-2443, a fragment and/or a variant thereof. Each possibility represents a separate embodiment of the present invention.

According to other embodiments, the at least one polypeptide is encoded by a polynucleotide comprising the nucleic acid sequence set forth in any one of SEQ ID NOs:783, 592-782, 784-2443, a fragment and/or a variant thereof. Each possibility represents a separate embodiment of the present invention.

Enhancing the polypeptide expression can be affected at the genomic and/or the transcript and/or translation level using a variety of methods that induce the transcription and/or translation of the polypeptide.

According to certain embodiments, enhancing the expression and/or activity of the polypeptide comprises expressing an exogenous polynucleotide encoding said at least one polypeptide within the at least one cell of the plant or the part thereof.

According to certain embodiments, enhancing the expression and/or activity of the polypeptide comprises transforming at least one cell of the plant or part thereof with an exogenous polynucleotide encoding the polypeptide, thereby producing a transgenic plant over-expressing said polypeptide.

Any method as is known in the art for introducing an exogenous polynucleotide into a plant cell can be used according to the teachings of the present invention. According to some embodiments, the exogenous polynucleotide is transformed into the plant cell using a suitable vector.

According to certain embodiments, genome editing is employed to edit the genome of the at least one cell as to express a heterologous polypeptide of the invention.

According to certain exemplary embodiments, the polynucleotide the expression of which is to be enhanced comprises a nucleic acid sequence at least 80% identical to a nucleic acid sequence selected from the group consisting of SEQ ID NOs:40, 80, 22-39, 41, 43-61, 63-79, 81, and 83-301. Each possibility represents a separate embodiment of the present invention. According to some embodiments, the polynucleotide the expression of which is to be enhanced comprises a nucleic acid sequence selected from the group consisting of SEQ ID NOs:40, 80, 22-39, 41, 43-61, 63-79, 81, and 83-305.

According to further exemplary embodiments, the polynucleotide the expression of which is to be enhanced comprises a nucleic acid sequence at least 70% identical to a nucleic acid sequence selected from the group consisting of SEQ ID NOs:783, 592-782, 784-2443 and a fragment thereof. According to some embodiments, the polynucleotide the expression of which is to be enhanced comprises a nucleic acid sequence selected from the group consisting of SEQ ID NOs:783, 592-782, 784-2443 and a fragment thereof.

Gene stacking is often desirable in the field of plant genetic engineering, leading to a desired phenotype and/or improvement of a desired phenotype. According to certain aspects, the present invention provides a method for enhancing the resistance of a plant or a part thereof to at least one pathogenic fungus and/or Oomycete, comprising transforming at least one cell of the plant or part thereof with at least one DNA construct comprising nucleic acid sequence encoding at least two polypeptides, wherein each polypeptide is capable of enhancing resistance to the at least one pathogenic fungus and/or Oomycete, thereby enhancing the resistance of said plant or part thereof to said at least one pathogenic fungus and/or Oomycete compared to the resistance of a control plant. According to certain embodiments, the present invention provides a method for enhancing the resistance of a plant or a part thereof to at least one pathogenic fungus and/or Oomycete, comprising transforming at least one cell of a plant or a part thereof with a DNA construct comprising a first polynucleotide encoding a polypeptide having the amino acid sequence set forth in SEQ ID NO:311 and a second polynucleotide encoding a polypeptide designated LFS57 having the amino acid sequence set forth in SEQ ID NO:617 of International Application Publication No. WO 2018/131037, thereby enhancing the resistance of said plant or part thereof to the at least one pathogenic fungus and/or Oomycete compared to the resistance of a control plant.

According to certain embodiments, the first polynucleotide comprises the nucleic acid sequence set forth in SEQ ID NO:66 and the second polynucleotide comprises the nucleic acid sequence set forth in any one of SEQ ID NO:101 and SEQ ID NO:165 of WO 2018/131037.

According to certain embodiments, the present invention provides a method for enhancing the resistance of a plant or a part thereof to at least one pathogenic fungus and/or Oomycete, comprising transforming at least one cell of a plant or a part thereof with a DNA construct comprising a first polynucleotide encoding a polypeptide having the amino acid sequence set forth in SEQ ID NO:310 and a second polynucleotide encoding a polypeptide designated LFS46 having the amino acid sequence set forth in SEQ ID NO:608 of International Application publication No. WO 2018/131037, thereby enhancing the resistance of said plant or part thereof to the at least one pathogenic fungus and/or Oomycete compared to the resistance of a control plant.

According to certain embodiments, the first polynucleotide comprises the nucleic acid sequence set forth in SEQ ID NO:65 and the second polynucleotide comprises the nucleic acid sequence set forth in any one of SEQ ID NO:92 and SEQ ID NO:157 of WO 2018/131037.

According to some embodiments, the control plant is a plant not manipulated to have modulated expression and/or activity of the polypeptide. According to some embodiments, the control plant is of the same species. According to some embodiments, the control plant comprises the same genetic background.

According to another aspect, the present invention provides a method for producing a population of plants each having an enhanced resistance to at least one pathogenic fungus and/or Oomycete, comprising the steps of:
(a) modulating the expression and/or activity of at least one polypeptide at least 80% identical to a polypeptide having an amino acid sequence selected from the group consisting of SEQ ID NOs:326, 360, 308-325, 327-359, and 361-506 within at least one cell of each plant of a plant population as to produce a genetically engineered plant population;
(b) inoculating each plant of the genetically engineered plant population with the at least one pathogenic fungus and/or Oomycete; and
(c) selecting plants showing an enhanced resistance to said at least one pathogenic fungus and/or Oomycete compared to a control plant or to a pre-determined resistance score value;
thereby producing a population of genetically engineered plants having enhanced resistance to said at least one pathogenic fungus and/or Oomycete.

According to certain embodiments, the method comprises modulating the expression and/or activity of at least one polypeptide having the amino acid sequence set forth in any one of SEQ ID NOs:326, 360, 308-325, 327-359, 361-508. According to certain embodiments, the method comprises modulating the expression and/or activity of at least one polypeptide having the amino acid sequence set forth in any one of SEQ ID NOs:507-508. According to certain embodiments, the method comprises modulating the expression and/or activity of at least one polypeptide having the amino acid sequence set forth in any one of SEQ ID NOs:507-509. According to other embodiments, the method comprises modulating the expression and/or activity of at least one polypeptide having the amino acid sequence set forth in SEQ ID NO:509. Each possibility represents a separate embodiment of the present invention.

According to certain embodiments, the method comprises enhancing the expression and/or activity of the at least one polypeptide. According to these embodiments, the method comprises enhancing the expression and/or activity of at least one polypeptide at least 80% identical to a polypeptide having an amino acid sequence selected from the group consisting of SEQ ID NOs:326, 360, 308-325, 327, 329-347, 349-359, 362-506. According to some embodiments, the method comprises enhancing the expression and/or activity of at least one polypeptide having an amino acid sequence selected from the group consisting of SEQ ID NOs:326, 360, 308-325, 327, 329-347, 349-359, 362-509. Each possibility represents a separate embodiment of the present invention.

According to certain embodiments, the method comprises reducing the expression and/or activity of the at least one polypeptide. According to these embodiments, the method comprises reducing the expression and/or activity of at least one polypeptide at least 80% identical to a polypeptide having an amino acid sequence selected from the group consisting of SEQ ID NO:328, SEQ ID NO:361 and SEQ ID NO:348. According to some embodiments, the method comprises reducing the expression and/or activity of at least one polypeptide having an amino acid sequence selected from the group consisting of SEQ ID NO:328, SEQ ID NO:361 and SEQ ID NO:348.

According to yet another aspect, the present invention provides a method for producing a population of plants each having an enhanced resistance to at least one pathogenic fungus and/or Oomycete, comprising the steps of:
(a) enhancing the expression and/or activity of at least one polypeptide at least 70% identical to a polypeptide having an amino acid sequence selected from the group consisting of SEQ ID NOs:2635, 2444-2634, 2636-4252, an active fragment and/or variant thereof within at least one cell of each plant of a plant population as to produce a genetically engineered plant population;
(b) inoculating each plant of the genetically engineered plant population with the at least one pathogenic fungus and/or Oomycete; and
(c) selecting plants showing an enhanced resistance to said at least one pathogenic fungus and/or Oomycete compared to a control plant or to a pre-determined resistance score value;
thereby producing a population of genetically engineered plants having enhanced resistance to said at least one pathogenic fungus and/or Oomycete.

According to certain embodiments, the method comprises modulating the expression and/or activity of at least one polypeptide having the amino acid sequence set forth in any one of SEQ ID NOs:2635, 2444-2634, 2636-4252, an active fragment and/or a variant thereof.

According to the certain exemplary embodiments, the polypeptide fragment comprises an amino acid sequence selected from the group consisting of SEQ ID NOs:4661, 4647-4660, and 4662-4799. The methods by which the expression and/or activity of the at least polypeptide can be enhanced or reduced are as is known in the art and as described hereinabove.

According to certain embodiments, the method comprises modulating the expression of at least one polynucleotide comprising a nucleic acid sequence at least 80% identical to a nucleic acid sequence selected from the group consisting of SEQ ID NOs:40, 80, 22-39, 41-79, 81-301. According to some embodiments, the method comprises modulating the expression of at least one polynucleotide comprising a nucleic acid sequence selected from the group consisting of SEQ ID NOs:40, 80, 22-39, 41-79, and 81-305. According to some embodiments, the method comprises modulating the expression of at least one polynucleotide comprising a nucleic acid sequence selected from the group consisting of SEQ ID NOs:304-305. According to some embodiments, the method comprises modulating the expression of at least one polynucleotide comprising a nucleic acid sequence selected from the group consisting of SEQ ID NOs:304-306. According to some embodiments, the method comprises modulating the expression of at least one polynucleotide comprising a nucleic acid sequence set forth in SEQ ID NO:306. Each possibility represents a separate embodiment of the present invention. According to some embodiments, modulating the expression of the at least one polynucleotide comprises enhancing its expression. According to these embodiments, the polynucleotide is at least 80% identical to a polynucleotide having the nucleic acid sequence selected from the group consisting of 40, 80, 22-39, 41, 43-61, 63-79, 81, and 83-301. According to some embodiments, the polynucleotide comprises the nucleic acid sequence selected from the group consisting of SEQ ID NOs:40, 80, 22-39, 41, 43-61, 63-79, 81, and 83-306. Each possibility represents a separate embodiment of the present invention.

According to certain embodiments, enhancing the expression comprises transforming the at least one cell of the plant or part thereof with a polynucleotide at least 80% identical to a polynucleotide having an amino acid sequence selected from the group consisting of SEQ ID NOs:40, 80, 22-39, 41-79, 81, and 83-301. According to certain embodiments, enhancing the expression comprises transforming the at least one cell of the plant or part thereof with a polynucleotide comprising a nucleic acid sequence selected from the group consisting of SEQ ID NOs:40, 80, 22-39, 41-79, 81, and 83-306.

According to some embodiments, modulating the expression of the at least one polynucleotide comprises reducing its expression. According to these embodiments, the polynucleotide is at least 80% identical to a polynucleotide having the nucleic acid sequence selected from the group consisting of SEQ ID NO:42, SEQ ID NO:82 and SEQ ID NO:62. According to some embodiments, the polynucleotide comprises the nucleic acid sequence selected from the group consisting of SEQ ID NO:42, SEQ ID NO:82 and SEQ ID NO:62.

According to certain embodiments, the method comprises enhancing the expression of at least one polynucleotide comprising a nucleic acid sequence at least 70% identical to a nucleic acid sequence selected from the group consisting of SEQ ID NOs:783, 592-782, 784-2443, a variant and/or a fragment thereof. According to some embodiments, the method comprises enhancing the expression of at least one polynucleotide comprising a nucleic acid sequence selected from the group consisting of SEQ ID NOs:783, 592-782, 784-2443, a variant and/or a fragment thereof.

The methods by which the expression of the at least one polynucleotide can be enhanced or reduced are as is known in the art and as described hereinabove.

According to additional aspect, the present invention provides a method for selecting a plant having an enhanced resistance to at least one pathogenic fungus and/or Oomycete, comprising the steps of:
  (a) providing a plurality of plants each comprising at least one cell with modulated expression and/or activity of a polypeptide at least 80% identical to a polypeptide having an amino acid sequence selected from the group consisting of SEQ ID NOs:326, 360, 308-325, 327-359, 361-506.
  (b) inoculating the plurality of plants with the at least one pathogenic fungus and/or Oomycete; and
  (c) selecting plants showing an enhanced resistance to said at least one pathogenic fungus and/or Oomycete compared to a control plant or to a pre-determined resistance score value.

According to certain embodiments, the method comprises providing a plurality of plants each having a modulated expression and/or activity of at least one polypeptide having the amino acid sequence set forth in any one of SEQ ID NOs:326, 360, 308-325, 327-359, 361-508. Each possibility represents a separate embodiment of the present invention. According to other embodiments, the method comprises providing a plurality of plants each having a modulated expression and/or activity of a polypeptide having the amino acid sequence set forth in any one of SEQ ID NOs:507-509. Each possibility represents a separate embodiment of the present invention. According to some embodiments, the method comprises providing a plurality of plants each having a modulated expression and/or activity of a polypeptide having the amino acid sequence set forth in SEQ ID NO:509.

According to certain embodiments, the method comprises providing a plurality of plants each having modulated expression of at least one polynucleotide comprising a nucleic acid sequence at least 80% identical to a polynucleotide having the nucleic acid sequence set forth in any one of SEQ ID NOs:40, 80, 22-39, 41-79, 81-301. According to some embodiments, the at least one polynucleotide comprises a nucleic acid sequence selected from the group consisting of SEQ ID NOs:40, 80, 22-39, 41-79, 81-305. Each possibility represents a separate embodiment of the present invention. According to some embodiments, the at least one polynucleotide comprises a nucleic acid sequence set forth in SEQ ID NO:306.

According to certain embodiments, the modulated expression and/or activity is selected from enhanced expression and/or activity and reduced expression and/or activity. Modulating the expression can be performed by any method as is known in the art and as described hereinabove. The polypeptides and polynucleotides the expression of which is to be enhanced or reduced are as described hereinabove.

According to yet further aspect, the present invention provides a method for selecting a plant having an enhanced resistance to at least one pathogenic fungus and/or Oomycete, comprising the steps of:
  (a) providing a plurality of plants each comprising at least one cell with enhanced expression and/or activity of a polypeptide at least 70% identical to a polypeptide having an amino acid sequence selected from the group consisting of SEQ ID NOs:2635, 2444-2634, 2636-4252, an active fragment and/or a variant thereof;
  (b) inoculating the plurality of plants with the at least one pathogenic fungus and/or Oomycete; and
  (c) selecting plants showing an enhanced resistance to said at least one pathogenic fungus and/or Oomycete compared to a control plant or to a pre-determined resistance score value.

According to certain embodiments, the method comprises providing a plurality of plants each having an enhanced expression and/or activity of at least one polypeptide having the amino acid sequence set forth in any one of SEQ ID NOs:2635, 2444-2634, 2636-4252, an active fragment and/or a variant thereof. Each possibility represents a separate embodiment of the present invention.

According to the certain exemplary embodiments, the fragment comprises an amino acid sequence selected from the group consisting of SEQ ID NOs:4661, 4647-4660, and 4662-4799. Each possibility represents a separate embodiment of the present invention.

According to certain embodiments, the method comprises providing a plurality of plants each having enhanced expression of at least one polynucleotide comprising a nucleic acid sequence at least 70% identical to a polynucleotide having the nucleic acid sequence set forth in any one of SEQ ID NOs:783, 592-782, 784-2443. According to some embodiments, the at least one polynucleotide comprises a nucleic acid sequence selected from the group consisting of SEQ ID NOs:4783, 592-782, 784-2443.

According to certain embodiments, the control plant is a plant not manipulated to have modulated expression and/or activity of the polypeptide. According to some embodiments, the control plant is of the same species. According to some embodiments, the control plant comprises the same genetic background.

According to certain embodiments, the pre-determined resistance score value is obtained by a method comprising the steps of inoculating a plurality of corresponding plants susceptible to the at least one pathogenic fungus or Oomycete; scoring the infection degree; and setting an average resistance score value.

Modulating (enhancing or reducing) the expression and/or activity of the polypeptide can be achieved as described hereinabove and by any other method as is known in the art.

According to certain embodiments, the plant part is selected from the group consisting of seeds, roots, shoots, leaves, flowers and the like. Each possibility represents separate embodiment of the present invention. According to certain exemplary embodiments, the plant part is a root. Tissue cultures comprising cells derived from the plant having a modulated expression and/or activity of a polypeptide of the invention are also encompassed within the scope of the present invention.

According to additional aspect, the present invention provides a genetically engineered plant having enhanced resistance to at least one fungus and/or Oomycete compared to a non-engineered control plant, the genetically engineered plant comprising at least one cell having modified expression and/or activity of at least one polypeptide at least 80% identical to a polypeptide having an amino acid sequence selected from the group consisting of SEQ ID NOs:326, 360, 308-325, 327-359, 361-506 compared to the polypeptide expression and/or activity in the non-engineered control plant. Each possibility represents a separate embodiment of the present invention.

According to certain embodiments, the genetically engineered plant comprises at least one cell having enhanced expression and/or activity of at least one polypeptide at least 80% identical to a polypeptide having an amino acid sequence selected from the group consisting of SEQ ID NOs:326, 360, 308-325, 327, 329-347, 349-359, 362-506.

According to certain embodiments, the genetically engineered plant comprises at least one cell having reduced expression and/or activity of at least one polypeptide at least 80% identical to a polypeptide having an amino acid sequence selected from the group consisting of SEQ ID NOs:328, 361 and 348.

According to additional aspect, the present invention provides a genetically engineered plant having enhanced resistance to at least one fungus and/or Oomycete compared to a non-engineered control plant, the genetically engineered plant comprising at least one cell having enhanced expression and/or activity of at least one polypeptide at least 70% identical to a polypeptide having an amino acid sequence selected from the group consisting of SEQ ID NOs:2635, 2444-2634, 2636-4252, an active fragment or a variant thereof compared to the polypeptide expression and/or activity in the non-engineered control plant. Each possibility represents a separate embodiment of the present invention.

According to certain embodiments, the genetically engineered plant comprises at least one cell having modified expression and/or activity of at least one polypeptide having the amino acid sequence selected from the group consisting of SEQ ID NOs:326, 360, 308-325, 327-359, 361-508. Each possibility represents a separate embodiment of the present invention. According to certain embodiments, the genetically engineered plant comprises at least one cell having modified expression and/or activity of at least one polypeptide having the amino acid sequence selected from the group consisting of SEQ ID NOs:507-508. Each possibility represents a separate embodiment of the present invention.

According to certain embodiments, the genetically engineered plant comprises at least one cell having enhanced expression and/or activity of at least one polypeptide having an amino acid sequence selected from the group consisting of SEQ ID NOs:326, 360, 308-325, 327, 329-347, 349-359, 362-508. Each possibility represents a separate embodiment of the present invention.

According to certain embodiments, the genetically engineered plant comprises at least one cell having reduced expression and/or activity of at least one polypeptide having an amino acid sequence selected from the group consisting of SEQ ID NOs:328, 361, and 348. Each possibility represents a separate embodiment of the present invention.

According to certain embodiments, the genetically engineered plant comprises at least one cell having enhanced expression and/or activity of at least one polypeptide having the amino acid sequence selected from the group consisting of SEQ ID NOs:2635, 2444-2634, 2636-4252, an active fragment and/or a variant thereof. Each possibility represents a separate embodiment of the present invention.

According to certain embodiments, the genetically engineered plant comprises at least one cell having modified expression of at least one polynucleotide comprising a nucleic acid sequence at least 80% identical to a polynucleotide having the nucleic acid sequence set forth in any one of SEQ ID NOs:40, 80, 22-39, 41-79, 81-301. According to some embodiments, the at least one polynucleotide comprises a nucleic acid sequence selected from the group consisting of SEQ ID NOs:40, 80, 22-39, 41-79, 81-305. According to some embodiments, the at least one polynucleotide comprises a nucleic acid sequence selected from the group consisting of SEQ ID NOs:302-305. Each possibility represents a separate embodiment of the present invention.

According to certain embodiments, the genetically engineered plant comprises at least one cell having enhanced expression of at least one polynucleotide comprising a nucleic acid sequence at least 80% identical to a polynucleotide having the nucleic acid sequence set forth in any one of SEQ ID NOs: 40, 80, 22-39, 41, 43-61, 63-79, 81, and 83-301. Each possibility represents a separate embodiment of the present invention.

According to certain embodiments, the genetically engineered plant comprises at least one cell having reduced expression of at least one polynucleotide comprising a nucleic acid sequence at least 80% identical to a polynucleotide having the nucleic acid sequence set forth in any one of SEQ ID NOs:42, 82 and 62. Each possibility represents a separate embodiment of the present invention.

According to certain embodiments, the genetically engineered plant comprises at least one cell having enhanced expression of at least one polynucleotide comprising a nucleic acid sequence at least 70% identical to a polynucleotide having the nucleic acid sequence set forth in any one of SEQ ID NOs:783, 592-782, 784-2443. According to some embodiments, the at least one polynucleotide comprises a nucleic acid sequence selected from the group consisting of SEQ ID NOs:783, 592-782, 784-2443. Each possibility represents a separate embodiment of the present invention.

According to certain embodiments, the genetically engineered plant comprises a polynucleotide encoding a modified form of the at least one polypeptide, wherein the modified form has reduced or no activity compared to the unmodified form, thereby having an enhanced resistance to the at least one fungus.

According to additional aspect, the present invention provides an isolated or recombinant polynucleotide encoding a polypeptide comprising an amino acid sequence at least 80% identical to an amino acid sequence selected from the group consisting of SEQ ID NOs:326, 360, 308-325, 327-359, and 362-506, wherein the polypeptide, when expressed in a plant, is capable of modulating the resistance of the plant to at least one pathogenic fungus and/or Oomycete. According to certain embodiments, the polynucleotide encodes a polypeptide comprising the amino acid sequence set forth in any one of SEQ ID NOs:326, 360, 308-325, 327-359, 362-506. According to certain embodiments, the polynucleotide encodes a polypeptide comprising the amino acid sequence set forth in any one of SEQ ID NOs:507-508. Each possibility represents a separate embodiment of the present invention.

According to certain embodiments, the polypeptide, when expressed in a plant, is capable of enhancing the resistance of the plant to at least one pathogenic fungus and/or Oomycete, said polypeptide is at least 80% identical to a polypeptide having an amino acid sequence selected from the group consisting of SEQ ID NOs:326, 360, 308-325, 327, 329-347, 349-359, and 362-506. According to certain embodiments, said polypeptide comprises an amino acid sequence selected from the group consisting of SEQ ID NOs:326, 360, 308-325, 327, 329-347, 349-359, and 362-508. Each possibility represents a separate embodiment of the present invention.

According to certain embodiments, the polynucleotide encoding a polypeptide capable of modulating the resistance of the plant to at least one pathogenic fungus and/or Oomycete when expressed in said plant comprises a nucleic acid sequence at least 80% identical to a nucleic acids sequence set forth in any one of SEQ ID NOs:40, 80, 22-39, 41-79, 81-301. According to other embodiments, the polynucleotide comprises the nucleic acid sequence set forth in any one of SEQ ID NOs:40, 80, 22-39, 41-79, 81-301. According to yet further embodiments, the polynucleotide comprises the nucleic acid sequence set forth in any one of SEQ ID NOs:302-305.

According to certain embodiments, the polynucleotide encoding a polypeptide capable of enhancing the resistance of the plant to at least one pathogenic fungus and/or Oomycete when expressed in said plant comprises a nucleic acid sequence at least 80% identical to a nucleic acids sequence set forth in any one of SEQ ID NOs: 40, 80, 22-39, 41, 43-61, 63-79, 81, and 83-301. According to other embodiments, the polynucleotide comprises the nucleic acid sequence set forth in any one of SEQ ID NOs: 40, 80, 22-39, 41, 43-61, 63-79, 81, and 83-301. According to yet further embodiments, the polynucleotide comprises the nucleic acid sequence set forth in any one of SEQ ID NOs:302-305.

According to yet additional aspect, the present invention provides an isolated or recombinant polynucleotide encoding a polypeptide comprising an amino acid sequence at least 70% identical to an amino acid sequence selected from the group consisting of SEQ ID NOs:2635, 2444-2634, 2636-4252, wherein the polypeptide, when expressed in a plant, is capable of enhancing the resistance of the plant to at least one pathogenic fungus and/or Oomycete. According to certain embodiments, the polynucleotide encodes a polypeptide comprising the amino acid sequence set forth in any one of SEQ ID NOs:2635, 2444-2634, 2636-4252.

According to yet another aspect, the present invention provides an isolated or recombinant polynucleotide, a fragment or a variant thereof, the polynucleotide comprising a nucleic acid sequence at least 80% identical to a nucleic acids sequence selected from the group consisting of SEQ ID NOs:40, 80, 22-39, 41, 43-61, 63-79, 81, and 83-301, wherein said polynucleotide, when expressed in a plant, is capable of enhancing the resistance of the plant to at least one pathogenic fungus and/or Oomycete. According to certain embodiments, the polynucleotide comprises the nucleic acid sequence set forth in any one if SEQ ID NOs:40, 80, 22-39, 41, 43-61, 63-79, 81, and 83-305.

According to yet further aspect, the present invention provides an isolated or recombinant polynucleotide, a fragment or a variant thereof, the polynucleotide comprising a nucleic acid sequence at least 70% identical to a nucleic acids sequence selected from the group consisting of SEQ ID NOs:783, 592-782, 784-2443, wherein said polynucleotide, when expressed in a plant, is capable of enhancing the resistance of the plant to at least one pathogenic fungus and/or Oomycete. According to certain embodiments, the polynucleotide comprises the nucleic acid sequence set forth in any one if SEQ ID NOs:783, 592-782, 784-2443.

According to additional aspect, the present invention provides a recombinant polynucleotide optimized for polypeptide expression in a bacterial expression system, wherein the polypeptide is capable of inhibiting the growth of at least one pathogenic fungus and/or Oomycete.

According to certain exemplary embodiment the bacterium is Escherichia coli. According to these embodiments, the polypeptide comprises an amino acid sequence selected from the group consisting of SEQ ID NOs: 4468, 4450-4467, and 4469-4646. According to certain embodiments, the recombinant polynucleotide comprises a nucleic acid sequence selected from the group consisting of SEQ ID NOs:4271, 4253-4270, and 4272-4449.

According to certain embodiments, the recombinant polynucleotide optimized for polypeptide expression in the bacterial expression system further comprises said bacterium signal peptide.

According to a further aspect, the present invention provides a fungicidal composition comprising an effective amount of at least one polypeptide at least 70% identical to a polypeptide having an amino acid sequence selected from the group consisting of SEQ ID NOs:2635, 2444-2634, 2636-4252, a fragment and/or a variant thereof, wherein the fungicidal composition is effective in inhibiting the growth and/or development of at least one plant pathogenic fungi and/or Oomycetes. According to certain embodiments, the fungicidal composition comprises at least one polypeptide having an amino acid sequence selected from the group consisting of SEQ ID NOs:2635, 4468, 4661, 2444-2634, 2636-4252, 4450-4467, 4469-4660, and 4662-4799. According to some embodiments, the fungicidal composition comprises at least one polypeptide having an amino acid sequence selected from the group consisting of SEQ ID NOs:4468, 4661, 4450-4467, 4469-4660, and 4662-4799. According to certain embodiments, the fungicidal composition further comprises at least one agriculturally compatible agent selected from the group consisting of a carrier, a stabilizer, a diluent, a surfactant, a mineral and an adjuvant.

According to yet additional aspect, the present invention provides a fungicidal composition comprising bacteria comprising at least one polypeptide at least 70% identical to a polypeptide having an amino acid sequence selected from the group consisting of SEQ ID NOs:2635, 2444-2634, 2636-4252, a fragment and/or a variant thereof, wherein the fungicidal composition is effective in inhibiting the growth and/or development of at least one plant pathogenic fungi and/or Oomycetes. According to certain embodiments, the bacteria comprise at least one polypeptide having an amino acid sequence selected from the group consisting of SEQ ID NOs:2635, 4468, 4661, 2444-2634, 2636-4252, 4450-4467, 4469-4660, and 4662-4799. According to some embodiments, the bacteria comprise at least one polypeptide having an amino acid sequence selected from the group consisting of SEQ ID NOs:4468, 4661, 4450-4467, 4469-4660, and 4662-4799. Each possibility represents a separate embodiment of the present invention. The bacteria can be of the same species or of different species, with the proviso that the bacteria have no adverse effect on a plant. The bacteria can be alive or dead. According to certain exemplary embodiments, the bacteria are selected from the group consisting of *Bacillus subtilis Lactococcus lacti, Corynebacterium glutamicum*; and *Bacillus brevis*.

According to certain embodiments, the fungicidal composition further comprises at least one agriculturally compatible agent selected from the group consisting of a carrier, a stabilizer, a diluent, a surfactant, a mineral and an adjuvant.

According to additional aspect, the present invention provides a nucleic acid construct comprising a polynucleotide according to some embodiments of the present invention, further comprising at least one regulatory element for directing the expression of the polynucleotide within a plant cell. According to certain embodiment, the regulatory element is a promoter. The promoter can be endogenous or heterologous to the plant comprising the nucleic acid construct.

The polypeptides and polynucleotides disclosed herein may be used to confer resistance to a wide variety of fungal and Oomycetous pathogens that cause commercial damage to crop and ornamental plants.

According to certain embodiments, the fungal or Oomycetous pathogens can be one or more fungi or Oomycetes from a class selected from the group consisting of Ascomycetes, Plasmodiophoromycetes, Chytridiomycetes, Zygomycetes, Basidiomycetes, Deuteromycetes, and Sordariomycetes. Each possibility represents a separate embodiment of the present invention.

According to some embodiments, the fungal pathogens can be one or more fungi from a genus selected from the group consisting of *Fusarium, Colletotrichum, Geotrichum, Aspergillus, Alternaria, Athelia, Botryosphaeria, Botrytis, Cryphonectria, Choanephora, Cercospora, Magnaporthe Monilinia, Mycosphaerella, Melampsora, Puccinia, Phakopsora, Rhizoctonia, Septoria, Uromyces, Ustilago* and *Verticillium*.

According to some embodiments, the Oomycetous pathogen can be from the class Oomycetes (synonym Peronosporomycetes). In some embodiments, said Oomycetous infection comprises infection by an Oomycete from a genus selected from the group consisting of *Blumeria, Macrophomina, Oidium, Pythium,* and *Phytophthora*. Each possibility represents a separate embodiment of the present invention. According to some embodiments, the fungal or Oomycetous pathogen is selected from the group consisting of *Botrytis cinerea, Mycosphaerella graminicola, Mycosphaerella fijiensis, Septoria lycopersici, Magnaporthe oryza, Rhizoctonia solani, Ustilago maydis, Sclerotium rolfsii,* and *Blumeria* graminis.

According to certain exemplary embodiments, the fungus of the genus *Fusarium* is selected from the group consisting of *Fusarium verticilloides* and *Fusarium graminearum*. According to additional exemplary embodiments, the *F. verticilloides* is *F. verticillioides* strain A-00149-FGSC 7600. According to further exemplary embodiments, the *F. graminearum* is *F. graminearum* strain CBS 110260.

According to other exemplary embodiments, the fungus of the genus *Colletotrichum* is *Colletotrichum graminicola*.

The polynucleotides and polypeptides of the present invention can be used to confer resistance to any plant type. According to certain embodiments, the plant is a cereal plant. According to some embodiments, the cereal plant is selected from the group consisting of maize, wheat, barley, sorghum, rice, oat, and rye. Each possibility represents a separate embodiment of the present invention. According to certain exemplary embodiments, the cereal plant is maize (*Zea mays*). According to other embodiments, the plant is a field-crop plant. According to some embodiments, the field crop plant is selected from the group consisting of tomato, potato, sweet potato, cassava, beets, ginger, horseradish, radish, ginseng, turnip, any root or tuber crop, pepper, eggplant, ground cherry, tomatillo, okra, other fruiting vegetables, cucumber, cantaloupe, melon, muskmelon, squash, watermelon and other cucurbit plants.

Further embodiments and the full scope of applicability of the present invention will become apparent from the detailed description given hereinafter. However, it should be understood that the detailed description and specific examples, while indicating preferred embodiments of the invention, are given by way of illustration only, since various changes and modifications within the spirit and scope of the invention will become apparent to those skilled in the art from this detailed description.

BRIEF DESCRIPTION OF THE FIGURES

FIGS. 2A-H depict an exemplary design of Homology Directed Repair according to some embodiments of the invention. FIG. 2A depicts the sequence of the endogenous 5'-upstream flanking region of the genomic sequence GRMZM2G069095 (SEQ ID NO:45). FIG. 2B depicts the sequence of the endogenous 3'-downstream flanking region of the genomic sequence GRMZM2G069095 having the nucleic acid sequence set forth in SEQ ID NO:46. FIG. 2C depicts the sequence of the 5'-UTR gRNA (SEQ ID NO:43). FIG. 2D depicts the sequence of the 5'-UTR gRNA without NGG nucleotides (SEQ ID NO:47). FIG. 2E depicts the sequence of the 3'-UTR gRNA (SEQ ID NO:44). FIG. 2F depicts the sequence of the 3'-UTR gRNA after cut (SEQ ID NO:48). FIG. 2G depicts the coding sequence (from the "ATG" start codon to the "TGA" termination codon, marked by bold and underlined) of the desired LFS127_H4 sequence (SEQ ID NO:50) encoding the polypeptide set forth by SEQ ID NO:487. FIG. 2H depicts the exemplary repair template (SEQ ID NO:49) which includes (1) the upstream flanking region (1 kbp) sequence including part of the gRNA after cutting (SEQ ID NO:47; shown in bold and italics); (2) 5' UTR of genomic DNA from Cas9 cutting site to ATG; (3) the coding sequence (CDS) of the desired LFS127_H4 sequence (SEQ ID NO:50) marked in lower case with the start (ATG) and the stop (TGA) codons marked in bold and underlined; (4) 3' UTR of genomic DNA from the stop codon to Cas9 cutting site including the predicted part of the gRNA after cutting (SEQ ID NO:48, shown in bold and underlined and (5) the downstream flanking region (1 kbp) sequence.

FIG. 3A-E depicts an exemplary design of polynucleotide knockout (KO) using CRISPR/CAS system. FIG. 3A depicts the sequence of the KO gRNA (SEQ ID NO:51); FIG. 3B depicts the sequence of the KO gRNA after cut (SEQ ID NO:52); FIG. 3C depicts the coding sequence (from the "ATG" start codon to the "TAG" termination codon, marked by bold and underlined) of the desired LFS132 sequence (SEQ ID NO:53); FIG. 3D (targeted region in bold) and FIG. 3E depict the anticipated change in the coding sequence of the exemplified KO gene (SEQ ID NO:54).

DETAILED DESCRIPTION OF THE INVENTION

Figure 1:
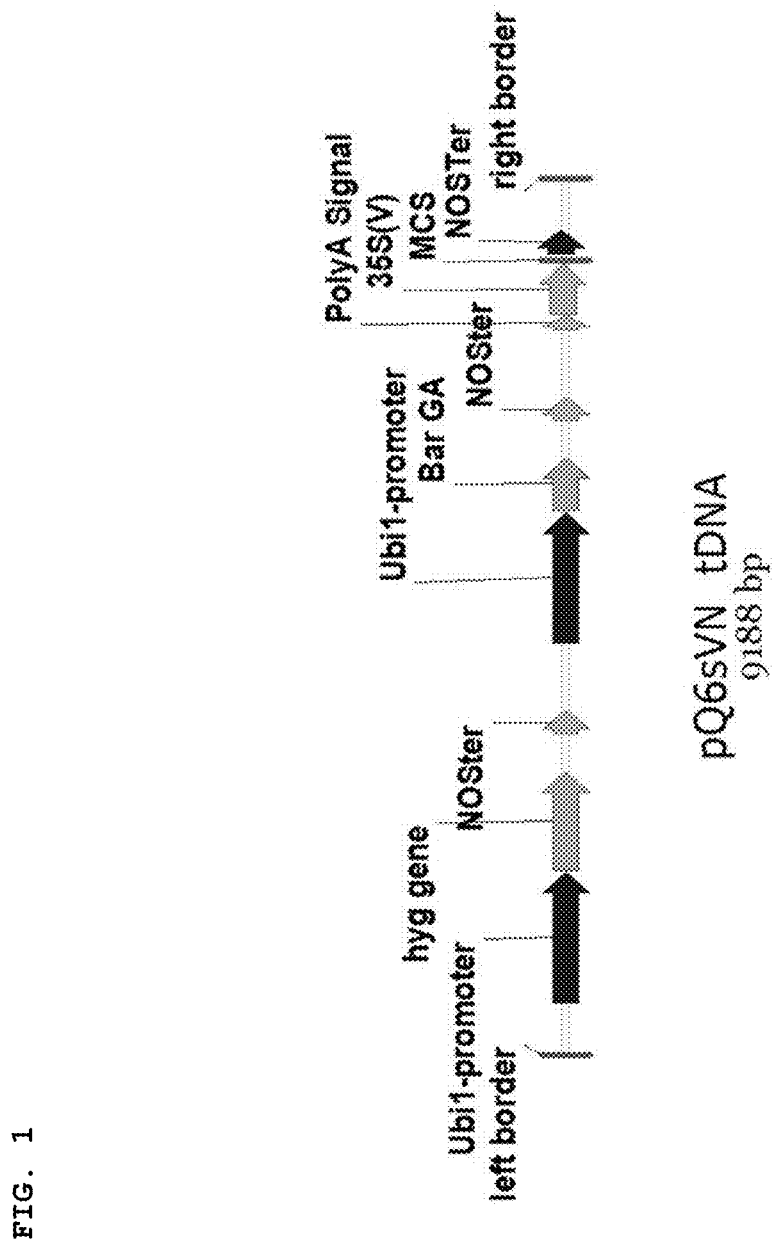
FIG. 1 is a schematic illustration of the pQ6sVN plasmid. pQ6sVN used for expression of the isolated polynucleotide sequences of some embodiments of the invention in *Brachypodium*. "35S(V)"=35S promoter (SEQ ID NO:37); "NOS ter"=nopaline synthase terminator; "Bar_GA"=BAR open reading frame optimized for expression in *Brachypodium* (SEQ ID NO:39); "Hyg"=Hygromycin resistance gene. "Ubi1 promoter"=SEQ ID NO:11; the isolated polynucleotide sequences of some embodiments of the invention were cloned into the Multiple cloning site of the vector (downstream of the "35S(V)" promoter) using one or more of the indicated restriction enzyme sites.

The present invention discloses means and methods for conferring and/or enhancing the resistance of a plant to pathogenic fungi and/or Oomycetes. Particularly, the present invention provides isolated polypeptides conferring or enhancing plant resistance to pathogenic fungi and/or Oomycetes, isolated polynucleotides encoding same, nucleic acid constructs comprising the polynucleotides and plant cells transformed with same. The present invention further provides methods for producing and selecting plants having increased resistance to at least one pathogenic fungus and/or Oomycete and plant with enhanced resistance to the at least one pathogenic fungus and/or Oomycete, in which the expression of the polynucleotides and/or polypeptides of the invention is modulated. In additional aspects, the present invention provides fungicidal compositions comprising isolated fungicidal polypeptides of the invention and/or bacteria comprising same.

The present invention is based in part on bioinformatics tools that have been used to identify polynucleotides associated with resistance or reduced sensitivity of plants to at least one pathogenic fungus or pathogenic Oomycete, as well as to identify polynucleotides of bacterial origin that encode for proteins with potential antifungal activity. Cereal plants, including maize (*Zea*), wheat (*Triticum*), millet (*Sitaria italica*) and the closely related *Aegilops* and *Brachypodium* species were used as representative genera to identify genes overexpressed or downregulated in plants showing increased resistance to fungal/Oomycetes infection. Genes comprising the nucleic acids sequence set forth in any one of SEQ ID NOs:22-62 and 302-303, encoding polypeptides having the amino acid sequence set forth in any one of SEQ ID NOs:308-348, 507, and 510 were identified. Homologous genes and encoded proteins were also identified in wider genera of plant, as described in details and presented in Table 7 hereinbelow. Bacteria isolated from soils known to contain *Fusaria* species were used for screening and identification of potential anti-fungal bacterial proteins. Genes comprising the nucleic acids sequence set forth in any one of SEQ ID NOs:592-789, encoding polypeptides having the amino acid sequence set forth in any one of SEQ ID NOs:2444-2641 were identified. Homologous genes and encoded proteins were also identified in wider genera of bacteria, as described in details and presented in Table 16 hereinbelow.

Polynucleotides of plant origin according to some embodiments of the present invention were cloned into binary vectors, and transformed into plants of the species *Brachypodium distachyon* (Example 6 hereinbelow) to validate the effect of the genes on the resistance of the transformed plants towards the fungi/Oomycetes (Example 7).

Polynucleotides of bacterial origin according to some embodiments of the present invention were cloned, transformed into *E. coli*, and the expressed proteins were isolated (Examples 14-15). The anti-fungal effect of the isolated proteins was validated by their ability to inhibit the growth of *Fusarium verticillioides* mycelia (Example 16, Table 21).

Definitions

The terms "comprise", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible sub ranges as well as individual numerical values within that range. For example, description of a range such as from 1 to 6 should be considered to have specifically disclosed sub ranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the agricultural, chemical, pharmacological, biological, biochemical and medical arts.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

As used herein, the phrase "exogenous polynucleotide" refers to a heterologous nucleic acid sequence which is not naturally expressed within the plant (e.g., a nucleic acid sequence from a different species) or to an endogenous nucleic acid of which overexpression in the plant is desired. The exogenous polynucleotide may be introduced into the plant in a stable or transient manner, so as to produce a ribonucleic acid (RNA) molecule and/or a polypeptide molecule. The term "endogenous" as used herein refers to a polynucleotide or polypeptide which is naturally present and/or naturally expressed within a plant or a cell thereof.

The terms "modulating", "modifying" and "altering" with reference to the expression or activity of a polynucleotide, gene, polypeptide or a protein within a cell or a plurality of cells, particularly plant cell(s), are used herein interchangeably and refer to changing their level of expression within the cell, particularly plant cell. The change can be an increase or a decrease; and it can be measured as compared to any one of the polynucleotide, gene, polypeptide and/or protein level within the same cell(s) before modulation and as compared to the level in a control plant or an average level from a plurality of control plants in which the expression was not modified by man.

According to certain embodiments, the control plant is a wild type plant not manipulated to have modulated expression and/or activity of the polynucleotide and/or polypeptide. According to some embodiments, the control plant is of the same species. According to some embodiments, the control plant comprises the same genetic background.

According to certain embodiments, the examined plant and the control plant are grown under the same growing conditions.

As used herein, the term "resistance" with regard to plants pathogenic fungus and/or Oomycete refers to a plant that is resistant to infection by a fungal or Oomycetous pathogen or resistant to the symptoms of fungal or Oomycetous pathogen infection. For example, a plant resistant to a fungal or Oomycetous pathogen can exhibit a lack of infection, or reduced symptoms of infection, when challenged with a pathogen. As another example, a plant resistant to a fungal or Oomycetous pathogen can be infected by the fungal or Oomycetous pathogen and yet exhibit a reduced number or degree of symptoms of said infection. As yet another example, a plant resistant to a fungal or Oomycetous pathogen can be infected by the pathogen and exhibit one or more symptoms of infection by the pathogen and yet exhibit a reduction in an effect of the infection or symptom thereof. For instance, a plant resistant to a fungal or Oomycetous pathogen can be infected by the pathogen, and exhibit one or more symptoms selected from the group consisting of leaf wilt, leaf or vascular discoloration (e.g., yellowing), spike bleaching etc., and yet not exhibit a reduction in yield loss in comparison to a plant that is not resistant (susceptible) to the fungal or Oomycetous pathogen.

Accordingly, "confer resistance to a pathogenic fungus and/or Oomycete" or "enhanced resistance to a pathogenic fungus and/or Oomycete" refer to a phenotype in which a plant has greater health, growth, multiplication, fertility, vigor, strength (e.g., stem strength and resistance), yield, or less severe symptoms associated with infection of the pathogenic fungus or Oomycete during or after a fungal or Oomycete infection than an organism that does not have enhanced resistance to the pathogen. Where a plant is tested for resistance, a control plant is used to assess the degree of the plant resistance. According to certain embodiments of the present invention, the control plant is a plant not manipulated to have modified expression of at least one polynucleotide and/or polypeptide of the present invention. The control plant is typically, but not necessarily of the same species as the examined plant. According to some embodiments the control plant is of the same specifies and has the same genetic background as the examined plant. The enhancement can be manifested as an increase of 0.1%, 0.2%, 0.3%, 0.5%, 0.75%, 1%, 1.5%, 2%, 3%, 4%, 5%, 6%, 7%, 8%, 9%, 10%, 12%, 15%, 17%, 20%, 25%, 30%, 35%, 40%, 50%, 60%, 70%, 80%, 90%, 100%, or more in health, growth, multiplication, fertility, vigor, strength, or yield, as compared to a control plant. The enhancement can be a decrease of 0.1%, 0.2%, 0.3%, 0.5%, 0.75%, 1%, 1.5%, 2%, 3%, 4%, 5%, 6%, 7%, 8%, 9%, 10%, 12%, 15%, 17%, 20%, 25%, 30%, 35%, 40%, 50%, 60%, 70%, 80%, 90%, or 100% in the symptoms associated with the pathogenic fungus and/or Oomycete as compared to the control plant. According to certain exemplary embodiments, the examined plant and the control plant are grown under the same conditions.

According to certain embodiments of the invention, enhancing the resistance of a plant to a pathogenic fungus comprises enhancing the expression and/or activity of a polypeptide of the invention within at least one cell of the plant. As used herein, the expression of a polynucleotide or polypeptide of the invention is "enhanced" or "up-regulated" if the level of the polynucleotide or polypeptide is enhanced by at least 50%, i.e. the polynucleotide or polypeptide level is at least 1.5-fold higher compared to its level in a control plant or compared to a predetermined threshold level. According to some embodiments, the level of the polynucleotide or polypeptide expression is enhanced by at least 60%, 70%, 80%, 90%, 100%, 200%, 300% and more.

According to certain embodiments, the pre-determined resistance score value is obtained by inoculating a population of corresponding plants susceptible to the at least one pathogenic fungus, scoring the infection degree and setting an average resistance score value.

According to certain embodiments of the invention, enhancing the resistance of a plant to a pathogenic fungus comprises reducing the expression and/or activity of a polynucleotide and/or polypeptide of the invention within at least one cell of the plant. As used herein, the expression of a polynucleotide or polypeptide of the invention is "reduced", "inhibited", "down regulated" or "knocked out" or "knocked down" if the level of the polynucleotide or polypeptide is reduced by at least 30% compared to its level in a control plant or compared to a predetermined threshold level. According to certain embodiments, the level of the polynucleotide or polypeptide is reduced by at least 40%, 50%, 60%, 70%, 80%, 90% and more. According to some embodiments, the term "reduced expression" refers to 100% inhibition or "knockout" of a polynucleotide function and/or expression.

As used herein the term "polynucleotide" refers to a single or double stranded nucleic acid sequence which is isolated and provided in the form of an RNA sequence, a complementary polynucleotide sequence (cDNA), a genomic polynucleotide sequence and/or a composite polynucleotide sequences (e.g., a combination of the above).

As used herein the phrase "complementary polynucleotide sequence" refers to a sequence, which results from reverse transcription of messenger RNA using a reverse transcriptase or any other RNA dependent DNA polymerase. Such a sequence can be subsequently amplified in vivo or in vitro using a DNA dependent DNA polymerase.

The term "isolated" refers to at least partially separated from the natural environment e.g., from a plant cell.

As used herein the phrase "genomic polynucleotide sequence" refers to a sequence derived (isolated) from a chromosome and thus it represents a contiguous portion of a chromosome.

As used herein the phrase "composite polynucleotide sequence" refers to a sequence, which is at least partially complementary and at least partially genomic. A composite sequence can include some exonal sequences required to encode the polypeptide of the present invention, as well as some intronic sequences interposing therebetween. The intronic sequences can be of any source, including of other genes, and typically will include conserved splicing signal sequences. Such intronic sequences may further include cis acting expression regulatory elements.

It should be noted that the nucleic acid sequence of a polynucleotide encoding a polypeptide which is provided in the sequence listing as a single strand refers to the sense direction which is equivalent to the mRNA transcribed from the polynucleotide.

When reference is made to particular sequence listings, such reference is to be understood to also encompass sequences that substantially correspond to its complementary sequence as including minor sequence variations, resulting from, e.g., sequencing errors, cloning errors, or other alterations resulting in base substitution, base deletion or base addition, provided that the frequency of such variations is less than 1 in 50 nucleotides, alternatively, less than 1 in 100 nucleotides, alternatively, less than 1 in 200 nucleotides, alternatively, less than 1 in 500 nucleotides, alternatively, less than 1 in 1000 nucleotides, alternatively, less than 1 in 5,000 nucleotides, alternatively, less than 1 in 10,000 nucleotides.

As used herein, the phrase "exogenous polynucleotide" refers to a heterologous nucleic acid sequence which is not naturally expressed within the plant (e.g., a nucleic acid sequence from a different species) or to an endogenous nucleic acid of which overexpression in the plant is desired. The exogenous polynucleotide may be introduced into the plant in a stable or transient manner, so as to produce a ribonucleic acid (RNA) molecule and/or a polypeptide molecule.

The term "endogenous" as used herein refers to a polynucleotide or polypeptide which is naturally present and/or naturally expressed within a plant or a cell thereof.

The term "heterologous" as used herein refers to polynucleotide or polypeptide which is not naturally present and/or naturally expressed within a plant or a cell thereof.

According to one aspect, the present invention provides a method for enhancing the resistance of a plant or a part thereof to at least one pathogenic fungus and/or Oomycete, comprising modulating the expression and/or activity of at least one polypeptide at least about 70%, at least about 71%, at least about 72%, at least about 73%, at least about 74%, at least about 75%, at least about 76%, at least about 77%, at least about 78%, at least about 79% or more homologous to a polypeptide having an amino acid sequence selected from the group consisting of SEQ ID NOs:2635, 2444-2634, 2636-4252; or at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a polypeptide having an amino acid sequence selected from the group consisting of SEQ ID NOs:326, 360, 308-325, 327-359, 361-506 and 2635, 2444-2634, 2636-4252, a fragment and/or a variant thereof within at least one cell of the plant or part thereof, thereby enhancing the resistance of said plant or part thereof to the at least one pathogenic fungus and/or Oomycetes compared to the resistance of a control plant. Each possibility represents a separate embodiment of the present invention.

According to another aspect, the present invention provides a method for enhancing the resistance of a plant or a part thereof to at least one pathogenic fungus and/or Oomycete, comprising modulating the expression of at least one polynucleotide encoding a polypeptide at least about 70%, at least about 71%, at least about 72%, at least about 73%, at least about 74%, at least about 75%, at least about 76%, at least about 77%, at least about 78%, at least about 79% or more homologous to a polypeptide having an amino acid sequence selected from the group consisting of SEQ ID NOs:2380-4175; or at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a polypeptide having an amino acid sequence selected from the group consisting of SEQ ID NOs:339-537 and 2380-4175, a fragment and/or a variant thereof within at least one cell of the plant or part thereof, thereby enhancing the resistance of said plant or part thereof to the at least one pathogenic fungus and/or Oomycete compared to the resistance of a corresponding control plant. Each possibility represents a separate embodiment of the present invention.

According to certain embodiments, the polypeptide is 70%-79% homologous to any one of the polypeptides set forth in SEQ ID NOs:2635, 2444-2634, 2636-4252. According to other embodiments, the polypeptide is 75%-79% homologous to any one of the polypeptides set forth in SEQ ID NOs:2635, 2444-2634, 2636-4252.

According to certain embodiments, the polypeptide is 80%-99% homologous to any one of the polypeptides set forth in SEQ ID NOs:326, 360, 308-325, 327-359, 361-506, 2635, 2444-2634, and 2636-4252. According to other embodiments, the polypeptide is 85%-95% homologous to any one of the polypeptides set forth in SEQ ID NOs: 326, 360, 308-325, 327-359, 361-506, 2635, 2444-2634, and 2636-4252. According to other embodiments, the polypeptide is 90%-99% homologous to any one of the polypeptides set forth in SEQ ID NOs:326, 360, 308-325, 327-359, 361-506, 2635, 2444-2634, and 2636-4252. According to certain embodiments, the polypeptide comprises an amino acid sequence selected from the group consisting of SEQ ID NOs: 326, 360, 308-325, 327-359, 361-508, 2635, 2444-2634, and 2636-4252. Each possibility represents a separate embodiment of the present invention. According to certain embodiments, the polypeptide consists of the amino acid sequence selected from the group consisting of SEQ ID NOs:326, 360, 308-325, 327-359, 361-508 and 2635, 2444-2634, 2636-4252. Each possibility represents a separate embodiment of the present invention.

According to yet additional aspect, the present invention provides a method for enhancing the resistance of a plant or a part thereof to at least one pathogenic fungus and/or Oomycete, comprising modulating the expression of at least one polynucleotide at least about 70%, at least about 71%, at least about 72%, at least about 73%, at least about 74%, at least about 75%, at least about 76%, at least about 77%, at least about 78%, at least about 79% or more homologous to a polynucleotide having a nucleic acid sequence selected from the group consisting of SEQ ID NOs:783, 592-782, 784-2443; or at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a polynucleotide having an nucleic acid sequence selected from the group consisting of SEQ ID NOs:40, 80, 22-39, 41-79, 81-301, 783, 592-782, 784-2443 within at least one cell of the plant or part thereof, thereby enhancing the resistance of said plant or part thereof to the at least one pathogenic fungus and/or Oomycetes compared to the resistance of a control plant. Each possibility represents a separate embodiment of the present invention.

According to certain embodiments, the polynucleotide is 70%-79% homologous to any one of the polynucleotides set forth in SEQ ID NOs:783, 592-782, 784-2443. According to other embodiments, the polynucleotide is 75%-79% homologous to any one of the polynucleotides set forth in SEQ ID NOs:783, 592-782, 784-2443. Each possibility represents a separate embodiment of the present invention.

According to certain embodiments, the polynucleotide is 80%-99% homologous to any one of the polynucleotides set forth in SEQ ID NOs:40, 80, 22-39, 41-79, 81-301, 783, 592-782, and 784-2443. According to other embodiments, the polynucleotide is 85%-95% homologous to any one of the polynucleotides set forth in SEQ ID NOs:40, 80, 22-39, 41-79, 81-301, 783, 592-782, and 784-2443. According to other embodiments, the polynucleotide is 90%-99% homologous to any one of the polynucleotides set forth in SEQ ID NOs:40, 80, 22-39, 41-79, 81-301, 783, 592-782, and 784-2443. Each possibility represents a separate embodiment of the present invention.

According to certain embodiments, the polynucleotide comprises a nucleic acids sequence set forth in any one of SEQ ID NOs:40, 80, 22-39, 41-79, 81-305, 783, 592-782, 784-2443.

According to other embodiments, the exogenous polynucleotide consists of a nucleic acids sequence set forth in any one of SEQ ID NOs:40, 80, 22-39, 41-79, 81-305, 783, 592-782, and 784-2443. Each possibility represents a separate embodiment of the present invention.

According to another aspect, the present invention provides a method for producing a population of plants each having an enhanced resistance to at least one pathogenic fungus or Oomycete, comprising the steps of:
(a) modulating the expression and/or activity of at least one polypeptide at least about 70%, at least about 71%, at least about 72%, at least about 73%, at least about 74%, at least about 75%, at least about 76%, at least about 77%, at least about 78%, at least about 79% or more homologous to a polypeptide having an amino acid sequence selected from the group consisting of SEQ ID NOs:2635, 2444-2634, 2636-4252; or at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a polypeptide having an amino acid sequence selected from the group consisting of SEQ ID NOs:326, 360, 308-325, 327-359, 361-506, 2635, 2444-2634, and 2636-4252, a fragment and/or a variant thereof within at least one cell of each plant of the plant population as to produce a genetically engineered plant population;
(b) inoculating each plant of the genetically engineered plant population with the at least one pathogenic fungus; and
(c) selecting plants showing an enhanced resistance to said at least one pathogenic fungus compared to a control or to a pre-determined resistance score value;

thereby producing a population of genetically engineered plants having enhanced resistance to said at least one pathogenic fungus.

According to certain embodiments, the method comprises modulating the expression and/or activity of a polypeptide having the amino acid sequence set forth in any one of SEQ ID NOs:326, 360, 308-325, 327-359, 361-508, 2635, 2444-2634, and 2636-4252. According to other embodiments, the method comprises enhancing the expression and/or activity of a polypeptide having the amino acid sequence set forth in SEQ ID NO:509. According to yet additional embodiments, the method comprises enhancing the expression and/or activity of a polypeptide consisting of the amino acid sequence set forth in any one of SEQ ID NOs:326, 360, 308-325, 327-359, 361-509, 2635, 2444-2634, and 2636-4252.

According to additional aspect, the present invention provides a method for selecting a plant having an enhanced resistance to at least one pathogenic fungus and/or Oomycete, comprising the steps of:
(a) providing a plurality of plants each comprising at least one cell with modulated expression and/or activity of a polypeptide at least about 70%, at least about 71%, at least about 72%, at least about 73%, at least about 74%, at least about 75%, at least about 76%, at least about 77%, at least about 78%, at least about 79% or more homologous to a polypeptide having an amino acid sequence selected from the group consisting of SEQ ID NOs:2635, 2444-2634, 2636-4252; or at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a polypeptide having an amino acid sequence selected from the group consisting of SEQ ID NOs:326, 360, 308-325, 327-359, 361-506, 2635, 2444-2634, and 2636-4252, a fragment and/or a variant thereof;
(b) inoculating the plurality of plants with the at least one pathogenic fungus or Oomycete; and
(c) selecting plants showing an enhanced resistance to said at least one pathogenic fungus or Oomycete compared to a control plant or to a pre-determined resistance score value.

According to certain embodiments, the method comprises providing a plurality of plants each comprising at least one cell with modulated expression and/or activity of at least one polypeptide having the amino acid sequence set forth in any one of SEQ ID NOs:326, 360, 308-325, 327-359, 361-508, 2635, 2444-2634, and 2636-4252. Each possibility represents a separate embodiment of the present invention. According to other embodiments, the method comprises providing a plurality of plants each having modulated expression and/or activity of a polypeptide having the amino acid sequence set forth SEQ ID NO:509. According to other embodiments, the method comprises providing a plurality of plants each having modulated expression and/or activity of at least one polypeptide consisting of the amino acid sequence set forth in any one of SEQ ID NOs: 326, 360, 308-325, 327-359, 361-509, 2635, 2444-2634, and 2636-4252.

The plurality of plants having modulated expression and/or activity of the polypeptide may include plants having at least one cell with enhanced expression and/or activity of a polypeptide, plants having at least one cell with reduced expression and/or activity of a polypeptide or a combination thereof. Enhancing or reducing the expression and/or activity of the polypeptide can be performed as is known in the Art and as described hereinbelow.

According to certain embodiments, the polypeptide the expression and/or activity of which is to be enhanced comprises an amino acid sequence at least 70% identical to a polypeptide having an amino acid sequence selected from the group consisting of SEQ ID NO:2635, 2444-2634, 2636-4252 or at least 80% identical to a polypeptide having an amino acid sequence selected from the group consisting of SEQ ID NOs:326, 360, 308-325, 327, 329-347, 349-359, 362-506. According to some embodiments, the polypeptide the expression and/or activity of which is to be enhanced comprises an amino acid sequence selected from the group consisting of SEQ ID NOs:326, 360, 308-325, 327, 329-347, 349-359, 362-508, 2635, 2444-2634, and 2636-4252. Each possibility represents a separate embodiment of the present invention.

According to certain embodiments, enhancing the resistance of the plant to the pathogenic fungus and/or Oomycete comprises reducing the expression and/or activity of at least one polypeptide compared to its expression and/or activity in the control plant. According to certain exemplary embodiments, the polypeptide the expression and/or activity of which is to be reduced comprises an amino acid sequence at least 80% identical to the amino acid sequence set forth in any one of SEQ ID NO:328, SEQ ID NO:361, and SEQ ID NO:348. According to further exemplary embodiments, the polypeptide the expression and/or activity of which is to be reduced comprises the amino acid sequence set forth in any one of SEQ ID NO:328, SEQ ID NO:361 and SEQ ID NO:348.

According to another aspect, the present invention provides a method for conferring and/or enhancing the resistance of a grafted plant to at least one pathogenic fungus and/or Oomycete, the method comprising providing a scion and a rootstock, wherein the rootstock exhibits enhanced resistance to the at least one pathogenic fungus and/or Oomycete, said rootstock comprises at least one cell with a modulated expression of a polynucleotide encoding a polypeptide at least about 70%, at least about 71%, at least about 72%, at least about 73%, at least about 74%, at least about 75%, at least about 76%, at least about 77%, at least about 78%, at least about 79% or more homologous to a polypeptide having an amino acid sequence selected from the group consisting of SEQ ID NOs:2635, 2444-2634, 2636-4252; or at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to the amino acid sequence selected from the group consisting of SEQ ID NOs:326, 360, 308-325, 327-359, 361-506, 2635, 2444-2634, 2636-4252, a fragment and/or a variant thereof compared to the scion and grafting said scion onto said rootstock, thereby producing a grafted plant having an enhanced resistance to said at least one pathogenic fungus and/or Oomycete.

According to another aspect, the present invention provides a method for conferring and/or enhancing the resistance of a grafted plant to at least one pathogenic fungus and/or Oomycete, the method comprising providing a scion and a rootstock, the scion having an enhances resistance to the at least one pathogenic fungus and/or Oomycete, said scion comprises at least one cell with modulated expression of at least one polynucleotide encoding a polypeptide at least about 70%, at least about 71%, at least about 72%, at least about 73%, at least about 74%, at least about 75%, at least about 76%, at least about 77%, at least about 78%, at least about 79% or more homologous to a polypeptide having an amino acid sequence selected from the group consisting of SEQ ID NOs:2635, 2444-2634, 2636-4252; or at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to the amino acid sequence selected from the group consisting of SEQ ID NOs:326, 360, 308-325, 327-359, 361-506, 2635, 2444-2634, 2636-4252, a fragment and/or a variant thereof compared to the rootstock, and grafting said scion onto said rootstock, thereby producing a grafted plant having an enhanced resistance to the at least one pathogenic fungus and/or Oomycete.

According to certain embodiments, the polypeptide expressed in the scion or in the rootstock comprises an amino acid sequence selected from the group consisting of SEQ ID NOs:326, 360, 308-325, 327-359, 361-508, 2635, 2444-2634, and 2636-4252.

According to certain embodiments, the scion or rootstock having enhanced resistance to the at least one fungus and/or Oomycete comprises at least one cell with enhanced expression and/or activity of at least one polypeptide or the nucleotide encoding same. According to other embodiments, the scion or rootstock having enhanced resistance to the at least one fungus and/or Oomycete comprises at least one cell with reduced expression and/or activity of at least one polypeptide or the nucleotide encoding same. The polypeptides the expression of which is enhanced or reduced are as described hereinabove.

According to some embodiments, the at least one polynucleotide is constitutively expressed in the transgenic rootstock. According to some embodiments, the at least one polynucleotide is expressed in the transgenic rootstock in a tissue specific or inducible manner. According to some embodiments, the expression of the at least one polynucleotide is induced by biotic stress, particularly by fungi infection.

According to additional aspect, the present invention provides a method of growing a crop plant having enhanced resistance to at least one pathogenic fungus and/or Oomycete comprising the steps of:
  (a) selecting a parent plant having a modulated expression of at least one polynucleotide comprising a nucleic acid sequence encoding a polypeptide at least about 70%, at least about 71%, at least about 72%, at least about 73%, at least about 74%, at least about 75%, at least about 76%, at least about 77%, at least about 78%, at least about 79% or more homologous to a polypeptide having an amino acid sequence selected from the group consisting of SEQ ID NOs:2635, 2444-2634, 2636-4252; or at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to the amino acid sequence selected from the group consisting of SEQ ID NOs:326, 360, 308-325, 327-359, 361-506, 2635, 2444-2634, 2636-4252, a fragment and/or a variant thereof for enhanced resistance to at least one pathogenic fungus and/or Oomycete; and (b) growing a progeny crop plant of the parent plant, wherein the progeny crop plant having modulated expression of the polynucleotide has an enhanced resistance to the at least one pathogenic fungus and/or Oomycete.

According to certain embodiments, the encoded polypeptide comprises the amino acid sequence set forth in any one of SEQ ID NOs:326, 360, 308-325, 327-359, 361-508, 2635, 2444-2634, and 2636-4252. According to certain embodiments, the encoded polypeptide comprises the amino acid sequence set forth in SEQ ID NOs:5509. According to some embodiments, the encoded polypeptide consists of the amino acid sequence set forth in any one of SEQ ID NOs: 326, 360, 308-325, 327-359, 361-509, 2635, 2444-2634, 2636-4252. Each possibility represents a separate embodiment of the present invention.

According to certain embodiments, the polynucleotide comprises a nucleic acid sequence at least about 70%, at least about 71%, at least about 72%, at least about 73%, at least about 74%, at least about 75%, at least about 76%, at least about 77%, at least about 78%, at least about 79% or more homologous to a polynucleotide having a nucleic acid sequence selected from the group consisting of SEQ ID NOs:783, 592-782, 784-2443; or at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a nucleic acid sequence set forth in any one of SEQ ID NOs:40, 80, 22-39, 41-79, 81-301, 783, 592-782, and 784-2443. Each possibility represents a separate embodiment of the present invention.

According to certain embodiments, the polynucleotide comprises the nucleic acid sequence set forth in any one of SEQ ID NOs:40, 80, 22-39, 41-79, 81-305, 783, 592-782, and 784-2443. According to certain embodiments, the polynucleotide comprises the nucleic acid sequence set forth in SEQ ID NO:306. According to some embodiments, the polynucleotide consists of the nucleic acid sequence set forth in any one of SEQ ID NOs: 40, 80, 22-39, 41-79, 81-306, 783, 592-782, 784-2443. Each possibility represents a separate embodiment of the present invention.

According to certain embodiments, the modulated expression comprises up-regulation of at least one polynucleotide expression. According to certain embodiments, the modulated expression comprises down-regulation of at least one polynucleotide expression.

According to certain exemplary embodiments, the gene to be upregulated comprises a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a nucleic acid sequence set forth in any one of SEQ ID NOs:40, 80, 22-39, 41, 43-61, 63-79, 81, 83-301. According to some embodiments, the gene to be upregulated comprises a polynucleotide selected from the group consisting of SEQ ID NOs:40, 80, 22-39, 41, 43-61, 63-79, 81, 83-306.

According to certain exemplary embodiments, the gene the expression of which is to be downregulated comprises a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a nucleic acid sequence set forth in any one of SEQ ID NOs:42, 62 and 82. According to certain embodiments, the gene the expression of which is to be downregulated comprises a nucleic acid sequence selected from the group consisting of SEQ ID NOs:42, 62 and 82.

According to certain embodiments, the encoded polypeptide the expression and/or activity of which is to be downregulated is at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to an amino acid sequence set forth in any one of SEQ ID NOs:328, 248 and 361. According to certain embodiments, the polypeptide the expression and/or activity of which is to be downregulated comprises an amino acid sequence selected from the group consisting of SEQ ID NOs:328, 248 and 361. Each possibility represents a separate embodiment of the present invention.

According to yet additional aspect, the present invention provides a method of producing seeds of a crop comprising the steps of:

(a) selecting a parent plant having a modulated expression of at least one polynucleotide comprising a nucleic acid sequence encoding a polypeptide at least about 70%, at least about 71%, at least about 72%, at least about 73%, at least about 74%, at least about 75%, at least about 76%, at least about 77%, at least about 78%, at least about 79% or more homologous to a polypeptide having an amino acid sequence selected from the group consisting of SEQ ID NOs:2635, 2444-2634, 2636-4252; or at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to the amino acid sequence selected from the group consisting of SEQ ID NOs:326, 360, 308-325, 327-359, 361-506, 2635, 2444-2634, 2636-

4252, a fragment and/or a variant thereof for enhanced resistance to at least one pathogenic fungus and/or Oomycete;

(b) growing the selected parent plant of step (a) to produce seeds;

(c) harvesting the produced seeds.

According to certain embodiments, the encoded polypeptide comprises the amino acid sequence set forth in any one of SEQ ID NOs:326, 360, 308-325, 327-359, 361-508 and 2635, 2444-2634, 2636-4252. According to certain embodiments, the encoded polypeptide comprises the amino acid sequence set forth in SEQ ID NO:509. According to some embodiments, the encoded polypeptide consists of the amino acid sequence set forth in any one of SEQ ID NOs:326, 360, 308-325, 327-359, 361-508 and 2635, 2444-2634, 2636-4252. Each possibility represents a separate embodiment of the present invention.

According to certain embodiments, the modulated expression of the least one polynucleotide comprises up-regulation of a polynucleotide expression as described hereinabove. According to certain embodiments, the modulated expression of the least one polynucleotide comprises down-regulation of a polynucleotide expression as described hereinabove.

According to certain embodiments, the seeds produced by the methods of the invention comprise at least one cell having modulated expression of the polynucleotide. According to some embodiments, plants grown from the produced seeds have enhanced resistance to at least one pathogenic fungus and/or Oomycete.

The present invention encompasses polynucleotides identified to be associated with resistance to at least one pathogenic fungus and/or Oomycete polypeptides encoded by same and homologs thereto.

According to certain embodiments, the exogenous isolated or recombinant polynucleotides employed in the methods of the present invention encode a polypeptide comprising an amino acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to an amino acid sequence set forth in any one of SEQ ID NOs:326, 360, 308-325, 327-359, 361-509 and 2635, 2444-2634, 2636-4252.

According to certain embodiments, the exogenous isolated or recombinant polynucleotides employed in the methods of the present invention comprise a nucleic acid sequence at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99% or more homologous to, or identical to a nucleic acid sequence set forth in any one of SEQ ID NOs:40, 80, 22-39, 41-79, 81-306 and 783, 592-782, 784-2443.

Homologous sequences include both orthologous and paralogous sequences. The term "paralogous" relates to gene-duplications within the genome of a species leading to paralogous genes. The term "orthologous" relates to homologous genes in different organisms due to ancestral relationship. Thus, orthologs are evolutionary counterparts derived from a single ancestral gene in the last common ancestor of given two species (Koonin E V and Galperin M Y 2003. Sequence—Evolution—Function: Computational Approaches in Comparative Genomics. Boston: Kluwer Academic; Chapter 2, Evolutionary Concept in Genetics and Genomics) and therefore have great likelihood of having the same function.

One option to identify orthologues in monocot or in dicot plant species is by performing a reciprocal blast search. This may be done by a first blast involving blasting the sequence-of-interest against any sequence database, such as the publicly available NCBI database which may be found at: ncbi.nlm.nih.gov. If orthologues in rice were sought, the sequence-of-interest would be blasted against, for example, the 28,469 full-length cDNA clones from Oryza sativa Nipponbare available at NCBI. The blast results may be filtered. The full-length sequences of either the filtered results or the non-filtered results are then blasted back (second blast) against the sequences of the organism from which the sequence-of-interest is derived. The results of the first and second blasts are then compared. An ortholog is identified when the sequence resulting in the highest score (best hit) in the first blast identifies in the second blast the query sequence (the original sequence-of-interest) as the best hit. Using the same rational a paralog (homolog to a gene in the same organism) is found. In case of large sequence families, the ClustalW program may be used (ebi.ac.uk/Tools/clustalw2/index.html), followed by a neighbor-joining tree (Wikipedia.org/wiki/Neighbor-joining) which helps visualizing the clustering.

Homology (e.g., percent homology, sequence identity+ sequence similarity) can be determined using any homology comparison software computing a pairwise sequence alignment.

As used herein, "sequence identity" or "identity" in the context of two nucleic acid or polypeptide sequences includes reference to the residues in the two sequences which are the same when aligned. When percentage of sequence identity is used in reference to proteins it is recognized that residue positions which are not identical often differ by conservative amino acid substitutions, where amino acid residues are substituted for other amino acid residues with similar chemical properties (e.g. charge or hydrophobicity) and therefore do not change the functional properties of the molecule. Where sequences differ in conservative substitutions, the percent sequence identity may be adjusted upwards to correct for the conservative nature of the substitution. Sequences which differ by such conservative substitutions are considered to have "sequence similarity" or "similarity". Means for making this adjustment are well-known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Henikoff S and Henikoff J G. (Amino acid substitution matrices from protein blocks. Proc. Natl. Acad. Sci. U.S.A. 1992, 89(22): 10915-9).

Identity (e.g., percent homology) can be determined using any homology comparison software, including for example, the BlastN software of the National Center of Biotechnology Information (NCBI) such as by using default parameters.

According to some embodiments of the invention, the identity is a global identity, i.e., an identity over the entire amino acid or nucleic acid sequences of the invention and not over portions thereof.

According to some embodiments of the invention, the term "homology" or "homologous" refers to identity of two or more nucleic acid sequences; or identity of two or more amino acid sequences; or the identity of an amino acid sequence to one or more nucleic acid sequence.

According to some embodiments of the invention, the homology is a global homology, i.e., a homology over the entire amino acid or nucleic acid sequences of the invention and not over portions thereof.

According to some embodiments of the invention, the homology is a partial homology, i.e. a homology over part of the amino acid or nucleic acid sequences of the invention. According to certain exemplary embodiments, the partial sequence is of polynucleotides and polypeptides of embodiments of the present invention lacking a signal or transit peptide.

The degree of homology or identity between two or more sequences can be determined using various known sequence comparison tools. Following is a non-limiting description of such tools which can be used along with some embodiments of the invention.

Pairwise global alignment was defined by S. B. Needleman and C. D. Wunsch, "A general method applicable to the search of similarities in the amino acid sequence of two proteins" Journal of Molecular Biology, 1970, pages 443-53, volume 48).

For example, when starting from a polypeptide sequence and comparing to other polypeptide sequences, the EMBOSS-6.0.1 Needleman-Wunsch algorithm (available from emboss(dot)sourceforge(dot)net/apps/cvs/emboss/apps/needle(dot)html) can be used to find the optimum alignment (including gaps) of two sequences along their entire length—a "Global alignment". Default parameters for Needleman-Wunsch algorithm (EMBOSS-6.0.1) include: gapopen=10; gapextend=0.5; datafile=EBLOSUM62; brief=YES.

According to some embodiments of the invention, the parameters used with the EMBOSS-6.0.1 tool (for protein-protein comparison) include: gapopen=8; gapextend=2; datafile=EBLOSUM62; brief=YES.

According to some embodiments of the invention, the threshold used to determine homology using the EMBOSS-6.0.1 Needleman-Wunsch algorithm is 80%, 81%, 82%, 83%, 84%, 8%, 86%, 87%, 88%, 89%, 90%, 91%, 92%, 93%, 94%, 9%, 96%, 97%, 98%, 99%, or 100%.

When starting from a polypeptide sequence and comparing to polynucleotide sequences, the OneModel FramePlus algorithm [Halperin, E., Faigler, S. and Gill-More, R. (1999)—FramePlus: aligning DNA to protein sequences. Bioinformatics, 15, 867-873) (available from biocceleration(dot)com/Products(dot)html] can be used with following default parameters: model=frame+_p2n.model mode=local.

According to some embodiments of the invention, the parameters used with the OneModel FramePlus algorithm are model=frame+_p2n.model, mode=qglobal.

According to some embodiments of the invention, the threshold used to determine homology using the OneModel FramePlus algorithm is 80%, 81%, 82%, 83%, 84%, 85%, 86%, 8%, 88%, 89%, 90%, 91%, 9%, 93%, 94%, 95%, 96%, 97%, 98%, 99%, or 100%.

When starting with a polynucleotide sequence and comparing to other polynucleotide sequences the EMBOSS-6.0.1 Needleman-Wunsch algorithm (available from emboss(dot)sourceforge(dot)net/apps/cvs/emboss/apps/needle(dot)html) can be used with the following default parameters: (EMBOSS-6.0.1) gapopen=10; gapextend=0.5; datafile=EDNAFULL; brief=YES.

According to some embodiments of the invention, the parameters used with the EMBOSS-6.0.1 Needleman-Wunsch algorithm are gapopen=10; gapextend=0.2; datafile=EDNAFULL; brief=YES.

According to some embodiments of the invention, the threshold used to determine homology using the EMBOSS-6.0.1 Needleman-Wunsch algorithm for comparison of polynucleotides with polynucleotides is 80%, 81%, 82%, 83%, 84%, 85%, 86%, 8%, 88%, 89%, 90%, 91%, 9%, 93%, 94%, 95%, 96%, 97%, 98%, 99%, or 100%.

According to some embodiment, determination of the degree of homology further requires employing the Smith-Waterman algorithm (for protein-protein comparison or nucleotide-nucleotide comparison).

Default parameters for GenCore 6.0 Smith-Waterman algorithm include: model=sw.model.

According to some embodiments of the invention, the threshold used to determine homology using the Smith-Waterman algorithm is 80%, 81%, 82%, 83%, 84%, 85%, 86%, 8%, 88%, 89%, 90%, 91%, 9%, 93%, 94%, 95%, 96%, 97%, 98%, 99%, or 100%.

According to some embodiments of the invention, the global homology is performed on sequences which are pre-selected by local homology to the polypeptide or polynucleotide of interest (e.g., 60% identity over 60% of the sequence length), prior to performing the global homology to the polypeptide or polynucleotide of interest (e.g., 80% global homology on the entire sequence). For example, homologous sequences are selected using the BLAST software with the Blastp and tBlastn algorithms as filters for the first stage, and the needle (EMBOSS package) or Frame+ algorithm alignment for the second stage. Local identity (Blast alignments) is defined with a very permissive cut-off—60% Identity on a span of 60% of the sequences lengths because it is used only as a filter for the global alignment stage. In this specific embodiment (when the local identity is used), the default filtering of the Blast package is not utilized (by setting the parameter "-F F").

In the second stage, homologs are defined based on a global identity of at least 80% to the core gene polypeptide sequence.

According to some embodiments of the invention, two distinct forms for finding the optimal global alignment for protein or nucleotide sequences are used:

1. Between Two Proteins (Following the Blastp Filter):

EMBOSS-6.0.1 Needleman-Wunsch algorithm with the following modified parameters: gapopen=8 gapextend=2. The rest of the parameters are unchanged from the default options listed here:

Standard (Mandatory) qualifiers:

| [-asequence] | sequence | filename and optional format, or reference (input USA) |
|---|---|---|
| [-bsequence] | seqall | Sequence(s) filename and optional format, or reference (input USA) |

-gapopen float [10.0 for any sequence]. The gap open penalty is the score taken away when a gap is created. The best value depends on the choice of comparison matrix. The default value assumes you are using the EBLOSUM62 matrix for protein sequences, and the EDNAFULL matrix for nucleotide sequences. (Floating point number from 1.0 to 100.0)

-gapextend float [0.5 for any sequence]. The gap extension, penalty is added to the standard gap penalty for each base or residue in the gap. This is how long gaps are penalized. Usually you will expect a few long gaps rather than many short gaps, so the gap extension penalty should be lower than the gap penalty. An exception is where one or both sequences are single reads with possible sequencing errors in which case you would expect many single base gaps. You can get this result by setting the gap open penalty to zero (or very low) and using the gap extension penalty to control gap scoring. (Floating point number from 0.0 to 10.0)

[-outfile] align [*needle] Output alignment file name

Additional (Optional) qualifiers:

-datafile matrixf [EBLOSUM62 for protein, EDNAFULL for DNA]. This is the scoring matrix file used when comparing sequences. By default, it is the file 'EBLOSUM62' (for proteins) or the file 'EDNAFULL' (for nucleic sequences). These files are found in the 'data' directory of the EMBOSS installation.

Advanced (Unprompted) qualifiers:

-[no]brief boolean [Y] Brief identity and similarity

Associated qualifiers:

| "-asequence" associated qualifiers | | |
|---|---|---|
| -sbegin1 | integer | Start of the sequence to be used |
| -send1 | integer | End of the sequence to be used |
| -sreverse1 | boolean | Reverse (if DNA) |
| -sask1 | boolean | Ask for begin/end/reverse |
| -snucleotide1 | boolean | Sequence is nucleotide |
| -sprotein1 | boolean | Sequence is protein |
| -slower1 | boolean | Make lower case |
| -supper1 | boolean | Make upper case |
| -sformat1 | string | Input sequence format |
| -sdbname1 | string | Database name |
| -sid1 | string | Entryname |
| -ufo1 | string | UFO features |
| -fformat1 | string | Features format |
| -fopenfile1 | string | Features file name |
| "-bsequence" associated qualifiers | | |
| -sbegin2 | integer | Start of each sequence to be used |
| -send2 | integer | End of each sequence to be used |
| -sreverse2 | boolean | Reverse (if DNA) |
| -sask2 | boolean | Ask for begin/end/reverse |
| -snucleotide2 | boolean | Sequence is nucleotide |
| -sprotein2 | boolean | Sequence is protein |
| -slower2 | boolean | Make lower case |
| -supper2 | boolean | Make upper case |
| -sformat2 | string | Input sequence format |
| -sdbname2 | string | Database name |
| -sid2 | string | Entryname |
| -ufo2 | string | UFO features |
| -fformat2 | string | Features format |
| -fopenfile2 | string | Features file name |
| "-outfile" associated qualifiers | | |
| -aformat3 | string | Alignment format |
| -aextension3 | string | File name extension |
| -adirectory3 | string | Output directory |
| -aname3 | string | Base file name |
| -awidth3 | integer | Alignment width |
| -aaccshow3 | boolean | Show accession number in the header |
| -adesshow3 | boolean | Show description in the header |
| -ausashow3 | boolean | Show the full USA in the alignment |
| -aglobal3 | boolean | Show the full sequence in alignment |

General qualifiers:

| -auto | boolean | Turn off prompts |
|---|---|---|
| -stdout | boolean | Write first file to standard output |
| -filter | boolean | Read first file from standard input, write first file to standard output |
| -options | boolean | Prompt for standard and additional values |
| -debug | boolean | Write debug output to program.dbg |
| -verbose | boolean | Report some/full command line options |
| -help | boolean Re | port command line options. More information on associated and general qualifiers can be found with -help -verbose |
| -warning | boolean | Report warnings |
| -error | boolean | Report errors |
| -fatal | boolean | Report fatal errors |
| -die | boolean | Report dying program messages |

2. Between a Protein Sequence and a Nucleotide Sequence (Following the Tblastn Filter):

GenCore 6.0 OneModel application utilizing the Frame+ algorithm with the following parameters: model=frame+_p2n.model mode=qglobal-q=protein. sequence-db=nucleotide. sequence. The rest of the parameters are unchanged from the default options:

Usage:

om-model=<model_fname> [-q=]query [-db=]database [options]

-model=<model_fname> Specifies the model that you want to run. All models supplied by Compugen are located in the directory $CGNROOT/models/.

Valid command line parameters:

-dev=<dev name> Selects the device to be used by the application.

Valid devices are:

bic—Bioccelerator (valid for SW, XSW, FRAME_N2P, and FRAME_P2N models).

xlg—BioXL/G (valid for all models except XSW).

xlp—BioXL/P (valid for SW, FRAME+N2P, and FRAME_P2N models).

xlh—BioXL/H (valid for SW, FRAME+N2P, and FRAME_P2N models).

soft—Software device (for all models).

-q=<query> Defines the query set. The query can be a sequence file or a database reference. You can specify a query by its name or by accession number. The format is detected automatically. However, you may specify a format using the -qfmt parameter. If you do not specify a query, the program prompts for one. If the query set is a database reference, an output file is produced for each sequence in the query.

-db=<database name> Chooses the database set. The database set can be a sequence file or a database reference. The database format is detected automatically. However, you may specify a format using -dfmt parameter.

-qacc Add this parameter to the command line if you specify query using accession numbers.

-dacc Add this parameter to the command line if you specify a database using accession numbers.

-dfmt/-qfmt=<format_type> Chooses the database/query format type. Possible formats are:

fasta—fasta with seq type auto-detected.

fastap—fasta protein seq.

fastan—fasta nucleic seq.

gcg—gcg format, type is auto-detected.

gcg9seq—gcg9 format, type is auto-detected.

gcg9seqp—gcg9 format protein seq.

gcg9seqn—gcg9 format nucleic seq.

nbrf—nbrf seq, type is auto-detected.

nbrfp—nbrf protein seq.
nbrfn—nbrf nucleic seq.
embl—embl and swissprot format.
genbank—genbank format (nucleic).
blast—blast format.
nbrf_gcg—nbrf-gcg seq, type is auto-detected.
nbrf_gcgp—nbrf-gcg protein seq.
nbrf_gcgn—nbrf-gcg nucleic seq.
raw—raw ascii sequence, type is auto-detected.
rawp—raw ascii protein sequence.
rawn—raw ascii nucleic sequence.
pir—pir codata format, type is auto-detected.
profile—gcg profile (valid only for -qfmt
in SW, XSW, FRAME_P2N, and FRAME+_P2N).
-out=<out_fname> The name of the output file.
-suffix=<name> The output file name suffix.
-gapop=<n> Gap open penalty. This parameter is not valid for FRAME+. For FrameSearch the default is 12.0. For other searches the default is 10.0.
-gapext=<n> Gap extend penalty. This parameter is not valid for FRAME+. For FrameSearch the default is 4.0. For other models: the default for protein searches is 0.05, and the default for nucleic searches is 1.0.
-qgapop=<n> The penalty for opening a gap in the query sequence. The default is 10.0. Valid for XSW.
-qgapext=<n> The penalty for extending a gap in the query sequence. The default is 0.05. Valid for XSW.
-start=<n> The position in the query sequence to begin the search.
-end=<n> The position in the query sequence to stop the search.
-qtrans Performs a translated search, relevant for a nucleic query against a protein database. The nucleic query is translated to six reading frames and a result is given for each frame.
Valid for SW and XSW.
-dtrans Performs a translated search, relevant for a protein query against a DNA database. Each database entry is translated to six reading frames and a result is given for each frame.
Valid for SW and XSW.
Note: "-qtrans" and "-dtrans" options are mutually exclusive.
-matrix=<matrix file> Specifies the comparison matrix to be used in the search. The matrix must be in the BLAST format. If the matrix file is not located in $CGNROOT/tables/matrix, specify the full path as the value of the -matrix parameter.
-trans=<transtab_name> Translation table. The default location for the table is $CGNROOT/tables/trans.
-onestrand Restricts the search to just the top strand of the query/database nucleic sequence.
-list=<n> The maximum size of the output hit list. The default is 50.
-docalign=<n> The number of documentation lines preceding each alignment. The default is 10.
-thr_score=<score_name> The score that places limits on the display of results. Scores that are smaller than -thr_min value or larger than -thr_max value are not shown. Valid options are: quality.
  zscore.
  escore.
-thr_max=<n> The score upper threshold. Results that are larger than -thr_max value are not shown.
-thr_min=<n> The score lower threshold. Results that are lower than -thr_min value are not shown.

-align=<n> The number of alignments reported in the output file.
-noalign Do not display alignment.
Note: "-align" and "-noalign" parameters are mutually exclusive.
-outfmt=<format_name> Specifies the output format type. The default format is PFS. Possible values are:
  PFS—PFS text format
  FASTA—FASTA text format
  BLAST—BLAST text format
-nonorm Do not perform score normalization.
-norm=<norm_name> Specifies the normalization method. Valid options are:
  log—logarithm normalization.
  std—standard normalization.
  stat—Pearson statistical method.
Note: "-nonorm" and "-norm" parameters cannot be used together.
Note: Parameters -xgapop, -xgapext, -fgapop, -fgapext, -ygapop, -ygapext, -delop, and -delext apply only to FRAME+.
-xgapop=<n> The penalty for opening a gap when inserting a codon (triplet). The default is 12.0.
-xgapext=<n> The penalty for extending a gap when inserting a codon (triplet). The default is 4.0.
-ygapop=<n> The penalty for opening a gap when deleting an amino acid. The default is 12.0.
-ygapext=<n> The penalty for extending a gap when deleting an amino acid. The default is 4.0.
-fgapop=<n> The penalty for opening a gap when inserting a DNA base. The default is 6.0.
-fgapext=<n> The penalty for extending a gap when inserting a DNA base. The default is 7.0.
-delop=<n> The penalty for opening a gap when deleting a DNA base. The default is 6.0.
-delext=<n> The penalty for extending a gap when deleting a DNA base. The default is 7.0.
-silent No screen output is produced.
-host=<host name> The name of the host on which the server runs. By default, the application uses the host specified in the file $CGNROOT/cgnhosts.
-wait Do not go to the background when the device is busy. This option is not relevant for the Parseq or Soft pseudo device.
-batch Run the job in the background. When this option is specified, the file "$CGNROOT/defaults/batch.defaults" is used for choosing the batch command. If this file does not exist, the command "at now" is used to run the job.
Note: "-batch" and "-wait" parameters are mutually exclusive.
-version Prints the software version number.
-help Displays this help message. To get more specific help type:
  "om -model=<model_fname>-help".
According to some embodiments the homology is a local homology or a local identity.
Local alignments tools include, but are not limited to the BlastP, BlastN, BlastX or TBLASTN software of the National Center of Biotechnology Information (NCBI), FASTA, and the Smith-Waterman algorithm.
A tblastn search allows the comparison between a protein sequence to the six-frame translations of a nucleotide database. It can be a very productive way of finding homologous protein coding regions in unannotated nucleotide sequences such as expressed sequence tags (ESTs) and draft genome records (HTG), located in the BLAST databases est and htgs, respectively.

Default parameters for blastp include: Max target sequences: 100; Expected threshold: e-5; Word size: 3; Max matches in a query range: 0; Scoring parameters: Matrix—BLOSUM62; filters and masking: Filter—low complexity regions.

Local alignments tools, which can be used include, but are not limited to, the tBLASTX algorithm, which compares the six-frame conceptual translation products of a nucleotide query sequence (both strands) against a protein sequence database. Default parameters include: Max target sequences: 100; Expected threshold: 10; Word size: 3; Max matches in a query range: 0; Scoring parameters: Matrix—BLOSUM62; filters and masking: Filter—low complexity regions.

Modulating the expression and/or activity of the polypeptides of the present invention within a plant cell as to enhance the resistance of the plant to the pathogenic fungi and/or Oomycetes may include enhancing the expression and/or activity of polypeptides identified to positively contribute to the plant defense mechanism against the pathogenic fungi, or reducing the expression and/or activity of those polypeptides found to be associated with susceptibility to the fungus or Oomycete infection.

According to certain embodiments, enhancing the resistance of the plant or part thereof to the pathogenic fungus and/or Oomycete comprises enhancing the expression and/or activity of the at least one polypeptide compared to its expression and/or activity in the control plant.

According to certain embodiments, enhancing the expression and/or activity of the polypeptide comprises introducing into at least one cell of the plant or part thereof an exogenous polynucleotide encoding said polypeptide, thereby producing a transgenic plant over-expressing said polypeptide compared to the control plant.

According to certain embodiments, the exogenous polynucleotide encodes a polypeptide endogenous to the at least one cell. According to other embodiments, the exogenous polynucleotide encodes a polypeptide heterologous to the at least one plant cell.

Nucleic acid sequences encoding the polypeptides of the present invention may be optimized for expression. Examples of such sequence modifications include, but are not limited to, an altered G/C content to more closely approach that typically found in the plant species of interest, and the removal of codons atypically found in the plant species commonly referred to as codon optimization.

The phrase "codon optimization" refers to the selection of appropriate DNA nucleotides for use within a structural gene or fragment thereof that approaches codon usage within the plant of interest, and/or to a process of modifying a nucleic acid sequence for enhanced expression in the host cells of interest by replacing at least one codon (e.g., about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Therefore, an optimized gene or nucleic acid sequence refers to a gene in which the nucleotide sequence of a native or naturally occurring gene has been modified in order to utilize statistically-preferred or statistically-favored codons within the plant. The nucleotide sequence typically is examined at the DNA level and the coding region optimized for expression in the plant species determined using any suitable procedure. For example (see U.S. Pat. No. 7,214,862), the standard deviation of codon usage (SDCU), a measure of codon usage bias, may be calculated by first finding the squared proportional deviation of usage of each codon of the native gene relative to that of highly expressed plant genes, followed by a calculation of the average squared deviation. The formula used is:

$$\sum_{n=1}^{N} [(X_n - Y_n)/Y_n]2/N$$

wherein Xn refers to the frequency of usage of codon n in highly expressed plant genes, where Yn to the frequency of usage of codon n in the gene of interest and N refers to the total number of codons in the gene of interest. A Table of codon usage from highly expressed genes of dicotyledonous plants is compiled using the data of Murray et al. (1989, Nuc Acids Res. 17:477-498).

Alternative method of optimizing the nucleic acid sequence in accordance with the preferred codon usage for a particular plant cell type is based on the direct use, without performing any extra statistical calculations, of codon optimization Tables such as those provided on-line at the Codon Usage Database through the NIAS (National Institute of Agrobiological Sciences) DNA bank in Japan (www.kazusa.or.jp/codon/). The Codon Usage Database contains codon usage tables for a number of different species, with each codon usage Table having been statistically determined based on the data present in Genbank.

By using the tables described above to determine the most preferred or most favored codons for each amino acid in a particular species (for example, rice), a naturally-occurring nucleotide sequence encoding a protein of interest can be codon optimized for that particular plant species. This is affected by replacing codons that may have a low statistical incidence in the particular species genome with corresponding codons, in regard to an amino acid, that are statistically more favored. However, one or more less-favored codons may be selected to delete existing restriction sites, to create new ones at potentially useful junctions (5' and 3' ends to add signal peptide or termination cassettes, internal sites that might be used to cut and splice segments together to produce a correct full-length sequence), or to eliminate nucleotide sequences that may negatively affect mRNA stability or expression.

The naturally-occurring encoding nucleotide sequence may already, in advance of any modification, contain a number of codons that correspond to a statistically-favored codon in a particular plant species. Therefore, codon optimization of the native nucleotide sequence may comprise determining which codons, within the native nucleotide sequence, are not statistically-favored with regards to a particular plant, and modifying these codons in accordance with a codon usage table of the particular plant to produce a codon optimized derivative. A modified nucleotide sequence may be fully or partially optimized for plant codon usage provided that the protein encoded by the modified nucleotide sequence is produced at a level higher than the protein encoded by the corresponding naturally occurring or native gene. Construction of synthetic genes by altering the codon usage is described in for example PCT Patent Application Publication No. WO 93/07278.

Bacterial genes quite often possess multiple methionine initiation codons in proximity to the start of the open reading frame. Translation initiation at one or more of these start codons often leads to generation of a functional protein, and it is not always predetermined which of these codons are used naturally in the bacterium. These start codons can include ATG codons, but additional codons, such GTG, may be used, for example by *Bacillus* sp. as a start codon, and proteins that initiate translation at GTG codons contain a methionine at the first amino acid. Thus, it is understood that use of one of the alternate methionine codons may also lead to generation of proteins capable of conferring resistance to plants against pathogenic filamentous fungi and/or Oomycetes. These proteins are encompassed within the scope of the present invention. It will be understood that, when expressed in plants, it will be necessary to alter the alternate start codon to ATG for proper translation. In addition, the translation initiator methionine of a polypeptide of the disclosure may be cleaved off post translationally. One skilled in the art understands that the N-terminal translation initiator methionine can be removed by methionine aminopeptidase in many cellular expression systems.

As is known to the skilled Artisan, the polynucleotide coding sequence can be modified to add a codon at the position following the methionine start codon to create a restriction enzyme site for recombinant cloning purposes and/or for expression purposes.

A "signal peptide" is an amino acid sequence which is translated in conjunction with a protein and directs the protein to the secretory system (Chrispeels, J. J., (1991) Ann. Rev. Plant Phys. Plant Mol. Biol. 42:21-53). A signal peptide may form part of the polypeptides of the invention or may be added as described hereinabove. In plants, the signal peptide may preferably direct the protein to the apoplast, the primary site of fungal colonization. When the antifungal proteins of the invention are of bacterial origin, the native fungal signal peptide should be replaced by a plant signal peptide, for example by the maize β-expansin 1 signal peptide (Fursova O et al., Ann Bot. 2012 110(1):47-56; Wu Y et al., Plant Physiol. 2001 126(1) 222-232). Bacterial-originated anti-fungal protein may also include lipid-anchor sequences, which should be modified and/or replaced for effective expression in plant cells.

According to certain embodiments of the present invention, a signal peptide required for expression in specific bacterium or plant species needs to be added or replace the native signal peptide. It is to be explicitly understood that polynucleotides and polypeptides optimized for expression in plant or bacterial cells by modification of their native N-terminus are encompassed within the scope of the present invention, although the global identity of the modified polypeptide to its parent peptide may be less than 70%. A polypeptide that was modified by removal of a native signal peptide thereof is considered herein as a "fragment polypeptide" or a "derived polypeptide", which includes the amino acid sequence of the mature polypeptide, without the native signal peptide of either a curated or an isolated natural polypeptide. As used herein, the term "optimized polypeptide" refers to a polypeptide encoded by a polynucleotide modified for optimized expression in a desired organism.

According to additional aspect, the present invention provides an isolated or recombinant polynucleotide encoding a polypeptide at least about 70%, at least about 71%, at least about 72%, at least about 73%, at least about 74%, at least about 75%, at least about 76%, at least about 77%, at least about 78%, at least about 79% or more homologous to a polypeptide having an amino acid sequence selected from the group consisting of SEQ ID NOs:2635, 2444-2634, 2636-4252; or at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to an amino acid sequence selected from the group consisting of SEQ ID NOs:326, 360, 308-325, 327-359, 361-506 and 2635, 2444-2634, 2636-4252, a fragment and/or a variant thereof. According to certain embodiments, the present invention provides an isolated polynucleotide encoding a polypeptide comprising the amino acid sequence set forth in any one of SEQ ID NOs:326, 360, 308-325, 327-359, 361-508 and 2635, 2444-2634, 2636-4252. According to additional embodiments, the present invention provides an isolated polypeptide consisting of the amino acid sequence set forth in any one of SEQ ID NOs:326, 360, 308-325, 327-359, 361-508 and 2635, 2444-2634, 2636-4252, a fragment and/or a variant thereof. According to certain embodiments, the present invention provides an isolated or recombinant polynucleotide encoding a polypeptide comprising the amino acid sequence set forth in any one of SEQ ID NOs:507-598. According to certain embodiments, the present invention provides an isolated or recombinant polynucleotide encoding a polypeptide consisting of the amino acid sequence set forth in any one of SEQ ID NOs:507-508. Each possibility represents a separate embodiment of the present invention.

The invention also encompasses fragments of the above described polynucleotides and polypeptides having mutations, such as deletions, insertions or substitutions of one or more amino acids, either naturally occurring or man induced, either randomly or in a targeted fashion.

Expression in plants of polypeptides isolated from bacteria according to some embodiments of the present invention may require modifying the polypeptide sequences for optimized expression. For example, signal peptides forming part of bacterial polypeptides should be typically removed, and optionally replaced with adequate signal peptides which will direct the localization of the polypeptide to a desired plant compartment.

According to certain embodiments, the bacterial polypeptide fragment comprises an amino acid sequence selected from the group consisting of SEQ ID NOs:4647-4799.

According to additional aspect, the present invention provides an isolated polynucleotide, a fragment or a mutant thereof, the polynucleotide comprising a nucleic acids sequence at least about 70%, at least about 71%, at least about 72%, at least about 73%, at least about 74%, at least about 75%, at least about 76%, at least about 77%, at least about 78%, at least about 79% or more homologous to a polynucleotide having a nucleic acid sequence selected from the group consisting of SEQ ID NOs:783, 592-782, 784-2443; or at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to a nucleic acid sequence selected from the group consisting of SEQ ID NOs:40, 80, 22-39, 41-79, 81-301 and 783, 592-782, 784-2443. According to certain embodiments, the present invention provides an isolated polynucleotide, a fragment or a mutant thereof, the polynucleotide comprising the nucleic acid sequence set forth in any one of SEQ ID NOs:40, 80, 22-39, 41-79, 81-305 and 783, 592-782, 784-2443. According to additional embodiments, the present invention provides an isolated polynucleotide consisting of the nucleic acid sequence set forth in any one of SEQ ID NOs:40, 80, 22-39, 41-79, 81-305 and 783, 592-782, 784-2443.

According to certain aspects, the present invention provides a recombinant polynucleotide optimized for polypeptide expression in a bacterial expression system, wherein the polypeptide is capable of inhibiting the growth of at least one pathogenic fungus and/or Oomycete.

According to certain exemplary embodiment the bacterium is *Escherichia coli*. According to these embodiments, the polypeptide comprises an amino acid sequence selected from the group consisting of SEQ ID NOs:4468, 4450-4467, and 4469-4646. According to certain embodiments, the recombinant polynucleotide comprises a nucleic acid sequence selected from the group consisting of SEQ ID NOs:4271, 4253-4270, and 4272-4449.

According to certain exemplary embodiments, the recombinant polynucleotide optimized for polypeptide expression in the bacterial expression system further comprises said bacterium signal peptide.

The isolated polynucleotides and polypeptides of the present invention and the fragment thereof are associated with conferring and/or increasing the resistance of a plant to at least one pathogenic fungus and/or Oomycete.

According to some embodiments of the invention, the exogenous polynucleotide is a non-coding RNA.

As used herein the phrase 'non-coding RNA" refers to an RNA molecule which does not encode an amino acid sequence (a polypeptide). Examples of such non-coding RNA molecules include, but are not limited to, an antisense RNA, a pre-miRNA (precursor of a microRNA), or a precursor of a Piwi-interacting RNA (piRNA).

Thus, the invention encompasses nucleic acid sequences described hereinabove; fragments thereof, sequences hybridizable therewith, sequences homologous thereto, sequences encoding similar polypeptides with different codon usage, altered sequences characterized by mutations, such as deletion, insertion or substitution of one or more nucleotides, either naturally occurring or man induced, either randomly or in a targeted fashion.

According to additional aspect, the present invention provides a nucleic acid construct comprising the isolated polynucleotide of the invention, further comprising at least one regulatory element for directing transcription of the nucleic acid sequence in a host plant cell.

According to some embodiments of the invention, expressing the exogenous polynucleotide of the invention within a plant is affected by transforming one or more cells of the plant with the exogenous polynucleotide, followed by generating a mature plant from the transformed cells and cultivating the mature plant under conditions suitable for expressing the exogenous polynucleotide within the mature plant.

According to some embodiments of the invention, the transformation is affected by introducing to the plant cell a nucleic acid construct which includes the exogenous polynucleotide of some embodiments of the invention and at least one promoter for directing transcription of the exogenous polynucleotide in a host cell (a plant cell). Further details of suitable transformation approaches are provided hereinbelow.

As mentioned, the nucleic acid construct according to some embodiments of the invention comprises a promoter sequence and the isolated polynucleotide of some embodiments of the invention.

According to some embodiments of the invention, the isolated polynucleotide is operably linked to the promoter sequence.

A coding nucleic acid sequence is "operably linked" to a regulatory sequence (e.g., promoter) if the regulatory sequence is capable of exerting a regulatory effect on the coding sequence linked thereto.

As used herein, the term "promoter" refers to a region of DNA which lies upstream of the transcriptional initiation site of a gene to which RNA polymerase binds to initiate transcription of RNA. The promoter controls where (e.g., which portion of a plant) and/or when (e.g., at which stage or condition in the lifetime of an organism) the gene is expressed.

According to some embodiments of the invention, the promoter is heterologous to the isolated polynucleotide and/or to the host cell.

As used herein the phrase "heterologous promoter" refers to a promoter from a different species or from the same species but from a different gene locus as of the isolated polynucleotide sequence.

According to some embodiments of the invention, the isolated polynucleotide is heterologous to the plant cell (e.g., the polynucleotide is derived from a different plant species when compared to the plant cell, thus the isolated polynucleotide and the plant cell are not from the same plant species).

Any suitable promoter sequence can be used by the nucleic acid construct of the present invention. Preferably the promoter is selected from the group consisting of a constitutive promoter, a tissue-specific, or biotic-stress specific promoter, particularly promoters inducible by fungi infection.

According to some embodiments of the invention, the promoter is a plant promoter, which is suitable for expression of the exogenous polynucleotide in a plant cell.

Suitable promoters for expression in planta include, but are not limited to, Wheat SPA promoter (SEQ ID NO:1; Albani et al, 1997. Plant Cell, 9:171-184); wheat LMW [SEQ ID NO:2 (longer LMW promoter) and SEQ ID NO:3 (LMW promoter)]; HMW glutenin-1 [SEQ ID NO:4; (Wheat HMW glutenin-1 longer promoter); and SEQ ID NO:5 (Wheat HMW glutenin-1 Promoter); Thomas and Flavell, 1990. The Plant Cell 2:1171-1180; Furtado et al., 2009. Plant Biotechnology Journal 7:240-253]; wheat alpha, beta and gamma gliadins [e.g., SEQ ID NO:6 (wheat alpha gliadin, B genome, promoter); SEQ ID NO:7 (wheat gamma gliadin promoter); Rafalski J A et al. 1984. EMBO 3:1409-1415], wheat TdPR60 [SEQ ID NO:8 (wheat TdPR60 longer promoter) or SEQ ID NO:9 (wheat TdPR60 promoter); Kovalchuk et al., 2009. Plant Mol Biol 71:81-98], maize Ub1 Promoter [cultivar Nongda 105 (SEQ ID NO:10); GenBank: DQ141598.1; Taylor et al., 1993. Plant Cell Rep 12: 491-495; and cultivar B73 (SEQ ID NO:11; Christensen, A H et al. 1992. Plant Mol. Biol. 18(4):675-689); rice actin 1 (SEQ ID NO:12; Mc Elroy et al. 1990, The Plant Cell (2):163-171 rice GOS2 [SEQ ID NO:13 (rice GOS2 longer promoter) and SEQ ID NO:14 (rice GOS2 Promoter); De Pater et al. 1992. Plant J. 2: 837-44], arabidopsis Pho1 [SEQ ID NO:15 (arabidopsis Pho1 Promoter); Hamburger et al., Plant Cell. 2002; 14: 889-902], ExpansinB promoters, e.g., rice ExpB5 [SEQ ID NO:16 (rice ExpB5 longer promoter) and SEQ ID NO:17 (rice ExpB5 promoter)] and Barley ExpB1 [SEQ ID NO:18 (barley ExpB1 Promoter); Won et al. Mol Cells. 2010. 30:369-76], barley SS2 (sucrose synthase 2; SEQ ID NO:19; Guerin and Carbonero, 1997. Plant Physiology 114(1):55-62), and rice PG5a (SEQ ID NO:20; U.S. Pat. No. 7,700,835; Nakase et al., 1996. Plant Mol Biol. 32:621-30).

Suitable constitutive promoters include, for example, CaMV 35S promoter [SEQ ID NO:21 (CaMV 35S (pQXNc) Promoter); SEQ ID NO:22 (PJJ 35S from Brachypodium); SEQ ID NO:23 (CaMV 35S (OLD) Promoter; Odell et al., Nature 313:810-812, 1985)], Arabidopsis At6669 promoter [SEQ ID NO:24 (Arabidopsis At6669 (OLD) Promoter; see PCT Publication No. WO04081173 or the new At6669 promoter (SEQ ID NO:25 (Arabidopsis At6669 (NEW) Promoter)]; maize Ub1 Promoter [cultivar Nongda 105 (SEQ ID NO:10); and cultivar B73 (SEQ ID NO:11)]; rice actin 1 (SEQ ID NO:12); pEMU (Last et al., 1991. Theor. Appl. Genet. 81:581-588); CaMV 19S (Nilsson et al., 1997. Physiol. Plant 100:456-462); rice GOS2 [SEQ ID NO:13 (rice GOS2 longer Promoter) and SEQ ID NO: 14 (rice GOS2 Promoter); RBCS promoter (SEQ ID NO:26); Rice cyclophilin (Bucholz et al., 1994 Plant Mol Biol. 25(5):837-43); Maize H3 histone (Lepetit et al., 1992 Mol. Gen. Genet. 231: 276-285); Actin 2 (An et al., 1996. Plant J. 10(1); 107-121) and Synthetic Super MAS (Ni et al., 1995. The Plant Journal 7: 661-676). Other constitutive promoters include those in U.S. Pat. Nos. 5,659,026; 5,608,149; 5,608, 144; 5,604,121; 5,569,597: 5,466,785; 5,399,680; 5,268, 463; and 5,608,142.

Suitable tissue-specific promoters include, but are not limited to, leaf-specific promoters [e.g., AT5G06690 (Thioredoxin), high expression, SEQ ID NO:27); AT5G61520 (AtSTP3, low expression, SEQ ID NO:28, described in Buttner et al., 2000. Plant, Cell and Environment 23:175-184); or the promoters described in Yamamoto et al., 1997. Plant J. 12:255-265; Kwon et al., 1994. Plant Physiol. 105:357-67; Yamamoto et al., 1994. Plant Cell Physiol. 35:773-778; Gotor et al., 1993. Plant J. 3:509-18; Orozco et al., Plant Mol. Biol. 1993. 23:1129-1138; and Matsuoka et al., 1993. Proc. Natl. Acad. Sci. USA 90:9586-9590; as well as Arabidopsis STP3 (AT5G61520) promoter (Buttner et al., 2000. Plant, Cell and Environment 23:175-184]; seed-preferred promoters [e.g., Napin (originated from *Brassica napus* which is characterized by a seed specific promoter activity; Stuitje A. R. et. al. 2003. Plant Biotechnology Journal 1(4):301-309; SEQ ID NO:29 (*Brassica napus* NAPIN Promoter) from seed specific genes (Simon, et al., 1985. Plant Mol. Biol. 5:191; Scofield, et al., 1987. J. Biol. Chem. 262:12202; Baszczynski, et al., 1990. Plant Mol. Biol. 14:633), rice PG5a (SEQ ID NO:20; U.S. Pat. No. 7,700,835), early seed development *Arabidopsis* BAN (AT1G61720) (SEQ ID NO:30, US 2009/0031450), late seed development Arabidopsis ABI3 (AT3G24650) (SEQ ID NO:31 (Arabidopsis ABI3 (AT3G24650) longer Promoter) or SEQ ID NO:32 (Arabidopsis ABI3 (AT3G24650) Promoter)) (Ng et al., 2004. Plant Molecular Biology 54: 25-38), Brazil Nut albumin (Pearson' et al., 1992. Plant Mol. Biol. 18: 235-245), legumin (Ellis, et al. 1988. Plant Mol. Biol. 10: 203-214), Glutelin (rice) (Takaiwa et al., 1986. Mol. Gen. Genet. 208:15-22; Takaiwa et al., 1987. FEBS Letts. 221: 43-47), Zein (Matzke et al., 1990. Plant Mol Biol, (143):323-332), napA (Stalberg et al., 1996. Planta 199:515-519); Wheat SPA (SEQ ID NO:1); sunflower oleosin (Cummins et al., 1992. Plant Mol. Biol. 19: 873-876); endosperm specific promoters [e.g., wheat LMW (SEQ ID NO:2; Wheat LMW Longer Promoter), and SEQ ID NO:3 (Wheat LMW Promoter)] and HMW glutenin-1 [(SEQ ID NO:4 (Wheat HMW glutenin-1 longer Promoter); and SEQ ID NO:5 (Wheat HMW glutenin-1 Promoter); Colot et al., Mol Gen Genet 216:81-90, 1989; Olin et al., NAR 17:461-2, 1989), wheat alpha, beta and gamma gliadins (SEQ ID NO:6 (wheat alpha gliadin (B genome) promoter); SEQ ID NO:7 (wheat gamma gliadin promoter); Barley ltr1 promoter, barley B1, C, D hordein (Cho et al., Theor Appl Gen 98:1253-62, 1999; Muller et al., Plant J 4:343-55, 1993; Sorenson et al., Mol Gen Genet 250:750-60, 1996), Barley DOF (Mena et al., 1998. The Plant Journal 116(1):53-62), Biz2 (EP99106056.7), Barley SS2 (SEQ ID NO:19), wheat Tarp60 (Kovalchuk et al., 2009. Plant Mol Biol 71:81-98), barley D-hordein (D-Hor) and B-hordein (B-Hor) (Agnelo F et al., 2009. Plant Biotech J 793):240-253)], Synthetic promoter (Vicente-Carbajosa et al., 1998. Plant J. 13: 629-640), rice prolamin NRP33, rice-globulin Glb-1 (Wu et al., 1998. Plant Cell Physiology 39(8) 885-889), rice alpha-globulin REB/OHP-1 (Nakase et al. 1997. Plant Mol. Biol. 33: 513-S22), rice ADP-glucose PP (Russell et al., Trans Res 6:157-68, 1997), maize ESR gene family (Opsahl-Ferstad et al., Plant J 12:235-46, 1997), sorghum gamma-kafirin (DeRose et al., PMB 32:1029-35, 1996)], embryo specific promoters [e.g., rice OSH1 (Sato et al., Proc. Natl. Acad. Sci. USA, 93: 8117-8122, 1996), KNOX (Postma-Haarsma et al., 1999. Plant Mol. Biol. 39:257-71), rice oleosin (Wu et al., 1998. J. Biochem., 123:386], and flower-specific promoters [e.g., AtPRP4, chalene synthase (chsA) (Van der Meer et al., 1990. Plant Mol. Biol. 15, 95-109), LAT52 (Twell et al., 1989. Mol. Gen Genet 217:240-245), *Arabidopsis apetala*-3 (Tilly et al., 1998. Development 125:1647-57), *Arabidopsis apetala* 1 (AT1G69120, AP1) (SEQ ID NO:33 (Arabidopsis (AT1G69120) APETALA 1)) (Hempel et al., 1997. Development 124:3845-3853)], and root promoters [e.g., the ROOTP promoter [SEQ ID NO:34]; rice ExpB5 [SEQ ID NO:17 (rice ExpB5 Promoter); or SEQ ID NO:16 (rice ExpB5 longer Promoter)] and barley ExpB1 promoters (SEQ ID NO:18) (Won et al. 2010. Mol. Cells 30: 369-376); Arabidopsis ATTPS-CIN (AT3G25820) promoter (SEQ ID NO:35; Chen et al., 2004. Plant Phys 135:1956-66); Arabidopsis Pho1 promoter (SEQ ID NO: 15), which is also slightly induced by stress].

The nucleic acid construct of some embodiments of the invention can further include an appropriate selectable marker and/or an origin of replication. According to some embodiments of the invention, the nucleic acid construct utilized is a shuttle vector, which can propagate both in *E. coli* (wherein the construct comprises an appropriate selectable marker and origin of replication) and be compatible with propagation in cells. The construct according to the present invention can be, for example, a plasmid, a bacmid, a phagemid, a cosmid, a phage, a virus or an artificial chromosome.

The nucleic acid construct of some embodiments of the invention can be utilized to stably or transiently transform plant cells. In stable transformation, the exogenous polynucleotide is integrated into the plant genome and as such it represents a stable and inherited trait. In transient transformation, the exogenous polynucleotide is expressed by the cell transformed but it is not integrated into the genome and as such it represents a transient trait.

There are various methods of introducing foreign genes into both monocotyledonous and dicotyledonous plants (Potrykus, I., Annu. Rev. Plant. Physiol. & Plant. Mol. Biol. 1991. 42:205-225; Shimamoto et al., 1989. Nature 338:274-276).

The principle methods of causing stable integration of exogenous DNA into plant genomic DNA include two main approaches:

(i) *Agrobacterium*-mediated gene transfer: Klee et al., (1987) Annu. Rev. Plant Physiol. 38:467-486; Klee and Rogers in Cell Culture and Somatic Cell Genetics of Plants, Vol. 6, Molecular Biology of Plant Nuclear Genes, eds. Schell, J., and Vasil, L. K., Academic Publishers, San Diego, Calif. (1989) p. 2-25; Gatenby, in Plant Biotechnology, eds. Kung, S. and Arntzen, C. J., Butterworth Publishers, Boston, Mass. (1989) p. 93-112.

(ii) Direct DNA uptake: Paszkowski et al., in Cell Culture and Somatic Cell Genetics of Plants, Vol. 6, Molecular Biology of Plant Nuclear Genes eds. Schell, J., and Vasil, L. K., Academic Publishers, San Diego, Calif. (1989) p. 52-68; including methods for direct uptake of DNA into protoplasts, Toriyama, K. et al. (1988) Bio/Technology 6:1072-1074. DNA uptake induced by brief electric shock of plant cells: Zhang et al. Plant Cell Rep. (1988) 7:379-384. Fromm et al. Nature (1986) 319:791-793. DNA injection into plant cells or tissues by particle bombardment, Klein et al. Bio/Technology (1988) 6:559-563; McCabe et al. Bio/Technology (1988) 6:923-926; Sanford, Physiol. Plant. (1990) 79:206-209; by the use of micropipette systems: Neuhaus et al., Theor. Appl. Genet. (1987) 75:30-36; Neuhaus and Spangenberg, Physiol. Plant. (1990) 79:213-217; glass fibers or silicon carbide whisker transformation of cell cultures, embryos or callus tissue, U.S. Pat. No. 5,464,765 or by the direct incubation of DNA with germinating pollen, DeWet et al. in Experimental Manipulation of Ovule Tissue, eds. Chapman, G. P. and Mantell, S. H. and Daniels, W. Longman, London, (1985) p. 197-209; and Ohta, Proc. Natl. Acad. Sci. USA (1986) 83:715-719.

The *Agrobacterium* system includes the use of plasmid vectors that contain defined DNA segments that integrate into the plant genomic DNA. Methods of inoculation of the plant tissue vary depending upon the plant species and the Agrobacterium delivery system. A widely used approach is the leaf disc procedure which can be performed with any tissue explant that provides a good source for initiation of whole plant differentiation. See, e.g., Horsch et al. in Plant Molecular Biology Manual A5, Kluwer Academic Publishers, Dordrecht (1988) p. 1-9. A supplementary approach employs the Agrobacterium delivery system in combination with vacuum infiltration. The Agrobacterium system is especially viable in the creation of transgenic dicotyledonous plants.

There are various methods of direct DNA transfer into plant cells. In electroporation, the protoplasts are briefly exposed to a strong electric field. In microinjection, the DNA is mechanically injected directly into the cells using very small micropipettes. In microparticle bombardment, the DNA is adsorbed on microprojectiles such as magnesium sulfate crystals or tungsten particles, and the microprojectiles are physically accelerated into cells or plant tissues.

Following stable transformation plant propagation is exercised. The most common method of plant propagation is by seed. Regeneration by seed propagation, however, has the deficiency that due to heterozygosity there is a lack of uniformity in the crop, since seeds are produced by plants according to the genetic variances governed by Mendelian rules. Basically, each seed is genetically different and each will grow with its own specific traits. Therefore, it is preferred that the transformed plant be produced such that the regenerated plant has the identical traits and characteristics of the parent transgenic plant. Therefore, it is preferred that the transformed plant be regenerated by micropropagation which provides a rapid, consistent reproduction of the transformed plants.

Micropropagation is a process of growing new generation plants from a single piece of tissue that has been excised from a selected parent plant or cultivar. This process permits the mass reproduction of plants having the preferred tissue expressing the fusion protein. The new generation plants which are produced are genetically identical to, and have all of the characteristics of, the original plant. Micropropagation allows mass production of quality plant material in a short period of time and offers a rapid multiplication of selected cultivars in the preservation of the characteristics of the original transgenic or transformed plant. The advantages of cloning plants are the speed of plant multiplication and the quality and uniformity of plants produced.

Micropropagation is a multi-stage procedure that requires alteration of culture medium or growth conditions between stages. Thus, the micropropagation process involves four basic stages: Stage one, initial tissue culturing; stage two, tissue culture multiplication; stage three, differentiation and plant formation; and stage four, greenhouse culturing and hardening. During stage one, initial tissue culturing, the tissue culture is established and certified contaminant-free. During stage two, the initial tissue culture is multiplied until a sufficient number of tissue samples are produced from the seedlings to meet production goals. During stage three, the tissue samples grown in stage two are divided and grown into individual plantlets. At stage four, the transformed plantlets are transferred to a greenhouse for hardening where the plants' tolerance to light is gradually increased so that it can be grown in the natural environment.

According to some embodiments of the invention, the transgenic plant is generated by transient transformation of leaf cells, meristematic cells or the whole plant.

Transient transformation can be performed by any of the direct DNA transfer methods described above or by viral infection using modified plant viruses.

Viruses that have been shown to be useful for the transformation of plant hosts include, for example, Cauliflower mosaic virus (CaMV), Tobacco mosaic virus (TMV), brome mosaic virus (BMV) and Bean Common Mosaic Virus (BV or BCMV). Methods for transformation of plants using plant viruses are well known in the art; see, e.g. U.S. Pat. No. 4,855,237; Gluzman, Y. et al., Communications in Molecular Biology: Viral Vectors, Cold Spring Harbor Laboratory, New York, pp. 172-189 (1988); and Mortimer C et al., 2015. Current Opinion in Biotechnology 32:85-92). Pseudovirus particles for use in expressing foreign DNA in many hosts, including plants are described in WO 87/06261.

According to some embodiments of the invention, the virus used for transient transformations is avirulent and thus is incapable of causing severe symptoms such as reduced growth rate, mosaic, ring spots, leaf roll, yellowing, streaking, pox formation, tumor formation and pitting. A suitable avirulent virus may be a naturally occurring avirulent virus or an artificially attenuated virus. Virus attenuation may be performed by using methods well known in the art including, but not limited to, sub-lethal heating, chemical treatment or by directed mutagenesis techniques such as described, for example, by Kurihara and Watanabe (Molecular Plant Pathology 4:259-269, 2003), Gal-On et al., J Gener Viriol 73: 2183-87 (1992), Atreya et al. Viriology 191:106-11 (1992) and Huet et al. Viriology 75: 1407-14 (1994).

Suitable virus strains can be obtained from available sources such as, for example, the American Type culture Collection (ATCC) or by isolation from infected plants.

Isolation of viruses from infected plant tissues can be effected by techniques well known in the art such as described, for example by Foster and Taylor, Eds. "Plant Virology Protocols: From Virus Isolation to Transgenic Resistance (Methods in Molecular Biology Vol 81 Humana Press, 1998). Briefly, tissues of an infected plant believed to contain a high concentration of a suitable virus, preferably young leaves and flower petals, are ground in a buffer solution (e.g., phosphate buffer solution) to produce a virus infected sap which can be used in subsequent inoculations.

Construction of plant RNA viruses for the introduction and expression of non-viral exogenous polynucleotide sequences in plants is demonstrated by the above references as well as by Dawson, W. O. et al., 1989. Virology 172: 285-292; Takamatsu et al. 1987. EMBO J 6:307-311; French et al. 1986. Science 231:1294-1297; Takamatsu et al. 1990. FEBS Letters 269:73-76; and U.S. Pat. No. 5,316,931.

When the virus is a DNA virus, suitable modifications can be made to the virus itself. Alternatively, the virus can first be cloned into a bacterial plasmid for ease of constructing the desired viral vector with the foreign DNA. The virus can then be excised from the plasmid. If the virus is a DNA virus, a bacterial origin of replication can be attached to the viral DNA, which is then replicated by the bacteria. Transcription and translation of this DNA will produce the coat protein which will encapsidate the viral DNA. If the virus is an RNA virus, the virus is generally cloned as a cDNA and inserted into a plasmid. The plasmid is then used to make all of the constructions. The RNA virus is then produced by transcribing the viral sequence of the plasmid and translation of the viral genes to produce the coat protein(s) which encapsidate the viral RNA.

In one embodiment, a plant viral polynucleotide is provided in which the native coat protein coding sequence has been deleted from a viral polynucleotide, a non-native plant viral coat protein coding sequence and a non-native promoter, preferably the subgenomic promoter of the non-native coat protein coding sequence, capable of expression in the plant host, packaging of the recombinant plant viral polynucleotide, and ensuring a systemic infection of the host by the recombinant plant viral polynucleotide, has been inserted. Alternatively, the coat protein gene may be inactivated by insertion of the non-native polynucleotide sequence within it, such that a protein is produced. The recombinant plant viral polynucleotide may contain one or more additional non-native subgenomic promoters. Each non-native subgenomic promoter is capable of transcribing or expressing adjacent genes or polynucleotide sequences in the plant host and incapable of recombination with each other and with native subgenomic promoters. Non-native (foreign) polynucleotide sequences may be inserted adjacent the native plant viral subgenomic promoter or the native and a non-native plant viral subgenomic promoters if more than one polynucleotide sequence is included. The non-native polynucleotide sequences are transcribed or expressed in the host plant under control of the subgenomic promoter to produce the desired products.

In a second embodiment, a recombinant plant viral polynucleotide is provided as in the first embodiment except that the native coat protein coding sequence is placed adjacent one of the non-native coat protein subgenomic promoters instead of a non-native coat protein coding sequence.

In a third embodiment, a recombinant plant viral polynucleotide is provided in which the native coat protein gene is adjacent its subgenomic promoter and one or more non-native subgenomic promoters have been inserted into the viral polynucleotide. The inserted non-native subgenomic promoters are capable of transcribing or expressing adjacent genes in a plant host and are incapable of recombination with each other and with native subgenomic promoters. Non-native polynucleotide sequences may be inserted adjacent the non-native subgenomic plant viral promoters such that the sequences are transcribed or expressed in the host plant under control of the subgenomic promoters to produce the desired product.

In a fourth embodiment, a recombinant plant viral polynucleotide is provided as in the third embodiment except that the native coat protein coding sequence is replaced by a non-native coat protein coding sequence.

The viral vectors are encapsidated by the coat proteins encoded by the recombinant plant viral polynucleotide to produce a recombinant plant virus. The recombinant plant viral polynucleotide or recombinant plant virus is used to infect appropriate host plants. The recombinant plant viral polynucleotide is capable of replication in the host, systemic spread in the host, and transcription or expression of foreign gene(s) (exogenous polynucleotide) in the host to produce the desired protein.

Techniques for inoculation of viruses to plants may be found, for example, in Foster and Taylor, Eds. "Plant Virology Protocols: From Virus Isolation to Transgenic Resistance (Methods in Molecular Biology (Humana Pr), Vol 81)", Humana Press, 1998; Maramorosh and Koprowski, Eds. "Methods in Virology" 7 vols, Academic Press, New York 1967-1984; Hill, S. A. "Methods in Plant Virology", Blackwell, Oxford, 1984; Walkey, D. G. A. "Applied Plant Virology", Wiley, New York, 1985; and Kado and Agrawa, eds. "Principles and Techniques in Plant Virology", Van Nostrand-Reinhold, New York.

In addition to the above, the polynucleotide of the present invention can also be introduced into a chloroplast genome thereby enabling chloroplast expression.

A technique for introducing exogenous polynucleotide sequences to the genome of the chloroplasts is known. This technique involves the following procedures. First, plant cells are chemically treated so as to reduce the number of chloroplasts per cell to about one. Then, the exogenous polynucleotide is introduced via particle bombardment into the cells with the aim of introducing at least one exogenous polynucleotide molecule into the chloroplasts. The exogenous polynucleotides selected such that it is integratable into the chloroplast's genome via homologous recombination which is readily performed by enzymes inherent to the chloroplast. To this end, the exogenous polynucleotide includes, in addition to a gene of interest, at least one polynucleotide stretch which is derived from the chloroplast's genome. In addition, the exogenous polynucleotide includes a selectable marker, which serves by sequential selection procedures to ascertain that all or substantially all of the copies of the chloroplast genomes following such selection will include the exogenous polynucleotide. Further details relating to this technique are found in U.S. Pat. Nos. 4,945,050; and 5,693,507 which are incorporated herein by reference. A polypeptide can thus be produced by the protein expression system of the chloroplast and become integrated into the chloroplast's inner membrane.

According to some embodiments of the invention, the transformed plant is homozygote to the transgene (i.e., the exogenous polynucleotide of some embodiments of the invention), and accordingly all seeds generated thereby include the transgene.

Expressing a plurality of exogenous polynucleotides in a single host plant can be effected by co-introducing multiple nucleic acid constructs, each including a different exogenous polynucleotide, into a single plant cell. The transformed cell can then be regenerated into a mature plant using the methods described hereinabove.

Alternatively, expressing a plurality of exogenous polynucleotides in a single host plant can be effected by co-introducing into a single plant-cell a single nucleic-acid construct including a plurality of different exogenous polynucleotides. Such a construct can be designed with a single promoter sequence which can transcribe a polycistronic messenger RNA including all the different exogenous polynucleotide sequences. To enable co-translation of the different polypeptides encoded by the polycistronic messenger RNA, the polynucleotide sequences can be inter-linked via an internal ribosome entry site (IRES) sequence which facilitates translation of polynucleotide sequences positioned downstream of the IRES sequence. In this case, a transcribed polycistronic RNA molecule encoding the different polypeptides described above will be translated from both the capped 5' end and the two internal IRES sequences of the polycistronic RNA molecule to thereby produce in the cell all different polypeptides. Alternatively, the construct can include several promoter sequences each linked to a different exogenous polynucleotide sequence.

The plant cell transformed with the construct including a plurality of different exogenous polynucleotides can be regenerated into a mature plant, using the methods described hereinabove.

Alternatively, expressing a plurality of exogenous polynucleotides in a single host plant can be effected by introducing different nucleic acid constructs, including different exogenous polynucleotides, into a plurality of plants. The regenerated transformed plants can then be cross-bred and resultant progeny selected for superior abiotic stress tolerance, water use efficiency, fertilizer use efficiency, early flowering, grain filling period, harvest index, plant height, growth, biomass, yield and/or vigor traits, using conventional plant breeding techniques.

According to certain embodiments, enhancing the resistance of the plant or part thereof to the pathogenic fungus comprises reducing the expression and/or activity of the at least one polypeptide compared to its expression and/or activity in the control plant.

Any method as is known in the art for reducing the expression and/or activity of a plant endogenous protein and the polynucleotide encoding same can be used according to the teachings of the resent invention.

According to certain embodiment of the invention, reducing the expression and/or activity of a polypeptide of the invention within a plant cell comprising transforming the plant cell with a polynucleotide that inhibits the expression of said polypeptide. The polynucleotide may inhibit the transcription or translation of a polynucleotide encoding said polypeptide or can encode for an inhibitory polypeptide interfering with the translation or activity of said polypeptide.

Polynucleotide-Based Methods

According to some embodiments of the present disclosure, a plant is transformed with a polynucleotide that inhibits the expression of a polypeptide of the invention. According to certain exemplary embodiments, the plant cell is transformed within a construct capable of expressing the inhibitory polynucleotide. The term "expression" as used herein refers to the biosynthesis of a gene product, including the transcription and/or translation of said gene product. For example, for the purposes of the present invention, a construct capable of expressing the inhibitory polynucleotide is capable of producing an RNA molecule that inhibits the transcription and/or translation of a polypeptide of the invention. The "expression" or "production" of a protein or polypeptide from a DNA molecule refers to the transcription and translation of the coding sequence to produce the protein or polypeptide, while the "expression" or "production" of a protein or polypeptide from an RNA molecule refers to the translation of the RNA coding sequence to produce the protein or polypeptide. Examples of polynucleotides that inhibit the expression of a CCT polypeptide are given below.

Sense Suppression/Co-Suppression

According to certain embodiments, inhibition of the expression of a polypeptide of the invention may be obtained by sense suppression or co-suppression. For co-suppression, a construct is designed to express an RNA molecule corresponding to all or part of a messenger RNA encoding the polypeptide in the "sense" orientation. Over-expression of the RNA molecule can result in reduced expression of the native gene. Accordingly, multiple plant lines transformed with the co-suppression constructs are screened to identify those that show the greatest inhibition of the polypeptide expression.

The polynucleotide used for co-suppression may correspond to all or part of the sequence encoding the polypeptide of the invention, all or part of the 5' and/or 3' untranslated region of said polypeptide transcript or all or part of both the coding sequence and the untranslated regions of a transcript encoding said polypeptide. In some embodiments where the polynucleotide comprises all or part of the coding region for said polypeptide, the construct is designed to eliminate the start codon of the polynucleotide so that no protein product will be translated.

Co-suppression may be used to inhibit the expression of plant genes to produce plants having undetectable protein levels for the proteins encoded by these genes. See, for example, Broin, et al., (2002) Plant Cell 14:1417-1432. Co-suppression may also be used to inhibit the expression of multiple proteins in the same plant. See, for example, U.S. Pat. No. 5,942,657. Methods for using co-suppression to inhibit the expression of endogenous genes in plants are described, for example, in Yu, et al., Phytochemistry (2003) 63:753-763 and U.S. Pat. Nos. 5,034,323, 5,283,184 and 5,942,657. The efficiency of co-suppression may be increased by including a poly-dT region in the expression cassette at a position 3' to the sense sequence and 5' of the polyadenylation signal. See for example, US Patent Application Publication Number 2002/0048814. Typically, such a nucleotide sequence has substantial sequence identity to the sequence of the transcript of the endogenous gene, optimally greater than about 65% sequence identity, more optimally greater than about 85% sequence identity, most optimally greater than about 95% sequence identity (U.S. Pat. Nos. 5,283,184 and 5,034,323).

Antisense Suppression

According to some embodiments, inhibition of the expression of a polypeptide of the invention may be obtained by antisense suppression. For antisense suppression, the construct is designed to express an RNA molecule complementary to all or part of a messenger RNA encoding the polypeptide. Over-expression of the antisense RNA molecule can result in reduced expression of the native gene. Accordingly, multiple plant lines transformed with the antisense RNA are screened to identify those that show the greatest inhibition of said polypeptide expression.

The polynucleotide for use in antisense suppression may correspond to all or part of the complement of the sequence encoding the polypeptide of the invention, all or part of the complement of the 5' and/or 3' untranslated region of its transcript or all or part of the complement of both the coding sequence and the untranslated regions of a transcript encoding said polypeptide. In addition, the antisense polynucleotide may be fully complementary (i.e., 100% identical to the complement of the target sequence) or partially complementary (i.e., less than 100% identical to the complement of the target sequence) to the target sequence. Antisense suppression may be used to inhibit the expression of multiple proteins in the same plant. See, for example, U.S. Pat. No. 5,942,657. Furthermore, portions of the antisense nucleotides may be used to disrupt the expression of the target gene. Generally, sequences of at least 50 nucleotides, 100 nucleotides, 200 nucleotides, 300, 400, 450, 500, 550 or greater may be used. Methods for using antisense suppression to inhibit the expression of endogenous genes in plants are described, for example, in Liu, et al., (2002) Plant Physiol. 129:1732-1743 and U.S. Pat. Nos. 5,759,829 and 5,942,657. Efficiency of antisense suppression may be increased by including a poly-dT region in the expression cassette at a position 3' to the antisense sequence and 5' of the polyadenylation signal (see, e.g. US Patent Application Publication Number 2002/0048814).

Double-Stranded RNA Interference

According to some embodiments, inhibition of the expression of a polypeptide of the invention may be obtained by double-stranded RNA (dsRNA) interference. For dsRNA interference, a sense RNA molecule like that described above for co-suppression and an antisense RNA molecule that is fully or partially complementary to the sense RNA molecule are expressed in the same cell, resulting in inhibition of the expression of the corresponding endogenous messenger RNA.

Expression of the sense and antisense molecules can be accomplished by designing the DNA construct to comprise both a sense sequence and an antisense sequence. Alternatively, separate constructs may be used for the sense and antisense sequences. Multiple plant lines transformed with the dsRNA interference construct(s) are then screened to identify plant lines that show the greatest inhibition of the expression of the polypeptide. Methods for using dsRNA interference to inhibit the expression of endogenous plant genes are described in Waterhouse, et al., (1998) Proc. Natl. Acad. Sci. USA 95:13959-13964, Liu, et al., (2002) Plant Physiol. 129:1732-1743 and WO 1999/49029, WO 1999/53050, WO 1999/61631 and WO 2000/49035.

Hairpin RNA Interference and Intron-Containing Hairpin RNA Interference

According to some embodiments, inhibition of the expression of a polypeptide of the invention may be obtained by hairpin RNA (hpRNA) interference or intron-containing hairpin RNA (ihpRNA) interference. These methods are highly efficient at inhibiting the expression of endogenous genes. See, Waterhouse and Helliwell, (2003) Nat. Rev. Genet. 4:29-38 and the references cited therein.

For hpRNA interference, the construct is designed to express an RNA molecule that hybridizes with itself to form a hairpin structure that comprises a single-stranded loop region and a base-paired stem. The base-paired stem region comprises a sense sequence corresponding to all or part of the endogenous messenger RNA encoding the gene whose expression is to be inhibited and an antisense sequence that is fully or partially complementary to the sense sequence. Thus, the base-paired stem region of the molecule generally determines the specificity of the RNA interference. hpRNA molecules are highly efficient at inhibiting the expression of endogenous genes, and the RNA interference they induce is inherited by subsequent generations of plants. See, for example, Chuang and Meyerowitz, (2000) Proc. Natl. Acad. Sci. USA 97:4985-4990; Stoutjesdijk, et al., (2002) Plant Physiol. 129:1723-1731 and Waterhouse and Helliwell, (2003) Nat. Rev. Genet. 4:29-38. Methods for using hpRNA interference to inhibit or silence the expression of genes are described, for example, in US Patent Application Publication Number 2003/0175965. A transient assay for the efficiency of hpRNA constructs to silence gene expression in vivo has been described by Panstruga, et al., (2003) Mol. Biol. Rep. 30:135-140.

For Intron-Containing Hairpin RNA (ihpRNA) interference, the interfering molecules have the same general structure as for hpRNA, but the RNA molecule additionally comprises an intron that is capable of being spliced in the cell in which the ihpRNA is expressed. The use of an intron minimizes the size of the loop in the hairpin RNA molecule following splicing, and this increases the efficiency of interference. See, for example, Smith, et al., (2000) Nature 407:319-320. In fact, Smith, et al., shows 100% suppression of endogenous gene expression using ihpRNA-mediated interference. Methods for using ihpRNA interference to inhibit the expression of endogenous plant genes are described, for example, in US Patent Application Publication Number 2003/0180945.

The expression cassette for hpRNA interference may also be designed such that the sense sequence and the antisense sequence do not correspond to an endogenous RNA. In this embodiment, the sense and antisense sequence flank a loop sequence that comprises a nucleotide sequence corresponding to all or part of the endogenous messenger RNA of the target gene. Thus, it is the loop region that determines the specificity of the RNA interference. See, for example, WO 2002/00904.

Amplicon-Mediated Interference

Amplicon expression cassettes comprise a plant virus-derived sequence that contains all or part of the target gene but generally not all of the genes of the native virus. The viral sequences present in the transcription product of the construct allow the transcription product to direct its own replication. The transcripts produced by the amplicon may be either sense or antisense relative to the target sequence (i.e., the messenger RNA for the polypeptide of the invention). Methods of using amplicons to inhibit the expression of endogenous plant genes are described, for example, in Angell and Baulcombe, (1997) EMBO J. 16:3675-3684, Angell and Baulcombe, (1999) Plant J. 20:357-362.

Ribozymes

According to some embodiments, the polynucleotide expressed by the construct of the invention is catalytic RNA or has ribozyme activity specific for the messenger RNA of a polypeptide of the invention. Thus, the polynucleotide causes the degradation of the endogenous messenger RNA, resulting in reduced expression of said polypeptide. This method is described, for example, in U.S. Pat. No. 4,987,071.

Small Interfering RNA or Micro RNA

According to certain embodiments of the invention, inhibition of the expression of a polypeptide of the invention may be obtained by RNA interference by expression of a gene encoding a micro RNA (miRNA). miRNAs are regulatory agents consisting of about 22 ribonucleotides. miRNAs are highly efficient at inhibiting the expression of endogenous genes. See, for example, Palatnikl J F et al., (2003) Nature 425:257-263.

For miRNA interference, the construct is designed to express an RNA molecule that is modeled on an endogenous miRNA gene. The miRNA gene encodes an RNA that forms a hairpin structure containing a 22-nucleotide sequence that is complementary to another endogenous gene (target sequence). For suppressing the expression of a polypeptide of the invention, the 22-nucleotide sequence is selected from the polypeptide transcript sequence and contains 22 nucleotides of said transcript sequence in sense orientation and 21 nucleotides of a corresponding antisense sequence that is complementary to the sense sequence. miRNA molecules are highly efficient at inhibiting the expression of endogenous genes and the RNA interference they induce is inherited by subsequent generations of plants.

Polypeptide-Based Inhibition of Gene Expression

According to certain additional or alternative embodiments, the inhibitory polynucleotide encodes a zinc finger protein that binds to a gene encoding a polypeptide of the invention, resulting in reduced expression of the gene. In particular embodiments, the zinc finger protein binds to a regulatory region of a polypeptide encoding gene. In other embodiments, the zinc finger protein binds to a messenger RNA encoding said polypeptide and prevents its translation. Methods of selecting sites for targeting by zinc finger proteins have been described, for example, in U.S. Pat. No. 6,453,242 and methods for using zinc finger proteins to inhibit the expression of genes in plants are described, for example, in U.S. Pat. No. 7,151,201.

Polypeptide-Based Inhibition of Protein Activity

According to certain additional or alternative embodiments, the polynucleotide encodes an antibody that binds to a polypeptide of the invention and reduces the activity of the polypeptide. In another embodiment, the binding of the antibody results in increased turnover of the antibody-polypeptide complex by cellular quality control mechanisms. The expression of antibodies in plant cells and the inhibition of molecular pathways by expression and binding of antibodies to proteins in plant cells are well known in the art. See, for example, Conrad and Sonnewald, (2003) Nature Biotech. 21:35-36.

According to some embodiments of the invention, up-regulation or down regulation of the expression and/or activity of the polypeptide of the invention is achieved by means of genome editing.

Genome editing is a reverse genetics method which uses artificially engineered nucleases to cut and create specific double-stranded breaks at a desired location(s) in the genome, which are then repaired by cellular endogenous processes such as, homology directed repair (HDR) and non-homologous end-joining (NHEJ). NHEJ directly joins the DNA ends in a double-stranded break, while HDR utilizes a homologous sequence as a template for regenerating the missing DNA sequence at the break point. In order to introduce specific nucleotide modifications to the genomic DNA, a DNA repair template containing the desired sequence must be present during HDR. Genome editing cannot be performed using traditional restriction endonucleases since most restriction enzymes recognize a few base pairs on the DNA as their target and the probability is very high that the recognized base pair combination will be found in many locations across the genome resulting in multiple cuts not limited to a desired location. To overcome this challenge and create site-specific single- or double-stranded breaks, several distinct classes of nucleases have been discovered and bioengineered to date. These include the meganucleases, Zinc finger nucleases (ZFNs), transcription-activator like effector nucleases (TALENs) and CRISPR/Cas system.

Genome editing is a powerful tool to impact target traits by modifications of the target plant genome sequence. Such modifications can result in new or modified alleles or regulatory elements.

In addition, the traces of genome-edited techniques can be used for marker assisted selection (MAS) as is further described hereinunder. Target plants for the mutagenesis/genome editing methods according to the invention are any plants of interest including monocot or dicot plants.

Over-expression of a polypeptide by genome editing can be achieved by: (i) replacing an endogenous sequence encoding the polypeptide of interest or a regulatory sequence under which it is placed, and/or (ii) inserting a new gene encoding the polypeptide of interest in a targeted region of the genome, and/or (iii) introducing point mutations which result in up-regulation of the gene encoding the polypeptide of interest (e.g., by altering the regulatory sequences such as promoter, enhancers, 5'-UTR and/or 3'-UTR, or mutations in the coding sequence).

Down regulation of the expression of a polypeptide by gnome editing can be achieved by (i) replacing an endogenous sequence encoding a polypeptide negatively affecting a desired plant trait, according to some embodiments of the invention enhancing susceptibility of the plant to pathogenic fungi and/or Oomycete or replacing a regulatory sequence under which the endogenous sequence encoding the polypeptide is placed, and/or (ii) introducing point mutations which result in down-regulation of the gene encoding the polypeptide of interest (e.g., by altering the regulatory sequences such as promoter, enhancers, 5'-UTR and/or 3'-UTR, or mutations in the coding sequence).

Genome Editing Systems Overview

Several systems have been reported to enable genome editing implementation. Examples detailed herein below:

Meganucleases—Meganucleases are commonly grouped into four families: the LAGLIDADG family, the GIY-YIG family, the His-Cys box family and the HNH family. These families are characterized by structural motifs, which affect catalytic activity and recognition sequence. For instance, members of the LAGLIDADG family are characterized by having either one or two copies of the conserved LAGLIDADG motif. The four families of meganucleases are widely separated from one another with respect to conserved structural elements and, consequently, DNA recognition sequence specificity and catalytic activity. Meganucleases are found commonly in microbial species and have the unique property of having very long recognition sequences (>14 bp) thus making them naturally very specific for cutting at a desired location. This can be exploited to make site-specific double-stranded breaks directing modifications in regulatory elements or coding regions upon introduction of the desired sequence. One of skill in the art can use these naturally occurring meganucleases, however the number of such naturally occurring meganucleases is limited. To overcome this challenge, mutagenesis and high throughput screening methods have been used to create meganuclease variants that recognize unique sequences. For example, various meganucleases have been fused to create hybrid enzymes that recognize a new sequence. Alternatively, DNA interacting amino acids of the meganuclease can be altered to design sequence specific meganucleases (see e.g., U.S. Pat. No. 8,021,867). Meganucleases can be designed using the methods described in e.g., Certo, M T et al., 2012. Nature Methods 9:073-975; U.S. Pat. Nos. 8,304,222; 8,021,867; 8,119,381; 8,124,369; 8,129,134; 8,133,697; 8,143,015; 8,143,016; 8,148,098; or 8,163,514. Alternatively, meganucleases with site specific cutting characteristics can be obtained using commercially available technologies e.g., Precision Biosciences' Directed Nuclease Editor™ genome editing technology.

ZFNs and TALENs—Two distinct classes of engineered nucleases, zinc-finger nucleases (ZFNs) and transcription activator-like effector nucleases (TALENs), have both proven to be effective at producing targeted double-stranded breaks (Christian et al., 2010. Genetics 186:757-761; Kim et al., 1996. Proc. Natl. Acad. Sci. 93:1156-1160; Li et al., 2011. Nucleic Acids Res 39:359-372; Mahfouz et al., 2011. Proc. Natl. Acad. Sci; 108:2623-2628; Miller et al., 2010. Nat Biotechnol. 29:143-148).

Basically, ZFNs and TALENs restriction endonuclease technology utilizes a non-specific DNA cutting enzyme which is linked to a specific DNA binding domain (either a series of zinc finger domains or TALE repeats, respectively). Typically, a restriction enzyme whose DNA recognition site and cleaving site are separate from each other is selected. The cleaving portion is separated and then linked to a DNA binding domain, thereby yielding an endonuclease with very high specificity for a desired sequence. An exemplary restriction enzyme with such properties is FokI. Additionally, FokI has the advantage of requiring dimerization to have nuclease activity and this means the specificity increases dramatically as each nuclease partner recognizes a unique DNA sequence. To enhance this effect, FokI nucleases have been engineered that can only function as heterodimers and have increased catalytic activity. The heterodimer functioning nucleases avoid the possibility of unwanted homodimer activity and thus increase specificity of the double-stranded break.

Thus, for example to target a specific site, ZFNs and TALENs are constructed as nuclease pairs, with each member of the pair designed to bind adjacent sequences at the targeted site. Upon transient expression in cells, the nucleases bind to their target sites and the FokI domains heterodimerize to create a double-stranded break. Repair of these double-stranded breaks through the nonhomologous end-joining (NHEJ) pathway most often results in small deletions or small sequence insertions. Since each repair made by NHEJ is unique, the use of a single nuclease pair can produce an allelic series with a range of different deletions at the target site. The deletions typically range anywhere from a few base pairs to a few hundred base pairs in length, but larger deletions have successfully been generated in cell culture by using two pairs of nucleases simultaneously (Carlson et al., 2012. Proc. Natl. Acad. Sci 109:17382-17387; Lee et al., 2010. Genome Res 20:81-89). In addition, when a fragment of DNA with homology to the targeted region is introduced in conjunction with the nuclease pair, the double-stranded break can be repaired via homology directed repair to generate specific modifications (Li et al., 2011, ibid; Miller et al., 2010, ibid; Urnov et al., 2005. Nature, 435:646-651).

Although the nuclease portions of both ZFNs and TALENs have similar properties, the difference between these engineered nucleases is in their DNA recognition peptide. ZFNs rely on Cys2-His2 zinc fingers and TALENs on TALEs. Both of these DNA recognizing peptide domains have the characteristic that they are naturally found in combinations in their proteins. Cys2-His2 Zinc fingers typically found in repeats that are 3 bp apart and are found in diverse combinations in a variety of nucleic acid interacting proteins. TALEs on the other hand are found in repeats with a one-to-one recognition ratio between the amino acids and the recognized nucleotide pairs. Because both zinc fingers and TALEs happen in repeated patterns, different combinations can be tried to create a wide variety of sequence specificities. Approaches for making site-specific zinc finger endonucleases include, e.g., modular assembly (where Zinc fingers correlated with a triplet sequence are attached in a row to cover the required sequence), OPEN (low-stringency selection of peptide domains vs. triplet nucleotides followed by high-stringency selections of peptide combination vs. the final target in bacterial systems), and bacterial one-hybrid screening of zinc finger libraries, among others. ZFNs can also be designed and obtained commercially from e.g., Sangamo Biosciences™ (Richmond, Calif.).

Method for designing and obtaining TALENs are described in e.g. Reyon et al., 2012. Nature Biotechnology 30(5):460-5; Miller et al., 2011. Nat Biotechnol. 29:143-148; Cermak et al., 2011. Nucleic Acids Research 39 (12): e82 and Zhang et al., 2011 Nature Biotechnology 29 (2): 149-53. A recently developed web-based program named Mojo Hand was introduced by Mayo Clinic for designing TAL and TALEN constructs for genome editing applications (can be accessed through www(dot)talendesign(dot)org). TALEN can also be designed and obtained commercially from e.g., Sangamo Biosciences™ (Richmond, Calif.).

The ZFN/TALEN system capability for precise targeting can be utilized for directing modifications in regulatory elements and/or coding regions upon introduction of the sequence of interest for trait improvement.

CRISPR/Cas9—The CRISPR/Cas system for genome editing contains two distinct components: a gRNA (guide RNA) and an endonuclease e.g. Cas9.

The gRNA is typically a 20-nucleotide sequence encoding a combination of the target homologous sequence (crRNA) and the endogenous bacterial RNA that links the crRNA to the Cas9 nuclease (tracrRNA) in a single chimeric transcript. The gRNA/Cas9 complex is recruited to the target sequence by the base-pairing between the gRNA sequence and the complement genomic DNA. For successful binding of Cas9, the genomic target sequence must also contain the correct Protospacer Adjacent Motif (PAM) sequence immediately following the target sequence. The binding of the gRNA/Cas9 complex localizes the Cas9 to the genomic target sequence so that the Cas9 can cut both strands of the DNA causing a double-strand break. Just as with ZFNs and TALENs, the double-stranded brakes produced by CRISPR/Cas can undergo homologous recombination or NHEJ.

The Cas9 nuclease has two functional domains: RuvC and HNH, each cutting a different DNA strand. When both of these domains are active, the Cas9 causes double strand breaks in the genomic DNA.

A significant advantage of CRISPR/Cas is that the high efficiency of this system coupled with the ability to easily create synthetic gRNAs enables multiple genes to be targeted simultaneously. In addition, the majority of cells carrying the mutation present biallelic mutations in the targeted genes.

However, apparent flexibility in the base-pairing interactions between the gRNA sequence and the genomic DNA target sequence allows imperfect matches to the target sequence to be cut by Cas9.

Modified versions of the Cas9 enzyme containing a single inactive catalytic domain, either RuvC- or HNH-, are called 'nickases'. With only one active nuclease domain, the Cas9 nickase cuts only one strand of the target DNA, creating a single-strand break or 'nick'. A single-strand break, or nick, is normally quickly repaired through the HDR pathway, using the intact complementary DNA strand as the template. However, two proximal, opposite strand nicks introduced by a Cas9 nickase are treated as a double-strand break, in what is often referred to as a 'double nick' CRISPR system. A double-nick can be repaired by either NHEJ or HDR depending on the desired effect on the gene target. Thus, if specificity and reduced off-target effects are crucial, using the Cas9 nickase to create a double-nick by designing two gRNAs with target sequences in close proximity and on opposite strands of the genomic DNA would decrease off-target effect as either gRNA alone will result in nicks that will not change the genomic DNA.

Modified versions of the Cas9 enzyme containing two inactive catalytic domains (dead Cas9, or dCas9) have no nuclease activity while still able to bind to DNA based on gRNA specificity. The dCas9 can be utilized as a platform for DNA transcriptional regulators to activate or repress gene expression by fusing the inactive enzyme to known regulatory domains. For example, the binding of dCas9 alone to a target sequence in genomic DNA can interfere with gene transcription.

There is a number of publically available tools available to help choose and/or design target sequences as well as lists of bioinformatically determined unique gRNAs for different genes in different species such as the Feng Zhang lab's Target Finder, the Michael Boutros lab's Target Finder (E-CRISP), the RGEN Tools: Cas-OFFinder, the CasFinder: Flexible algorithm for identifying specific Cas9 targets in genomes and the CRISPR Optimal Target Finder.

In order to use the CRISPR system, both gRNA and Cas9 should be expressed in a target cell. The insertion vector can contain both cassettes on a single plasmid or the cassettes are expressed from two separate plasmids. CRISPR plasmids are commercially available such as the px330 plasmid from Addgene.

Recombinant adeno-associated virus (rAAV) platform—this genome-editing platform is based on rAAV vectors which enable insertion, deletion or substitution of DNA sequences in the genomes of live mammalian cells. The rAAV genome is a single-stranded deoxyribonucleic acid (ssDNA) molecule, either positive- or negative-sensed, which is about 4.7 kb long. These single-stranded DNA viral vectors have high transduction rates and have a unique property of stimulating endogenous homologous recombination in the absence of double-strand DNA breaks in the genome. One of skill in the art can design a rAAV vector to target a desired genomic locus and perform both gross and/or subtle endogenous gene alterations in a cell. rAAV genome editing has the advantage in that it targets a single allele and does not result in any off-target genomic alterations. rAAV genome editing technology is commercially available, for example, the rAAV GENESIS™ system from Horizon™ (Cambridge, UK).

Methods for qualifying efficacy and detecting sequence alteration are well known in the art and include, but not limited to, DNA sequencing, electrophoresis, an enzyme-based mismatch detection assay and a hybridization assay such as PCR, RT-PCR, RNase protection, in-situ hybridization, primer extension, Southern blot, Northern Blot and dot blot analysis.

Sequence alterations in a specific gene can also be determined at the protein level using e.g. chromatography, electrophoretic methods, immunodetection assays such as ELISA and Western blot analysis and immunohistochemistry.

In addition, one ordinarily skilled in the art can readily design a knock-in/knock-out construct including positive and/or negative selection markers for efficiently selecting transformed cells that underwent a homologous recombination event with the construct. Positive selection provides a means to enrich the population of clones that have taken up foreign DNA. Non-limiting examples of such positive markers include glutamine synthetase, dihydrofolate reductase (DHFR), markers that confer antibiotic resistance, such as neomycin, hygromycin, puromycin, and blasticidin S resistance cassettes. Negative selection markers are necessary to select against random integrations and/or elimination of a marker sequence (e.g. positive marker). Non-limiting examples of such negative markers include the herpes simplex-thymidine kinase (HSV-TK) which converts ganciclovir (GCV) into a cytotoxic nucleoside analog, hypoxanthine phosphoribosyltransferase (HPRT) and adenine phosphoribosytransferase (ARPT).

Recombination Procedures—Common to Different Genome Editing Systems

"Hit and run" or "in-out"—involves a two-step recombination procedure. In the first step, an insertion-type vector containing a dual positive/negative selectable marker cassette is used to introduce the desired sequence alteration. The insertion vector contains a single continuous region of homology to the targeted locus and is modified to carry the mutation of interest. This targeting construct is linearized with a restriction enzyme at a one site within the region of homology, electroporated into the cells, and positive selection is performed to isolate homologous recombinants. These homologous recombinants contain a local duplication that is separated by intervening vector sequence, including the selection cassette. In the second step, targeted clones are subjected to negative selection to identify cells that have lost the selection cassette via intrachromosomal recombination between the duplicated sequences. The local recombination event removes the duplication and, depending on the site of recombination, the allele either retains the introduced mutation or reverts to wild type. The end result is the introduction of the desired modification without the retention of any exogenous sequences.

The "double-replacement" or "tag and exchange" strategy—involves a two-step selection procedure similar to the hit and run approach, but requires the use of two different targeting constructs. In the first step, a standard targeting vector with 3' and 5' homology arms is used to insert a dual positive/negative selectable cassette near the location where the mutation is to be introduced. After electroporation and positive selection, homologous targeted clones are identified. Next, a second targeting vector that contains a region of homology with the desired mutation is electroporated into targeted clones, and negative selection is applied to remove the selection cassette and introduce the mutation. The final allele contains the desired mutation while eliminating unwanted exogenous sequences.

Site-Specific Recombinases—The Cre recombinase derived from the P1 bacteriophage and Flp recombinase derived from the yeast *Saccharomyces cerevisiae* are site-specific DNA recombinases each recognizing a unique 34 base pair DNA sequence (termed "Lox" and "FRT", respectively) and sequences that are flanked with either Lox sites or FRT sites can be readily removed via site-specific recombination upon expression of Cre or Flp recombinase, respectively. For example, the Lox sequence is composed of an asymmetric eight base pair spacer region flanked by 13 base pair inverted repeats. Cre recombines the 34 base pair lox DNA sequence by binding to the 13 base pair inverted repeats and catalyzing strand cleavage and religation within the spacer region. The staggered DNA cuts made by Cre in the spacer region are separated by 6 base pairs to give an overlap region that acts as a homology sensor to ensure that only recombination sites having the same overlap region recombine. Basically, the site-specific recombinase system offers means for the removal of selection cassettes after homologous recombination. This system also allows for the generation of conditional altered alleles that can be inactivated or activated in a temporal or tissue-specific manner. Of note, the Cre and Flp recombinases leave behind a Lox or FRT "scar" of 34 base pairs. The Lox or FRT sites that remain are typically left behind in an intron or 3' UTR of the modified locus, and current evidence suggests that these sites usually do not interfere significantly with gene function. Thus, Cre/Lox and Flp/FRT recombination involves introduction of a targeting vector with 3' and 5' homology arms containing the mutation of interest, two Lox or FRT sequences and typically a selectable cassette placed between the two Lox or FRT sequences. Positive selection is applied and homologous recombinants that contain targeted mutation are identified. Transient expression of Cre or Flp in conjunction with negative selection results in the excision of the selection cassette and selects for cells where the cassette has been lost. The final targeted allele contains the Lox or FRT scar of exogenous sequences.

Transposases—As used herein, the term "transposase" refers to an enzyme that binds to the ends of a transposon and catalyzes the movement of the transposon to another part of the genome.

As used herein the term "transposon" refers to a mobile genetic element comprising a nucleotide sequence which can move around to different positions within the genome of a single cell. In the process the transposon can cause mutations and/or change the amount of a DNA in the genome of the cell. A number of transposon systems that are able to also transpose in cells e.g. vertebrates have been isolated or designed, such as Sleeping Beauty [Izsvák and Ivics Molecular Therapy (2004) 9: 147-156], piggyBac [Wilson et al. Molecular Therapy (2007) 15: 139-145], Tol2 [Kawakami et al. PNAS (2000) 97 (21): 11403-11408] or Frog Prince [Miskey et al. Nucleic Acids Res. December 1, (2003) 31(23): 6873-6881]. Generally, DNA transposons translocate from one DNA site to another in a simple, cut-and-paste manner. Each of these elements has their own advantages, for example, Sleeping Beauty is particularly useful in region-specific mutagenesis, whereas Tol2 has the highest tendency to integrate into expressed genes. Hyperactive systems are available for Sleeping Beauty and piggyBac. Most importantly, these transposons have distinct target site preferences, and can therefore introduce sequence alterations in overlapping, but distinct sets of genes. Therefore, to achieve the best possible coverage of genes, the use of more than one element is particularly preferred. The basic mechanism is shared between the different transposases, therefore the piggyBac (PB) is described as an example. PB is a 2.5 kb insect transposon originally isolated from the cabbage looper moth, *Trichoplusia ni*. The PB transposon consists of asymmetric terminal repeat sequences that flank a transposase, PBase. PBase recognizes the terminal repeats and induces transposition via a "cut-and-paste" based mechanism, and preferentially transposes into the host genome at the tetranucleotide sequence TTAA. Upon insertion, the TTAA target site is duplicated such that the PB transposon is flanked by this tetranucleotide sequence. When mobilized, PB typically excises itself precisely to reestablish a single TTAA site, thereby restoring the host sequence to its pretransposon state. After excision, PB can transpose into a new location or be permanently lost from the genome. Typically, the transposase system offers an alternative means for the removal of selection cassettes after homologous recombination quite similar to the use Cre/Lox or Flp/FRT. Thus, for example, the PB transposase system involves introduction of a targeting vector with 3' and 5' homology arms containing the mutation of interest, two PB terminal repeat sequences at the site of an endogenous TTAA sequence and a selection cassette placed between PB terminal repeat sequences. Positive selection is applied and homologous recombinants that contain targeted mutation are identified. Transient expression of PBase removes in conjunction with negative selection results in the excision of the selection cassette and selects for cells where the cassette has been lost. The final targeted allele contains the introduced mutation with no exogenous sequences.

For PB to be useful for the introduction of sequence alterations, there must be a native TTAA site in relatively close proximity to the location where a particular mutation is to be inserted.

Homology Directed Repair (HDR) Homology Directed Repair (HDR) can be used to generate specific nucleotide changes (also known as gene "edits") ranging from a single nucleotide change to large insertions. In order to utilize HDR for gene editing, a DNA "repair template" containing the desired sequence must be delivered into the cell type of interest with e.g. the guide RNA [gRNA(s)] and Cas9 or Cas9 nickase or other genome editing method (examples herein below). The repair template must contain the desired edit as well as additional homologous sequence immediately upstream and downstream of the target (termed left and right homology arms). The length and binding position of each homology arm is dependent on the size of the change being introduced. The repair template can be a single stranded oligonucleotide, double-stranded oligonucleotide, or double-stranded DNA plasmid depending on the specific application.

The HDR method was successfully used for targeting a specific modification in a coding sequence of a gene in plants [Budhagatapalli Nagaveni et al. (2015) "Targeted Modification of Gene Function Exploiting Homology-Directed Repair of TALEN-Mediated Double-Strand Breaks in Barley". G3 (Bethesda). 5(9): 1857-1863). Thus, the gfp-specific transcription activator-like effector nucleases were used along with a repair template that, via HDR, facilitates conversion of gfp into yfp, which is associated with a single amino acid exchange in the gene product. The resulting yellow-fluorescent protein accumulation along with sequencing confirmed the success of the genomic editing.

Similarly, Zhao Yongping et al. 2016 (An alternative strategy for targeted gene replacement in plants using a dual-sgRNA/Cas9 design. Scientific Reports 6, Article number: 23890 (2016)) describe co-transformation of *Arabidopsis* plants with a combinatory dual-sgRNA/Cas9 vector that successfully deleted miRNA gene regions (MIR169a and MIR827a) and second construct that contains sites homologous to *Arabidopsis* TERMINAL FLOWER 1 (TFL1) for homology-directed repair (HDR) with regions corresponding to the two sgRNAs on the modified construct to provide both targeted deletion and donor repair for targeted gene replacement by HDR.

Specific considerations for Homology Directed Repair (HDR) utilizing CRISPR/Cas9 system are described herein: It should be noted that the repair template should not include a sequence that exhibits more than 90% identity to the gRNA designed to the genomic DNA or to the reverse complement sequence of the gRNA which is designed to the genomic sequence, otherwise the repair template becomes a suitable target for Cas9 cleavage. Additionally or alternatively, when using a short repair template (e.g., about 40-200 base pairs) the repair template should preferably lack the Protospacer Adjacent Motif (PAM) sequence. For example, the PAM could be mutated such that it is no longer present, but the coding region of the gene is not affected (i.e. a silent mutation).

Introduction of large double stranded DNA as repair template can be performed using plasmids, yet, the plasmid should be linearized before transfection.

Activation of Target Genes Using CRISPR/Cas9 System

Many bacteria and archaea contain endogenous RNA-based adaptive immune systems that can degrade nucleic acids of invading phages and plasmids. These systems consist of clustered regularly interspaced short palindromic repeat (CRISPR) genes that produce RNA components and CRISPR associated (Cas) genes that encode protein components. The CRISPR RNAs (crRNAs) contain short stretches of homology to specific viruses and plasmids and act as guides to direct Cas nucleases to degrade the complementary nucleic acids of the corresponding pathogen. Studies of the type II CRISPR/Cas system of *Streptococcus pyogenes* have shown that three components form an RNA/protein complex and together are sufficient for sequence-specific nuclease activity: the Cas9 nuclease, a crRNA containing 20 base pairs homologous to the target sequence, and a trans-activating crRNA (tracrRNA) (Jinek et al. Science (2012) 337: 816-821). It was further demonstrated that a synthetic chimeric guide RNA (gRNA) composed of a fusion between crRNA and tracrRNA could direct Cas9 to cleave DNA targets that are complementary to the crRNA in vitro. It was also demonstrated that transient expression of CRISPR-associated endonuclease (Cas9) in conjunction with synthetic gRNAs can be used to produce targeted double-stranded brakes in a variety of different species.

The CRISPR/Cas9 system is a remarkably flexible tool for genome manipulation. A unique feature of Cas9 is its ability to bind target DNA independently of its ability to cleave target DNA. Specifically, both RuvC- and HNH-nuclease domains can be rendered inactive by point mutations (D10A and H840A in SpCas9), resulting in a nuclease dead Cas9 (dCas9) molecule that cannot cleave target DNA. The dCas9 molecule retains the ability to bind to target DNA based on the gRNA targeting sequence. The dCas9 can be tagged with transcriptional activators, and targeting these dCas9 fusion proteins to the promoter region results in robust transcription activation of downstream target genes. The simplest dCas9-based activators consist of dCas9 fused directly to a single transcriptional activator. Importantly, unlike the genome modifications induced by Cas9 or Cas9 nickase, dCas9-mediated gene activation is reversible, since it does not permanently modify the genomic DNA.

Indeed, genome editing was successfully used to overexpress a protein of interest in a plant by, for example, mutating a regulatory sequence, such as a promoter to overexpress the endogenous polynucleotide operably linked to the regulatory sequence. For example, U.S. Patent Application Publication No. 20160102316 to Rubio Munoz, Vicente et al., describes plants with increased expression of an endogenous DDA1 plant nucleic acid sequence wherein the endogenous DDA1 promoter carries a mutation introduced by mutagenesis or genome editing which results in increased expression of the DDA1 gene, using for example, CRISPR. The method involves targeting of Cas9 to the specific genomic locus, in this case DDA1, via a 20-nucleotide guide sequence of the single-guide RNA. An online CRISPR Design Tool can identify suitable target sites (tools.genome-engineering.org; Ran et al. (2013) Nature Protocols, 8911: 2281-2308).

The CRISPR-Cas system was used for altering (increasing or decreasing) gene expression in plants as described in U.S. Patent Application publication No. 20150067922 to Yang; Yinong et al. The engineered, non-naturally occurring gene editing system comprises two regulatory elements, wherein the first regulatory element (a) operable in a plant cell operably linked to at least one nucleotide sequence encoding a CRISPR-Cas system guide RNA (gRNA) that hybridizes with the target sequence in the plant, and a second regulatory element (b) operable in a plant cell operably linked to a nucleotide sequence encoding a Type-II CRISPR-associated nuclease, wherein components (a) and (b) are located on same or different vectors of the system, whereby the guide RNA targets the target sequence and the CRISPR-associated nuclease cleaves the DNA molecule, thus altering the expression of a gene product in a plant. It should be noted that the CRISPR-associated nuclease and the guide RNA do not naturally occur together.

In addition, as described above, point mutations which activate a gene-of-interest and/or which result in overexpression of a polypeptide-of-interest can be also introduced into plants by means of genome editing. Such mutation can be for example, deletions of repressor sequences which result in activation of the gene-of-interest; and/or mutations which insert nucleotides and result in activation of regulatory sequences such as promoters and/or enhancers.

According to additional aspect, the present invention provides a genetically engineered plant having enhanced resistance to at least one fungus and/or Oomycete compared to a non-engineered control plant, the genetically engineered plant comprises at least one cell having modified expression and/or activity of at least one polypeptide at least 70% identical to a polypeptide having an amino acid sequence selected from the group consisting of SEQ ID NOs:2635, 2444-2634, 2636-4252 or at least 80% identical to a polypeptide having an amino acid sequence selected from the group consisting of SEQ ID NOs:326, 360, 308-325, 327-359, 361-506 and 2635, 2444-2634, 2636-4252, a fragment and/or a variant thereof compared to the polypeptide expression and/or activity in the non-engineered control plant. Each possibility represents a separate embodiment of the present invention.

According to certain embodiments, the genetically engineered plant comprises at least one cell having modified expression and/or activity of at least one polypeptide having the amino acid sequences selected from the group consisting of SEQ ID NOs:326, 360, 308-325, 327-359, 361-508 and 2635, 2444-2634, 2636-4252. Each possibility represents a separate embodiment of the present invention.

According to certain embodiments, the genetically engineered plant having enhanced resistance to the at least one fungus and/or Oomycete comprises at least one cell with enhanced expression and/or activity of at least one polypeptide at least 70% identical to a polypeptide having an amino acid sequence selected from the group consisting of SEQ ID NOs: 2635, 2444-2634, 2636-4252 or at least 80% identical to a polypeptide having an amino acid sequence selected from the group consisting of SEQ ID NOs:326, 360, 308-325, 327, 329-347, 349-359, 362-506.

According to certain embodiments, the genetically engineered plant comprises at least one cell transformed with an exogenous polynucleotide encoding the at least one polypeptide, the polynucleotide is at least 70% identical to a nucleic acid sequence selected from the group consisting of SEQ ID NOs:783, 592-782, 784-2443 or at least 80% identical to a polynucleotide sequence selected from the group consisting of SEQ ID NOs:40, 80, 22-39, 41, 43-61, 63-79, 81, and 83-301, thereby having an enhanced resistance to the at least one fungus. The exogenous polynucleotide can be endogenous to the plant cell or heterologous to the plant cell.

According to certain embodiments, the genetically engineered plant comprises at least one cell edited to express an exogenous polynucleotide encoding the at least one polypeptide, thereby having an enhanced resistance to the at least one fungus.

According to certain embodiments, the genetically engineered plant comprises at least one cell edited to overexpress an endogenous polynucleotide encoding the at least one polypeptide, thereby having an enhanced resistance to the at least one fungus.

According to certain embodiments, the genetically engineered plant having enhanced resistance to the at least one fungus comprises at least one cell with enhanced expression of at least one polynucleotide encoding a polypeptide at least 70% identical to a polypeptide having an amino acid sequence selected from the group consisting of SEQ ID NOs:2635, 2444-2634, 2636-4252 or at least 80% identical to a polypeptide having an amino acid sequence selected from the group consisting of SEQ ID NOs:326, 360, 308-325, 327, 329-347, 349-359, 362-506. According to certain exemplary embodiments, the polynucleotide expression in the genetically engineered plant is enhanced in comparison to the polynucleotide expression in a control plant.

According to certain embodiments, the genetically engineered plant having enhanced resistance to the at least one fungus comprises at least one cell with reduced expression and/or activity of the at least one polypeptide at least 80% identical to a polypeptide having an amino acid sequence selected from the group consisting of SEQ ID NOs:328, 348 and 361. According to certain exemplary embodiments, the polypeptide expression and/or activity in the genetically engineered plant is reduced in comparison to the polypeptide expression and/or activity in a control plant.

According to certain embodiments, the genetically engineered plant having reduced expression and/or activity of the at least one polypeptide comprises at least one cell having reduced expression of a polynucleotide encoding said at least one polypeptide, thereby having an enhanced resistance to the at least one fungus.

According to certain embodiments, the genetically engineered plant comprises a polynucleotide encoding a modified form of the at least one polypeptide, wherein the modified form has reduced or no activity compared to the unmodified form, thereby having an enhanced resistance to the at least one fungus.

According to additional aspect, the present invention provides a genetically engineered plant having enhanced resistance to at least one fungus and/or Oomycete compared to a control plant, the genetically engineered plant comprises at least one cell having modified expression and/or activity of at least one polypeptide at least about 70%, at least about 71%, at least about 72%, at least about 73%, at least about 74%, at least about 75%, at least about 76%, at least about 77%, at least about 78%, at least about 79% or more homologous to a polypeptide having an amino acid sequence selected from the group consisting of SEQ ID NOs:2635, 2444-2634, 2636-4252; or at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to a polypeptide having an amino acid sequence selected from the group consisting of SEQ ID NOs:326, 360, 308-325, 327-359, 361-506 and 2635, 2444-2634, 2636-4252, a fragment and/or a variant thereof compared to the polypeptide expression and/or activity in a control plant. Each possibility represents a separate embodiment of the present invention.

According to certain embodiments, the genetically engineered plant comprises at least one cell having modified expression and/or activity of at least one polypeptide having the amino acid sequence selected from the group consisting of SEQ ID NOs:326, 360, 308-325, 327-359, 361-508 and 2635, 2444-2634, 2636-4252. Each possibility represents a separate embodiment of the present invention.

According to certain embodiments, the genetically engineered plant comprises at least one cell having modified expression of a polynucleotide encoding the at least one polypeptide.

According to additional aspect, the present invention provides a genetically engineered plant having enhanced resistance to at least one fungus and/or Oomycete compared to a control plant, the genetically engineered plant comprises at least one cell having modified expression of at least one polynucleotide at least about 70%, at least about 71%, at least about 72%, at least about 73%, at least about 74%, at least about 75%, at least about 76%, at least about 77%, at least about 78%, at least about 79% or more homologous to a polynucleotide having a nucleic acid sequence selected from the group consisting of SEQ ID NOs:783, 592-782, 784-2443; or at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 93%, at least about 94%, at least about 95%, at least about 96%, at least about 97%, at least about 98%, at least about 99% or more homologous, or identical to a polynucleotide having an nucleic acid sequence selected from the group consisting of SEQ ID NOs:40, 80, 22-39, 41-79, 81-301 and 783, 592-782, 784-2443 compared to the polynucleotide expression and/or activity in a control plant. Each possibility represents a separate embodiment of the present invention.

According to certain embodiments, the genetically engineered plant comprises at least one cell having modified expression of at least one polynucleotide having the nucleic acid sequence selected from the group consisting of SEQ ID NOs:40, 80, 22-39, 41-79, 81-305 and 783, 592-782, 784-2443. Each possibility represents a separate embodiment of the present invention.

According to certain embodiments, modified expression/ and or activity of a polypeptide or polynucleotide encoding same comprises enhanced expression and/or activity. According to certain embodiments, modified expression/and or activity of a polypeptide or polynucleotide encoding same comprises reduced expression and/or activity.

According to certain embodiments, the genetically engineered plant having enhanced resistance to the at least one fungus and/or Oomycete comprises at least one cell with enhanced expression and/or activity of at least one polypeptide at least 80% identical to a polypeptide having an amino acid sequence selected from the group consisting of SEQ ID NOs:326, 360, 308-325, 327, 329-347, 349-359, 362-506 and 2635, 2444-2634, 2636-4252. According to certain exemplary embodiments, the polypeptide expression and/or activity in the genetically engineered plant is enhanced in comparison to the polypeptide expression and/or activity in a control plant.

According to certain embodiments, the genetically engineered plant having enhanced resistance to the at least one fungus and/or Oomycete comprises at least one cell with reduced expression and/or activity of at least one polypeptide at least 80% identical to a polypeptide having an amino acid sequence selected from the group consisting of SEQ ID NOs:328, 361 and 348. According to certain exemplary embodiments, the polypeptide expression and/or activity in the genetically engineered plant is reduced in comparison to the polypeptide expression and/or activity in a control plant.

According to certain embodiments, the genetically engineered plant having reduced expression and/or activity of the at least one polypeptide comprises at least one cell having reduced expression of a polynucleotide encoding said at least one polypeptide, thereby having an enhanced resistance to the at least one fungus.

According to certain embodiments, the genetically engineered plant comprises a polynucleotide encoding a modified form of the at least one polypeptide, wherein the modified form has reduced or no activity compared to the unmodified form, thereby having an enhanced resistance to the at least one fungus.

Once expressed within the plant cell or the entire plant, the level of the polypeptide encoded by the exogenous polynucleotide can be determined by methods well known in the art such as, activity assays, Western blots using antibodies capable of specifically binding the polypeptide, Enzyme-Linked Immuno Sorbent Assay (ELISA), radio-immuno-assays (RIA), immunohistochemistry, immunocytochemistry, immunofluorescence and the like.

Methods of determining the level in the plant of the RNA transcribed from the exogenous polynucleotide are well known in the art and include, for example, Northern blot analysis, reverse transcription polymerase chain reaction (RT-PCR) analysis (including quantitative, semi-quantitative or real-time RT-PCR) and RNA-in situ hybridization.

The sequence information and annotations uncovered by the present teachings can be harnessed in favor of classical breeding. Thus, sub-sequence data of those polynucleotides described above, can be used as markers for marker assisted selection (MAS), in which a marker is used for indirect selection of a genetic determinant or determinants of a trait of interest (e.g., biomass, growth rate, oil content, yield, abiotic stress tolerance, water use efficiency, nitrogen use efficiency and/or fertilizer use efficiency). Nucleic acid data of the present teachings (DNA or RNA sequence) may contain or be linked to polymorphic sites or genetic markers on the genome such as restriction fragment length polymorphism (RFLP), microsatellites and single nucleotide polymorphism (SNP), DNA fingerprinting (DFP), amplified fragment length polymorphism (AFLP), expression level polymorphism, polymorphism of the encoded polypeptide and any other polymorphism at the DNA or RNA sequence.

Examples of marker assisted selections include, but are not limited to, selection for a morphological trait (e.g., a gene that affects form, coloration, male sterility or resistance such as the presence or absence of awn, leaf sheath coloration, height, grain color, aroma of rice); selection for a biochemical trait (e.g., a gene that encodes a protein that can be extracted and observed; for example, isozymes and storage proteins); selection for a biological trait (e.g., pathogen races or insect biotypes based on host pathogen or host parasite interaction can be used as a marker since the genetic constitution of an organism can affect its susceptibility to pathogens or parasites).

The polynucleotides and polypeptides described hereinabove can be used in a safe and cost-effective manner in a wide range of economical plants, exemplary species of which are described hereinabove.

It will be appreciated that some genes involved in a plant defense mechanism conferring resistance to a particular fungus species may also be involved in resistance to other species, regulated by the same or homologous genes. Of course, the overall defense mechanism is related, not identical, and therefore not all genes involved in resistance to one pathogen will confer resistance to other pathogens. Nonetheless, if a gene confers or enhances resistance to one of the pathogen species, it would be apparent to one skilled in the art to test for resistance to other pathogens, specifically to pathogen of the same genus or that cause similar symptoms.

According to certain embodiments, the fungus and/or Oomycete is selected from, but not limited to, *Fusarium verticillioides*; *Fusarium graminearum*; *Collotetrichum graminicola*; *Fusarium avenaceum*; *Fusarium culmorum*; *Fusarium oxysporum*; *Fusarium roseum*; *Fusarium semitectum*; *Fusarium solani*; *Fusarium verticillioides*; *Fusarium verticillioides* var. *subglutinans*; *Acremonium strictum*; *Albugo candida*; *Albugo tragopogonis*; *Alternaria alternate*; *Alternaria brassicae*; *Alternaria helianthi*; *Alternaria zinnia*; *Aphanomyces euteiches*; *Ascochyta sorghina*; *Ascochyta tritici*; *Aspergillus flavus*; *Bipolaris maydis* O; *Bipolaris sorghicola*; *Bipolaris sorokiniana*; *Botrytis cinerea*; *Cephalosporium acremonium*; *Cephalosporium gramineum*; *Cephalosporium maydis*; *Cercospora kikuchii*; *Cercospora medicaginis*; *Cercospora sojina*; *Cercospora sorghi*; *Cladosporium herbarum*; *Clavibacter michiganense* subsp. *Nebraskense*; *Clavibacter michiganese* subsp. *Insidiosum*; *Claviceps purpurea*; *Claviceps sorghi*; *Cochliobolus heterostrophus*; *Colletotrichum dematium* (*Colletotichum truncatum*); *Colletotrichum trifolii*; *Colletotrichum sublineolum*; Corn stunt spiroplasma; *Corynespora cassiicola*; *Curvularia inaequalis*; *Curvularia lunata*; *Curvularia pallescens*; *Diaporthe phaseolorum* var. *caulivora*; *Diaporthe phaseolorum* var. *sojae* (*Phomopsis sojae*); *Diplodia macrospora*; *Erwinia carotovora*; *Erwinia carotovorum* pv. *Carotovora*; *Erwinia chrysanthemi* pv. *Zea*; *Erwinia stewartii*; *Erysiphe cichoracearum*; *Erysiphe graminis* fsp. *tritici*; *Exserohilum turcicum* I, II & III; *Gaeumannomyces graminis* var. *tritici*; *Gibberella zeae* (*Fusarium graminearum*); *Gloeocercospora sorghi*; *Glomerella glycines*; *Helminthosporium carbonum* I, II & III (*Cochliobolus carbonum*); *Helminthosporium pedicellatum*; *Helminthosporium sorghicola*; *Kabatiella maydis*; *Leptosphaeria maculans*; *Leptosphaerulina briosiana*; *Leptotrichila medicaginis*; *Macrophomina phaseolina*; *Microsphaera diffusa*; *Mycosphaerella brassicicola*; *Nigrospora oryzae*; *Penicillium oxalicum*; *Perconia circinata*; *Peronosclerospora maydis*; *Peronosclerospora philippinensis*; *Peronosclerospora sacchari*; *Peronosclerospora sorghi*; *Peronospora manshurica*; *Peronospora parasitica*; *Peronospora trifoliorum*; *Phakopsora pachyrhizi*; *Phialophora gregata*; *Phoma insidiosa*; *Phoma macdonaldii*; *Phoma medicaginis* var. *medicaginis*; *Phomopsis helianthi*; *Phyllachara sacchari*; *Phyllosticta maydis*; *Phyllosticta sojicola*; *Physoderma maydis*; *Physopella zeae*; *Phytophthora cryptogea*; *Phytophthora megasperma*; *Phytophthora megasperma* fsp. *Glycinea*; *Plasmopora halstedii*; *Pseudocercosporella herpotrichoides*; *Pseudomonas andropogonis*; *Pseudomonas*

*avenae; Pseudomonas avenae* (*Pseudomonas alboprecipitans*); *Pseudomonas syringae* p.v. *atrofaciens; Pseudomonas syringae* p. v. *glycinea; Pseudomonas syringae* p. v. *syringae; Pseudopeziza medicaginis; Puccinia graminis* fsp. *tritici; Puccinia helianthi; Puccinia polysora; Puccinia purpurea; Puccinia recondita* fsp. *tritici; Puccinia sorghi; Puccinia striiformis; Pyrenophora tritici-repentis; Pythium aphanidermatum; Pythium arrhenomanes; Pythium debaryanum; Pythium gramicola; Pythium graminicola; Pythium irregular; Pythium splendens; Pythium ultimum; Ramulispora sorghi; Ramulispora sorghicola; Rhizoctonia cerealis; Rhizoctonia solani; Rhizopus arrhizus; Rhizopus oryzae; Rhizopus stolonifera; Sclerophthona macrospora; Sclerospora graminicola; Sclerotinia sclerotiorum; Sclerotinia trifoliorum; Sclerotium rolfsii; Septoria avenae; Septoria glycines; Septoria helianthi; Septoria nodorum; Septoria tritici; Exserohilum turcicum; Sphacelotheca cruenta; Sporisorium reilianum* (*Sphacelotheca reiliana*); *Sporisorium sorghi; Stagonospora meliloti; Stemphylium alfalfa; Stemphylium botryosum; Stemphylium herbarum; Stenocarpella maydi* (*Diplodia maydis*); *Tilletia indica; Tilletia laevis; Tilletia tritici; Trichoderma viride; Urocystis agropyri; Uromyces striatus; Ustilago maydis; Ustilago tritici; Verticillium albo-atrum; Verticillium dahlia; Xanthomonas campestris* p.v. *alfalfa; Xanthomonas campestris* p. v. *hokicola; Xanthomonas campestris* p. v. *phaseoli*; and *Xanthomonas campestris* p.v. *translucens*. Each possibility represents a separate embodiment of the present invention.

Specific pathogenic fungi or Oomycetes are known to cause dramatic crop lose due to disease symptoms which negatively affect the quality of the crop. For example, *Fusarium verticilloides* and *Fusarium graminearum* cause rot in maize (specifically stalk rot), wheat, sweet paper, eggplants and head blight is wheat. *Fusarium oxysporum* causes sudden death syndrome (SDS) in soybeans, yellow spots in sugar beet, Panama disease in Banana, and wilt in tomato, sweet pepper, eggplants, potatoes and various plant of the Cucurbitaceae family. *Colletotrichum* spp. cause stalk rot in maize, anthracnose in sugar beet, tomato and sweet pepper. *Botrytis cinerea* causes gray mold in tomato, sweet pepper, eggplants and potato. Rust is caused by *Puccinia* spp. in maize, wheat and sunflower, by *Uromyces* spp. in sunflower and by *Phakopsora* in soybean. *Phytophthora* causes root rot in soybean, late blight in tomato and potato, blight in eggplant and blight fruit rot in sweet pepper. *Mycosphaerella graminicola* causes leaf blotch in wheat. *Mycosphaerella fijiensis* causes black leaf streak disease (BLSD; aka black Sigatoka leaf spot) in banana. *Septoria lycopersici* causes leaf spots in tomato. *Verticillium* spp. cause wilt disease in canola, sugar beet, tomato, sweet pepper, eggplant and potato. *Magnaporthe oryza* causes rice blast. *Pythium* spp. cause damping off disease in maize, soybean, tomato, sweet pepper, eggplant and potato and black vessels in sugar beet. *Sclerotinia* causes stem rot in soybean and white mold in tomato, sweet pepper, eggplant and potato. *Rhizoctonia solani* causes root crown rot in sugar beet, sheath blight in rice, and damping off disease in tomato, sweet pepper, eggplant and potato. Maize smut is caused by *Ustilago maydis*. *Alternaria* spp. cause leaf spots in sugar beet and sweet pepper, early blight in tomato and potato, and fruit rot in sweet pepper and eggplants. *Cercospora* causes leaf blight in soybean and leaf spots in sugar beet, sweet pepper, eggplants and potato. *Macrophomina* causes charcoal rot in maize, wheat, soybean, tomato and potato. *Sclerotium rolfsii* causes Southern blight in sweet pepper and eggplants. *Oidium* spp. cause powdery mildew in tomato, sweet pepper, eggplants and potato. Powdery mildew is also caused by *Blumeria graminis*.

Methods for identifying symptoms caused by various fungi and Oomycetes upon infection of specific plant species, and for measuring the degree of the plant susceptibility/resistance to the infection are well known to those skilled in the art.

The term "plant" as used herein encompasses a whole plant, a grafted plant, ancestor(s) and progeny of the plants and plant parts, including seeds, shoots, stems, roots (including tubers), rootstock, scion, and plant cells, tissues and organs. The plant or part thereof may be in any form including suspension cultures, embryos, meristematic regions, callus tissue, leaves, gametophytes, sporophytes, pollen, and microspores. Plants that are particularly useful in the methods of the invention include all plants which belong to the superfamily Viridiplantae, in particular monocotyledonous and dicotyledonous plants including a fodder or forage legume, ornamental plant, food crop, tree, or shrub selected from the list comprising *Acacia* spp., *Acer* spp., *Actinidia* spp., *Aesculus* spp., *Agathis australis, Albizia amara, Alsophila tricolor, Andropogon* spp., *Arachis* spp, *Areca catechu, Astelia fragrans, Astragalus cicer, Baikiaea plurijuga, Betula* spp., *Brassica* spp., *Bruguiera gymnorrhiza, Burkea africana, Butea frondosa, Cadaba farinosa, Calliandra* spp, *Camellia sinensis, Canna indica, Capsicum* spp., *Cassia* spp., *Centroema pubescens, Chacoomeles* spp., *Cinnamomum cassia, Coffea arabica, Colophospermum mopane, Coronillia varia, Cotoneaster serotina, Crataegus* spp., *Cucumis* spp., *Cupressus* spp., *Cyathea dealbata, Cydonia oblonga, Cryptomeria japonica, Cymbopogon* spp., *Cynthea dealbata, Cydonia oblonga, Dalbergia monetaria, Davallia divaricata, Desmodium* spp., *Dicksonia squarosa, Dibeteropogon amplectens, Dioclea* spp, *Dolichos* spp., *Dorycnium rectum, Echinochloa pyramidalis, Ehraffia* spp., *Eleusine coracana, Eragrestis* spp., *Erythrina* spp., *Eucalypfus* spp., *Euclea schimperi, Eulalia villosa, Pagopyrum* spp., *Feijoa sellowlana, Fragaria* spp., *Flemingia* spp, *Freycinetia banksli, Geranium thunbergii, Ginkgo biloba, Glycine javanica, Gliricidia* spp, *Gossypium hirsutum, Grevillea* spp., *Guibourtia coleosperma, Hedysarum* spp., *Hemaffhia altissima, Heteropogon contoffus, Hordeum vulgare, Hyparrhenia rufa, Hypericum erectum, Hypeffhelia dissolute, Indigo incamata, Iris* spp., *Leptarrhena pyrolifolia, Lespedeza* spp., *Lettuca* spp., *Leucaena leucocephala, Loudetia simplex, Lotonus bainesli, Lotus* spp., *Macrotyloma axillare, Malus* spp., *Manihot esculenta, Medicago saliva, Metasequoia glyptostroboides, Musa sapientum, Nicotianum* spp., *Onobrychis* spp., *Ornithopus* spp., *Oryza* spp., *Peltophorum africanum, Pennisetum* spp., *Persea gratissima, Petunia* spp., *Phaseolus* spp., *Phoenix canariensis, Phormium cookianum, Photinia* spp., *Picea glauca, Pinus* spp., *Pisum sativam, Podocarpus totara, Pogonarthria fleckii, Pogonaffhria squarrosa, Populus* spp., *Prosopis cineraria, Pseudotsuga menziesii, Pterolobium stellatum, Pyrus communis, Quercus* spp., *Rhaphiolepsis umbellata, Rhopalostylis sapida, Rhus natalensis, Ribes grossularia, Ribes* spp., *Robinia pseudoacacia, Rosa* spp., *Rubus* spp., *Salix* spp., *Schyzachyrium sanguineum, Sciadopitys vefficillata, Sequoia sempervirens, Sequoiadendron giganteum, Sorghum bicolor, Spinacia* spp., *Sporobolus fimbriatus, Stiburus alopecuroides, Stylosanthos humilis, Tadehagi* spp, *Taxodium distichum, Themeda triandra, Trifolium* spp., *Triticum* spp., *Tsuga heterophylla, Vaccinium* spp., *Vicia* spp., *Vitis vinifera, Watsonia pyramidata, Zantedeschia aethiopica, Zea mays,* amaranth, artichoke, asparagus, broccoli, Brussels sprouts, cabbage, canola, carrot, cauliflower, celery, collard greens, flax, kale, lentil, oilseed rape, okra, onion, potato, rice, soybean, straw, sugar beet, sugar cane, sunflower, tomato, squash tea, maize, wheat, barley, rye, oat, peanut, pea, lentil and alfalfa, cotton, rapeseed, canola, pepper, sunflower, tobacco, eggplant, eucalyptus, a tree, an ornamental plant, a perennial grass and a forage crop. Alternatively, algae and other non-Viridiplantae can be used for the methods of the present invention.

According to some embodiments, the plant used according to the teachings of the present invention is a crop plant such as maize, rice, wheat, barley, peanut, potato, sesame, olive tree, palm oil, banana, soybean, sunflower, canola, sugarcane, alfalfa, millet, Leguminosae (bean, pea), flax, lupinus, rapeseed, tobacco, poplar and cotton. According to certain exemplary embodiments, the crop plant is maize (*Zea mays*).

According to some embodiment, the plant used according to the teachings of the present invention is a field crop plant selected from the group consisting of tomato, potato, sweet potato, cassava, beets, ginger, horseradish, radish, ginseng, turnip, any root or tuber crop, pepper, eggplant, ground cherry, tomatillo, okra, other fruiting vegetables, cucumber cantaloupe, melon, muskmelon, squash, watermelon and other cucurbit plants.

According to some embodiments of the invention the plant is a dicotyledonous plant.

According to some embodiments of the invention the plant is a monocotyledonous plant.

According to some embodiments the present invention provides a plant cell expressing the exogenous polynucleotide of some embodiments of the invention, the nucleic acid construct comprising the exogenous polynucleotide of some embodiments of the invention and/or the polypeptide of some embodiments of the invention.

According to a further aspect, the present invention provides a fungicidal composition comprising an effective amount of at least one polypeptide at least 70% identical to a polypeptide having an amino acid sequence selected from the group consisting of SEQ ID NOs:2635, 2444-2634, 2636-4252, a fragment and/or a variant thereof, wherein the fungicidal composition is effective in inhibiting the growth and/or development of at least one plant pathogenic fungi and/or oomycetes. According to certain embodiments, the fungicidal composition comprises at least one polypeptide having an amino acid sequence selected from the group consisting of SEQ ID NOs:2635, 4468, 4661, 2444-2634, 2636-4252, 4450-4467, 4469-4660, and 4662-4799. According to some embodiments, the fungicidal composition comprises at least one polypeptide having an amino acid sequence selected from the group consisting of SEQ ID NOs:4468, 4661, 4450-4467, 4469-4660, and 4662-4799.

According to yet additional aspect, the present invention provides a fungicidal composition comprising bacteria comprising at least one polypeptide at least 70% identical to a polypeptide having an amino acid sequence selected from the group consisting of SEQ ID NOs:2635, 2444-2634, 2636-4252, a fragment and/or a variant thereof, wherein the fungicidal composition is effective in inhibiting the growth and/or development of at least one plant pathogenic fungi and/or oomycetes. According to certain embodiments, the bacteria comprise at least one polypeptide having an amino acid sequence selected from the group consisting of SEQ ID NOs:2635, 4468, 4661, 2444-2634, 2636-4252, 4450-4467, 4469-4660, and 4662-4799. According to some embodiments, the bacteria comprise at least one polypeptide having an amino acid sequence selected from the group consisting of SEQ ID NOs:4468, 4661, 4450-4467, 4469-4660, and 4662-4799. Each possibility represents a separate embodiment of the present invention. The bacteria can be of the same species or of different species, with the proviso that the bacteria have no adverse effect on the plant. The bacteria can be alive or dead. Any bacteria suitable for expression of exogenous genes and not having negative effects on plant can be used (see, e.g. Billman-Jacobe H. "Expression in bacteria other than *E. coli* 1996. Curr. Opiniom in Biotech 7:500). According to certain exemplary embodiments, the bacteria are selected from the group consisting of *Bacillus subtilis, Lactococcus lacti, Corynebacterium glutamicum*; and *Bacillus brevis*. Particular example is *Bacillus* Expression systems Lonza XS™ ToolBox.

According to certain embodiments, the fungicidal composition further comprises at least one agriculturally compatible carrier or diluent.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

The following examples are presented in order to more fully illustrate some embodiments of the invention. They should, in no way be construed, however, as limiting the broad scope of the invention. One skilled in the art can readily devise many variations and modifications of the principles disclosed herein without departing from the scope of the invention.

EXAMPLES

Reference is now made to the following examples, which together with the above descriptions illustrate some embodiments of the invention in a non-limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., Eds.

(1984); "A Practical Guide to Molecular Cloning" Perbal, B., (1984) and "Methods in Enzymology" Vol. 1-317, Academic Press; "PCR Protocols: A Guide To Methods and Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Section I: Plant Genes Associated with Fungal Resistance

Example 1: Identification of Plant Genes Associated with Fungal Resistance

The inventors of the present invention have identified polynucleotides related to resistant to fungal infection, particularly to infection by *Fusarium verticillioides, Fusarium graminearum* or *Colletotrichum graminicola*. Modulating the expression of the polynucleotide in plants can increase the plant resistance to fungal infection.

The nucleotide sequence datasets used for the polynucleotide identification were originated from publicly available databases as well as from Applicant proprietary sequencing data obtained using the Solexa technology (form e.g. wheat, maize and sorghum). Sequence data from 200 different plant species was introduced into a single, comprehensive database. The information used to build the datasets included gene expression levels, protein annotation, enzymatic activity and involvement in biosynthetic pathways.

Major databases used included:

Genomic Databases

*Arabidopsis* genome [TAIR genome version 6 (arabidopsis.org/)];

Rice genome [IRGSP build 4.0 (rgp.dna.affrc.go.jp/IRGSP/)];

Poplar [*Populus trichocarpa* release 1.1 from JGI (assembly release v1.0) (genome.jgi-psf.org/)];

*Brachypodium* [JGI 4× assembly, brachpodium.org)];

Soybean [DOE-JGI SCP, version Glyma0 (phytozome.net/)];

Grape [French-Italian Public Consortium for Grapevine Genome Characterization grapevine genome (genoscope.cns.fr/)];

Castorbean [TIGR/J Craig Venter Institute 4× assembly [msc.jcvi.org/r communis];

Sorghum [DOE-JGI SCP, version Sbi1 [phytozome.net/)]; and

Maize "B73" [DOE-JGI SCP, version AGPv2 [phytozome.net/)];

Databases of Expressed Sequence Tag (EST) and mRNA Sequences:

GenBank ncbi.nlm.nih.gov/dbEST;

RefSeq (ncbi.nlm.nih.gov/RefSeq/);

TAIR (arabidopsis.org/);

Protein and Pathway Databases:

Uniprot [uniprot.org/];

AraCyc [arabidopsis.org/biocyc/index.jsp];

ENZYME [expasy.org/enzyme/];

Microarray datasets were downloaded from: GEO (ncbi.nlm.nih.gov/geo/); TAIR (arabidopsis.org/); and Applicant proprietary microarray data as described in PCT Patent Application Publication No. WO 2008/122980.

QTL (quantitative trait loci) and SNPs information was retrieved from Gramene [gramene.org/qtl/]; and Panzea [panzea.org/index.html].

Database Assembly

Database assembly was performed to build a wide, rich, reliable annotated and easy to analyze database. The assembly comprised data retrieved from publicly available genomic sequences, mRNA sequences, ESTs DNA sequences and QTL data, as well as information regarding gene expression, protein annotation, and involvement in biosynthesis pathway, all in various plant types. The assembly further comprised data retrieved from Applicant proprietary databases produced from various plant types including genomic sequences, mRNA sequences, expression, proteomic and metabolomic data, QTL and GWAS (genome-wide association studies) data.

Database assembly is comprised of a toolbox of gene refining, structuring and annotation as well as analysis tools enabling to construct a tailored database for each gene-discovery project. Gene refining and structuring tools enable to reliably detect splice variants and antisense transcripts, and understand various potential phenotypic outcomes of a single gene. The capabilities of the "LEADS" platform of Compugen LTD. for analyzing human genome have been confirmed and accepted by the scientific community [see e.g., "Widespread Antisense Transcription", Yelin, et al. (2003) Nature Biotechnology 21, 379-85; "Splicing of Alu Sequences", Lev-Maor, et al. (2003) Science 300 (5623), 1288-91; "Computational analysis of alternative splicing using EST tissue information", Xie H et al. Genomics 2002], and have been proven most efficient in plant genomics as well.

EST Clustering and Gene Assembly

For gene clustering and assembly of organisms with available genome sequence data (*Arabidopsis*, rice, castorbean, grape, *Brachypodium*, poplar, soybean, sorghum, maize) the genomic LEADS version (GANG) was employed. This tool allows most accurate clustering of ESTs and mRNA sequences on genome, and predicts gene structure as well as alternative splicing events and anti sense transcription.

For organisms with no available full genome sequence data, "expressed LEADS" clustering software was applied.

Gene Annotation

Predicted genes and proteins were annotated as follows: BLAST™ search [blast.ncbi.nlm.nih.gov/Blast.cgi] against all plant UniProt [uniprot.org/] sequences was performed. Open reading frames (ORFs) of each putative transcript were analyzed and longest ORF with highest number of homologues was selected as a predicted protein of the transcript. The predicted proteins were analyzed by InterPro [ebi.ac.uk/interpro/].

BLAST™ against proteins from AraCyc and ENZYME databases was used to map the predicted transcripts to AraCyc pathways.

Predicted proteins from different species were compared using BLAST™ algorithm (ncbi.nlm.nih.gov/Blast.cgi) to validate the accuracy of the predicted protein sequence, and for efficient detection of orthologs.

Gene Expression Profiling

Several data sources were exploited for gene expression profiling, namely microarray data and digital expression profile (see below). Genes were analyzed for expression patterns in different plant species and varieties. The analysis was based on differential expression under uninfected and infected conditions, wherein the infection was induced by different pathogens and the gene expression was measured in different plant organs and at different time points along the disease development. Publicly available microarray datasets were downloaded from TAIR and NCBI GEO sites, renormalized, and integrated into the database. Expression profiling is one of the most important resource data for identifying genes related to disease resistance.

A digital expression profile summary was compiled for each gene cluster according to all keywords included in the sequence records comprising the cluster. Digital expression, also known as electronic Northern Blot, is a tool that displays virtual expression profile based on the expressed sequence tag (EST) sequences forming the gene cluster. The tool provides the expression profile of a cluster in terms of plant anatomy (e.g., the tissue/organ in which the gene is expressed), developmental stage (the developmental stages at which a gene can be found) and profile of treatment (provides the physiological conditions under which a gene is expressed such as drought, cold, pathogen infection, etc.). Given a random distribution of ESTs in the different clusters, the digital expression provides a probability value that describes the probability of a cluster having a total of N ESTs to contain X ESTs from a certain collection of libraries. For the probability calculations, the following is taken into consideration: a) the number of ESTs in the cluster, b) the number of ESTs of the implicated and related libraries, c) the overall number of ESTs available representing the species. Thereby clusters with low probability values are highly enriched with ESTs from the group of libraries of interest indicating a specialized expression.

Recently, the accuracy of this system was demonstrated by Portnoy et al., 2009 (Analysis of The Melon Fruit Transcriptome Based on 454 Pyrosequencing, in: Plant & Animal Genomes XVII Conference, San Diego, Calif.). Transcriptomic analysis, based on relative EST abundance in data was performed by 454 pyrosequencing of cDNA representing mRNA of the melon fruit. Fourteen double strand cDNA samples obtained from two genotypes, two fruit tissues (flesh and rind) and four developmental stages were sequenced. GS FLX pyrosequencing (Roche/454 Life Sciences) of non-normalized and purified cDNA samples yielded 1,150,657 expressed sequence tags that assembled into 67,477 unigenes (32,357 singletons and 35,120 contigs). Analysis of the data obtained against the Cucurbit Genomics Database [icugi.org/] confirmed the accuracy of the sequencing and assembly. Expression patterns of selected genes fitted well their qRT-PCR data.

The produced datasets were used for further comparative analyses of gene expression in various plant species and lines in response to fungal infection.

Example 2: Production of Plant Transcriptomes for Discovery of Genes Correlating with Resistance to the Fungal Infection Experimental Procedures The association of gene expression with fungal infection was examined in *Brachypodium distachyon, Aegilops* spp., *Setaria italica, Triticum aestivum* and *Zea mays*.

The following pathogenic fungi were used: *Fusarium verticillioides* (hereinafter *F. verticillioides* or Fv). A GFP transformant of *F. verticillioides* strain A-00149-FGSC 7600 (Oren et al., 2003, Appl. Environ. Microbiol. 69:1695) was used throughout the data generation and validation experiments; and *Fusarium graminearum* (hereinafter *F. graminearum* or Fg).

Fungi Infection

Fungal infection of plant roots: this method was used for inoculating plant root with *F. verticillioides* (Fv) and *Fusarium graminearum* (Fg). Sterilized seeds from tolerant and sensitive lines of the examined plant were germinated on water agar supplemented with Ampicillin (100 µg/ml) and inoculated after 6 days with an agar plug (1 cm diameter) covered with one-week old fungal mycelium applied to the root site (1 cm below the seed) for 2 hours four days after germination. Control plants were mock inoculated with an empty plug.

RNA extraction was performed using TRIzol Reagent from Invitrogen (invitrogen.com/content.cfm?pageid=469). Approximately 30-50 mg of sample tissue was taken for the analysis. The weighed tissues were ground using pestle and mortar in liquid nitrogen and resuspended in 500 µl of TRIzol Reagent. To the homogenized lysate, 100 µl of chloroform were added followed by precipitation using isopropanol and two washes with 75% ethanol. The RNA was eluted in 30 µl of RNase-free water. RNA samples were cleaned up using Qiagen's RNeasy minikit clean-up protocol as per the manufacturer's protocol (QIAGEN Inc, CA USA).

RNA was extracted from tissues of the infected and mock plants obtained from each treatment as follows:

Direct root infection—Root and basal stem tissues from plants growing under normal or fungal infection conditions were sampled at 6, 24 and 72 hours post infection (hpi) and RNA was extracted as described hereinabove.

Identification and Validation of Gene Associated with Fungal Infection

In order to discover gene expressed in the examined plant species and plant lines with fungal infection, the present inventors utilized available micro-arrays as described in details hereinbelow for each plant species examined. To define correlations between the levels of RNA expression and fungal resistance, parameters related to plant response to fungal infection were analyzed under normal and infected conditions. From plant identified as encompassing variance in the resistance or susceptibility spectrum, hybrids were selected for further association analysis between fungal infection and gene expression after the plants were challenged with *F. verticillioides* or *F. graminearum* as described hereinabove.

Fungal infection was phenotyped as follows:

Plants infected via the direct root infection were phenotyped (24 and 72 hpi) for fungal recovery from root and stem tissues by culturing sterilized explants on PDA for 4-5 days and validating the presence of the Fv-GFP strain. For plants infected with Fg, development of necrosis on the roots was monitored along 7 days.

Example 2.1: Production of *B. distachyon* Plant Transcriptomes

The association of gene expression in *Brachypodium* lines with fungal infection was investigated utilizing a *Brachypodium* oligonucleotide micro-array, produced by Agilent Technologies [chem.agilent.com/Scripts/PDS.asp?lPage=50879]. The array oligonucleotide represents about 27,500 *Brachypodium* genes and transcripts. To define correlations between the levels of RNA expression and fungal resistance, parameters related to responses to fungal infection were analyzed in 30 different *Brachypodium* lines under normal and infected conditions as described hereinabove. Among them, 5 lines encompassing susceptibility to *F. graminearum* (designated as "sensitive", Table 1) were selected for RNA expression analysis after challenge with *F. verticillioides* or *F. graminearum* as described hereinabove.

TABLE 1

*Brachypodium* varieties used for production of transcriptomic data and their phenotypic response to *F. graminearum* infection

| Variety | Response to *F. graminearum* |
|---|---|
| Bd20-1 | Sensitive |
| Bd25-1 | Sensitive |
| PI254868 | Sensitive |
| Bd9-1 | Sensitive |
| Bd26-1 | Sensitive |

Example 2.2: Production of *Setaria italica* Transcriptome for Discovery of Gene Correlating with Resistance to the Fungal Infection The association of gene expression in *Setaria italica* lines with fungal infection was investigated utilizing a *Setaria italica* oligonucleotide micro-array, produced by Agilent Technologies [chem.agilent.com/Scripts/PDS.asp?lPage=50879]. The array oligonucleotide represents about 27,500 *Setaria italica* genes and transcripts designed based on data from Public databases (Example 1). To define correlations between the levels of RNA expression and fungal resistance related parameters in responses to fungal infection various plant characteristics of 30 different *Setaria italica* hybrids were analyzed under normal and infected conditions as described hereinabove. Among them, 5 hybrids encompassing medium resistance to *F. graminearum* (designated as "medium resistant", Table 2) were selected for RNA expression analysis after challenge with *F. verticillioides* or *F. graminearum*

TABLE 2

*Setaria italica* varieties used for production of transcriptomic data and their phenotypic response to *F. graminearum* infection

| Variety | Response to *F. graminearum* |
|---|---|
| PI231736 | Medium resistant |
| PI473596 | Medium resistant |
| PI253494 | Medium resistant |
| PI269971 | Medium resistant |
| Ames27267 | Medium resistant |

Example 2.3: Production of *Aegilops* Spp. Transcriptome

In order to define correlations between the levels of RNA expression with fungal resistance related parameters, responses to fungal infection of 30 different *Aegilops* varieties were analyzed under normal and infected conditions as described hereinabove. Among them, 5 hybrids encompassing resistance to *F. graminearum* (designated resistant", Table 3) were selected for RNAseq expression analysis (Illumina) after challenge with *F. verticillioides* or *F. graminearum*.

TABLE 3

*Aegilops* varieties used for production of transcriptomic data and their phenotypic response to *F. garminearum* infection

| Species | Variety | Response to *F. graminearum* |
|---|---|---|
| *Aegilops geniculata* | Coll3-III | Resistant |
| *Aegilops geniculata* | Coll3-VI | Resistant |
| *Aegilops tauschii* | L84 TQ20 | Resistant |
| *Aegilops tauschii* | TQ106 | Resistant |
| *Aegilops sharonensis* | 6118VI | Resistant |

Example 2.4: Production of Maize Transcriptome

The association of gene expression in Maize lines with fungal infection was investigated utilizing a Maize oligonucleotide micro-array, produced by Agilent Technologies [chem.agilent.com/Scripts/PDS.asp?lPage=50879]. The array oligonucleotide represents about 60K Maize genes and transcripts designed based on data from Public databases (Example 1). To define correlations between the levels of RNA expression and fungal resistance related parameters responses to fungal infection of various plant characteristics of 30 different Maize hybrids were analyzed under normal and infected conditions as described hereinabove. Among them, 6 hybrids encompassing variance in the resistance spectrum to *F. verticillioides* or *C. graminicola* (designated as "tolerant" and "sensitive", Table 4) were selected for RNA expression analysis after challenge with *F. verticillioides* or *F. graminearum*

TABLE 4

Maize varieties used for production of transcriptomic data and their phenotypic response to *F. verticillioides* infection

| Variety | Response to *F. verticillioides* |
|---|---|
| 32W86 | Tolerant |
| Klips | Sensitive |
| W182E | Tolerant |
| B84 | Sensitive |
| NC350 | Tolerant |
| Ky WS4 | Sensitive |

Example 2.5: Production of Wheat Transcriptome

The association of gene expression in wheat lines to fungal infection was investigated utilizing a wheat oligonucleotide micro-array, produced by Agilent Technologies [chem.agilent.com/Scripts/PDS.asp?lPage=50879]. The array oligonucleotide represents about 50,000 wheat genes and transcripts.

In order to define correlations between the levels of RNA expression with fungal resistance related parameters, responses to fungal infection of 30 different wheat varieties were analyzed under normal and infected conditions as described hereinabove. Among them, 6 hybrids encompassing variance in the resistance spectrum to *F. verticillioides* (designated as "tolerant" and "sensitive", Table 5) were selected for RNA expression analysis after challenge with *F. verticillioides* or *F. graminearum*.

TABLE 5

Wheat varieties used for production of transcriptomic data and their phenotypic response to *F. verticillioides* infection

| Variety | Response to *F. verticillioides* |
|---|---|
| Aurora | Sensitive |
| Precoce | Tolerant |
| Barani | Sensitive |
| N46 | Tolerant |
| Bobwhite | Sensitive |
| Thacher | Tolerant |

Differential Expression Analysis

The analysis was preformed via proprietary differential expression algorithm.

The default query parameters used were: >2 fold change, p value<0.01, FDR<0.5 (FDR=false discovery rate). Stringency varied due to specific experimental context. The following queries were performed across species (aggregated through the use of proprietary ortholog determination), germplasm, organs, types of pathogens treated, and time post infection:

1. Up regulation upon infection: the gene's expression level is higher in infected samples than in mock controls (both resistant and susceptible lines are queried).

2. Stronger expression induction in resistant lines: the gene's expression induction is higher in resistant than in susceptible lines upon infection.

3. Higher basal expression in resistant lines: the gene's expression is higher in resistant than in susceptible lines in uninfected samples.

No type of query is necessary nor sufficient but overall enrichment of positive indications is considered to identify genes significantly qualifying the above criteria Results The genes identified using the above differential expression analyses and the indications found per gene are described hereinbelow:

LFS90

*Aegilops*—The gene was upregulated in the roots in response to *Fusarium verticillioides* (Fv) at early infection stage (6 and 24 hours post infection—hpi).

Wheat—The wheat gene ortholog was upregulated in the roots and stem in response to Fv at early infection stages (6 and 72 hpi, respectively), and in the inflorescence in response to *Fusarium graminearum* (Fg) at early infection stages (30 and 50 hpi).

LFS91

*Aegilops*—The gene was upregulated in the roots in response to *Fusarium verticillioides* (Fv) at early infection stage (6 and 24 hpi).

Barley—The barley gene ortholog was upregulated at both early and late stages following inflorescence infection with *Fusarium graminearum* (Fg) or challenging assays with the mycotoxin Deoxynivalenol (DON) 1, 2, 3, 4- and 6-days post infection (dpi).

*Brachypodium*—The *Brachypodium* ortholog was upregulated in the roots of several genotypes in response to Fg at early infection stages (48 hpi).

Maize—The maize gene ortholog was upregulated in response to *Colletotrichum graminicola* (Cg) at early infection stage (120 hpi).

*Sorghum*—The *sorghum* ortholog was upregulated in the roots in response to Fv at early infection stages (6, 24 and 72 hpi).

Wheat—The wheat ortholog was upregulated in the inflorescence in response to Fg at early infection stages (50 hpi).

QTL—The rice ortholog mapped to a QTL for blast disease resistance.

LFS92

*Aegilops*—The gene was upregulated in the roots in response to *Fusarium verticillioides* (Fv) at early infection stage (6 and 24 hpi).

Wheat—The wheat ortholog was upregulated in the inflorescence in response to *Fusarium graminearum* (Fg) at early infection stages (50 hpi).

Maize—The maize ortholog was upregulated in the inflorescence in response to Fv at early infection stages (72 and 96 hpi). In addition, the ortholog was upregulated in the leaves in response to *Colletotrichum graminicola* (Cg) at early infection stages (96 and 120 hpi).

QTL—The soybean ortholog mapped to a QTL for fungal disease resistance.

LFS93

*Aegilops*—The gene was upregulated in the roots in response to *Fusarium verticillioides* (Fv) at early infection stage (6 and 24 hpi).

QTL—The maize ortholog mapped to QTLs for *Fusarium* ear rot resistance and for resistance to contamination with the mycotoxin fumonisin.

LFS94

*Aegilops*—The gene was upregulated in the roots in response to *Fusarium verticillioides* (Fv) at early infection stage (6 and 24 hpi).

Wheat—The wheat ortholog was upregulated in the roots of resistant genotypes in response to Fv at early infection stages (1.5 and 2.5 hpi) and in the inflorescence in response to *Fusarium graminearum* (Fg) at early infection stages (30 and 50 hpi)

LFS95

*Brachypodium*—The *Brachypodium* ortholog gene was upregulated following spikes inoculation with *Fusarium graminearum* (Fg) (96 hpi).

Wheat—The wheat ortholog was upregulated in the roots of resistant genotypes in response to Fv at early infection stages (1.5 and 2.5 hpi) and in the inflorescence in response to *Fusarium graminearum* (Fg) at early infection stages (30 and 50 hpi).

Maize—The maize ortholog was upregulated in the inflorescence in response to Fv at early infection stages (96 hpi). In addition, the ortholog was upregulated in the leaves in response to *Colletotrichum graminicola* (Cg) at early infection stages (96 and 120 hpi).

LFS96

*Aegilops*—The gene was upregulated in the roots in response to *Fusarium verticillioides* (Fv), and in several genotypes also to *Fusarium graminearum* (Fg) at early infection stage (6 and 24 hpi).

Maize—The maize ortholog was upregulated in the inflorescence in response to Fv at early infection stages (72 and 96 hpi). In addition, the ortholog was upregulated in the leaves in response to *Colletotrichum graminicola* (Cg) at early infection stages (72, 96 and 120 hpi).

QTL—The rice ortholog mapped to a QTL for blast disease resistance.

LFS97

*Aegilops*—The gene was upregulated in the roots in response to *Fusarium verticillioides* (Fv) at early infection stage (6 and 24 hpi). In addition, an upregulation in several genotypes was observed in the roots in response to *Fusarium graminearum* (Fg) at early infection stages (6 and 24 hpi).

Barley—The barley ortholog was upregulated at early and late stages following inflorescence infection with Fg (72, 96 and 144 hpi) or challenging assays with the mycotoxin Deoxynivalenol (DON) (12 and 24 hpi).

Wheat—The wheat ortholog was upregulated in the inflorescence in response to Fg at early infection stages (30 and 50 hpi).

Maize—The maize ortholog was upregulated in the inflorescence in response to Fv at early infection stage (72 hpi). In addition, the gene was upregulated in the leaves in response to Colletotrichum graminicola (Cg) at early infection stage (120 hpi) and was upregulated in the inflorescence following Cg infection (72 hpi).

Sorghum—The sorghum ortholog was upregulated in the roots in response to Fv at early infection stages (2.5 and 6 hpi).

QTL—The maize ortholog mapped to a QTL for resistance to the mycotoxin fumonisin contamination. The Sorghum ortholog mapped to a QTL for rust resistance.

LFS98

Aegilops—The gene was upregulated in the roots in response to Fusarium verticillioides (Fv) at early infection stage (6 and 24 hours post infection—hpi). In addition, an upregulation in several genotypes was observed in the roots, in response to Fusarium graminearum (Fg) at early infection stages (24 hpi).

Maize—The maize ortholog was upregulated in the roots in response to Fv and Fg at early infection stages (6 hpi and 72 hpi, respectively). In addition, the ortholog was upregulated in the leaves in response to Colletotrichum graminicola (Cg) at early infection stage (96 and 120 hpi).

Sorghum—The Sorghum ortholog was upregulated in the roots in response to Fv at early infection stages (24 hpi).

Wheat—The wheat ortholog was upregulated in the roots in response to Fv at late infection stages (10 days post infection—dpi), and in the inflorescence in response to Fg at early infection stages (50 hpi).

QTL—The maize ortholog mapped to a QTL for Fusarium ear rot resistance. The rice ortholog mapped to a QTL for sheath blight disease resistance.

LFS99

Barley—The barley ortholog was upregulated at both early and late stages following inflorescence infection with Fusarium graminearum (Fg) or challenging assays with the mycotoxin Deoxynivalenol (DON) (1, 2, 3, 4 and 6 dpi).

Wheat—The wheat ortholog was upregulated in the roots in response to Fv at early infection stages (6 and 24 hpi). In addition, the ortholog was upregulated in the inflorescence in response to Fg at early infection stages (30 and 50 hpi).

LFS100

Aegilops—The gene was upregulated in the roots in response to Fusarium verticillioides (Fv) at early infection stage (6 and 24 hours post infection—hpi). In addition, an upregulation in several genotypes was observed in the roots, in response to Fusarium graminearum (Fg) at early infection stages (6 and 24 hpi).

Wheat—The wheat ortholog was upregulated in the roots of resistant genotypes in response to Fv at early infection stages (6 and 24 hpi) and in the inflorescence in response to Fg at early infection stages (30 and 50 hpi).

Brachypodium—The Brachypodium ortholog was upregulated in the roots at early stages of both Fv and Fg infections (6 and 24 hpi).

Barley—The barley ortholog was upregulated at both early and late stages following inflorescence infection with Fg or challenging assays with the mycotoxin Deoxynivalenol (DON) (1, 2, 3, 4 and 6 dpi).

QTL—The rice ortholog mapped to a QTL for blast disease resistance

LFS102

Aegilops—The gene was upregulated in the roots in response to Fusarium verticillioides (Fv) at early infection stage (6 and 24 hours post infection—hpi).

Wheat—The wheat ortholog was upregulated in the inflorescence in response to Fg at early infection stages (30 and 50 hpi).

Barley—The barley ortholog was upregulated at late stages following inflorescence infection with Fg (3, 4- and 6-days post infection—dpi) or at early stage following challenging assays with the mycotoxin Deoxynivalenol (DON) (2 and 4 dpi).

Maize—The maize ortholog was upregulated in the leaves in response to Colletotrichum graminicola (Cg) at early and late infection stages (120 hpi) and was upregulated in the inflorescence following Cg infection (4 and 6 dpi). QTL—The maize ortholog mapped to a QTL for fumonisin contamination resistance.

LFS104

Aegilops—The gene was upregulated in the roots in response to Fusarium verticillioides (Fv) at early infection stage (6 and 24 hpi). In addition, an upregulation in several genotypes was observed in the roots, in response to Fusarium graminearum (Fg) at early infection stages (24 hpi).

Wheat—The wheat ortholog was upregulated in the roots in response to Fv at early infection stages (6 and 24 hpi) and in the inflorescence in response to Fg at early infection stages (30 and 50 hpi).

Brachypodium—The Brachypodium ortholog was moderately upregulated following spikes inoculation with Fg (96 hpi).

Barley—The barley ortholog was upregulated at both early and late stages following inflorescence infection with Fg or challenging assays with the mycotoxin Deoxynivalenol (DON) (1, 2, 3, 4- and 6-days post infection—dpi).

Maize—The maize ortholog was upregulated in the leaves in response to Colletotrichum graminicola (Cg) at early and late infection stages (120 hpi).

Sorghum—The Sorghum ortholog was upregulated in the roots in response to Fv at early infection stages (6 hpi).

QTL—The maize ortholog mapped to QTLs for fumonisin contamination resistance. The rice ortholog mapped to a QTL for blast disease resistance.

LFS105

Aegilops—The gene was upregulated in the roots in response to Fusarium verticillioides (Fv) at early infection stage (6 and 24 hpi).

Maize—The maize ortholog was upregulated in the inflorescence in response to Fv at early infection stages (72 hpi). In addition, the ortholog was upregulated in the leaves in response to Colletotrichum graminicola (Cg) at early infection stage (120 hpi).

Wheat—The wheat ortholog was upregulated in the roots in response to Fv at early infection stages (6 and 24 hpi) and in the inflorescence in response to Fusarium graminearum (Fg) at early infection stages (30 and 50 hpi).

QTL—The rice ortholog mapped to a QTL for blast disease resistance

LFS106

Aegilops—The gene was upregulated in the roots in response to Fusarium verticillioides (Fv) at early infection stage (6 and 24 hpi).

Brachypodium—The Brachypodium ortholog was upregulated in the roots of several genotypes in response to Fv at early infection stage (48 hpi). In addition, the gene was upregulated following spikes inoculation with *Fusarium graminearum* (Fg) (96 hpi).

Wheat—The wheat ortholog was upregulated in the inflorescence in response to Fg at early infection stages (50 hpi).

Maize—The maize ortholog was upregulated in the inflorescence in response to Fv at early infection stage (72 hpi). In addition, the gene was upregulated in the leaves in response to *Colletotrichum graminicola* (Cg) at early infection stage (120 hpi).

Sorghum—The *Sorghum* ortholog was upregulated in the roots in response to Fv at early infection stages (6 and 24 hpi)

LFS107

*Aegilops*—The gene was upregulated in the roots in response to *Fusarium verticillioides* (Fv) at early infection stage (6 and 24 hpi). In addition, in several genotypes upregulation was observed in the roots in response to *Fusarium graminearum* (Fg) at early infection stages (24 hpi).

Foxtail millet (*Setaria italica*)—The foxtail millet ortholog was moderately upregulated in the roots in response to Fg at early infection stages (24 and 48 hpi).

Wheat—The wheat ortholog was upregulated in the roots in response to Fv at early infection stages (6 hpi) and in the inflorescence in response to Fg at early infection stages (30 and 50 hpi).

QTL—The rice ortholog mapped to a QTL for blast disease resistance.

LFS109

*Aegilops*—The gene was upregulated in the roots in response to *Fusarium verticillioides* (Fv) at early infection stage (6 and 24 hpi) and upregulated moderately in the roots in response to *Fusarium graminearum* (Fg) at early infection stage (6 and 24 hpi).

*Brachypodium*—The *Brachypodium* ortholog was upregulated in the roots of several genotypes in response to Fg at early infection stages (48 hpi).

Maize—The maize ortholog was upregulated in the inflorescence in response to Fv at early infection stages (72 hpi). In addition, the ortholog was upregulated in the leaves in response to *Colletotrichum graminicola* (Cg) at early infection stage (48, 96 and 120 hpi).

Sorghum—The *Sorghum* ortholog was upregulated in the roots in response to Fv at early infection stages (6 and 24 hpi).

LFS110

*Aegilops*—The gene was upregulated in the roots in response to *Fusarium verticillioides* (Fv) at early infection stage (6 and 24 hpi). In addition, an upregulation in several genotypes was observed in the roots, in response to *Fusarium graminearum* (Fg) at early infection stages (24 hpi).

Barley—The barley ortholog was upregulated at early infection stages following inflorescence infection with Fg (96 hpi) or challenging assays with the mycotoxin Deoxynivalenol (DON) (1 and 12 hpi).

Maize—The maize ortholog was upregulated in the leaves in response to *Colletotrichum graminicola* (Cg) at early infection stages (120 hpi).

QTL—The maize ortholog mapped to QTLs for *Fusarium* ear rot resistance. The rice ortholog mapped to a QTL for blast disease resistance. The soybean ortholog mapped to a QTL for fungal disease resistance.

LFS111

*Aegilops*—The gene was upregulated in the roots in response to *Fusarium verticillioides* (Fv) at early infection stage (6 and 24 hpi).

Foxtail millet (*Setaria italica*)—The foxtail millet ortholog was moderately upregulated in the roots of several genotypes in response to *Fusarium graminearum* (Fg) at early infection stages (48 hpi).

*Brachypodium*—The *Brachypodium* ortholog was moderately upregulated in the roots of several genotypes in response to Fg at early infection stages (48 hpi).

QTL—The maize ortholog mapped to QTLs for resistance to fumonisin contamination. The rice ortholog mapped to a QTL for blast disease resistance.

LFS112

*Aegilops*—The gene was upregulated in the roots in response to *Fusarium verticillioides* (Fv) at early infection stage (6 and hpi).

Foxtail millet (*Setaria italica*)—The foxtail millet ortholog was upregulated in the roots of several genotypes at early infection stages of Fv infection (6 and 24 hpi).

Maize—The maize ortholog was upregulated in the inflorescence in response to Fv at early infection stage (72 hpi). In addition, the gene was upregulated in the leaves in response to *Colletotrichum graminicola* (Cg) at early and late infection stages (120 hpi) and was upregulated in the inflorescence following Cg infection (4 and 6 dpi).

QTL—The rice ortholog mapped to a QTL for sheath blast disease resistance. The soybean ortholog is mapped to a QTL for a fungal disease resistance

LFS113

*Aegilops*—The gene was upregulated in the roots in response to *Fusarium verticillioides* (Fv) at early infection stage (6 and 24 hpi).

Barley—The barley ortholog was upregulated at both early and late stages following inflorescence infection with *Fusarium graminearum* (Fg) or challenging assays with the mycotoxin Deoxynivalenol (DON) (1, 2, 3, 4 and 6 dpi).

Foxtail millet (*Setaria italica*)—The foxtail millet ortholog was upregulated in the roots of several genotypes in response to Fg at early infection stages (24 and 48 hpi).

*Brachypodium*—The *Brachypodium* ortholog was upregulated in the roots of several genotypes in response to Fg at early infection stages (48 hpi).

Wheat—The wheat ortholog was upregulated in the inflorescence in response to Fg at early infection stages (30 and 50 hpi).

QTL—The *Sorghum* ortholog mapped to a QTL for anthracnose resistance. The rice ortholog mapped to a QTL for blast disease resistance.

LFS114

*Aegilops*—The gene was upregulated in the roots in response to *Fusarium verticilloides* (Fv) and *Fusarium graminearum* (Fg) at early infection stage (6 and 24 hpi).

*Brachypodium*—The gene was upregulated in the roots in response to Fg at early infection stage (24 and 48 hpi).

Barley—The barley ortholog was upregulated at early stages following inflorescence challenging with the mycotoxin Deoxynivalenol (DON) (1 and 12 hpi).

Wheat—The wheat ortholog was upregulated in inflorescence in response to Fg at early infection stages (30 and 50 hpi).

Maize—The maize ortholog was upregulated in the roots in response to Fv at early (6 hpi) and late (6 and 14 dpi) infection stages. In addition, the ortholog was upregulated in the inflorescence in response to Fv at early infection stage (72 hpi). The ortholog was also upregulated in the roots in response to Fg at early infection stages (24 and 72 hpi). An upregulation was also observed in the leaves in response to *Colletotrichum graminicola* (Cg) infection (96 and 120 hpi).

Sorghum—The *Sorghum* ortholog was upregulated in the roots in response to Fv at early infection stages (6 and 24 hpi)

LFS115

*Aegilops*—The gene was upregulated in the roots in response to *Fusarium graminearum* (Fg) at early infection stage (6 and 24 hpi).

LFS116

*Aegilops*—The gene was upregulated in the roots in response to *Fusarium verticillioides* (Fv) at early infection stage (6 and 24 hpi).

Brachypodium—The *Brachypodium* ortholog was upregulated following spikes inoculation with *Fusarium graminearum* (Fg) (96 hpi).

Wheat—The wheat ortholog was upregulated in the inflorescence in response to Fg at early infection stages (30 and 50 hpi).

QTL—The rice ortholog mapped to a QTL for blast disease resistance.

LFS117

*Aegilops*—The gene was upregulated in the roots in response to *Fusarium verticillioides* (Fv) at early infection stage (6 and 24 hours post infection—hpi).

Brachypodium—The *Brachypodium* ortholog was upregulated following spikes inoculation with *Fusarium graminearum* (Fg) (96 hpi).

Maize—The maize ortholog was upregulated in the roots in response to Fg at early infection stages (72 hpi).

QTL—The maize ortholog mapped to a QTL for *Fusarium* ear rot resistance

LFS121

Foxtail millet (*Setaria italica*)—The gene was upregulated in the roots at early stages of *Fusarium verticillioides* (Fv) and *Fusarium graminearum* (Fg) infection (6 and 24 hpi).

*Aegilops*—The *Aegilops* ortholog was upregulated in the roots at early infection stages of Fg and Fv infection (6 and 24 hpi).

Sorghum—The *Sorghum* ortholog was upregulated in the roots in response to Fv at early infection stages (6 and 24 hpi).

Wheat—The wheat ortholog was upregulated in the roots of resistant genotypes in response to Fv at early infection stages (6 hpi) and in the inflorescence in response to Fg at early infection stages (30 and 50 hpi).

Maize—The maize ortholog was upregulated in the leaves in response to *Colletotrichum graminicola* (Cg) at early infection stages (120 hpi).

QTL—The maize ortholog mapped to a QTL for *Fusarium* ear rot resistance.

LFS122

Foxtail millet (*Setaria italica*)—The gene was upregulated in the roots of several genotypes in response to *Fusarium verticillioides* (Fv) and *Fusarium graminearum* (Fg) at early infection stages (6 and 24 hpi).

*Aegilops*—The *Aegilops* ortholog was upregulated in the roots in response to Fv at early infection stage (6 and 24 hpi)

LFS123

Foxtail millet (*Setaria italica*)—The gene was upregulated in the roots at early stages of *Fusarium graminearum* (Fg) infection (24 and 48 hpi).

LFS124

Foxtail millet (*Setaria italica*)—The gene was upregulated in the roots at early infection stages of both *Fusarium verticillioides* (Fv) and *Fusarium graminearum* (Fg) infections (6 and 24 hpi).

*Aegilops*—The *Aegilops* ortholog was upregulated in the roots in response to Fv at early infection stage (6 and 24 hpi). In addition, an upregulation in several genotypes was observed in the roots, in response to Fg at early infection stages (24 hpi).

Wheat—The wheat ortholog was upregulated in the roots in response to Fv at early infection stages (24 and 72 hpi) and in the inflorescence in response to Fg at early infection stages (50 hpi).

Barley—The barley ortholog was upregulated at both early and late stages following inflorescence infection with Fg or challenging assays with the mycotoxin Deoxynivalenol (DON) (1, 2, 3, 4 and 6 dpi).

Maize—The maize ortholog was upregulated in the inflorescence in response to Fv at early infection stage (72 hpi).

Sorghum—The *Sorghum* ortholog was upregulated in the roots in response to Fv at early infection stages (6 and 24 hpi).

QTL—The rice ortholog mapped to a QTL for blast disease resistance. The *Sorghum* ortholog mapped to a QTL for rust resistance.

LFS125

Foxtail millet (*Setaria italica*)—The foxtail millet gene was upregulated in the roots in response to *Fusarium verticillioides* (Fv) and *Fusarium graminearum* (Fg) at early infection stages (24 hpi).

*Aegilops*—The *Aegilops* ortholog was upregulated in the roots in response to Fv at early infection stage (6 and 24 hpi).

Maize—The maize ortholog was upregulated in the inflorescence of resistant genotype in response to Fv at early infection stages (96 hpi). In addition, the ortholog was upregulated in the leaves of resistant genotype in response to *Colletotrichum graminicola* (Cg) at early infection stage (48 and 120 hpi).

Sorghum—The *Sorghum* ortholog was upregulated in the roots in response to Fv at early infection stages (6 hpi).

QTL—The maize ortholog mapped to a QTL for fumonisin contamination resistance.

LFS126

Foxtail millet (*Setaria italica*)—The gene was upregulated in the roots at early stages of *Fusarium verticillioides* (Fv) and *Fusarium graminearum* (Fg) infection (24 and 48 hpi).

Sorghum—The *Sorghum* ortholog was upregulated in the roots in response to *Fusarium verticillioides* (Fv) at early infection stages (72 hpi).

QTL—The *Sorghum* ortholog mapped to a QTL for anthracnose resistance.

LFS127

Foxtail millet (*Setaria italica*)—The gene was upregulated in the roots at early stages of *Fusarium graminearum* (Fg) infection (24 and 48—hpi).

Brachypodium—The *Brachypodium* ortholog was upregulated in the roots at early stages of Fg and *Fusarium verticillioides* (Fv) infection (48 hpi).

*Aegilops*—The *Aegilops* ortholog was upregulated in the roots of several genotypes at early stages of Fg and Fv infection (24 hpi).

Sorghum—The *Sorghum* ortholog was upregulated in the roots in response to Fv at late infection stages (5 dpi).

Maize—The maize ortholog was upregulated in the leaves of a resistant genotype in response to *Colletotrichum graminicola* (Cg) at early infection stage (120 hpi).

Wheat—The wheat ortholog was upregulated in the roots in response to Fv at early and late infection stages (6, 24 and hpi, 5 and 10 dpi). QTL—The rice ortholog mapped to a QTL for blast disease resistance. The sorghum ortholog mapped to QTLs for anthracnose resistance and for rust resistance.

LFS128

Foxtail millet (*Setaria italica*)—The gene was upregulated in the roots at early infection stages of *Fusarium graminearum* (Fg) infection (24 and 48 hpi).

*Aegilops*—The *Aegilops* ortholog was moderately upregulated in the roots in response to *Fusarium verticillioides* (Fv) at early infection stage (6 hpi).

*Sorghum*—The *Sorghum* ortholog was upregulated in the roots in response to Fv at early infection stages (2.5 hpi)

LFS129

*Aegilops*—The *Aegilops* ortholog was upregulated in the roots in response to *Fusarium verticillioides* (Fv) at early infection stage (6 and 24 hpi).

Wheat—The wheat ortholog was upregulated in the inflorescence in response to Fg at early infection stages (30 and 50 hpi).

Barley—The barley ortholog was upregulated at both early and late stages following inflorescence infection with Fg (72, 96 and 144 hpi).

*Brachypodium*—The *Brachypodium* ortholog was upregulated in the roots of several genotypes in response to Fg at early infection stage (48 hpi).

QTL—The rice ortholog mapped to a QTL for sheath blight disease resistance.

LFS130

*Aegilops*—Computational evidences indicate up-regulation of the gene mainly at early infection stages of *Fusarium verticillioides* (Fv) and *Fusarium graminearum* (Fg) in roots.

LFS131

Foxtail mille (*Setaria italica*)—The gene was upregulated in the roots and stem in response to *Fusarium verticillioides* (Fv) at early infection stages.

LFS132

Maize—Computational evidences indicate upregulation of the gene in roots of sensitive lines at early infection stages of *Fusarium verticillioides* (Fv).

LFS82

Maize—Computational evidences indicate upregulation of the gene mainly at early infection stages of *Fusarium verticillioides* (Fv) and *Fusarium graminearum* (Fg) in different organs Wheat—The wheat ortholog was upregulated in the roots and stem in response to Fv at early infection stages.

LFS83

Wheat—Computational evidences indicate upregulation of the gene mainly at early infection stages of *Fusarium verticillioides* (Fv) and *Fusarium graminearum* (Fg) in different organs.

*Aegilops* and Maize—The gene orthologs were upregulated in the roots and stem in response to *Fusarium verticillioides* (Fv) at early infection stages.

LFS84

Wheat—Computational evidences indicate upregulation of the gene and its *Aegilops* ortholog mainly at early infection stages of *Fusarium verticillioides* (Fv) and *Fusarium graminearum* (Fg) in different organs Maize—The gene was up regulated as a result of *Colletotrichum graminicola* (Cg) infection in stem tissue.

LFS86

Maize—Computational evidences indicate upregulation of the gene and its *Sorghum* ortholog mainly at early infection stages of *Fusarium verticillioides* (Fv) and *Fusarium graminearum* (Fg) in different organs.

LFS87

Maize—Computational evidences indicate upregulation of the gene and its wheat ortholog mainly at early infection stages of *Fusarium verticillioides* (Fv) and *Fusarium graminearum* (Fg) in different organs

LFS89

Wheat—Computational evidences indicate upregulation of the gene at late infection stages of *Fusarium graminearum* (Fg) in heads and its *Aegilops* ortholog mainly at early infection stages of *Fusarium verticillioides* (Fv) and *Fusarium graminearum* (Fg) roots.

Maize—Computational evidences indicate a positive correlation of the gene expression to the base diameter, stalk width.

The plant genes listed in Table 6 below were identified as candidates to have a major impact on plant resistance to at least one of *Fusarium verticilloides, Fusarium graminearum* and *Colletotrichum graminicola* when expression thereof is modulated in plants. The identified gene name, the plant from which it is derived, and the amino acid and nucleic acid sequences of each gene are summarized in Table 6, hereinbelow.

TABLE 6

Genes associated with plant resistance to fungal infection

| Gene Name | Organism | Polyn. SEQ ID NO: | Polyp. SEQ ID NO: |
|---|---|---|---|
| LFS82 | *Zea mays* | 22 | 308 |
| LFS83 | *Triticum aestivum* | 23 | 309 |
| LFS84 | *Triticum aestivum* | 24 | 310 |
| LFS86 | *Zea mays* | 25 | 311 |
| LFS87 | *Zea mays* | 26 | 312 |
| LFS89 | *Triticum aestivum* | 27 | 313 |
| LFS90 | *Aegilops tauschii* | 28 | 314 |
| LFS91 | *Aegilops tauschii* | 29 | 315 |
| LFS92 | *Aegilops tauschii* | 30 | 316 |
| LFS93 | *Aegilops tauschii* | 31 | 317 |
| LFS94 | *Aegilops tauschii* | 32 | 318 |
| LFS95 | *Aegilops tauschii* | 33 | 319 |
| LFS96 | *Aegilops tauschii* | 34 | 320 |
| LFS97 | *Aegilops tauschii* | 35 | 321 |
| LFS98 | *Aegilops tauschii* | 36 | 322 |
| LFS99 | *Aegilops tauschii* | 37 | 323 |
| LFS100 | *Aegilops tauschii* | 38 | 324 |
| LFS102 | *Aegilops tauschii* | 39 | 325 |
| LFS104 | *Aegilops tauschii* | 40 | 326 |
| LFS105 | *Aegilops tauschii* | 302 | 510 |
| LFS106 | *Aegilops tauschii* | 41 | 327 |
| LFS107 | *Aegilops tauschii* | 42 | 328 |
| LFS109 | *Aegilops tauschii* | 43 | 329 |
| LFS110 | *Aegilops tauschii* | 44 | 330 |
| LFS111 | *Aegilops tauschii* | 45 | 331 |
| LFS112 | *Aegilops tauschii* | 303 | 507 |
| LFS113 | *Aegilops tauschii* | 46 | 332 |
| LFS114 | *Aegilops tauschii* | 47 | 333 |
| LFS115 | *Aegilops tauschii* | 48 | 334 |
| LFS116 | *Aegilops tauschii* | 49 | 335 |
| LFS117 | *Aegilops tauschii* | 50 | 336 |
| LFS121 | *Setaria italica* | 51 | 337 |
| LFS122 | *Setaria italica* | 52 | 338 |
| LFS123 | *Setaria italica* | 53 | 339 |
| LFS124 | *Setaria italica* | 54 | 340 |
| LFS125 | *Setaria italica* | 55 | 341 |
| LFS126 | *Setaria italica* | 56 | 342 |
| LFS127 | *Setaria italica* | 57 | 343 |
| LFS128 | *Setaria italica* | 58 | 344 |

TABLE 6-continued Genes associated with plant resistance to fungal infection

| Gene Name | Organism | Polyn. SEQ ID NO: | Polyp. SEQ ID NO: |
|---|---|---|---|
| LFS129 | *Setaria italica* | 59 | 345 |
| LFS130 | *Aegilops tauschii* | 60 | 346 |
| LFS131 | *Setaria italica* | 61 | 347 |
| LFS132 | *Zea mays* | 62 | 348 |

"polyn." = polynucleotide;
"polyp." = polypeptide.

Example 3: Identification of Homologous Sequences Associated with Fungal Resistance The concepts of orthology and paralogy have recently been applied to functional characterizations and classifications on the scale of whole-genome comparisons. Orthologs and paralogs constitute two major types of homologs: The first evolved from a common ancestor by specialization, and the latter are related by duplication events. It is assumed that paralogs arising from ancient duplication events are likely to have diverged in function while true orthologs are more likely to retain identical function over evolutionary time.

To further investigate and identify putative orthologs of the genes identified to affect plant resistance to *Fusarium verticilloides, Fusarium graminearum* or *Colletotrichum graminicola*, all sequences were aligned using the BLAST™ (Basic Local Alignment Search Tool). Sequences sufficiently similar were tentatively grouped. These putative orthologs were further organized under a Phylogram—a branching diagram (tree) assumed to be a representation of the evolutionary relationships among the biological taxa. Putative ortholog groups were analyzed as to their agreement with the phylogram and in cases of disagreements these ortholog groups were broken accordingly.

Expression data were analyzed and the EST libraries were classified using a fixed vocabulary of custom terms such as developmental stages (e.g., genes showing similar expression profile through development with up-regulation at specific stage, such as at seed germination, time points during seedling growth and at maturity) and/or plant organ (e.g., genes showing similar expression profile across their organs with up-regulation at specific organs such as roots and stems). The annotations from all the ESTs clustered to a gene were analyzed statistically by comparing their frequency in the cluster versus their abundance in the database, allowing the construction of a numeric and graphic expression profile of that gene, which is termed "digital expression". The rationale of using these two complementary methods with methods of phenotypic association studies of QTLs, SNPs and phenotype expression correlation is based on the assumption that true orthologs are likely to retain identical function over evolutionary time. These methods provide different sets of indications on function similarities between two homologous genes, including similarities in the sequence level—identical amino acids in the protein domains and similarity in expression profiles.

The search and identification of homologous genes involves the screening of sequence information available, for example, in public databases such as the DNA Database of Japan (DDBJ), GenBank, and the European Molecular Biology Laboratory Nucleic Acid Sequence Database (EMBL) or versions thereof or the MIPS database. A number of different search algorithms have been developed, including but not limited to the suite of programs referred to as BLAST™ programs. There are five implementations of BLAST™, three designed for nucleotide sequence queries (BLASTN, BLASTX, and TBLASTX) and two designed for protein sequence queries (BLASTP and TBLASTN) (Altschul, S. F et al., (1990) "Basic local alignment search tool." J. Mol. Biol. 215:403-410). Such methods involve alignment and comparison of sequences. The BLAST™ algorithm calculates percent sequence identity and performs a statistical analysis of the similarity between the two sequences. The software for performing BLAST™ analysis is publicly available through the National Centre for Biotechnology Information. Other such software or algorithms are GAP, BESTFIT, FASTA and TFASTA. GAP uses the algorithm of Needleman and Wunsch (J. Mol. Biol. 48: 443-453, 1970) to find the alignment of two complete sequences that maximizes the number of matches and minimizes the number of gaps.

The homologous genes may belong to the same gene family. The analysis of a gene family may be carried out using sequence similarity analysis. To perform this analysis, one may use standard programs for multiple alignments e.g. Clustal W. A neighbor-joining tree of the proteins homologous to the proteins encoded by the genes identified in this invention may be used to provide an overview of structural and ancestral relationships. Sequence identity may be calculated using an alignment program as described above. It is expected that plants other that those examined in the present invention will carry a similar functional gene (ortholog) or a family of similar genes and those genes will provide the same preferred phenotype as the genes presented here. Advantageously, these family members may be useful in the methods of the invention. Example of other plants are included here but not limited to, barley (*Hordeum vulgare*), *Arabidopsis* (*Arabidopsis thaliana*), maize (*Zea mays*), cotton (*Gossypium*), Oilseed rape (*Brassica napus*), Rice (*Oryza sativa*), Sugar cane (*Saccharum officinarum*), *Sorghum* (*Sorghum bicolor*), Soybean (*Glycine max*), Sunflower (*Helianthus annuus*), Tomato (*Lycopersicon esculentum*), and Wheat (*Triticum aestivum*).

The above-mentioned analyses for sequence homology can be carried out on a full-length sequence, but may also be based on a comparison of certain regions such as conserved domains. The identification of such domains would also be well within the realm of the person skilled in the art and would involve, for example, a computer readable format of the nucleic acids of the present invention, the use of alignment software programs and the use of publicly available information on protein domains, conserved motifs and boxes. This information is available in the PRODOM (biochem.ucl.ac.uk/bsm/dbbrowser/protocol/prodomqry.html), PIR (pir.Georgetown.edu/) or Pfam (sanger.ac.uk/Software/Pfam/) databases. Sequence analysis programs designed for motif searching may be used for identification of fragments, regions and conserved domains as mentioned above. Preferred computer programs include, but are not limited to, MEME, SIGNALSCAN, and GENESCAN.

A person skilled in the art may use the homologous sequences provided herein to find similar sequences in other species and other organisms. Homologues of a protein encompass peptides, oligopeptides, polypeptides, proteins and enzymes having amino acid substitutions, deletions and/or insertions relative to the unmodified protein in question and having similar biological and functional activity as the unmodified protein from which they are derived. To produce such homologues, amino acids of the protein may be replaced by other amino acids having similar properties (conservative changes, such as similar hydrophobicity, hydrophilicity, antigenicity, propensity to form or break α-helical structures or β-sheet structures). Conservative substitution Tables are well known in the art (see for example Creighton T E (1984) Proteins. W.H. Freeman and Company). Homologues of a nucleic acid encompass nucleic acids having nucleotide substitutions, deletions and/or insertions relative to the unmodified nucleic acid in question and having similar biological and functional activity as the unmodified nucleic acid from which they are derived.

Polynucleotides and polypeptides with significant homology to the identified genes described in Table 6 (Example 2) were identified from the databases using BLAST™ software with the Blastp and tBlastn algorithms as filters for the first stage, and the needle (EMBOSS package) or Frame+ algorithm alignment for the second stage. Local identity (BLAST™ alignments) was defined with a very permissive cutoff—60% Identity on a span of 60% of the sequences lengths because it is used only as a filter for the global alignment stage. The default filtering of the BLAST™ package was not utilized (by setting the parameter "-F F").

In the second stage, homologs were defined based on a global identity of at least 80% to the core gene polypeptide sequence. Two distinct forms for finding the optimal global alignment for protein or nucleotide sequences were used in this application:

1. Between two proteins (following the BLASTP filter):
EMBOSS-6.0.1 Needleman-Wunsch algorithm with the following modified parameters: gapopen=8 gapextend=2. The rest of the parameters were unchanged from the default options described hereinabove.

2. Between a protein sequence and a nucleotide sequence (following the TBLASTN filter):
GenCore 6.0 OneModel application utilizing the Frame+ algorithm with the following parameters: model=frame+_p2n.model mode=qglobal -q=protein. sequence -db=nucleotide.sequence. The rest of the parameters are unchanged from the default options described hereinabove.

The query polypeptide sequences were the sequences listed in Table 6 (Example 2). The subject sequences are protein sequences identified in the database based on greater than 80% global identity to the predicted translated sequences of the query nucleotide sequences or to the polypeptide sequences. Homology was calculated as % of identity over the aligned sequences. The identified orthologous and homologous sequences having at least 80% global sequence identity to said sequences are provided in Table 7, below. These homologous genes are expected to increase plant resistance to fungal infection caused by the mentioned pathogens

TABLE 7

Homologues (e.g., orthologues) of genes associated with plant resistance to fungal infection

| Polyn. SEQ ID NO: | Hom. to Gene Name | Organism | Polyp. SEQ ID NO: | Hom. to SEQ ID NO: | % glob. Iden. | Algor. |
|---|---|---|---|---|---|---|
| 100 | LFS122 | Panicum virgatum | — | 338 | 90.76 | glotblastn |
| 101 | LFS122 | Panicum virgatum | 369 | 338 | 84.3 | globlastp |
| 102 | LFS109 | Hordeum vulgare | 370 | 329 | 81.2 | globlastp |
| 103 | LFS86 | Sorghum bicolor | 371 | 311 | 80.3 | globlastp |
| 104 | LFS132 | Sorghum bicolor | — | 348 | 80.33 | glotblastn |
| 105 | LFS107 | Triticum aestivum | 372 | 328 | 90.6 | globlastp |
| 106 | LFS116 | Triticum aestivum | 373 | 335 | 99.5 | globlastp |
| 107 | LFS116 | Hordeum vulgare | 374 | 335 | 90.9 | globlastp |
| 108 | LFS121 | Panicum virgatum | 375 | 337 | 85 | globlastp |
| 109 | LFS121 | Panicum virgatum | 376 | 337 | 84.3 | globlastp |
| 110 | LFS121 | Zea mays | 377 | 337 | 80.9 | globlastp |
| 111 | LFS92 | Triticum aestivum | 378 | 316 | 94.6 | globlastp |
| 112 | LFS92 | Secale cereale | 379 | 316 | 87.5 | globlastp |
| 113 | LFS95 | Aegilops tauschii | 380 | 354 | 88.7 | globlastp |
| 114 | LFS95 | Triticum aestivum | 381 | 354 | 88.3 | globlastp |
| 115 | LFS95 | Secale cereale | 382 | 354 | 86 | globlastp |
| 116 | LFS95 | Secale cereale | 383 | 354 | 84.8 | globlastp |
| 117 | LFS95 | Secale cereale | 384 | 354 | 84.3 | globlastp |
| 118 | LFS95 | Secale cereale | — | 354 | 83.88 | glotblastn |
| 119 | LFS95 | Secale cereale | — | 354 | 83.47 | glotblastn |
| 120 | LFS95 | Triticum aestivum | 385 | 354 | 83.1 | globlastp |
| 121 | LFS95 | Triticum aestivum | 386 | 354 | 80.2 | globlastp |
| 122 | LFS106 | Secale cereale | 387 | 327 | 89.2 | globlastp |
| 123 | LFS106 | Triticum aestivum | 388 | 327 | 85.5 | globlastp |
| 124 | LFS106 | Hordeum vulgare | 389 | 327 | 83.1 | globlastp |
| 125 | LFS111 | Triticum aestivum | — | 331 | 96.71 | glotblastn |
| 126 | LFS111 | Hordeum vulgare | 390 | 331 | 88.6 | globlastp |
| 127 | LFS97 | Triticum aestivum | 391 | 321 | 99.8 | globlastp |
| 128 | LFS97 | Triticum aestivum | 392 | 321 | 99 | globlastp |
| 129 | LFS97 | Triticum aestivum | 393 | 321 | 99 | globlastp |
| 130 | LFS97 | Hordeum vulgare | 394 | 321 | 98.1 | globlastp |
| 131 | LFS97 | Secale cereale | 395 | 321 | 97.7 | globlastp |
| 132 | LFS97 | Brachypodium distachyon | 396 | 321 | 94.7 | globlastp |
| 133 | LFS97 | Avena sativa | 397 | 321 | 94.7 | globlastp |
| 134 | LFS97 | Brachypodium distachyon | 398 | 321 | 93 | globlastp |
| 135 | LFS97 | Oryza sativa | 399 | 321 | 89.1 | globlastp |
| 136 | LFS97 | Panicum virgatum | 400 | 321 | 84.4 | globlastp |
| 137 | LFS97 | Setaria italica | 401 | 321 | 83.6 | globlastp |
| 138 | LFS97 | Aegilops tauschii | — | 321 | 82.56 | glotblastn |

TABLE 7-continued

Homologues (e.g., orthologues) of genes associated with plant resistance to fungal infection

| Polyn. SEQ ID NO: | Hom. to Gene Name | Organism | Polyp. SEQ ID NO: | Hom. to SEQ ID NO: | % glob. Iden. | Algor. |
|---|---|---|---|---|---|---|
| 139 | LFS97 | Sorghum bicolor | 402 | 321 | 81.2 | globlastp |
| 140 | LFS98 | Triticum aestivum | 403 | 357 | 97.2 | globlastp |
| 141 | LFS113 | Triticum aestivum | 404 | 332 | 98.8 | globlastp |
| 142 | LFS113 | Hordeum vulgare | 405 | 332 | 97.5 | globlastp |
| 143 | LFS113 | Brachypodium distachyon | 406 | 332 | 84.6 | globlastp |
| 144 | LFS113 | Oryza sativa | 407 | 332 | 82.7 | globlastp |
| 145 | LFS113 | Oryza sativa | — | 332 | 81.53 | glotblastn |
| 146 | LFS113 | Secale cereale | — | 363 | 98.25 | glotblastn |
| 147 | LFS113 | Secale cereale | 408 | 363 | 97.9 | globlastp |
| 148 | LFS113 | Setaria italica | 409 | 363 | 84 | globlastp |
| 149 | LFS113 | Sorghum bicolor | 410 | 363 | 83.1 | globlastp |
| 150 | LFS113 | Zea mays | 411 | 363 | 82.2 | globlastp |
| 151 | LFS117 | Triticum aestivum | — | 365 | 96.87 | glotblastn |
| 152 | LFS100 | Triticum aestivum | — | 359 | 92.49 | glotblastn |
| 153 | LFS100 | Aegilops tauschii | — | 359 | 89.67 | glotblastn |
| 154 | LFS100 | Secale cereale | — | 359 | 80.47 | glotblastn |
| 155 | LFS94 | Secale cereale | — | 318 | 94.7 | glotblastn |
| 156 | LFS94 | Secale cereale | — | 318 | 93.32 | glotblastn |
| 157 | LFS94 | Triticum aestivum | — | 318 | 93.09 | glotblastn |
| 158 | LFS94 | Hordeum vulgare | 412 | 318 | 92.2 | globlastp |
| 159 | LFS94 | Secale cereale | 413 | 318 | 91.2 | globlastp |
| 160 | LFS94 | Aegilops tauschii | 414 | 318 | 90.1 | globlastp |
| 161 | LFS94 | Brachypodium distachyon | 415 | 318 | 86.3 | globlastp |
| 162 | LFS94 | Brachypodium distachyon | 416 | 318 | 85.8 | globlastp |
| 163 | LFS94 | Oryza sativa | 417 | 318 | 83.3 | globlastp |
| 164 | LFS94 | Secale cereale | 418 | 318 | 83.1 | globlastp |
| 165 | LFS94 | Zea mays | 419 | 318 | 80 | globlastp |
| 166 | LFS99 | Triticum aestivum | — | 358 | 80 | glotblastn |
| 167 | LFS95 | Hordeum vulgare | 420 | 319 | 89 | globlastp |
| 168 | LFS95 | Aegilops tauschii | 421 | 319 | 87.9 | globlastp |
| 169 | LFS96 | Triticum aestivum | 422 | 320 | 98.1 | globlastp |
| 170 | LFS96 | Aegilops tauschii | — | 320 | 86.79 | glotblastn |
| 171 | LFS130 | Triticum aestivum | 423 | 346 | 98.5 | globlastp |
| 172 | LFS130 | Hordeum vulgare | 424 | 346 | 94.8 | globlastp |
| 173 | LFS130 | Brachypodium distachyon | 425 | 346 | 83.1 | globlastp |
| 174 | LFS82 | Panicum virgatum | 426 | 349 | 94.7 | globlastp |
| 175 | LFS82 | Panicum virgatum | 427 | 349 | 93.9 | globlastp |
| 176 | LFS82 | Oryza sativa | 428 | 349 | 88.6 | globlastp |
| 177 | LFS82 | Brachypodium distachyon | 429 | 349 | 87.1 | globlastp |
| 178 | LFS82 | Triticum aestivum | 430 | 349 | 86.4 | globlastp |
| 179 | LFS82 | Secale cereale | 431 | 349 | 86.2 | globlastp |
| 180 | LFS82 | Hordeum vulgare | 432 | 349 | 86.1 | globlastp |
| 306 | LFS112 | Triticum aestivum | 509 | 507 | 99.2 | globlastp |
| 305 | LFS112 | Hordeum vulgare | 508 | 507 | 95.6 | globlastp |
| 181 | LFS129 | Panicum virgatum | 433 | 345 | 92 | globlastp |
| 182 | LFS129 | Panicum virgatum | 434 | 345 | 80.5 | globlastp |
| 183 | LFS94 | Triticum aestivum | 435 | 353 | 99.8 | globlastp |
| 184 | LFS94 | Secale cereale | 436 | 353 | 96.8 | globlastp |
| 185 | LFS94 | Secale cereale | 437 | 353 | 90.8 | globlastp |
| 186 | LFS94 | Setaria italica | 438 | 353 | 80.7 | globlastp |
| 187 | LFS89 | Aegilops tauschii | 313 | 313 | 100 | globlastp |
| 188 | LFS84 | Hordeum vulgare | 439 | 310 | 94.3 | globlastp |
| 189 | LFS84 | Secale cereale | 440 | 310 | 90 | globlastp |
| 190 | LFS84 | Aegilops tauschii | 441 | 310 | 89.4 | globlastp |
| 191 | LFS84 | Brachypodium distachyon | 442 | 310 | 87.4 | globlastp |
| 192 | LFS84 | Panicum virgatum | 443 | 310 | 85.8 | globlastp |
| 193 | LFS84 | Sorghum bicolor | 444 | 310 | 85.3 | globlastp |
| 194 | LFS84 | Setaria italica | 445 | 310 | 84.9 | globlastp |
| 195 | LFS84 | Zea mays | — | 310 | 83.65 | glotblastn |
| 196 | LFS84 | Zea mays | 446 | 310 | 83.2 | globlastp |
| 197 | LFS84 | Oryza sativa | — | 310 | 80.27 | glotblastn |
| 198 | LFS125 | Zea mays | 447 | 341 | 83.8 | globlastp |
| 199 | LFS115 | Secale cereale | 448 | 334 | 99.8 | globlastp |
| 200 | LFS115 | Triticum aestivum | 449 | 334 | 92.7 | globlastp |
| 201 | LFS114 | Hordeum vulgare | 450 | 364 | 92.3 | globlastp |
| 202 | LFS114 | Secale cereale | 451 | 364 | 91.4 | globlastp |
| 203 | LFS114 | Triticum aestivum | 452 | 364 | 80.8 | globlastp |
| 204 | LFS93 | Hordeum vulgare | 453 | 317 | 92.8 | globlastp |
| 205 | LFS93 | Aegilops tauschii | — | 317 | 89.24 | glotblastn |
| 206 | LFS93 | Triticum aestivum | — | 317 | 84.39 | glotblastn |
| 207 | LFS93 | Brachypodium distachyon | — | 317 | 80.38 | glotblastn |
| 208 | LFS126 | Panicum virgatum | 454 | 342 | 91.2 | globlastp |
| 209 | LFS126 | Panicum virgatum | 455 | 342 | 91.2 | globlastp |

TABLE 7-continued

Homologues (e.g., orthologues) of genes associated
with plant resistance to fungal infection

| Polyn. SEQ ID NO: | Hom. to Gene Name | Organism | Polyp. SEQ ID NO: | Hom. to SEQ ID NO: | % glob. Iden. | Algor. |
|---|---|---|---|---|---|---|
| 210 | LFS126 | Zea mays | 456 | 342 | 88 | globlastp |
| 211 | LFS126 | Sorghum bicolor | 457 | 342 | 88 | globlastp |
| 212 | LFS126 | Oryza sativa | 458 | 342 | 80.5 | globlastp |
| 213 | LFS100 | Triticum aestivum | 459 | 324 | 81.9 | globlastp |
| 214 | LFS83 | Triticum aestivum | 460 | 350 | 99.7 | globlastp |
| 215 | LFS83 | Secale cereale | 461 | 350 | 95.4 | globlastp |
| 216 | LFS83 | Lolium multiflorum | 462 | 350 | 87.5 | globlastp |
| 217 | LFS83 | Lolium multiflorum | 463 | 350 | 87.5 | globlastp |
| 218 | LFS83 | Brachypodium distachyon | 464 | 350 | 83.7 | globlastp |
| 219 | LFS83 | Setaria italica | 465 | 350 | 80.5 | globlastp |
| 220 | LFS131 | Setaria italica | 466 | 347 | 83.2 | globlastp |
| 221 | LFS131 | Setaria italica | 467 | 347 | 81.2 | globlastp |
| 222 | LFS131 | Sorghum bicolor | 468 | 347 | 81.2 | globlastp |
| 223 | LFS91 | Triticum aestivum | — | 315 | 100 | globlastp |
| 224 | LFS91 | Triticum aestivum | 469 | 315 | 93.1 | globlastp |
| 225 | LFS91 | Secale cereale | — | 315 | 91.16 | glotblastn |
| 226 | LFS91 | Secale cereale | — | 315 | 89.23 | glotblastn |
| 227 | LFS91 | Secale cereale | 470 | 315 | 81.4 | globlastp |
| 228 | LFS91 | Brachypodium distachyon | 471 | 315 | 80.7 | globlastp |
| 229 | LFS83 | Secale cereale | 472 | 309 | 95.6 | globlastp |
| 230 | LFS83 | Secale cereale | — | 309 | 82.07 | glotblastn |
| 231 | LFS83 | Aegilops tauschii | 473 | 309 | 82 | globlastp |
| 232 | LFS83 | Sorghum bicolor | 474 | 309 | 80.8 | globlastp |
| 233 | LFS83 | Triticum aestivum | 475 | 309 | 80.5 | globlastp |
| 234 | LFS102 | Triticum aestivum | 476 | 325 | 96.9 | globlastp |
| 235 | LFS102 | Hordeum vulgare | 477 | 325 | 90.2 | globlastp |
| 236 | LFS102 | Aegilops tauschii | — | 325 | 87.5 | glotblastn |
| 237 | LFS104 | Hordeum vulgare | 478 | 326 | 97.8 | globlastp |
| 238 | LFS104 | Secale cereale | 479 | 326 | 83.1 | globlastp |
| 239 | LFS104 | Zea mays | — | 326 | 81.37 | glotblastn |
| 240 | LFS99 | Avena sativa | — | 323 | 93 | glotblastn |
| 241 | LFS99 | Triticum aestivum | — | 323 | 87 | glotblastn |
| 242 | LFS99 | Triticum aestivum | 480 | 323 | 86 | globlastp |
| 243 | LFS99 | Triticum aestivum | — | 323 | 82 | glotblastn |
| 244 | LFS90 | Triticum aestivum | 481 | 314 | 99.8 | globlastp |
| 245 | LFS90 | Triticum aestivum | 482 | 314 | 97.2 | globlastp |
| 246 | LFS90 | Triticum aestivum | 483 | 314 | 95.5 | globlastp |
| 247 | LFS90 | Triticum aestivum | 484 | 314 | 93.9 | globlastp |
| 248 | LFS90 | Triticum aestivum | 485 | 314 | 93.7 | globlastp |
| 249 | LFS82 | Sorghum bicolor | — | 308 | 97.24 | glotblastn |
| 250 | LFS87 | Zea mays | 486 | 312 | 96.9 | globlastp |
| 251 | LFS87 | Zea mays | 486 | 312 | 96.9 | globlastp |
| 252 | LFS87 | Zea mays | — | 312 | 95.92 | glotblastn |
| 253 | LFS87 | Sorghum bicolor | — | 312 | 95.92 | glotblastn |
| 254 | LFS87 | Saccharum officinarum | — | 312 | 95.92 | glotblastn |
| 255 | LFS87 | Cenchrus ciliaris | — | 312 | 94.9 | glotblastn |
| 256 | LFS87 | Setaria italica | — | 312 | 94.9 | glotblastn |
| 257 | LFS87 | Zea mays | — | 312 | 94.9 | glotblastn |
| 258 | LFS87 | Panicum virgatum | — | 312 | 94.9 | glotblastn |
| 259 | LFS87 | Panicum virgatum | — | 312 | 94.9 | glotblastn |
| 260 | LFS87 | Zea mays | — | 312 | 93.88 | glotblastn |
| 261 | LFS87 | Pennisetum glaucum | — | 312 | 93.88 | glotblastn |
| 262 | LFS87 | Echinochloa colona | — | 312 | 91.84 | glotblastn |
| 263 | LFS87 | Zea mays | — | 312 | 89.8 | glotblastn |
| 264 | LFS87 | Oryza sativa | — | 312 | 88.78 | glotblastn |
| 265 | LFS87 | Oryza sativa | — | 312 | 87.76 | glotblastn |
| 266 | LFS87 | Hordeum vulgare | — | 312 | 86.73 | glotblastn |
| 267 | LFS87 | Aegilops tauschii | — | 312 | 85.71 | glotblastn |
| 268 | LFS87 | Secale cereale | — | 312 | 85.71 | glotblastn |
| 269 | LFS87 | Secale cereale | — | 312 | 85.71 | glotblastn |
| 270 | LFS87 | Triticum aestivum | — | 312 | 85.71 | glotblastn |
| 271 | LFS87 | Triticum aestivum | — | 312 | 85.71 | glotblastn |
| 272 | LFS87 | Brachypodium distachyon | — | 312 | 84.69 | glotblastn |
| 273 | LFS87 | Cocos nucifera | — | 312 | 82.65 | glotblastn |
| 274 | LFS87 | Phalaenopsis aphrodite | — | 312 | 82.65 | glotblastn |
| 275 | LFS87 | Cocos nucifera | — | 312 | 81.63 | glotblastn |
| 276 | LFS87 | Cynodon dactylon | — | 312 | 81.63 | glotblastn |
| 277 | LFS87 | Elaeis guineensis | — | 312 | 81.63 | glotblastn |
| 278 | LFS87 | Lolium multiflorum | — | 312 | 80.61 | glotblastn |
| 279 | LFS87 | Avena sativa | — | 312 | 80.61 | glotblastn |
| 280 | LFS87 | Elaeis guineensis | — | 312 | 80.61 | glotblastn |
| 281 | LFS104 | Brachypodium distachyon | 487 | 360 | 92.6 | globlastp |
| 282 | LFS104 | Setaria italica | 488 | 360 | 86.7 | globlastp |

TABLE 7-continued

Homologues (e.g., orthologues) of genes associated with plant resistance to fungal infection

| Polyn. SEQ ID NO: | Hom. to Gene Name | Organism | Polyp. SEQ ID NO: | Hom. to SEQ ID NO: | % glob. Iden. | Algor. |
|---|---|---|---|---|---|---|
| 283 | LFS104 | Sorghum bicolor | 489 | 360 | 85.6 | globlastp |
| 284 | LFS104 | Zea mays | 490 | 360 | 83.8 | globlastp |
| 285 | LFS104 | Oryza sativa | 491 | 360 | 80.9 | globlastp |
| 286 | LFS127 | Panicum virgatum | 492 | 343 | 86.2 | globlastp |
| 287 | LFS127 | Sorghum bicolor | 493 | 343 | 85.2 | globlastp |
| 288 | LFS127 | Panicum virgatum | 494 | 343 | 82.1 | globlastp |
| 289 | LFS127 | Zea mays | 495 | 343 | 81.5 | globlastp |
| 290 | LFS125 | Panicum virgatum | 496 | 367 | 92.3 | globlastp |
| 291 | LFS125 | Panicum virgatum | 497 | 367 | 91.6 | globlastp |
| 292 | LFS125 | Zea mays | 498 | 367 | 85.5 | globlastp |
| 293 | LFS125 | Sorghum bicolor | 499 | 367 | 84.7 | globlastp |
| 294 | LFS125 | Oryza sativa | 500 | 367 | 82.1 | globlastp |
| 295 | LFS117 | Hordeum vulgare | 501 | 336 | 94.3 | globlastp |
| 296 | LFS117 | Secale cereale | — | 336 | 80.97 | glotblastn |
| 297 | LFS124 | Setaria italica | 502 | 340 | 90.1 | globlastp |
| 298 | LFS124 | Sorghum bicolor | 503 | 340 | 85.7 | globlastp |
| 299 | LFS124 | Zea mays | 504 | 340 | 83.3 | globlastp |
| 300 | LFS124 | Panicum virgatum | 505 | 340 | 82.3 | globlastp |
| 301 | LFS124 | Panicum virgatum | 506 | 340 | 81.8 | globlastp |

"Polyn." = polynucleotide; "Polyp." = polypeptide; "Algor." = algorithm (used for sequence alignment and determination of percent homology); "Hom."—homology; "iden."—identity; "glob."—global.

The output of the functional genomics approach described herein is a set of genes highly predicted to improve resistance of a plant to fungal infection by *Fusarium verticilloides*, *Fusarium graminearum* or *Colletotrichum graminicola* when their expression is modulated (enhanced or downregulated) in said plant. Although each gene is predicted to have its own impact, modifying the mode of expression of more than one gene is expected to provide an additive or synergistic effect on the plant resistance Altering the expression of each gene described herein alone or of a set of genes together increases the overall plant resistance, hence expects to increase agricultural productivity.

Example 4: Identification of Domains Comprised within Identified Genes

A polypeptide domain refers to a set of conserved amino acids located at specific positions along an alignment of sequences of evolutionarily related proteins. While amino acids at other positions can vary between homologues, amino acids that are highly conserved, and particularly amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, ProDom and Pfam, Smart and TIGRFAMs. Pfam is a large collection of multiple sequence alignments and hidden Markov models covering many common protein domains and families. Pfam is hosted at the Sanger Institute server in the United Kingdom.

Interpro is hosted at the European Bioinformatics Institute in the United Kingdom. InterProScan is the software package that allows sequences (protein and nucleic) to be scanned against InterPro's signatures. Signatures are predictive models, provided by several different databases that make up the InterPro consortium.

InterProScan 5.32-71.0 was used to analyze the polypeptides of the present invention (core and homologues/orthologs) for common domains (Jones P et al., 2014. Bioinformatics, January 2014 (doi:10.1093/bioinformatics/btu031). Briefly, InterProScan is based on scanning methods native to the InterPro member databases. It is distributed with pre-configured method cut-offs recommended by the member database experts and which are believed to report relevant matches. All cut-offs are defined in configuration files of the InterProScan programs. Matches obtained with the fixed cut-off are subject to the following filtering:

Pfam filtering: Each Pfam family is represented by two hidden Markov models (HMMs)—ls and fs (full-length and fragment). An HMM model has bit score cut-offs (for each domain match and the total model match) and these are defined in the Gathering threshold (GA) lines of the Pfam database. Initial results are obtained with quite a high common cut-off and then the matches of the signature with a lower score than the family specific cut-offs are dropped.

If both the fs and is model for a particular Pfam hits the same region of a sequence, the AM field in the Pfam database is used to determine which model should be chosen—globalfirst(LS); localfirst(FS) or byscore (whichever has the highest e-value).

Another type of filtering has been implemented since release of version 4.1. It is based on Clan filtering and nested domains. Further information on Clan filtering can be found in the Pfam website (www.sanger.ac.uk/Pfam) for more information on Clan filtering.

TIGRFAMs filtering: Each TIGRFAM HMM model has its own cut-off scores for each domain match and the total model match. These bit score cut-offs are defined in the "trusted cut-offs" (TC) lines of the database. Initial results are obtained with quite a high common cut-off and then the matches (of the signature or some of its domains) with a lower score compared to the family specific cut-offs are dropped.

PRINTS filtering: All matches with p-value more than a pre-set minimum value for the signature, are dropped.

SMART filtering: The publicly distributed version of InterProScan has a common e-value cut-off corresponding to the reference database size. A more sophisticated scoring model is used on the SMART web server and in the production of pre-calculated InterPro Match data.

Exact scoring thresholds for domain assignments are proprietary data. The InterProMatches data production procedure uses these additional smart.thresholds data. It is to be noted that the given cut-offs are e-values (i.e. the number of expected random hits) and therefore are valid only in the context of reference database size and smart.desc data files to filter out results obtained with higher cut-off.

It implements the following logic: If the whole sequence E-value of a found match is worse than the 'cut_low', the match is dropped. If the domain E-value of a found match is worse than the 'repeat' cut-off (where defined) the match is dropped. If a signature is a repeat, the number of significant matches of that signature to a sequence must be greater than the value of 'repeats' in order for all matches to be accepted as true (T).

If the signature is part of a family ('family_cut' is defined), if the domain E-value is worse than the domain cut off ('cutoff'), the match is dropped. If the signature has "siblings" (because it has a family_cut defined), and they overlap, the preferred sibling is chosen as the true match according to information in the overlaps file.

PROSITE patterns CONFIRMation: ScanRegExp is able to verify PROSITE matches using corresponding statistically-significant CONFIRM patterns. The default status of the PROSITE matches is unknown (?) and the true positive (T) status is assigned if the corresponding CONFIRM patterns match as well. The CONFIRM patterns were generated based on the true positive SWISS-PROT PROSITE matches using eMOTIF software with a stringency of 10e-9 P-value.

PANTHER filtering: Panther has pre- and post-processing steps. The pre-processing step is intended to speed up the HMM-based searching of the sequence and involves blasting the HMM sequences with the query protein sequence in order to find the most similar models above a given e-value. The resulting HMM hits are then used in the HMM-based search.

Panther consists of families and sub-families. When a sequence is found to match a family in the blast run, the sub-families are also scored using HMMER tool (that is, unless there is only 1 sub-family, in which case, the family alone is scored against).

Any matches that score below the e-value cut-off are discarded. Any remaining matches are searched to find the HMM with the best score and e-value and the best hit is then reported (including any sub-family hit).

GENE3D filtering: Gene3D also employs post-processing of results by using a program called DomainFinder. This program takes the output from searching the Gene3D HMMs against the query sequence and extracts all hits that are more than 10 residues long and have an e-value better than 0.001. If hits overlap at all, the match with the better e-value is chosen.

The polypeptides of the invention associated with conferring and/or enhancing the resistance of a plant to at least one fungal pathogen can be characterized by specific amino acid domains. According to certain embodiments, particular domains are conserved within a family of polypeptides as described in Table 8 hereinbelow. Without wishing to be bound by any specific theory or mechanism of action, the conserved domain(s) may indicate common functionally of the polypeptides comprising same. The domains are presented by an identifier (number). Table 9 provides the details of each domain.

TABLE 8

Core and homologous polypeptides comprising the same domains

| Core Polypeptide (SEQ ID NO) | Gene Name (Core) | Characteristic Domains (Domain identifier) | Homologous Polypeptides Comprising the Domains (SEQ ID NOs) |
|---|---|---|---|
| 308 | LFS82 | 1; 2; 3; 4; 5; 6; 7; 8; 9; 10 in core, cloned and homologs | 426; 427; 428; 429; 430; 431; 432 |
| 309 | LFS83 | 11; 12; 13; 14; 15; 16 in core, cloned and homologs | 460; 461; 462; 463; 464; 465; 472; 473; 474; 475 |
| 310 | LFS84 | 2; 17; 18; 5 in core, cloned and homologs | 439; 440; 441; 442; 443; 444; 445; 446 |
| 311 | LFS86 | 19 in core, cloned and homologs | 371 |
| 312 | LFS87 | 20; 21 in core and homologs | 486 |
| 313 | LFS89 | 22; 23; 24; 25; 26; 27 in core, cloned and homologs | 313 |
| 314 | LFS90 | 28; 29; 30 in core, cloned and homologs | 481; 482; 483; 484; 485 |
| 315 | LFS91 | 31; 32 in core, cloned and homologs | 315; 469; 470; 471 |
| 316 | LFS92 | 23; 24; 33 in core, cloned and homologs | 378; 379 |
| 317 | LFS93 | 34 in core, cloned and homologs | 453 |
| 318 | LFS94 | 35; 36 in core, cloned and homologs | 412; 413; 414; 415; 416; 417; 418; 419; 435; 436; 437; 438 |
| 319 | LFS95 | 37 in core, cloned and homologs | 380; 381; 382; 383; 384; 385; 386; 420; 421 |
| 320 | LFS96 | 38; 39 in core, cloned and homologs | 422 |
| 321 | LFS97 | 40; 41; 42; 43 in core, cloned and homologs | 391; 392; 393; 394; 395; 396; 397; 398; 399; 400; 401; 402 |
| 322 | LFS98 | 44; 45; 32; 46 in core, cloned and homologs | 403 |

TABLE 8-continued

Core and homologous polypeptides comprising the same domains

| Core Polypeptide (SEQ ID NO) | Gene Name (Core) | Characteristic Domains (Domain identifier) | Homologous Polypeptides Comprising the Domains (SEQ ID NOs) |
|---|---|---|---|
| 323 | LFS99 | no domains in core | |
| 324 | LFS100 | 47; 48 in core, cloned and homologs | 459 |
| 325 | LFS102 | 49; 50 in core, cloned and homologs | 476; 477 |
| 326 | LFS104 | 51; 52; 53; 54; 55; 56; 57 in core, cloned and homologs | 478; 479; 487; 488; 489; 490; 491 |
| 327 | LFS106 | no domains in core | |
| 328 | LFS107 | 35; 36 in core, cloned and homologs | 372 |
| 329 | LFS109 | 58; 59; 60; 21; 61; 20; 62 in core, cloned and homologs | 370 |
| 330 | LFS110 | 63 in core and cloned | |
| 331 | LFS111 | 34 in core, cloned and homologs | 390 |
| 332 | LFS113 | 65; 66; 67 in core, cloned and homologs | 404; 405; 406; 407; 408; 409; 410; 411 |
| 333 | LFS114 | 68; 69 in core, cloned and homologs | 450; 451; 452 |
| 334 | LFS115 | 1; 2; 3; 4; 5; 70; 9; 71; 10 in core, cloned and homologs | 448; 449 |
| 335 | LFS116 | 20; 72; 21 in core, cloned and homologs | 373; 374 |
| 336 | LFS117 | 73; 74; 75 in core, cloned and homologs | 501 |
| 337 | LFS121 | 76; 77; 78 in core, cloned and homologs | 375; 376; 377 |
| 338 | LFS122 | 79 in core, cloned and homologs | 369 |
| 339 | LFS123 | 80; 81; 82; 83; 84 in core and cloned | |
| 340 | LFS124 | 85; 86; 87; 88 in core, cloned and homologs | 502; 503; 504; 505; 506 |
| 341 | LFS125 | 89 in core, cloned and homologs | 447; 496; 497; 498; 499; 500 |
| 342 | LFS126 | 62; 59; 60 in core, cloned and homologs | 454; 455; 456; 457; 458 |
| 343 | LFS127 | 90; 91; 92; 93; 94 in core, cloned and homologs | 492; 493; 494; 495 |
| 344 | LFS128 | 95; 96; 97; 98 in core and cloned | |
| 345 | LFS129 | 99; 100; 101; 48; 102; 103; 104; 105; 106; 107 in core, cloned and homologs | 433; 434 |
| 346 | LFS130 | 108 in core and homologs | 423; 424; 425 |
| 347 | LFS131 | 109; 110; 111; 112 in core and homologs | 466; 467; 468 |
| 348 | LFS132 | 35; 36 in core | |
| 507 | LFS112 | 64 in core, cloned and homologs | 508; 509 |
| 510 | LFS105 | no domains in core | |

TABLE 9

Details of identified domains

| Domain Identifier | InterPro No. | Accession No. | Description |
|---|---|---|---|
| 1 | IPR023298 | SSF81665 | P-type ATPase, transmembrane domain superfamily |
| 2 | IPR036412 | SSF56784 | HAD-like superfamily |
| 3 | IPR023299 | G3DSA:3.40.1110.10 | P-type ATPase, cytoplasmic domain N |
| 4 | IPR008250 | SSF81653 | P-type ATPase, A domain superfamily |
| 5 | IPR023214 | G3DSA:3.40.50.1000 | HAD superfamily |
| 6 | IPR032631 | PF16209 | Phospholipid-translocating ATPase N-terminal P-type ATPase, N-terminal |
| 7 | IPR032630 | PF16212 | Phospholipid-translocating P-type ATPase C-terminal P-type ATPase, C-terminal |
| 8 | IPR006539 | TIGR01652 | ATPase-Plipid: phospholipid-translocating P-type ATPase, flippase P-type ATPase, subfamily IV |
| 9 | IPR001757 | TIGR01494 | ATPase_P-type: HAD ATPase, P-type, family IC P-type ATPase |
| 10 | IPR018303 | PS00154 | E1-E2 ATPases phosphorylation site. P-type ATPase, phosphorylation site |

TABLE 9-continued

Details of identified domains

| Domain Identifier | InterPro No. | Accession No. | Description |
|---|---|---|---|
| 11 | IPR000909 | PF00388 | Phosphatidylinositol-specific phospholipase C, X domain Phosphatidylinositol-specific phospholipase C, X domain |
| 12 | IPR017946 | G3DSA:3.20.20.190 | PLC-like phosphodiesterase, TIM beta/alpha-barrel domain superfamily |
| 13 | IPR001192 | PR00390 | Phospholipase C signature Phosphoinositide phospholipase C family |
| 14 | IPR035892 | G3DSA:2.60.40.150 | C2 domain superfamily |
| 15 | IPR000008 | SM00239 | C2 domain |
| 16 | IPR001711 | PF00387 | Phosphatidylinositol-specific phospholipase C, Y domain Phospholipase C, phosphatidylinositol-specific, Y domain |
| 17 | IPR006379 | TIGR01484 | HAD-SF-IIB: HAD hydrolase, family IIB HAD-superfamily hydrolase, subfamily IIB |
| 18 | IPR003337 | PF02358 | Trehalose-phosphatase |
| 19 | IPR008889 | PF05678 | VQ motif |
| 20 | IPR000719 | PS50011 | Protein kinase domain profile. Protein kinase domain |
| 21 | IPR011009 | SSF56112 | Protein kinase-like domain superfamily |
| 22 | IPR012967 | PF08100 | Dimerisation domain Plant methyltransferase |
| 23 | IPR036390 | SSF46785 | Winged helix DNA-binding domain superfamily |
| 24 | IPR036388 | G3DSA:1.10.10.10 | Winged helix-like DNA-binding domain superfamily |
| 25 | IPR029063 | SSF53335 | S-adenosyl-L-methionine-dependent methyltransferase |
| 26 | IPR001077 | PF00891 | O-methyltransferase domain |
| 27 | IPR016461 | PIRSF005739 | O-methyltransferase COMT-type |
| 28 | IPR008998 | PF07468 | Agglutinin domain |
| 29 | IPR036242 | SSF50382 | Agglutinin domain superfamily |
| 30 | IPR005830 | PF01117 | Aerolysin toxin Aerolysin |
| 31 | IPR001509 | PF01370 | NAD dependent epimerase/dehydratase family |
| 32 | IPR036291 | SSF51735 | NAD(P)-binding domain superfamily |
| 33 | IPR000232 | PS00434 | HSF-type DNA-binding domain signature. Heat shock factor (HSF)-type, DNA-binding |
| 34 | IPR005202 | PS50985 | GRAS family profile. Transcription factor GRAS |
| 35 | IPR003480 | PF02458 | Transferase family Transferase |
| 36 | IPR023213 | G3DSA:3.30.559.10 | Chloramphenicol acetyltransferase-like domain superfamily |
| 37 | IPR007770 | PF05078 | Protein of unknown function (DUF679) Protein DMP |
| 38 | IPR035995 | SSF57247 | Bowman-Birk type proteinase inhibitor |
| 39 | IPR000877 | cd00023 | BBI Proteinase inhibitor I12, Bowman-Birk |
| 40 | IPR003593 | SM00382 | AAA+ ATPase domain |
| 41 | IPR003959 | PF00004 | ATPase family associated with various cellular activities (AAA) ATPase, AAA-type, core |
| 42 | IPR025753 | PF14363 | Domain associated at C-terminal with AAA AAA-type ATPase, N-terminal domain |
| 43 | IPR027417 | SSF52540 | P-loop containing nucleoside triphosphate hydrolase |
| 44 | IPR011032 | SSF50129 | GroES-like superfamily |
| 45 | IPR020843 | SM00829 | Polyketide synthase, enoylreductase domain |
| 46 | IPR013149 | PF00107 | Zinc-binding dehydrogenase Alcohol dehydrogenase, C-terminal |
| 47 | IPR003245 | PS51485 | Phytocyanin domain profile. Phytocyanin domain |
| 48 | IPR008972 | SSF49503 | Cupredoxin |
| 49 | IPR035897 | SSF52200 | Toll/interleukin-1 receptor homology (TIR) domain superfamily |
| 50 | IPR000157 | PF01582 | TIR domain Toll/interleukin-1 receptor homology (TIR) domain |
| 51 | IPR020833 | PS00711 | Lipoxygenases iron-binding region signature 1. Lipoxygenase, iron binding site |
| 52 | IPR036392 | SSF49723 | PLAT/LH2 domain superfamily |
| 53 | IPR036226 | SSF48484 | Lipoxigenase, C-terminal domain superfamily |
| 54 | IPR013819 | PR00087 | Lipoxygenase signature Lipoxygenase, C-terminal |
| 55 | IPR027433 | G3DSA:4.10.372.10 | Lipoxygenase, domain 3 |
| 56 | IPR020834 | PS00081 | Lipoxygenases iron-binding region signature 2. Lipoxygenase, conserved site |
| 57 | IPR001246 | PR00468 | Plant lipoxygenase signature Lipoxygenase, plant |
| 58 | IPR017441 | PS00107 | Protein kinases ATP-binding region signature. Protein kinase, ATP binding site |
| 59 | IPR001611 | PS51450 | Leucine-rich repeat profile. Leucine-rich repeat |
| 60 | IPR032675 | G3DSA:3.80.10.10 | Leucine-rich repeat domain superfamily |
| 61 | IPR008271 | PS00108 | Serine/Threonine protein kinases active-site signature. |

TABLE 9-continued

Details of identified domains

| Domain Identifier | InterPro No. | Accession No. | Description |
|---|---|---|---|
| 62 | IPR003591 | SM00369 | Leucine-rich repeat, typical subtype |
| 63 | IPR015425 | PS51444 | Formin homology-2 (FH2) domain profile. Formin, FH2 domain |
| 64 | IPR020864 | SM00457 | Membrane attack complex component/perforin (MACPF) domain |
| 65 | IPR036259 | SSF103473 | MFS transporter superfamily |
| 66 | IPR020846 | cd06174 | MFS Major facilitator superfamily domain |
| 67 | IPR000109 | PF00854 | POT family Proton-dependent oligopeptide transporter family |
| 68 | IPR029058 | SSF53474 | Alpha/Beta hydrolase fold |
| 69 | IPR013094 | PF07859 | alpha/beta hydrolase fold Alpha/beta hydrolase fold-3 |
| 70 | IPR004014 | PF00690 | Cation transporter/ATPase, N-terminus Cation-transporting P-type ATPase, N-terminal |
| 71 | IPR006534 | TIGR01647 | ATPase-IIIA_H: plasma-membrane proton-efflux P-type ATPase P-type ATPase, subfamily IIIA |
| 72 | IPR001245 | PF07714 | Protein tyrosine kinase Serine-threonine/tyrosine-protein kinase, catalytic domain |
| 73 | IPR036955 | G3DSA:3.30.730.10 | AP2/ERF domain superfamily |
| 74 | IPR016177 | SSF54171 | DNA-binding domain superfamily |
| 75 | IPR001471 | PR00367 | Ethylene responsive element binding protein signature AP2/ERF domain |
| 76 | IPR001005 | cd00167 | SANT SANT/Myb domain |
| 77 | IPR009057 | SSF46689 | Homeobox-like domain superfamily |
| 78 | IPR017930 | PS51294 | Myb-type HTH DNA-binding domain profile. Myb domain |
| 79 | IPR025886 | PF14299 | Phloem protein 2 Phloem protein 2-like |
| 80 | IPR005630 | PF03936 | Terpene synthase family, metal binding domain Terpene synthase, metal-binding domain |
| 81 | IPR036965 | G3DSA:1.50.10.130 | Terpene synthase, N-terminal domain superfamily |
| 82 | IPR008949 | G3DSA:1.10.600.10 | Isoprenoid synthase domain superfamily |
| 83 | IPR008930 | SSF48239 | Terpenoid cyclases/protein prenyltransferase alpha-alpha toroid |
| 84 | IPR001906 | PF01397 | Terpene synthase, N-terminal domain |
| 85 | IPR016039 | SSF53901 | Thiolase-like |
| 86 | IPR001099 | PF00195 | Chalcone and stilbene synthases, N-terminal domain Chalcone/stilbene synthase, N-terminal |
| 87 | IPR011141 | PIRSF000451 | Polyketide synthase, type III |
| 88 | IPR012328 | PF02797 | Chalcone and stilbene synthases, C-terminal domain Chalcone/stilbene synthase, C-terminal |
| 89 | IPR002123 | SM00563 | Phospholipid/glycerol acyltransferase |
| 90 | IPR011051 | SSF51182 | RmlC-like cupin domain superfamily |
| 91 | IPR006045 | SM00835 | Cupin 1 |
| 92 | IPR014710 | G3DSA:2.60.120.10 | RmlC-like jelly roll fold |
| 93 | IPR001929 | PR00325 | Germin signature Germin |
| 94 | IPR019780 | PS00725 | Germin family signature. Germin, manganese binding site |
| 95 | IPR026961 | PF13962 | Domain of unknown function PGG domain |
| 96 | IPR036770 | G3DSA:1.25.40.20 | Ankyrin repeat-containing domain superfamily |
| 97 | IPR020683 | cd00204 | ANK Ankyrin repeat-containing domain |
| 98 | IPR002110 | PS50088 | Ankyrin repeat profile. Ankyrin repeat |
| 99 | IPR034289 | cd13897 | CuRO_3_LCC_plant Laccase, third cupredoxin domain |
| 100 | IPR011706 | PF07731 | Multicopper oxidase Multicopper oxidase, type 2 |
| 101 | IPR011707 | PF07732 | Multicopper oxidase Multicopper oxidase, type 3 |
| 102 | IPR033138 | PS00079 | Multicopper oxidases signature 1. Multicopper oxidases, conserved site |
| 103 | IPR002355 | PS00080 | Multicopper oxidases signature 2. Multicopper oxidase, copper-binding site |
| 104 | IPR001117 | PF00394 | Multicopper oxidase Multicopper oxidase, type 1 |
| 105 | IPR017761 | TIGR03389 | laccase: laccase |
| 106 | IPR034285 | cd13875 | CuRO_2_LCC_plant Laccase, second cupredoxin domain |
| 107 | IPR034288 | cd13849 | CuRO_1_LCC_plant Laccase, first cupredoxin domain |
| 108 | IPR004326 | PF03094 | Mlo family Mlo-related protein |
| 109 | IPR036396 | G3DSA:1.10.630.10 | Cytochrome P450 superfamily |
| 110 | IPR001128 | PF00067 | Cytochrome P450 Cytochrome P450 |
| 111 | IPR017972 | PS00086 | Cytochrome P450 cysteine heme-iron ligand signature. Cytochrome P450, conserved site |
| 112 | IPR002401 | PR00463 | E-class P450 group I signature Cytochrome P450, E-class, group I |

Example 5: Gene Cloning and Generation of Binary Vectors for Expression in Plants To validate the role of genes identified hereinabove in increasing resistance to fungal infection, selected genes were over-expressed in plants, as follows.

Cloning Strategy

Selected genes from those presented in Examples 1-4 hereinabove were cloned into binary vectors for the generation of transgenic plants. In addition, to examine the effect of gene stacking, two pairs of genes were also cloned. For cloning, the full-length open reading frames (ORFs) were identified. EST clusters and in some cases mRNA sequences were analyzed to identify the entire open reading frame by comparing the results of several translation algorithms to known proteins from other plant species.

In order to clone the full-length cDNAs, reverse transcription (RT) followed by polymerase chain reaction (PCR; RT-PCR) was performed on total RNA extracted from roots or shoots challenged by the relevant pathogen. Total RNA extraction, production of cDNA and PCR amplification was performed using standard protocols described elsewhere (Sambrook J., E. F. Fritsch, and T. Maniatis. 1989. Molecular Cloning. A Laboratory Manual, 2nd Ed. Cold Spring Harbor Laboratory Press, New York) which are well known to those skilled in the art. PCR products were purified using PCR purification kit (Qiagen).

Typically, 2 sets of primers were prepared for the amplification of each gene, via nested PCR (if required). Both sets of primers were used for amplification on a cDNA. In case no product was obtained, a nested PCR reaction was performed. Nested PCR was performed by amplification of the gene using external primers and then using the produced PCR product as a template for a second PCR reaction, where the internal set of primers was used. Alternatively, one or two of the internal primers were used for gene amplification, both in the first and the second PCR reactions (meaning only 2-3 primers are designed for a gene). To facilitate further cloning of the cDNAs, an 8-12 base pairs (bp) extension was added to the 5' of each internal primer. The primer extension includes an endonuclease restriction site. The restriction sites were selected using two parameters: (a) the restriction site does not exist in the cDNA sequence; and (b) the restriction sites in the forward and reverse primers were designed such that the digested cDNA was inserted in the sense direction into the binary vector utilized for transformation.

PCR products were digested with the restriction endonucleases (New England BioLabs Inc.) according to the sites designed in the primers. Each digested/undigested PCR product was inserted into a high copy vector pUC19 (New England BioLabs Inc.), or into plasmids originating from this vector. In some cases, the undigested PCR product was inserted into pCR-Blunt II-TOPO (Invitrogen) or into pJET1.2 (CloneJET PCR Cloning Kit, Thermo Scientific) or directly into the binary vector. The digested/undigested products and the linearized plasmid vector were ligated using T4 DNA ligase enzyme (Roche, Switzerland or other manufacturers). In cases where pCR-Blunt II-TOPO is used no T4 ligase was needed.

Sequencing of the inserted genes was performed using the ABI 377 sequencer (Applied Biosystems). In some cases, after confirming the sequences of the cloned genes, the cloned cDNA was introduced into pQ6sVN plasmid.

Several DNA sequences of the selected genes were synthesized by GeneArt™ (Life Technologies, Grand Island, N.Y., USA). Synthetic DNA was designed in silico. Suitable restriction enzyme sites were added to the cloned sequences at the 5' end and at the 3' end to enable later cloning into the desired binary vector.

Binary vectors—The pPI plasmid vector was constructed by inserting a synthetic poly-(A) signal sequence, originating from pGL3 basic plasmid vector (Promega, GenBank Accession No. U47295; nucleotides 4658-4811) into the HindIII restriction site of the binary vector pBI101.3 (Clontech, GenBank Accession No. U12640). pGI is similar to pPI, but the original gene in the backbone is GUS-Intron and not GUS.

The modified pGI vector (e.g., pQFN, pQFNc, pQFNd, pQYN_6669, pQNa_RP, pQFYN, pQXNc or pQ6sVN (FIG. 1) is a modified version of the pGI vector in which the cassette is inverted between the left and right borders so the gene and its corresponding promoter are close to the right border and the hygromycin-resistance conferring gene is close to the left border.

In case of *Brachypodium* transformation, after confirming the sequences of the cloned genes, the cloned cDNAs were introduced into pQ6sVN (FIG. 1) containing 35S promoter (SEQ ID NO:37) and the NOS terminator (SEQ ID NO:36) via digestion with appropriate restriction endonucleases. The genes were cloned downstream to the 35S promoter and upstream to the NOS terminator. In the pQ6sVN vector the Hygromycin resistance gene cassette and the Bar_GA resistance gene cassette replaced the NPTII resistance gene cassette. pQ6sVN contains the 35S promoter (SEQ ID NO:37). Bar_GA resistance gene (SEQ ID NO: 39) is an optimized sequence of the BAR gene for expression in Brachypodium plants (ordered from GeneArt™).

BAR gene coding sequence is provided in GenBank Accession No. JQ293091.1 (SEQ ID NO:38); further description is provided in Akama K, et al. "Efficient *Agrobacterium*-mediated transformation of *Arabidopsis thaliana* using the bar gene as selectable marker", Plant Cell Rep. 1995, 14(7):450-4; Christiansen P, et al. "A rapid and efficient transformation protocol for the grass *Brachypodium distachyon*", Plant Cell Rep. 2005 March; 23(10-11):751-8. Epub 2004 Oct. 19; and Păcurar D I, et al. "A high-throughput Agrobacterium-mediated transformation system for the grass model species *Brachypodium distachyon* L", Transgenic Res. 2008 17(5):965-75; each of which is fully incorporated herein by reference in its entirety.

The pQ6sVN vector, in addition to the multiple cloning sites (MCS) between the promoter and terminator, contains additional restriction sites (PmeI, I-SceI, and BsaI) downstream of the expression cassette to allow cloning of a second expression cassette into the vector.

Stacking two genes (two expression cassettes) into pQ6sVN was performed as follows: the first gene was cloned into pQ6sVN via the MCS. The second gene was cloned into the vector pUCsVN. Genes cloned into this high copy vector via its MCS are flanked by a 35S promoter and a NOS terminator—the same elements found in the pQ6sVN vector. The expression cassette of pUCsVN is flanked by restriction sites for PmeI, I-SceI and BsaI. The cassette containing the second gene was excised from pUCsVN by digestion with one of the aforementioned enzymes, and ligated into the pQ6sVN plasmid already carrying the first gene, linearized with the same restriction enzyme. This resulted in a single vector harboring two "stacked" cassettes. The sequences and orientations of both cassettes were verified by Sanger sequencing and restriction digests.

In case genomic DNA was cloned, the genes were amplified by direct PCR on genomic DNA extracted from leaf tissue using the DNAeasy kit (Qiagen Cat. No. 69104).

Table 10 hereinbelow provides a list of the gene cloned, including gene name, the organism from which the gene is derived, the SEQ ID NO. of the primer used and the SEQ ID NO. of the gene polynucleotide and encoded polypeptide.

TABLE 10

Cloned genes

| Gene Name | Organism | Primers used SEQ ID NOs | Polyn. SEQ ID NO | Polyp. SEQ ID NO |
|---|---|---|---|---|
| LFS82 | Zea mays | 535, 561, 574, 588 | 63 | 349 |
| LFS83 | Triticum aestivum | 536, 562, 575, 589 | 64 | 350 |
| LFS84 | Triticum aestivum | — | 65 | 310 |
| LFS86 | Zea mays | — | 66 | 311 |
| LFS89 | Triticum aestivum | — | 67 | 313 |
| LFS90 | Aegilops tauschii | 511, 537, 563, 576 | 68 | 351 |
| LFS91 | Aegilops tauschii | 512, 538 | 69 | 315 |
| LFS92 | Aegilops tauschii | 513, 539 | 70 | 352 |
| LFS93 | Aegilops tauschii | — | 71 | 317 |
| LFS94 | Aegilops tauschii | 514, 540, 564 | 72 | 353 |
| LFS95 | Aegilops tauschii | 515, 541, 565, 577 | 73 | 354 |
| LFS96 | Aegilops tauschii | 516, 542 | 74 | 355 |
| LFS97 | Aegilops tauschii | 517, 543, 566, 578 | 75 | 356 |
| LFS98 | Aegilops tauschii | 518, 544, 567, 579 | 76 | 357 |
| LFS99 | Aegilops tauschii | 519, 545, 568, 580 | 77 | 358 |
| LFS100 | Aegilops tauschii | 520, 546, 569, 581 | 78 | 359 |
| LFS102 | Aegilops tauschii | 521, 547, 582 | 79 | 325 |
| LFS104 | Aegilops tauschii | 547, 582, 522, 548 | 80 | 360 |
| LFS105 | Aegilops tauschii | 590, 591 | 307 | 510 |
| LFS106 | Aegilops tauschii | 523, 549 | 81 | 327 |
| LFS107 | Aegilops tauschii | 524, 550 | 82 | 361 |
| LFS109 | Aegilops tauschii | 525, 551 | 83 | 362 |
| LFS110 | Aegilops tauschii | — | 84 | 330 |
| LFS111 | Aegilops tauschii | — | 85 | 331 |
| LFS112 | Aegilops tauschii | — | 304 | 507 |
| LFS113 | Aegilops tauschii | 526, 552, 570, 583 | 86 | 363 |
| LFS114 | Aegilops tauschii | 527, 553, 571, 584 | 87 | 364 |
| LFS115 | Aegilops tauschii | — | 88 | 334 |
| LFS116 | Aegilops tauschii | 528, 554, 572, 585 | 89 | 335 |
| LFS117 | Aegilops tauschii | 529, 555 | 90 | 365 |
| LFS121 | Setaria italica | — | 91 | 337 |
| LFS122 | Setaria italica | 530, 556, 573, 586 | 92 | 338 |
| LFS123 | Setaria italica | 531, 557, 587 | 93 | 366 |
| LFS124 | Setaria italica | — | 94 | 340 |
| LFS125 | Setaria italica | 532, 558 | 95 | 367 |
| LFS126 | Setaria italica | — | 96 | 342 |
| LFS127 | Setaria italica | — | 97 | 343 |
| LFS128 | Setaria italica | 533, 559 | 98 | 368 |
| LFS129 | Setaria italica | 534, 560 | 99 | 345 |

"polyn." = polynucleotide;
"polyp." = polypeptide.

Example 6: Transformation of *Brachypodium distachyon* Plants with the Polynucleotides of the Invention Similar to the *Arabidopsis* model plant, *Brachypodium distachyon* has several features that recommend it as a model plant for functional genomics studies, especially in the grasses. Traits that make it an ideal model include its small genome (~160 Mbp for a diploid genome and 355 Mbp for a polyploidy genome), small physical stature, a short lifecycle, and few growth requirements. *Brachypodium* is related to the major cereal grain species but is understood to be more closely related to the Triticeae (wheat, barley) than to the other cereals. *Brachypodium*, with its polyploidy accessions, can serve as an ideal model for these grains (whose genomic size and complexity is a major barrier to biotechnological improvement).

*Brachypodium distachyon* embryogenic calli were transformed using the procedure described by Vogel and Hill (2008. High-efficiency *Agrobacterium*-mediated transformation of *Brachypodium distachyon* inbred line Bd21-3. Plant Cell Rep 27:471-478); Vain et al (2008. *Agrobacterium*-mediated transformation of the temperate grass *Brachypodium distachyon* (genotype Bd21) for T-DNA insertional mutagenesis. Plant Biotechnology J 6: 236-245), and Vogel J, et al. (2006. *Agrobacterium* mediated transformation and inbred line development in the model grass *Brachypodium distachyon*. Plant Cell Tiss Org. Cult. 85:199-211), each of which is fully incorporated herein by reference, with some minor modifications, which are briefly summarized hereinbelow.

Callus initiation—Immature spikes (about 2 months after seeding) were harvested at the very beginning of seeds filling. Spikes were then husked and surface sterilized with 3% NaClO containing 0.1% Tween 20, shaken on a gyratory shaker at low speed for 20 minutes. Following three rinses with sterile distilled water, embryos were excised under a dissecting microscope in a laminar flow hood using fine forceps.

Excised embryos (size ~0.3 mm, bell shaped) were placed on callus induction medium (CIM) [LS salts (Linsmaier, E. M. & Skoog, F. 1965. Physiol. Plantarum 18, 100) and vitamins plus 3% sucrose, 6 mg/L $CuSO_4$, 2.5 mg/l 2,4-Dichlorophenoxyacetic Acid, pH 5.8 and 0.25% phytagel (Sigma)] with the scutellum side down, 50 or 100 embryos on a plate, and incubated at 28° C. in the dark. One week later, the embryonic calli were cleaned from emerging shoots and somatic calli, and subcultured onto fresh CIM medium. During culture, yellowish embryogenic calli (EC) appear and were further selected (e.g., picked and transferred) for further incubation in the same conditions for additional 2 weeks. Twenty-five pieces of sub-cultured calli were then separately placed on 90×15 mm petri plates, and incubated as before for three additional weeks.

Transformation—As described in Vogel and Hill (2008, Supra), Agrobacterium is scraped off 2-day-old MGL plates (plates with the MGL medium which contains: Tryptone 5 gr/L, Yeast Extract 2.5 gr/L, NaCl 5 gr/L, D-Mannitol 5 g/l, $MgSO_4*7H_2O$ 0.204 gr/L, $K_2HPO_4$ 0.25 gr/L, Glutamic Acid 1.2 gr/L, Plant Agar 7.5 gr/L) and resuspended in liquid MS medium supplemented with 200 μM acetosyringone to an optic density (OD) at 600 nm ($OD_{600}$) of 0.6 to 1.0. Once the desired OD was attained, 1 ml of 10% Synperonic PE/F68 (Sigma) per 100 ml of inoculation medium is added.

To begin inoculation, 300 callus pieces were placed in approximately 12 plates (25 callus pieces in each plate) and covered with the Agrobacterium suspension (8-10 ml). The callus was incubated in the Agrobacterium suspension for 5 to 20 minutes. After incubation, the Agrobacterium suspension was aspirated off and the calli were then transferred into co-cultivation plates, prepared by placing a sterile 7-cm diameter filter paper in an empty 90×15 mm petri plate. The calli pieces are then gently distributed on the filter paper. One co-cultivation plate is used for two starting callus plates (50 initial calli pieces). The co-cultivation plates were then sealed with Parafilm M® or a plastic wrap [e.g., Saran™ wrap (Dow Chemical Company)] and incubated at 24° C. in the dark for 3 days.

The callus pieces were then individually transferred into CIM medium as described above, which was further supplemented with 200 mg/L Ticarcillin (to kill the Agrobacterium) and Bialaphos (5 mg/L) or Hygromycin B (40 mg/L) (for selection of the transformed resistant embryogenic calli sections), and incubated at 28° C. in the dark for 14 days.

The calli pieces were then transferred to shoot induction media (SIM; LS salts and vitamins plus 3% Maltose monohydrate) supplemented with 400 mg/L Ticarcillin, Bialaphos (5 mg/L) or Hygromycin B (40 mg/L), Indol-3-acetic acid (IAA) (0.25 mg/L), and 6-Benzylaminopurine (BAP) (1 mg/L), and were cultivated in conditions as described below. After 10-15 days calli were sub-cultured on the same fresh media for additional 10-15 days (total of 20-30 days). At each sub-culture all the pieces from a single callus were kept together to maintain their independence and were incubated under the following conditions: light to a level of 60 lE $m^{-2}$ $s^{-1}$, a 16-hours light, 8-hours dark photoperiod and a constant 24° C. temperature. During the period of 20 to 30 days from the beginning of cultivation of calli on shoot induction media (SIM) plantlets start to emerge from the transformed calli.

When plantlets were large enough to handle without damage, they were transferred to plates containing the above-mentioned shoot induction media (SIM) with Bialaphos or Hygromycin B. Each plantlet is considered as a different event. After two weeks of growth, the plantlets were transferred to 2-cm height Petri plates (De Groot, Catalog No. 60-664160) containing MSnoH media (MS salts 4.4 gr/L, sucrose 30 gr/L, supplemented with Hygromycin B (40 mg/L) and Ticarcillin (400 mg/L). Roots usually appear within 2 weeks. Rooted and non-rooted plants were transferred to a fresh MSnoH media supplemented with Hygromycin B and Ticarcillin as described above. In case roots do not appear in the non-rooted plants after two weeks on the MSnoH media (which is supplemented with Hygromycin B and Ticarcillin), then the non-rooted plants are further transferred to the rooting induction medium [RIM; MS salts and vitamins 4.4 gr/L, sucrose 30 gr/L with Ticarcillin 400 mg/L, Indol-3-acetic acid (IAA) (1 mg/L), and α-Naphthalene acetic acid (NAA) (2 mg/L)]. After additional two weeks of incubation at 24° C., the plantlets are transferred to 0.5 modified RIM medium [MS modified salts 4.4 gr/L, MS vitamins 103 mg/L, sucrose 30 gr/L with α-Tocopherol (2 mg/L), Indol-3-acetic acid (IAA) (1 mg/L), and α-Naphthalene acetic acid (NAA) (2 mg/L)] and are incubated at 28° C. for additional 15-20 days, till the roots appear.

If needed, in the tillering stage the plantlets can grow axillary tillers and eventually become bushy on the above-mentioned media (SIM) without Bialaphos or Hygromycin B. Each bush from the same plant (event ID) is then divided to tissue culture boxes ("Humus") containing "rooting medium" [MS basal salts, 3% sucrose, 3 gr/L phytagel, 2 mg/L α-Naphthalene Acetic Acid (NAA) and 1 mg/L IAA and Ticarcillin 400 mg/L, PH 5.8]. All plants in a "Humus box" are individual plants of the same transformation event.

When plantlets establish roots, they are transplanted to the soil and grown in the greenhouse. Before transfer to greenhouse, 20 randomly selected events are tested every month for expression of the BAR_GA gene (SEQ ID NO:39, BAR gene) which is responsible for resistance to Bialaphos, using AgraStrip® LL strip test seed check (Romer labs). Briefly, the expression of the BAR gene is determined as follows: Leaves (about 0.5 cm long leave) are grounded using a pellet pestle in an Eppendorf tube containing 150 µl of water until the water turns green in color. A strip test is then added to the Eppendorf tube and the results are read within 30-60 seconds. Appearance of two pink bands means that the plant is transgenic. On the other hand, appearance of one pink band means that the plant is not transgenic or not expressing BAR gene.

To verify the transgenic status of plants containing the gene of interest, Ti plants are subjected to PCR as previously described by Vogel et al. 2006 [*Agrobacterium* mediated transformation and inbred line development in the model grass *Brachypodium distachyon*. Plant Cell Tiss Org. Cult. 85:199-211].

Example 7: Validation Assays

The transgenic *Brachypodium* plants obtained as described hereinabove were used to validate the effect of the transformed gene(s) on fungal penetration and spreading within the plant by evaluation of fungal penetration and spreading within inoculated seedlings grown under controlled conditions.

Each validation assay evaluates the gene performance by quantitative and/or qualitative measure of specific traits as described in Table 11 below.

TABLE 11

| Allocation of fungal parameters to specific traits | | |
| --- | --- | --- |
| # | Parameters | Traits |
| 1 | Fungal biomass in root | Fungal presence in tissue |

The validation assay was performed with inoculated transgenic plants grown under controlled conditions till seedling stage (1-2 tillers).

Transgenic *Brachypodium* seeds were sown in trays contained sterilized vermiculite soaked with 0.1% BASTA solution for selection of transgenic plants. The trays were placed in the refrigerator at 4° C. for cold treatment for 3 days (stratification step) following by trays placement in controlled growth chamber for germination up to 5 days (26° C.±1, humidity of 50%).

The viable transgenic seedlings were inoculated with *Fusarium verticillioides* (Fv 149 strain, GFP-tagged and bar-resistant) spore solution ($10^6$/ml) and then transplanted to 180 $cm^3$ pots filled with sterilized vermiculite. The plants were grown for 7 days in the growth chamber.

For fungal biomass recovery, roots externally sterilized and then grinded. Serial dilutions of the extracts from each one of the biological repeats (1 biological repeat is a pool of 6 roots) were plated in Petri dishes and incubated for 5 days at 25° C. Developing colonies were counted to provide Colony Forming Units (CFU) using a florescent binocular and data were transformed to logarithmic scale for further analysis.

Fungal Biomass was computed as Log CFU of fungal root extraction 7 days after inoculation Statistical analyses—To identify genes conferring significantly improved tolerance to fungal penetration and fungal spreading, the results obtained from the transgenic plants were compared to those obtained from control plants. To identify outperforming genes and constructs, results from the independent transformation events tested were analyzed separately. Analysis was conducted on the log CFU data using Student's t-test. The JMP statistics software package was used (Version 5.2.1, SAS Institute Inc., Cary, N.C., USA). Table 12 hereinbelow shows the reduction in CFU in the tested infected plants and its significance compared to control plants.

TABLE 12

Validation results (single genes): reduction of fungi burden in
*Brachypodium* plant infected with *Fusarium verticilloides*

| Gene Name | Origin | % change of

TABLE 12-continued

Validation results (single genes): reduction of fungi burden in *Brachypodium* plant infected with *Fusarium verticilloides*

| Gene Name | Origin | % change of logCFU relative to control (p value) | % change of CFU relative to control |
|---|---|---|---|
| | | Event 13937.1: −5.62% (significant, p_value = 0.01) | Event 13937.1: −41.63% |
| | | Event 13939.1: 1.19% (not significant, p_value = 0.32) | Event 13939.1: 12.11% |
| | | Event 13933.1: −0.78% (not significant, p_value = 0.

TABLE 12-continued

Validation results (single genes): reduction of fungi burden in *Brachypodium* plant infected with *Fusarium verticilloides*

| Gene

TABLE 12-continued

Validation results (single genes): reduction of fungi burden in *Brachypodium* plant infected with *Fusarium verticilloides*

| Gene Name | Origin | % change of logCFU relative to control (p value) | % change of CFU relative to control |
|---|---|---|---|
| LFS116 | *Aegilops* | first assay: | first assay: |
| | | Event 13962.41: −2.38% (not significant, p_value = 0.30) | Event 13962.41: −20.21% |
| | | Event 13898.1: −2.67% (not significant, p_value = 0.27) | Event 13898.1: −22.39% |
| | | Event 13904.1: −7.55% (significant, p_value = 0.04) | Event 13904.1: −51.20% |
| | | Event 13961.30: −4.26% (not significant, p_value = 0.17) | Event 13961.30: −33.27% |
| | | Event 13902.1: −3.32% (not significant, p_value = 0.23) | Event 13902.1: −27.05% |
| | | Event 13903.1: −7.12% (significant, p_value = 0.06) | Event 13903.1: −49.13% |
| | | second assay: | second assay: |
| | | Event 13904.1: −1.77% (not significant, p_value = 0.29) | Event 13904.1: −16.48% |
| | | Event 13903.1: −0.56% (not significant, p_value = 0.44) | Event 13903.1: −5.52% |
| LFS117 | *Aegilops* | first assay: | first assay: |
| | | Event 14246.1: −5.66% (significant, p_value = 0.05) | Event 14246.1: −42.61% |
| | | Event 14203.1: 3.03% (not significant, p_value = 0.19) | Event 14203.1: 34.55% |
| | | Event 14245.1: −9.05% (significant, p_value = 0.00) | Event 14245.1: −58.81% |
| | | second assay: | second assay: |
| | | Event 14246.1: 3.99% (not significant, p_value = 0.14) | Event 14246.1: 44.59% |
| | | Event 14245.1: −1.48% (not significant, p_value = 0.34) | Event 14245.1: −12.76% |
| LFS122 | Foxtail millet | first assay: | first assay: |
| | | Event 13926.1: 10.35% (significant, p_value = 0.00) | Event 13926.1: 160.27% |
| | | Event 13880.1: 14.50% (significant, p_value = 0.00) | Event 13880.1: 281.82% |
| | | Event 13879.1: 12.68% (significant, p_value = 0.00) | Event 13879.1: 222.64% |
| | | Event 13908.1: 6.91% (significant, p_value = 0.01) | Event 13908.1: 89.30% |
| | | Event 13906.1: 0.21% (not significant, p_value = 0.47) | Event 13906.1: 1.99% |
| | | Event 13907.1: −3.63% (significant, p_value = 0.09) | Event 13907.1: −28.52% |
| | | second assay: | second assay: |
| | | Event 13907.1: −9.24% (significant, p_value = 0.00) | Event 13907.1: −60.88% |
| LFS123 | Foxtail millet | first assay: | first assay: |
| | | Event 14127.1: 3.23% (not significant, p_value = 0.11) | Event 14127.1: 37.61% |
| | | Event 14130.1: −0.64% (not significant, p_value = 0.40) | Event 14130.1: −6.18% |
| | | Event 14125.1: −13.66% (significant, p_value = 0.00) | Event 14125.1: −74.11% |
| | | Event 14121.1: −5.44% (significant, p_value = 0.02) | Event 14121.1: −41.63% |
| | | Event 14122.1: 7.25% (significant, p_value = 0.00) | Event 14122.1: 104.81% |
| | | Event 14131.1: 1.34% (not significant, p_value = 0.30) | Event 14131.1: 14.13% |
| | | second assay: | second assay: |
| | | Event 14125.1: 0.49% (not significant, p_value = 0.47) | Event 14125.1: 4.42% |
| | | Event 14121.1: −0.47% (not significant, p_value = 0.39) | Event 14121.1: −4.06% |
| LFS125 | Foxtail millet | first assay: | first assay: |
| | | Event 14043.1: 0.01% (not significant, p_value = 0.49) | Event 14043.1: 0.05% |
| | | Event 14056.1: −6.59% (significant, p_value = 0.02) | Event 14056.1: −46.26% |
| | | Event 14044.1: −6.57% (significant, p_value = 0.02) | Event 14044.1: −46.15% |
| | | Event 14048.1: 1.23% (not significant, p_value = 0.34) | Event 14048.1: 12.26% |
| | | Event 14042.1: 1.20% (not significant, p_value = 0.34) | Event 14042.1: 11.95% |
| | | Event 14053.1: −4.57% (significant, p_value = 0.08) | Event 14053.1: −34.98% |
| | | second assay: | second assay: |
| | | Event 14056.1: −6.84% (significant, p_value = 0.02) | Event 14056.1: −50.22% |
| | | Event 14044.1: −6.73% (significant, p_value = 0.02) | Event 14044.1: −49.65% |
| | | Event 14053.1: −3.49% (not significant, p_value = 0.15) | Event 14053.1: −29.92% |
| LFS126 | Foxtail millet | first assay: | first assay: |
| | | Event 14081.1: −4.75% (significant, p_value = 0.02) | Event 14081.1: −37.78% |
| | | Event 14089.1: −9.88% (significant, p_value = 0.00) | Event 14089.1: −62.77% |
| | | Event 14085.1: 6.71% (significant, p_value = 0.00) | Event 14085.1: 95.51% |
| | | Event 14082.1: −0.40% (not significant, p_value = 0.43) | Event 14082.1: −3.88% |
| | | Event 14086.1: −10.60% (significant, p_value = 0.00) | Event 14086.1: −65.34% |
| | | Event 14087.1: 3.21% (significant, p_value = 0.08) | Event 14087.1: 37.82% |
| | | second assay: | second assay: |
| | | Event 14081.1: −5.25% (significant, p_value = 0.06) | Event 14081.1: −41.44% |
| | | Event 14089.1: 2.31% (not significant, p_value = 0.23) | Event 14089.1: 26.61% |
| | | Event 14086.1: −4.17% (significant, p_value = 0.10) | Event 14086.1: −34.67% |
| LFS127 | Foxtail millet | first assay: | first assay: |
| | | Event 14102.1: −1.42% (not significant, p_value = 0.32) | Event 14102.1: −14.65% |
| | | Event 14104.1: −6.45% (significant, p_value = 0.01) | Event 14104.1: −51.20% |
| | | Event 14101.1: −3.76% (significant, p_value = 0.08) | Event 14101.1: −34.14% |
| | | Event 14096.1: −4.07% (significant, p_value = 0.07) | Event 14096.1: −36.39% |
| | | Event 14098.1: −7.82% (significant, p_value = 0.00) | Event 14098.1: −58.07% |
| | | Event 14100.1: −9.83% (significant, p_value = 0.00) | Event 14100.1: −66.48% |
| | | second assay: | second assay: |
| | | Event 14104.1: 2.31% (not significant, p_value = 0.29) | Event 14104.1: 24.66% |
| | | Event 14101.1: −0.33% (not significant, p_value = 0.47) | Event 14101.1: −3.06% |
| | | Event 14096.1: 7.82% (significant, p_value = 0.03) | Event 14096.1: 110.92% |
| | | Event 14098.1: −1.41% (not significant, p_value = 0.37) | Event 14098.1: −12.56% |
| | | Event 14100.1: 2.72% (not significant, p_value = 0.26) | Event 14100.1: 29.66% |
| LFS128 | Foxtail millet | first assay: | first assay: |
| | | Event 14222.1: −0.79% (not significant, p_value = 0.40) | Event 14222.1: −7.05% |
| | | Event 14223.1: −2.67% (not significant, p_value = 0.19) | Event 14223.1: −21.93% |

TABLE 12-continued

Validation results (single genes): reduction of fungi burden in
*Brachypodium* plant infected with *Fusarium verticilloides*

| Gene Name | Origin | % change of logCFU relative to control (p value) | % change of CFU relative to control |
|---|---|---|---|
| | | Event 14225.1: −1.43% (not significant, p_value = 0.32) | Event 14225.1: −12.39% |
| | | Event 14226.1: −2.56% (not significant, p_value = 0.17) | Event 14226.1: −21.10% |
| | | Event 14229.1: −0.93% (not significant, p_value = 0.38) | Event 14229.1: −8.23% |
| | | Event 14220.1: 2.35% (not significant, p_value = 0.22) | Event 14220.1: 24.38% |

"CFU" = Colony Forming Unit

An increase in the resistance of plants to fungal diseases may be achieved by two genes stack expression, which are addressing the same or different mode of action.

Two different combinations of gene stacking were expressed in *Brachypodium* plants. The combination of response signaling therefore increasing the efficacy of the reaction.

Table 13 hereinbelow summarizes the reduction of fungi burden in the transgenic *Brachypodium* plants comprising the stacked genes infected with *Fusarium verticilloides*.

TABLE 13

Validation results (stacked genes): reduction of fungi burden in
*Brachypodium* plant infected with *Fusarium verticilloides*

| Construct Name | Origin gene 1 | Origin gene 2 | % change of logCFU relative to control (p-value) | % change of CFU relative to control |
|---|---|---|---|---|
| Stack: LFS57 & LFS86 | Sorghum | Maize | first assay:<br>Event 13342.1: −11.07% (significant, p_value = 0.00)<br>Event 13345.1: −5.46% (significant, p_value = 0.04)<br>Event 13339.1: −13.82% (significant, p_value = 0.00)<br>Event 13344.1: 6.76% (significant, p_value = 0.01)<br>Event 13331.1: 0.39% (not significant, p_value = 0.45)<br>Event 13340.1: −8.44% (significant, p value = 0.00)<br>second assay:<br>Event 13342.1: −2.88% (not significant, p_value = 0.13)<br>Event 13345.1: −2.69% (not significant, p_value = 0.15)<br>Event 13339.1: −3.83% (significant, p_value = 0.07) | first assay:<br>Event 13342.1: −66.14%<br>Event 13345.1: −41.40%<br>Event 13339.1: −74.12%<br>Event 13344.1: 93.66%<br>Event 13331.1: 3.85%<br>Event 13340.1: −56.20%<br><br><br>second assay:<br>Event 13342.1: −23.99%<br>Event 13345.1: −22.59%<br>Event 13339.1: −30.57% |
| Stack: LFS46 & LFS84 | Sorghum | Wheat | first assay:<br>Event 13859.1: −7.47% (significant, p_value = 0.01)<br>Event 13852.1: −0.08% (not significant, p_value = 0.49)<br>Event 13848.1: −3.18% (not significant, p_value = 0.17)<br>Event 13850.1: −12.93% (significant, p_value = 0.00)<br>Event 13851.1: 4.31% (not significant, p_value = 0.11)<br>second assay:<br>Event 13859.1: −4.10% (not significant, p_value = 0.13)<br>Event 13850.1: −14.82% (significant, p_value = 0.00) | first assay:<br>Event 13859.1: −52.31%<br>Event 13852.1: −0.79%<br>Event 13848.1: −26 99%<br><br>Event 13850.1: −72.23%<br>Event 13851.1: 53.34%<br><br>second assay:<br>Event 13859.1: −31.75%<br>Event 13850.1: −74.82% |

"CFU" = Colony Forming Unit

LFS57 (disclosed in WO 2018/131037), a gene linked to programmed cell death, and LFSS86 disclosed in the present invention, a gene related to plant defense signaling activation, addresses the effect of stacking two different mode of actions directed to increase resistance.

The combination of LFS46 (disclosed in WO 2018/131037) and LFS84 disclosed in the present invention addresses the effect of stacking two genes coding for enzymes processing the same metabolite involved in defense Example 8: Overexpression of a Polypeptide by Genome Editing Over-expression of a polypeptide according to certain embodiments of the present invention can be achieved using methods of gene editing. One example of such approach includes editing a selected genomic region as to express the polypeptide of interest. In the current example, the target genomic region is the maize locus GRMZM2G069095

(based on genome version *Zea mays* AGPv3) and the polypeptide to be over-expressed is the maize LFS127_H4 comprising the amino acid sequence set forth in SEQ ID NO:495 encoded by the polynucleotide having the nucleic acid sequence set forth in SEQ ID NO:289. It is to be explicitly understood that other genome loci can be used as targets for genome editing for over-expressing other polypeptides of the invention based on the same principles.

FIG. 2A depicts the sequence of the endogenous 5' upstream flanking region of the genomic sequence GRMZM2G069095 (SEQ ID NO:12) and FIG. 2B depicts the sequence of the endogenous 3'-downstream flanking region of this genomic locus (SEQ ID NO:13). FIG. 2C depicts the sequence of the 5'-UTR gRNA (SEQ ID NO:10) and FIG. 2D depicts the sequence of the 5'-UTR gRNA without NGG nucleotides following the 3 nucleotides after the Cas9 cutting (SEQ ID NO:14). FIG. 2E depicts the sequence of the 3'-UTR gRNA (SEQ ID NO:11) and FIG. 2F depicts the sequence of the 3'-UTR gRNA after cut (SEQ ID NO:15). FIG. 2G depicts the coding sequence (from the "ATG" start codon to the "TAG" termination codon, marked by bold and underlined) of the desired LFS127_H4 sequence (SEQ ID NO:289) encoding the polypeptide set forth by SEQ ID NO:495.

The complete exemplary repair template (SEQ ID NO:16) is depicted in FIG. 2H. The repair template includes: (1) the upstream flanking region (1 kbp) sequence including part of the gRNA after cutting (SEQ ID NO:14; shown in bold and italics); (2) 5' UTR of genomic DNA from Cas9 cutting site to ATG; (3) the coding sequence (CDS) of the desired LFS127_H4 sequence (SEQ ID NO:17) marked in lower case with the start (ATG) and the stop (TGA) codons marked in bold and underlined; (4) 3' UTR of genomic DNA from the stop codon to Cas9 cutting site including the predicted part of the gRNA after cutting (SEQ ID NO:15), shown in bold and underlined and (5) the downstream flanking region (1 kbp) sequence.

The repair template is delivered into the cell type of interest along with the 5' and 3'guide RNA sequences (SEQ ID NO:10 and SEQ ID NO:11, respectively).

Example 9: Knock Out of a Polypeptide by Genome Editing

Knock-out of a polypeptide according to certain embodiments of the present invention can be achieved using methods of gene editing.

In the current example, the target genomic region is the maize (*Zea mays*) LFS132 comprising the amino acid sequence set forth in SEQ ID NO:348 encoded by the polynucleotide having the nucleic acid sequence set forth in SEQ ID NO:62. It is to be explicitly understood that other genome loci can be used as targets for genome editing for over-expressing other polypeptides of the invention based on the same principles.

The Crisper/CAS9 or similar systems can generate double stranded breaks (DSBs) at any genomic locus under the guidance of an engineered single-guide RNA when delivered into the cell type of interest. Non-homologous end-joining (NHEJ) in the absence of DNA template accompanied with the modification of target genomic repair the DSBs but tends to be prone to insertion and/or deletion (indel) mutations at the junctional site therefore causing frameshifts mutations that disrupt the targeted gene. (FIG. 3E)

FIG. 3A depicts the sequence of the KO gRNA (SEQ ID NO:51); FIG. 3C depicts the coding sequence (from the "ATG" start codon to the "TGA" termination codon, marked by bold and underlined) of the desired LFS132 sequence (SEQ ID NO:53); FIG. 3B depicts the sequence of the KO gRNA after cut (SEQ ID NO:52); FIG. 3D (targeted region in bold) and FIG. 3E depict the anticipated change in the coding sequence of the exemplified KO gene (SEQ ID NO:54).

Section II: Bacterial Genes Associated with Fungal Resistance

Example 10: Isolating Soil Bacteria with Potential Antifungal Activity

Bacteria were isolated from soil in five different locations in Israel with agriculture history for *Fusaria* spp. related diseases, by a two-layer functional assay against *Fusarium verticillioides* (Fv). In brief, fungal spores were plated on PDA agar medium with a thin R2A medium (Reasoner D J & Geldreich A new medium for the enumeration and subculture of bacteria from potable water. Appl Environ Microbiol 1985 49:1-7) overlay containing different dilutions of soil washes. Active bacteria were isolated from lytic zones and further characterized for the antifungal activity in dual-culture confrontation assays against Fv on R2A agar plates. Table 14 presents a list of the bacteria isolated. In parenthesis is the percentage of similarity between the isolate and the known genus or species.

TABLE 14

Bacterial isolates having antifungal activity

| Isolate No. | Taxa Isolate (Percentage of similarity) |
|---|---|
| 1 | *Arthrobacter globiformis* (31.4) |
| 2 | *Bacillus* (95.0) |
| 3 | *Pseudomonas* (66.2) |
| 4 | *Erwinia* (17.8) |
| 5 | *Arthrobacter* (33.1) |
| 6 | *Bacillus* (75.5) |
| 7 | *Bacillus* (94.8) |
| 8 | *Bacillus* (94.8) |
| 9 | *Pseudomonas* (43.6) | *Massilia* (45.6) |
| 10 | *Pseudomonas* (43.6) |*Massilia* (45.6) |
| 11 | *Pseudomonas* (44.0) |
| 12 | *Pseudomonas* (61.4) |
| 13 | *Pseudomonas* (61.4) |
| 14 | *Pseudomonas* (61.4) |
| 15 | *Pseudomonas* (52.7) |*Bacillus subtilis* (80.1) |
| 16 | *Bacillus* (78.4) |
| 17 | *Bacillus* (95.2) |
| 18 | *Bacillus* (95.1) |
| 19 | *Bacillus* (93.5) |
| 20 | *Pseudomonas* (50.6) |
| 21 | *Erwinia* (17.9) |
| 22 | *Lysobacter_capsici* (85.2) *Erwinia* (18.0) |
| 23 | *Arthrobacter* (36.1) |
| 24 | *Arthrobacter_globiformis* (29.2) |
| 25 | *Pseudomonas* (63.8) *Lysobacter* (22.5) |
| 26 | *Pseudomonas* (63.8) *Lysobacter* (22.5) |
| 27 | *Pseudomonas* (59.2) |
| 28 | *Pseudomonas* (59.2) |
| 29 | *Pseudomonas* (59.2) |
| 30 | *Chryseobacterium_daeyuense* (28.1) |
| 31 | *Chryseobacterium_daeyuense* (28.1) |
| 32 | *Pseudomonas* (44.0) |
| 33 | *Pseudomonas* (44.0) |
| 34 | *Pseudomonas* (61.4) |
| 35 | *Pseudomonas* (60.9) |
| 36 | *Pseudomonas* (60.9) |
| 37 | *Pseudomonas* (58.9) *Bacillus* (77.2) |
| 38 | *Bacillus* (74.0) |
| 39 | *Arthrobacter* (19.8) |
| 40 | *Pantoea_agglomerans* (35.7) |
| 41 | *Curtobaderium_UNCCL17*(82.3) | *Pantoea_agglomerans* |

TABLE 14-continued

Bacterial isolates having antifungal activity

| Isolate No. | Taxa Isolate (Percentage of similarity) |
|---|---|
| | (91.6) |
| 42 | *Pantoea* (83.6) |
| 43 | *Pantoea* (83.6) |
| 44 | *Pseudomonas alcaligenes* (38.6) |
| 45 | *Pseudomonas* (50.2) |
| 46 | *Pseudomonas* (41.2) |
| 47 | *Pseudomonas* (85.4) |
| 48 | *Leifsonia* (11.9) | *Clavibacter michiganensis* (9.3) |
| 49 | *Microbacterium* (19.8) |
| 50 | *Microbacterium* (19.8) |
| 51 | *Pseudomonas* (60.1) |
| 52 | *Bacillus* (94.5) |
| 53 | *Pseudomonas* s (50.1) |
| 54 | *Pseudomonas* (40.5) |
| 55 | *Pseudomonas* (40.5) |
| 56 | *Pseudomonas* (59.1) |
| 57 | *Pseudomonas* s (59.1) |
| 58 | *Bacillus* (92.4) |
| 59 | *Pseudomonas* (44.0) |
| 60 | *Bacillus* (92.4) |
| 61 | *Pseudomonas* (44.0) |
| 62 | *Pseudomonas* (56.0) |
| 63 | *Bacillus* (95.0) |
| 64 | *Bacillus* (74.0) |
| 65 | *Pseudomonas* (41.1) |
| 66 | *Pseudomonas* (41.1) |
| 67 | *Pseudomonas* (41.1) |
| 68 | *Pseudomonas* (60.1) |
| 69 | *Pseudomonas* (60.1) |
| 70 | *Pseudomonas* (60.1) |
| 71 | *Pantoea* (100); |
| 72 | *Bacillus* (100); |
| 73 | *Arthrobacter* (100); unclassified; |
| 74 | *Paenibacillus* (100); unclassified; |
| 75 | *Paenibacillus* (100); unclassified; |
| 76 | *Pseudomonas* (100); *Pseudomonas frederiksbergensis* (98) |
| 77 | *Erwinia* (91); unclassified; |
| 78 | *Bacillus* (100) |
| 79 | *Pseudomonas chloraphis* |
| 80 | Alcaligenaceae (100); unclassified |
| 81 | *Bacillus_axarquiensis* |
| 82 | *Pseudomonas* spp. |
| 83 | *Pantoea agglomerans* |
| 84 | *Chryseobacterium_ginsenosidimutans* |
| 85 | *Bacillus_altitudinis* |

Example 11: Identifying Fungicidal Genes Eligible for Disease Control

The present inventors have identified 199 polynucleotides of bacterial origin that encode for proteins with potential antifungal activity. The antifungal activity of successfully purified soluble proteins was tested in an in vitro spore assay against *Fusarium verticilloides*. The antifungal activity is further examined by expressing the bacterial genes in planta, and evaluating fungal resistance conferred by the exogenous polynucleotides.

The polynucleotides and polypeptides of some embodiments of the invention having the antifungal activity originate from bacterial isolate proprietary genomes as listed in Table 14 and public bacterial genomes that were incorporated into a unified database, also containing gene expression data produced ad hoc, as well as gene phylogeny, protein annotation, enzymatic function and pathway.

Genomic and Transcriptomic Profiling of Bacterial Isolates for Gene Discovery

Genomic Profiling

Genome assembly—genomes of all isolates were assembled using a proprietary pipeline.

Gene prediction—gene prediction was performed using Prokaryotic Dynamic Programming Genefinding Algorithm [Prodigal—BMC Bioinformatics. 2010 Mar. 8; 11(1):119].

Gene annotation—Predicted genes and proteins were annotated using BLAST™ search [blast.ncbi.nlm.nih.gov/Blast.cgi] against NCBI nr (non-redundant protein sequence database) and by further analysis by InterPro [ebi.ac.uk/interpro/].

Transcriptome Profiling

Eleven (11) bacterial strains (Serial Number 71, 72, 73, 74, 75, 77, 78, 79, 80, 83 of Table 14) were striped on a R2A medium in Petri dishes on the two opposite sides of a *Fusarium verticillioides* strip culture. Bacterial samples were collected after 3 days of co-culture after a clear inhibition zone was defined and the collected bacteria were used for transcriptomics analysis. Total RNA was extracted and submitted to Omega Bioservices contract lab for RNA sequencing. Transcriptomics data were evaluated for identification of highly expressed potential antifungal genes.

Differential Expression Data Analysis

RNA-seq uses next-generation sequencing (NGS) methods to sequence cDNA that has been derived from an RNA sample, and hence produces millions of short reads. These reads were then mapped onto a reference genome and the number of reads mapping within a genomic feature of interest (such as a gene) was used as a measure of the abundance of the feature in the analyzed sample, resulting in gene expression profile. According to the gene expression profile, a differential analysis was performed to identify genes with higher expression during fungal co-culture compared to pure bacteria cultures that are further associated with antifungal phenotypes.

Identification of Antifungal Genes from Bacterial Isolates

The 199 genes listed in Table 15 below were identified as potential antifungal and may confer fungal-resistance traits in planta. The Table shows the identified genes, their curated polynucleotide and polypeptide sequences.

TABLE 15

| Identified antifungal genes from bacterial isolates | | | | |
|---|---|---|---|---|
| Gene Name | Gene Description | Isolate Name | Polyn. SEQ ID NO | Polyp. SEQ ID NO |
| BLFS1 | antifungal protein | *Streptomyces clavuligerus* ATCC 27064 | 592 | 2444 |
| BLFS2 | Hypothetical protein | 15627EM_META_Alkanindiges1\| | 593 | 2445 |
| BLFS3 | Hypothetical protein | 15627EM_META_*Enterococcus*10\|16v1\|scaffold580442 G95 | 594 | 2446 |
| BLFS4 | Hypothetical protein | 15627EM_META_*Klebsiella*4 | 595 | 2447 |
| BLFS5 | Hypothetical protein | *Actinosporangium*_NRRL_B_3428 | 596 | 2448 |

TABLE 15-continued Identified antifungal genes from bacterial isolates

| Gene Name | Gene Description | Isolate Name | Polyn. SEQ ID NO | Polyp. SEQ ID NO |
|---|---|---|---|---|
| BLFS6 | Hypothetical protein | *Actinosynnema mirum* | 597 | 2449 |
| BLFS7 | peptidase C11 clostripain | *Ammonifex_degensii*_KC4 | 598 | 2450 |
| BLFS8 | Hypothetical protein | *Amycolatopsis azurea* | 599 | 2451 |
| BLFS9 | oxidoreductase | *Amycolatopsis azurea* | 600 | 2452 |
| BLFS10 | oxidoreductase | *Amycolatopsis azurea* DSM 43854 | 601 | 2453 |
| BLFS11 | Hypothetical protein | *Arthrobacter* spp. | 602 | 2454 |
| BLFS12 | Hypothetical protein | *Arthrobacter* spp. | 603 | 2455 |
| BLFS13 | Hypothetical protein | *Arthrobacter* spp. | 604 | 2456 |
| BLFS14 | alpha integrin | *Arthrobacter* spp. | 605 | 2457 |
| BLFS15 | alpha integrin | *Arthrobacter*_161MFSha2_1 | 606 | 2458 |
| BLFS16 | lysozyme | *Arthrobacter*_161MFSha2_1 | 607 | 2459 |
| BLFS17 | D-alanyl-D-alanine carboxypeptidase | *Arthrobacter*_161MFSha2_1 | 608 | 2460 |
| BLFS18 | Hypothetical protein | *Bacillus* spp. | 609 | 2461 |
| BLFS19 | peptidase p60 | *Bacillus* spp. | 610 | 2462 |
| BLFS20 | Cell division suppressor protein | *Bacillus* spp. | 611 | 2463 |
| BLFS21 | spoivb peptidase | *Bacillus* spp. | 612 | 2464 |
| BLFS22 | Hypothetical protein | *Bacillus* spp. | 613 | 2465 |
| BLFS23 | glycosyl hydrolase family 18 | *Bacillus* spp. | 614 | 2466 |
| BLFS24 | Hypothetical protein | *Bacillus* spp. | 615 | 2467 |
| BLFS25 | chitooligosaccharide deacetylase | *Bacillus* spp. | 616 | 2468 |
| BLFS26 | Hypothetical protein | *Bacillus* spp. | 617 | 2469 |
| BLFS27 | large protein of pyocin ap41 | *Bacillus* spp. | 618 | 2470 |
| BLFS29 | Hypothetical protein | *Bacillus_marmarensis*_DSM_21297 | 619 | 2471 |
| BLFS30 | epsilon-toxin type b | *Bacillus_thuringiensis*_serovar_indiana | 620 | 2472 |
| BLFS31 | Hypothetical protein | *Bacillus velezensis* | 621 | 2473 |
| BLFS32 | Protease HtpX [htpX]. | *Bacillus velezensis* | 622 | 2474 |
| BLFS33 | zinc metalloprotease | *Bacillus velezensis* | 623 | 2475 |
| BLFS34 | Cell division suppressor protein | *Bacillus velezensis* | 624 | 2476 |
| BLFS35 | Hypothetical protein | *Bradyrhizobium japonicum* | 625 | 2477 |
| BLFS36 | Hypothetical protein | *Bradyrhizobium yuanmingense* | 626 | 2478 |
| BLFS37 | beta/gamma crystallin family protein | *Brevibacillus laterosporus* | 627 | 2479 |
| BLFS38 | jacalin-like lectin domain protein | *Brevibacillus laterosporus* | 628 | 2480 |
| BLFS39 | toxin ETX | *Brevibacillus laterosporus* | 629 | 2481 |
| BLFS41 | chitobiase | *Burkholderia gladioli* | 630 | 2482 |
| BLFS42 | chitin-binding protein | *Burkholderia gladioli* | 631 | 2483 |
| BLFS43 | carboxypeptidase regulatory-like domain protein | *Burkholderia gladioli* | 632 | 2484 |
| BLFS44 | ricin-type beta-trefoil lectin domain protein | *Burkholderia gladioli* | 633 | 2485 |
| BLFS45 | peptidase | *Burkholderia gladioli* | 634 | 2486 |
| BLFS46 | lysm domain protein | *Burkholderia gladioli* | 635 | 2487 |
| BLFS47 | Hypothetical protein | *Cellulosimicrobium* spp. | 636 | 2488 |
| BLFS48 | peptidase m48 | *Collimonas arenae* | 637 | 2489 |
| BLFS49 | Hypothetical protein | *Collimonas arenae* | 638 | 2490 |
| BLFS50 | chitin-binding protein | *Collimonas_arenae* | 639 | 2491 |
| BLFS51 | endoglucanase | *Collimonas_arenae* | 640 | 2492 |
| BLFS52 | Ricin B lectin | *Dactylosporangium aurantiacum* | 641 | 2493 |
| BLFS53 | Etx/MtX1 toxin | *Dickeya_dadantii* | 642 | 2494 |
| BLFS55 | beta/gamma crystallin family protein | *Duganella*_HH101 | 643 | 2495 |
| BLFS56 | aminopeptidase | *Duganella*_HH101 | 644 | 2496 |
| BLFS57 | glycoside hydrolase family 12 | *Duganella*_HH101 | 645 | 2497 |
| BLFS58 | 17 kda surface antigen | *Duganella*_HH101 | 646 | 2498 |
| BLFS59 | Hypothetical protein | *Duganella_violaceinigra* | 647 | 2499 |
| BLFS60 | Hypothetical protein | *Erwinia* spp. | 648 | 2500 |
| BLFS61 | type i secretion target | *Erwinia* spp. | 649 | 2501 |
| BLFS62 | murein hydrolase activator nlpd | *Erwinia* spp. | 650 | 2502 |
| BLFS63 | n-acetylmuramoyl-1-alanine amidase amib | *Erwinia* spp. | 651 | 2503 |

TABLE 15-continued

Identified antifungal genes from bacterial isolates

| Gene Name | Gene Description | Isolate Name | Polyn. SEQ ID NO | Polyp. SEQ ID NO |
|---|---|---|---|---|
| BLFS64 | NLP/P60 protein | *Geobacillus* Y4_1MC1 | 652 | 2504 |
| BLFS65 | extracellular repeat containing protein HAF family | *Janthinobacterium*_HH010 | 653 | 2505 |
| BLFS67 | Beta/gamma crystallin | *Janthinobacterium*_HH103 | 654 | 2506 |
| BLFS68 | putative exported protein | *Janthinobacterium* MP5059B | 655 | 2507 |
| BLFS69 | heme adhesion protein | *Janthinobacterium*_Marseille | 656 | 2508 |
| BLFS70 | Hypothetical protein | *Janthinobacterium*_agaricidamnosum | 657 | 2509 |
| BLFS72 | Carboxypeptidase | *Lysobacter* spp. | 658 | 2510 |
| BLFS73 | Hypothetical protein | *Paenibacillus* spp. | 659 | 2511 |
| BLFS74 | m1-852 | *Paenibacillus* spp. | 660 | 2512 |
| BLFS75 | Serine hydrolase | *Paenibacillus* spp. | 661 | 2513 |
| BLFS76 | Hypothetical protein | *Paenibacillus* spp. | 662 | 2514 |
| BLFS77 | glycoside hydrolase family 5 | *Paenibacillus* spp. | 663 | 2515 |
| BLFS79 | Hypothetical protein | *Paenibacillus* spp. | 664 | 2516 |
| BLFS80 | Hypothetical protein | *Paenibacillus* spp. | 665 | 2517 |
| BLFS82 | sspe | *Paenibacillus* spp. | 666 | 2518 |
| BLFS83 | exoglucanase a | *Paenibacillus* spp. | 667 | 2519 |
| BLFS84 | alpha/beta hydrolase | *Paenibacillus* spp. | 668 | 2520 |
| BLFS85 | alpha-amylase | *Paenibacillus* spp. | 669 | 2521 |
| BLFS86 | hypothetical protein | *Paenibacillus* spp. | 670 | 2522 |
| BLFS87 | endoglucanase b | *Paenibacillus* spp. | 671 | 2523 |
| BLFS88 | Hypothetical protein | *Paenibacillus* spp. | 672 | 2524 |
| BLFS89 | endoglucanase | *Paenibacillus* spp. | 673 | 2525 |
| BLFS90 | wgr domain-containing protein | *Paenibacillus* spp. | 674 | 2526 |
| BLFS91 | Hypothetical protein | *Paenibacillus* spp. | 675 | 2527 |
| BLFS92 | spoivb peptidase | *Paenibacillus* spp. | 676 | 2528 |
| BLFS93 | arabinogalactan endo-1,4-beta-galactosidase | *Paenibacillus* spp. | 677 | 2529 |
| BLFS94 | rhamnogalacturonan endolyase | *Paenibacillus* spp. | 678 | 2530 |
| BLFS95 | Hypothetical protein | *Paenibacillus* spp. | 679 | 2531 |
| BLFS96 | Hypothetical protein | *Paenibacillus curdlanolyticus* | 680 | 2532 |
| BLFS97 | Hypothetical protein | *Paenibacillus mucilaginosus* | 681 | 2533 |
| BLFS98 | Hypothetical protein | *Pantoea* spp. | 682 | 2534 |
| BLFS99 | uncharacterized protein yhcn | *Pantoea* spp. | 683 | 2535 |
| BLFS100 | uncharacterized protein yhcn | *Pantoea* spp. | 684 | 2536 |
| BLFS101 | metalloprotease loiP | *Pantoea* spp. | 685 | 2537 |
| BLFS102 | Hypothetical protein | *Pantoea* spp. | 686 | 2538 |
| BLFS103 | toxin tccc3 | *Pantoea* spp. | 687 | 2539 |
| BLFS104 | Hypothetical protein | *Pantoea* spp. | 688 | 2540 |
| BLFS105 | protein of unknown function (DUF1311) | *Pantoea* spp. | 689 | 2541 |
| BLFS106 | uncharacterized protein yqjd | *Pantoea* spp. | 690 | 2542 |
| BLFS107 | polyketide synthase | *Pantoea* spp. | 691 | 2543 |
| BLFS108 | toxin relE | *Pantoea* spp. | 692 | 2544 |
| BLFS109 | hemolysin | *Pantoea* spp. | 693 | 2545 |
| BLFS110 | hypothetical protein | *Pedobacter* V48 | 694 | 2546 |
| BLFS111 | hypothetical protein | *Pseudogulbenkiania_ferrooxidans* EGD HP2 | 695 | 2547 |
| BLFS112 | Hypothetical protein | *Pseudomonas* spp. | 696 | 2548 |
| BLFS113 | transpeptidase | *Pseudomonas* spp | 697 | 2549 |
| BLFS114 | ATP-dependent zinc protease | *Pseudomonas* spp | 698 | 2550 |
| BLFS115 | probable periplasmic serine endoprotease DegP-like | *Pseudomonas* spp | 699 | 2551 |
| BLFS116 | lysophospholipase | *Pseudomonas* spp | 700 | 2552 |
| BLFS118 | peptidoglycan-binding protein | *Pseudomonas* spp | 701 | 2553 |
| BLFS119 | Hypothetical protein | *Pseudomonas* spp | 702 | 2554 |
| BLFS120 | supernuclease toxin 2 family protein | *Pseudomonas* spp. | 703 | 2555 |
| BLFS121 | glutamate carboxypeptidase | *Pseudomonas* spp | 704 | 2556 |

TABLE 15-continued

Identified antifungal genes from bacterial isolates

| Gene Name | Gene Description | Isolate Name | Polyn. SEQ ID NO | Polyp. SEQ ID NO |
|---|---|---|---|---|
| BLFS122 | hpr | *Pseudomonas* spp | 705 | 2557 |
| BLFS123 | peptidase c1 | *Pseudomonas* spp | 706 | 2558 |
| BLFS124 | tigr02448 family protein | *Pseudomonas* spp | 707 | 2559 |
| BLFS125 | peptidase | *Pseudomonas* spp | 708 | 2560 |
| BLFS126 | Hypothetical protein | *Pseudomonas* spp | 709 | 2561 |
| BLFS127 | Hypothetical protein | *Pseudomonas* spp | 710 | 2562 |
| BLFS128 | peptidoglycan hydrolase flgj | *Pseudomonas* spp | 711 | 2563 |
| BLFS129 | alginate lyase | *Pseudomonas* spp | 712 | 2564 |
| BLFS130 | leucine-rich repeat-containing protein | *Pseudomonas* spp.. | 713 | 2565 |
| BLFS131 | uncharacterized protein ycfj | *Pseudomonas chlororaphis* | 714 | 2566 |
| BLFS132 | Hypothetical protein | *Pseudomonas chlororaphis* | 715 | 2567 |
| BLFS133 | Hypothetical protein | *Pseudomonas chlororaphis* | 716 | 2568 |
| BLFS134 | Protein of unknown function DUF2782 | *Pseudomonas chlororaphis* | 717 | 2569 |
| BLFS135 | multidrug transporter | *Pseudomonas chlororaphis* | 718 | 2570 |
| BLFS136 | Hypothetical protein | *Pseudoxanthomonas* J31 | 719 | 2571 |
| BLFS137 | membrane protein | *Rhodococcus* KB6 | 720 | 2572 |
| BLFS138 | uncharacterized peptidase | *Salinibacillus* spp. | 721 | 2573 |
| BLFS139 | peptidoglycan endopeptidase | *Salinibacillus* spp. | 722 | 2574 |
| BLFS140 | uncharacterized lipoprotein ybbd | *Salinibacillus* spp. | 723 | 2575 |
| BLFS141 | mannan endo-1,4-beta-mannosidase | *Salinibacillus* spp. | 724 | 2576 |
| BLFS142 | uncharacterized protein ykvt | *Salinibacillus* spp. | 725 | 2577 |
| BLFS143 | putative signal peptide peptidase sppa | *Salinibacillus* spp. | 726 | 2578 |
| BLFS144 | thermolysin | *Salinibacillus* spp. | 727 | 2579 |
| BLFS145 | d-alanyl-d-alanine carboxypeptidase dacb | *Salinibacillus* spp. | 728 | 2580 |
| BLFS146 | l-ala--d-glu endopeptidase | *Salinibacillus* spp. | 729 | 2581 |
| BLFS147 | beta-n-acetylglucosaminidase | *Salinibacillus* spp. | 730 | 2582 |
| BLFS148 | metalloprotease loip | *Serratia_fonticola_AU_P3* | 731 | 2583 |
| BLFS149 | chitobiase | *Serratia_fonticola_LMG_7882* | 732 | 2584 |
| BLFS150 | lytic enzyme | *Stenotrophomonas_maltophilia_ATCC_19867* | 733 | 2585 |
| BLFS151 | peptidase S33 family protein | *Stenotrophomonas_maltophilia_S028* | 734 | 2586 |
| BLFS152 | lipase | *Streptomyces_NRRL_F_4335* | 735 | 2587 |
| BLFS153 | peptidase | *Streptomyces albus* | 736 | 2588 |
| BLFS154 | peptidase s1 | *Streptomyces_clavuligerus_ATCC_27064* | 737 | 2589 |
| BLFS155 | mannose-binding protein | *Streptomyces griseorubens* | 738 | 2590 |
| BLFS156 | hypothetical protein | *Streptomyces_mobaraensis_NBRC_13819* | 739 | 2591 |
| BLFS157 | hypothetical protein | *Thalassobacter_arenae_DSM_19593* | 740 | 2592 |
| BLFS158 | bicupin, oxalate decarboxylase family | *Virgibacillus_Vm_5* | 741 | 2593 |
| BLFS159 | large Ala/Gln-rich protein | *Xanthomonas_hortorum_pv_carotae_M081* | 742 | 2594 |
| PUB6 | Hypothetical protein | *Bacillus_weihenstephanensis* | 743 | 2595 |
| PUB23 | Hypothetical protein | *Bacillus cereus* | 744 | 2596 |
| PUB31 | Hypothetical protein | *Bacillus_thuringiensis_serovar_andalousiensis* | 745 | 2597 |
| PUB65 | putative extracellular carbohydrate-recognition protein | *Variovorax_paradoxus* B4 | 746 | 2598 |
| ZLFS1 | Arthropod defensin | *Actinomyces_oral_taxon_171* | 747 | 2599 |
| ZLFS2 | peptidase m14 | *Arthrobacter* spp. | 748 | 2600 |
| ZLFS3 | probable peptidoglycan endopeptidase lyte | *Bacillus_amyloliquefaciens_plantarum* | 749 | 2601 |
| ZLFS5 | Hypothetical protein | *Burkholderia_A1* | 750 | 2602 |
| ZLFS6 | type vi secretion protein | *Collimonas_fungivorans_Ter331* | 751 | 2603 |
| ZLFS7 | glycosyl hydrolase | *Collimonas_fungivorans_Ter331* | 752 | 2604 |
| ZLFS8 | chitin-binding protein | *Collimonas_fungivorans_Ter331* | 753 | 2605 |
| ZLFS9 | polyketide synthase-like protein | *Collimonas_fungivorans_Ter331* | 754 | 2606 |

TABLE 15-continued

Identified antifungal genes from bacterial isolates

| Gene Name | Gene Description | Isolate Name | Polyn. SEQ ID NO | Polyp. SEQ ID NO |
| --- | --- | --- | --- | --- |
| ZLFS10 | Hypothetical protein | Collimonas_fungivorans_Ter331 | 755 | 2607 |
| ZLFS11 | patatin | Collimonas_fungivorans_Ter331 | 756 | 2608 |
| ZLFS12 | pseudomonalisin | Collimonas_fungivorans_Ter331 | 757 | 2609 |
| ZLFS13 | Hypothetical protein | Collimonas_fungivorans_Ter331 | 758 | 2610 |
| ZLFS14 | Hypothetical protein | Collimonas_fungivorans_Ter331 | 759 | 2611 |
| ZLFS15 | Beta-barrel assembly-enhancing protease [bepA]. | Collimonas_fungivorans_Ter331 | 760 | 2612 |
| ZLFS16 | d-alanyl-d-alanine carboxypeptidase dacd | Collimonas_fungivorans_Ter331 | 761 | 2613 |
| ZLFS17 | Antimicrobial protein MiAMP1 | Herbidospora cretacea | 762 | 2614 |
| ZLFS18 | peptidoglycan-binding protein | Lysobacter enzymogenes | 763 | 2615 |
| ZLFS19 | lipoprotein nlpd/lppb homolog | Lysobacter gummosus | 764 | 2616 |
| ZLFS21 | chitosanase | Paenibacillus spp. | 765 | 2617 |
| ZLFS22 | Hypothetical protein | Paenibacillus spp. | 766 | 2618 |
| ZLFS23 | beta-glucanase | Pantoea spp. | 767 | 2619 |
| ZLFS24 | lipase 1 | Pantoea spp. | 768 | 2620 |
| ZLFS25 | SGNH hydrolase-type esterase domain | Pantoea spp. | 769 | 2621 |
| ZLFS27 | lytic transglycosylase | Pseudomonas_In5 | 770 | 2622 |
| ZLFS28 | hydrolase | Pseudomonas_In5 | 771 | 2623 |
| ZLFS29 | Beta-barrel assembly-enhancing protease [bepA]. | Pseudomonas_In5 | 772 | 2624 |
| ZLFS30 | dipeptidase | Pseudomonas_In5 | 773 | 2625 |
| ZLFS31 | lipase 1 | Serratia_plymuthica_S13 | 774 | 2626 |
| ZLFS32 | endoglucanase | Serratia_plymuthica_S13 | 775 | 2627 |
| ZLFS33 | chitin-binding protein | Serratia_plymuthica_S13 | 776 | 2628 |
| ZLFS34 | peptidyl-dipeptidase dcp | Serratia_plymuthica_S13 | 777 | 2629 |
| ZLFS35 | Hypothetical protein | Serratia_plymuthica_S13 | 778 | 2630 |
| ZLFS36 | Calcium-mediated lectin | Serratia_plymuthica_S13 | 779 | 2631 |
| ZLFS37 | upf0339 protein yegp | Serratia_plymuthica_S13 | 780 | 2632 |
| ZLFS38 | bacterioferritin | Serratia_plymuthica_S13 | 781 | 2633 |
| ZLFS39 | Glycogen debranching enzyme [glgX]. | Serratia_plymuthica_S13 | 782 | 2634 |
| ZLFS42 | killer toxin like | Streptomyces_HPH0547 | 783 | 2635 |
| ZLFS44 | glycoside hydrolase | Streptomyces_M10 | 784 | 2636 |
| ZLFS45 | Oxidoreductase | Streptomyces_M10 | 785 | 2637 |
| ZLFS47 | Antimicrobial protein MiAMP1 | Streptomyces_scopuliridis_RB72 | 786 | 2638 |
| ZLFS48 | Antimicrobial protein MiAMP1 | Streptosporangium_amethystogenes | 787 | 2639 |
| ZLFS49 | Hypothetical protein | Curtobacterium spp. | 788 | 2640 |
| ZLFS51 | Glycosyl hydrolase | Bacillus_subtilis_subtilis_OH_131_1 | 789 | 2641 |

"polyn." = polynucleotide; "polyp." = polypeptide.

Example 12: Identification of Orthologous Sequences of Antifungal Proteins

Orthologues and paralogues constitute two major types of homologues: The first evolved from a common ancestor by specialization, and the latter are related by duplication events. It is assumed that paralogues arising from ancient duplication events are likely to have diverged in function while true orthologues are more likely to retain identical function over evolutionary time. Orthologues of the discovered antifungal genes are not only likely to be antifungal by themselves but also may hold improved potency or target different fungi spectra.

The search and identification of homologous genes involves the screening of sequence information available, for example, public databases such as the GenBank, and the European Molecular Biology Laboratory Nucleic Acid Sequence Database (EMBL).

Polynucleotides and polypeptides with significant homology to the identified genes described in Table 15 (Example 11) were identified from the databases using BLAST™ software with the Blastp and tBlastn algorithms as filters for the first stage, and the needle (EMBOSS package) or Frame+ algorithm alignment for the second stage. Local identity (BLAST™ alignments) was defined with a very permissive cutoff—40% Identity on a span of 40% of the sequences lengths because it is used only as a filter for the global alignment stage. The default filtering of the BLAST™ package was not utilized (by setting the parameter "-F F").

In the second stage, homologs were defined based on a global identity of at least 70% to the core gene polypeptide sequence. Two distinct forms for finding the optimal global alignment for protein or nucleotide sequences were used in this application:

1. Between two proteins (following the BLASTP filter): EMBOSS-6.0.1 Needleman-Wunsch algorithm with the following modified parameters: gapopen=8 gapextend=2. The rest of the parameters were unchanged from the default options described hereinabove.

2. Between a protein sequence and a nucleotide sequence (following the TBLASTN filter): GenCore 6.0 OneModel application utilizing the Frame+ algorithm with the following parameters: model=frame+_p2n.model mode=qglobal -q=protein. sequence -db=nucleotide. sequence. The rest of the parameters are unchanged from the default options described hereinabove.

Homology was calculated as % of identity over the aligned sequences. The query sequences were the polypeptide sequences depicted in Table 15 (Example 11). The subject sequences are protein sequences identified in the database based on greater than 80% global identity to the predicted translated sequences of the query nucleotide sequences or to the polypeptide sequences.

The identified orthologous and homologous sequences having at least 70% global sequence identity to the sequences are provided in Table 16, below.

TABLE 16

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 1187 | BLFS87 | *Paenibacilhis* sp. | 3024 | 2523 | 96.2 | globlastp |
| 1188 | BLFS87 | *Paenibacilhis* sp. | 3025 | 2523 | 95.5 | globlastp |
| 1189 | BLFS87 | *Paenibacilhis* sp. | 3026 | 2523 | 94.8 | globlastp |
| 1190 | BLFS87 | *Paenibacillus* sp. | 3027 | 2523 | 94.1 | globlastp |
| 1191 | BLFS87 | *Paenibacillus* sp. | 3028 | 2523 | 93.5 | globlastp |
| 1192 | BLFS87 | *Paenibacillus* sp. | 3029 | 2523 | 92 | globlastp |
| 1193 | BLFS87 | *Paenibacillus* sp. | 3030 | 2523 | 91.1 | globlastp |
| 1194 | BLFS87 | *Paenibacillus* sp. | 3031 | 2523 | 90.2 | globlastp |
| 1195 | BLFS87 | *Paenibacillus* sp. | 3032 | 2523 | 89.4 | globlastp |
| 1196 | BLFS87 | *Paenibacillus* sp. | 3033 | 2523 | 88.3 | globlastp |
| 1197 | BLFS87 | *Paenibacillus* sp. | 3034 | 2523 | 71 | globlastp |
| 2052 | ZLFS3 | *Bacillus* sp. | 3866 | 2601 | 98.5 | globlastp |
| 2053 | ZLFS3 | *Bacillus* sp. | 3867 | 2601 | 97.8 | globlastp |
| 2054 | ZLFS3 | *Bacillus* sp. | 3868 | 2601 | 97.4 | globlastp |
| 2055 | ZLFS3 | *Bacillus* sp. | 3869 | 2601 | 94.9 | globlastp |
| 2056 | ZLFS3 | *Bacillus* sp. | 3870 | 2601 | 94.6 | globlastp |
| 2057 | ZLFS3 | *Bacillus* sp. | 3871 | 2601 | 94.2 | globlastp |
| 2058 | ZLFS3 | *Bacillus* sp. | 3872 | 2601 | 93.8 | globlastp |
| 2059 | ZLFS3 | *Bacillus* sp. | 3873 | 2601 | 84.1 | globlastp |
| 2060 | ZLFS3 | *Bacillus* sp. | 3874 | 2601 | 83.8 | globlastp |
| 2061 | ZLFS3 | *Bacillus* sp. | 3875 | 2601 | 76.1 | globlastp |
| 2062 | ZLFS3 | *Bacillus* sp. | 3876 | 2601 | 75.7 | globlastp |
| 2063 | ZLFS3 | *Bacillus* sp. | 3877 | 2601 | 75.5 | globlastp |
| 2064 | ZLFS3 | *Bacillus* sp. | 3878 | 2601 | 75.4 | globlastp |
| 2065 | ZLFS3 | *Bacillus* sp. | 3879 | 2601 | 75.2 | globlastp |
| 2066 | ZLFS3 | *Bacillus* sp. | 3880 | 2601 | 74.9 | globlastp |
| 2067 | ZLFS3 | *Bacillus* sp. | 3881 | 2601 | 74.5 | globlastp |
| 2068 | ZLFS3 | *Bacillus* sp. | 3882 | 2601 | 74.1 | globlastp |
| 2069 | ZLFS3 | *Bacillus* sp. | 3883 | 2601 | 73 | globlastp |
| 949 | BLFS34 | *Bacillus* sp. | 2799 | 2476 | 99 | globlastp |
| 950 | BLFS34 | *Bacillus* sp. | 2800 | 2476 | 98.1 | globlastp |
| 951 | BLFS34 | *Bacillus* sp. | 2801 | 2476 | 95.1 | globlastp |
| 1013 | BLFS56 | *Janthinobacterium* sp. | 2859 | 2496 | 98.7 | globlastp |
| 1014 | BLFS56 | Oxalobacteraceae sp. | 2860 | 2496 | 93.2 | globlastp |
| 1015 | BLFS56 | *Janthinobacterium* sp. | 2861 | 2496 | 72.5 | globlastp |
| 1016 | BLFS56 | *Janthinobacterium* sp. | 2862 | 2496 | 72.2 | globlastp |
| 1017 | BLFS56 | *Janthinobacterium* sp. | 2863 | 2496 | 71.6 | globlastp |
| 1018 | BLFS56 | *Massilia* sp. | 2864 | 2496 | 71.4 | globlastp |
| 1019 | BLFS56 | *Massilia* sp. | — | 2496 | 71.02 | glotblastn |
| 1020 | BLFS56 | *Massilia* sp. | — | 2496 | 70.7 | glotblastn |
| 1021 | BLFS56 | *Duganella* sp. | — | 2496 | 70.04 | glotblastn |
| 1207 | BLFS89 | *Paenibacillus* sp. | 3044 | 2525 | 99.2 | globlastp |
| 1208 | BLFS89 | *Paenibacillus* sp. | 3045 | 2525 | 98.7 | globlastp |
| 1209 | BLFS89 | *Paenibacillus* sp. | 3046 | 2525 | 97 | globlastp |
| 1210 | BLFS89 | *Paenibacillus* sp. | 3047 | 2525 | 96.7 | globlastp |
| 1211 | BLFS89 | *Paenibacillus* sp. | 3048 | 2525 | 95 | globlastp |
| 1212 | BLFS89 | *Paenibacillus* sp. | 3049 | 2525 | 94.2 | globlastp |
| 1213 | BLFS89 | *Paenibacillus* sp. | 3050 | 2525 | 93.4 | globlastp |
| 1214 | BLFS89 | *Paenibacillus* sp. | 3051 | 2525 | 92.2 | globlastp |
| 1215 | BLFS89 | *Paenibacillus* sp. | 3052 | 2525 | 91.9 | globlastp |
| 1216 | BLFS89 | *Paenibacillus* sp. | — | 2525 | 71.86 | glotblastn |
| 1217 | BLFS89 | *Paenibacillus* sp. | — | 2525 | 70.07 | glotblastn |
| 884 | BLFS23 | *Bacillus* sp. | 2734 | 2466 | 96.4 | globlastp |
| 885 | BLFS23 | *Bacillus* sp. | 2735 | 2466 | 95.2 | globlastp |
| 886 | BLFS23 | *Bacillus* sp. | 2736 | 2466 | 94 | globlastp |
| 887 | BLFS23 | *Bacillus* sp. | 2737 | 2466 | 93.1 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 888 | BLFS23 | Bacillus sp. | 2738 | 2466 | 93 | globlastp |
| 889 | BLFS23 | Bacillus sp. | 2739 | 2466 | 92.4 | globlastp |
| 890 | BLFS23 | Bacillus sp. | 2740 | 2466 | 92 | globlastp |
| 891 | BLFS23 | Bacillus sp. | 2741 | 2466 | 91.8 | globlastp |
| 892 | BLFS23 | Bacillus sp. | 2742 | 2466 | 91.2 | globlastp |
| 1062 | BLFS64 | Geobacillus sp. | 2904 | 2504 | 98.8 | globlastp |
| 2194 | ZLFS28 | Pseudomonas sp. | 4008 | 2623 | 94.1 | globlastp |
| 2195 | ZLFS28 | Pseudomonas sp. | 4009 | 2623 | 93.8 | globlastp |
| 2196 | ZLFS28 | Pseudomonas sp. | 4010 | 2623 | 92.2 | globlastp |
| 2197 | ZLFS28 | Pseudomonas sp. | 4011 | 2623 | 91.4 | globlastp |
| 2198 | ZLFS28 | Pseudomonas sp. | 4012 | 2623 | 89.5 | globlastp |
| 2199 | ZLFS28 | Pseudomonas sp. | 4013 | 2623 | 88.3 | globlastp |
| 2200 | ZLFS28 | Pseudomonas sp. | 4014 | 2623 | 87.9 | globlastp |
| 2201 | ZLFS28 | Pseudomonas sp. | 4015 | 2623 | 87.5 | globlastp |
| 2202 | ZLFS28 | Pseudomonas sp. | 4016 | 2623 | 86.7 | globlastp |
| 2203 | ZLFS28 | Pseudomonas sp. | 4017 | 2623 | 86.3 | globlastp |
| 2204 | ZLFS28 | Pseudomonas sp. | 4018 | 2623 | 85.9 | globlastp |
| 2205 | ZLFS28 | Pseudomonas sp. | 4019 | 2623 | 85.5 | globlastp |
| 2206 | ZLFS28 | Pseudomonas sp. | 4020 | 2623 | 82.7 | globlastp |
| 2207 | ZLFS28 | Pseudomonas sp. | 4021 | 2623 | 80.1 | globlastp |
| 2208 | ZLFS28 | Collimonas sp. | 4022 | 2623 | 72.1 | globlastp |
| 908 | BLFS29 | Bacillus sp. | 2758 | 2471 | 75.3 | globlastp |
| 2104 | ZLFS19 | Environmental sample | 3918 | 2616 | 84.6 | globlastp |
| 2105 | ZLFS19 | Lysobacter sp. | 3919 | 2616 | 84.3 | globlastp |
| 2106 | ZLFS19 | Lysobacter sp. | 3920 | 2616 | 83.9 | globlastp |
| 2107 | ZLFS19 | Lysobacter sp. | 3921 | 2616 | 83.4 | globlastp |
| 2108 | ZLFS19 | Lysobacter sp. | 3922 | 2616 | 82.4 | globlastp |
| 2109 | ZLFS19 | Environmental sample | 3923 | 2616 | 81.9 | globlastp |
| 2110 | ZLFS19 | Environmental sample | 3924 | 2616 | 81.5 | globlastp |
| 2111 | ZLFS19 | Environmental sample | 3925 | 2616 | 80.6 | globlastp |
| 2112 | ZLFS19 | Lysobacter sp. | 3926 | 2616 | 79.7 | globlastp |
| 2113 | ZLFS19 | Lysobacter sp. | 3927 | 2616 | 76.9 | globlastp |
| 845 | BLFS18 | Bacillus sp. | 2697 | 2461 | 95.5 | globlastp |
| 846 | BLFS18 | Bacillus sp. | 2698 | 2461 | 84.6 | globlastp |
| 847 | BLFS18 | Bacillus sp. | 2699 | 2461 | 82.1 | globlastp |
| 848 | BLFS18 | Bacillus sp. | 2700 | 2461 | 81.9 | globlastp |
| 849 | BLFS18 | Bacillus sp. | 2701 | 2461 | 80.1 | globlastp |
| 850 | BLFS18 | Bacillus sp. | 2702 | 2461 | 78.1 | globlastp |
| 851 | BLFS18 | Bacillus sp. | 2703 | 2461 | 77 | globlastp |
| 852 | BLFS18 | Bacillus sp. | 2704 | 2461 | 76.3 | globlastp |
| 853 | BLFS18 | Bacillus sp. | 2705 | 2461 | 75 | globlastp |
| 854 | BLFS18 | Bacillus sp. | 2706 | 2461 | 74.2 | globlastp |
| 855 | BLFS18 | Bacillus sp. | 2707 | 2461 | 73 | globlastp |
| 856 | BLFS18 | Kurthia sp. | 2708 | 2461 | 72 | globlastp |
| 857 | BLFS18 | Bacillus sp. | 2709 | 2461 | 71 | globlastp |
| 858 | BLFS18 | Anoxybacillus sp. | 2710 | 2461 | 70.3 | globlastp |
| 1997 | BLFS155 | Streptomyces sp. | 3811 | 2590 | 88.1 | globlastp |
| 1998 | BLFS155 | Streptomyces sp. | 3812 | 2590 | 70.2 | globlastp |
| 592 | BLFS156 | Streptomyces sp. | — | 2591 | 71.07 | glotblastn |
| 1696 | BLFS130 | Pseudomonas sp. | 3520 | 2565 | 98.8 | globlastp |
| 1697 | BLFS130 | Pseudomonas sp. | 3521 | 2565 | 93.9 | globlastp |
| 1698 | BLFS130 | Pseudomonas sp. | 3522 | 2565 | 81.2 | globlastp |
| 1699 | BLFS130 | Pseudomonas sp. | 3523 | 2565 | 72.9 | globlastp |
| 1700 | BLFS130 | Pseudomonas sp. | 3524 | 2565 | 70 | globlastp |
| 2426 | ZLFS51 | Bacillus sp. | 4235 | 2641 | 99.1 | globlastp |
| 2427 | ZLFS51 | Bacillus sp. | 4236 | 2641 | 98.1 | globlastp |
| 2428 | ZLFS51 | Bacillus sp. | 4237 | 2641 | 97.2 | globlastp |
| 2429 | ZLFS51 | Bacillus sp. | 4238 | 2641 | 96 | globlastp |
| 2430 | ZLFS51 | Salinibacillus sp. | 4239 | 2641 | 95.3 | globlastp |
| 2431 | ZLFS51 | Bacillus sp. | 4240 | 2641 | 94.6 | globlastp |
| 2432 | ZLFS51 | Bacillus sp. | 4241 | 2641 | 93.9 | globlastp |
| 2433 | ZLFS51 | Bacillus sp. | 4242 | 2641 | 87.6 | globlastp |
| 2434 | ZLFS51 | Bacillus sp. | 4243 | 2641 | 86.2 | globlastp |
| 2435 | ZLFS51 | Bacillus sp. | 4244 | 2641 | 85.7 | globlastp |
| 2436 | ZLFS51 | Bacillus sp. | 4245 | 2641 | 78 | globlastp |
| 2437 | ZLFS51 | Bacillus sp. | 4246 | 2641 | 77.1 | globlastp |
| 2438 | ZLFS51 | Bacillus sp. | 4247 | 2641 | 76 | globlastp |
| 2439 | ZLFS51 | Bacillus sp. | 4248 | 2641 | 75.2 | globlastp |
| 2440 | ZLFS51 | Bacillus sp. | 4249 | 2641 | 74 | globlastp |
| 2441 | ZLFS51 | Bacillus sp. | 4250 | 2641 | 73.8 | globlastp |
| 2442 | ZLFS51 | Bacillus sp. | 4251 | 2641 | 71.1 | globlastp |
| 2443 | ZLFS51 | Bacillus sp. | 4252 | 2641 | 70 | globlastp |
| 2389 | ZLFS42 | Streptomyces sp. | 4202 | 2635 | 80.3 | globlastp |
| 2390 | ZLFS42 | Streptomyces sp. | 4203 | 2635 | 78.6 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 2391 | ZLFS42 | Streptomyces sp. | 4204 | 2635 | 78.6 | globlastp |
| 2392 | ZLFS42 | Streptomyces sp. | 4205 | 2635 | 77.8 | globlastp |
| 785 | ZLFS42 | Streptomyces sp. | 2637 | 2635 | 77.8 | globlastp |
| 2393 | ZLFS42 | Streptomyces sp. | 4206 | 2635 | 76.9 | globlastp |
| 2394 | ZLFS42 | Streptomyces sp. | 4207 | 2635 | 76.1 | globlastp |
| 2395 | ZLFS42 | Streptomyces sp. | 4207 | 2635 | 76.1 | globlastp |
| 2396 | ZLFS42 | Streptomyces sp. | 4208 | 2635 | 75.2 | globlastp |
| 2397 | ZLFS42 | Streptomyces sp. | 4209 | 2635 | 73.5 | globlastp |
| 2398 | ZLFS42 | Streptomyces sp. | 4210 | 2635 | 73.5 | globlastp |
| 808 | ZLFS42 | Streptomyces sp. | 2660 | 2635 | 70.1 | globlastp |
| 1792 | BLFS136 | Pseudoxanthomonas sp. | 3616 | 2571 | 81 | globlastp |
| 1163 | BLFS84 | Paenibacillus sp. | 3000 | 2520 | 98.3 | globlastp |
| 1164 | BLFS84 | Paenibacillus sp. | 3001 | 2520 | 95.9 | globlastp |
| 1165 | BLFS84 | Paenibacillus sp. | 3002 | 2520 | 95.1 | globlastp |
| 1166 | BLFS84 | Paenibacillus sp. | 3003 | 2520 | 92.4 | globlastp |
| 1167 | BLFS84 | Paenibacillus sp. | 3004 | 2520 | 89.5 | globlastp |
| 1168 | BLFS84 | Paenibacillus sp. | 3005 | 2520 | 88.1 | globlastp |
| 1169 | BLFS84 | Paenibacillus sp. | 3006 | 2520 | 87.5 | globlastp |
| 1129 | BLFS79 | Paenibacillus sp. | 2966 | 2516 | 99.2 | globlastp |
| 1130 | BLFS79 | Paenibacillus sp. | 2967 | 2516 | 98.5 | globlastp |
| 1131 | BLFS79 | Paenibacillus sp. | 2968 | 2516 | 97 | globlastp |
| 1132 | BLFS79 | Paenibacillus sp. | 2969 | 2516 | 96.6 | globlastp |
| 1133 | BLFS79 | Paenibacillus sp. | 2970 | 2516 | 95.1 | globlastp |
| 1134 | BLFS79 | Paenibacillus sp. | 2971 | 2516 | 94 | globlastp |
| 1135 | BLFS79 | Paenibacillus sp. | 2972 | 2516 | 93.6 | globlastp |
| 1136 | BLFS79 | Paenibacillus sp. | 2973 | 2516 | 93.2 | globlastp |
| 1137 | BLFS79 | Paenibacillus sp. | 2974 | 2516 | 92.5 | globlastp |
| 1138 | BLFS79 | Paenibacillus sp. | 2975 | 2516 | 91.7 | globlastp |
| 2235 | ZLFS30 | Pseudomonas sp. | 4049 | 2625 | 94.6 | globlastp |
| 2236 | ZLFS30 | Pseudomonas sp. | 4050 | 2625 | 90.5 | globlastp |
| 2237 | ZLFS30 | Pseudomonas sp. | 4051 | 2625 | 89.1 | globlastp |
| 2238 | ZLFS30 | Pseudomonas sp. | 4052 | 2625 | 88.3 | globlastp |
| 2239 | ZLFS30 | Pseudomonas sp. | 4053 | 2625 | 87.2 | globlastp |
| 2240 | ZLFS30 | Pseudomonas sp. | 4054 | 2625 | 86 | globlastp |
| 2241 | ZLFS30 | Pseudomonas sp. | 4055 | 2625 | 85 | globlastp |
| 2242 | ZLFS30 | Erwinia sp. | 4056 | 2625 | 84.1 | globlastp |
| 2243 | ZLFS30 | Pseudomonas sp. | 4057 | 2625 | 83.1 | globlastp |
| 2244 | ZLFS30 | Pseudomonas sp. | 4058 | 2625 | 82 | globlastp |
| 2245 | ZLFS30 | Pseudomonas sp. | 4059 | 2625 | 81 | globlastp |
| 2246 | ZLFS30 | Pseudomonas sp. | 4060 | 2625 | 80.1 | globlastp |
| 2247 | ZLFS30 | Pseudomonas sp. | 4061 | 2625 | 79.1 | globlastp |
| 2248 | ZLFS30 | Pseudomonas sp. | 4062 | 2625 | 78.1 | globlastp |
| 2249 | ZLFS30 | Pseudomonas sp. | 4063 | 2625 | 77.2 | globlastp |
| 2250 | ZLFS30 | Pseudomonas sp. | 4064 | 2625 | 76.7 | globlastp |
| 2251 | ZLFS30 | Pseudomonas sp. | 4065 | 2625 | 75.5 | globlastp |
| 2252 | ZLFS30 | Environmental sample | 4066 | 2625 | 72 | globlastp |
| 2253 | ZLFS30 | Pseudomonas sp. | 4067 | 2625 | 71 | globlastp |
| 2254 | ZLFS30 | Environmental sample | 4068 | 2625 | 70.1 | globlastp |
| 2033 | ZLFS2 | Arthrobacter sp. | 3847 | 2600 | 99.4 | globlastp |
| 2034 | ZLFS2 | Arthrobacter sp. | 3848 | 2600 | 96.3 | globlastp |
| 2035 | ZLFS2 | Arthrobacter sp. | 3849 | 2600 | 94.6 | globlastp |
| 2036 | ZLFS2 | Environmental sample | 3850 | 2600 | 92.7 | globlastp |
| 2037 | ZLFS2 | Environmental sample | 3851 | 2600 | 92.1 | globlastp |
| 2038 | ZLFS2 | Arthrobacter sp. | 3852 | 2600 | 90.1 | globlastp |
| 2039 | ZLFS2 | Arthrobacter sp. | 3853 | 2600 | 89.8 | globlastp |
| 2040 | ZLFS2 | Environmental sample | 3854 | 2600 | 89.3 | globlastp |
| 2041 | ZLFS2 | Arthrobacter sp. | 3855 | 2600 | 88.9 | globlastp |
| 2042 | ZLFS2 | Arthrobacter sp. | 3856 | 2600 | 87.3 | globlastp |
| 2043 | ZLFS2 | Arthrobacter sp. | 3857 | 2600 | 86.2 | globlastp |
| 2044 | ZLFS2 | Arthrobacter sp. | 3858 | 2600 | 73.7 | globlastp |
| 2045 | ZLFS2 | Arthrobacter sp. | 3859 | 2600 | 73.2 | globlastp |
| 2046 | ZLFS2 | Sporosarcina sp. | 3860 | 2600 | 72.6 | globlastp |
| 2047 | ZLFS2 | Bhargavaea sp. | 3861 | 2600 | 72.1 | globlastp |
| 2048 | ZLFS2 | Arthrobacter sp. | 3862 | 2600 | 71.5 | globlastp |
| 2049 | ZLFS2 | Arthrobacter sp. | 3863 | 2600 | 71.2 | globlastp |
| 2050 | ZLFS2 | Sporosarcina sp. | 3864 | 2600 | 70.6 | globlastp |
| 2051 | ZLFS2 | Planomicrobium sp. | 3865 | 2600 | 70.5 | globlastp |
| 1071 | BLFS72 | Lysobacter sp. | 2913 | 2510 | 95 | globlastp |
| 1124 | BLFS77 | Paenibacillus sp. | 2963 | 2515 | 98.1 | globlastp |
| 1125 | BLFS77 | Paenibacillus sp. | 2964 | 2515 | 96.6 | globlastp |
| 1126 | BLFS77 | Paenibacillus sp. | 2965 | 2515 | 81.1 | globlastp |
| 1127 | BLFS77 | Paenibacillus sp. | — | 2515 | 73.95 | glotblastn |
| 1128 | BLFS77 | Paenibacillus sp. | — | 2515 | 73.24 | glotblastn |
| 1599 | BLFS122 | Pseudomonas sp. | 3424 | 2557 | 97.7 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 1600 | BLFS122 | Pseudomonas sp. | 3425 | 2557 | 96.9 | globlastp |
| 1601 | BLFS122 | Pseudomonas sp. | 3426 | 2557 | 96.2 | globlastp |
| 1602 | BLFS122 | Pseudomonas sp. | 3427 | 2557 | 93.1 | globlastp |
| 1603 | BLFS122 | Pseudomonas sp. | 3428 | 2557 | 79.4 | globlastp |
| 1604 | BLFS122 | Pseudomonas sp. | — | 2557 | 72.18 | glotblastn |
| 1605 | BLFS122 | Pseudomonas sp. | 3429 | 2557 | 71.1 | globlastp |
| 1606 | BLFS122 | Pseudomonas sp. | 3430 | 2557 | 70.9 | globlastp |
| 970 | BLFS38 | Brevibacillus sp. | 2818 | 2480 | 81.2 | globlastp |
| 1139 | BLFS82 | Paenibacillus sp. | 2976 | 2518 | 99 | globlastp |
| 1140 | BLFS82 | Paenibacillus sp. | 2977 | 2518 | 98 | globlastp |
| 1141 | BLFS82 | Paenibacillus sp. | 2978 | 2518 | 97.1 | globlastp |
| 1142 | BLFS82 | Paenibacillus sp. | 2979 | 2518 | 96.1 | globlastp |
| 1143 | BLFS82 | Paenibacillus sp. | 2980 | 2518 | 94.1 | globlastp |
| 1144 | BLFS82 | Paenibacillus sp. | 2981 | 2518 | 93.1 | globlastp |
| 1145 | BLFS82 | Paenibacillus sp. | 2982 | 2518 | 92.2 | globlastp |
| 1146 | BLFS82 | Paenibacillus sp. | 2983 | 2518 | 89.4 | globlastp |
| 1147 | BLFS82 | Paenibacillus sp. | 2984 | 2518 | 88.2 | globlastp |
| 1148 | BLFS82 | Paenibacillus sp. | 2985 | 2518 | 86.3 | globlastp |
| 1149 | BLFS82 | Paenibacillus sp. | 2986 | 2518 | 85.3 | globlastp |
| 1150 | BLFS82 | Paenibacillus sp. | 2987 | 2518 | 84.3 | globlastp |
| 1151 | BLFS82 | Paenibacillus sp. | 2988 | 2518 | 82.4 | globlastp |
| 2075 | ZLFS6 | Collimonas sp. | 3889 | 2603 | 95.7 | globlastp |
| 2076 | ZLFS6 | Herbaspirillum sp. | 3890 | 2603 | 72 | globlastp |
| 2077 | ZLFS6 | Janthinobacterium sp. | 3891 | 2603 | 71.3 | globlastp |
| 2078 | ZLFS6 | Janthinobacterium sp. | 3892 | 2603 | 70.7 | globlastp |
| 2079 | ZLFS6 | Oxalobacteraceae sp. | 3893 | 2603 | 70.6 | globlastp |
| 812 | BLFS11 | Arthrobacter sp. | 2664 | 2454 | 96.3 | globlastp |
| 813 | BLFS11 | Arthrobacter sp. | 2665 | 2454 | 80.4 | globlastp |
| 814 | BLFS11 | Arthrobacter sp. | 2666 | 2454 | 79.9 | globlastp |
| 815 | BLFS11 | Environmental sample | 2667 | 2454 | 75.7 | globlastp |
| 816 | BLFS11 | Arthrobacter sp. | 2668 | 2454 | 73 | globlastp |
| 817 | BLFS11 | Arthrobacter sp. | 2669 | 2454 | 71.2 | globlastp |
| 818 | BLFS11 | Arthrobacter sp. | 2670 | 2454 | 70.1 | globlastp |
| 2114 | ZLFS21 | Paenibacillus sp. | 3928 | 2617 | 99.1 | globlastp |
| 2115 | ZLFS21 | Paenibacillus sp. | 3929 | 2617 | 96.7 | globlastp |
| 2116 | ZLFS21 | Paenibacillus sp. | 3930 | 2617 | 96.4 | globlastp |
| 2117 | ZLFS21 | Paenibacillus sp. | 3931 | 2617 | 94.5 | globlastp |
| 2118 | ZLFS21 | Paenibacillus sp. | 3932 | 2617 | 94.2 | globlastp |
| 2119 | ZLFS21 | Paenibacillus sp. | 3933 | 2617 | 91.3 | globlastp |
| 2120 | ZLFS21 | Paenibacillus sp. | 3934 | 2617 | 85 | globlastp |
| 2121 | ZLFS21 | Paenibacillus sp. | 3935 | 2617 | 84.5 | globlastp |
| 2122 | ZLFS21 | Paenibacillus sp. | 3936 | 2617 | 84.3 | globlastp |
| 2123 | ZLFS21 | Paenibacillus sp. | 3937 | 2617 | 82.6 | globlastp |
| 2124 | ZLFS21 | Paenibacillus sp. | 3938 | 2617 | 81.9 | globlastp |
| 2125 | ZLFS21 | Paenibacillus sp. | 3939 | 2617 | 81.6 | globlastp |
| 2126 | ZLFS21 | Paenibacillus sp. | 3940 | 2617 | 72.3 | globlastp |
| 839 | BLFS17 | Multievos46 sp. | 2691 | 2460 | 96 | globlastp |
| 840 | BLFS17 | Environmental sample | 2692 | 2460 | 86.4 | globlastp |
| 841 | BLFS17 | Arthrobacter sp. | 2693 | 2460 | 80 | globlastp |
| 842 | BLFS17 | Arthrobacter sp. | 2694 | 2460 | 79 | globlastp |
| 843 | BLFS17 | Arthrobacter sp. | 2695 | 2460 | 78.6 | globlastp |
| 844 | BLFS17 | Arthrobacter sp. | 2696 | 2460 | 77.5 | globlastp |
| 1450 | BLFS113 | Pseudomonas sp. | 3276 | 2549 | 99.4 | globlastp |
| 1451 | BLFS113 | Pseudomonas sp. | 3277 | 2549 | 98.8 | globlastp |
| 1452 | BLFS113 | Pseudomonas sp. | 3278 | 2549 | 97.6 | globlastp |
| 1453 | BLFS113 | Pseudomonas sp. | 3279 | 2549 | 97 | globlastp |
| 1454 | BLFS113 | Pseudomonas sp. | 3280 | 2549 | 96.4 | globlastp |
| 1455 | BLFS113 | Pseudomonas sp. | 3281 | 2549 | 94.6 | globlastp |
| 1456 | BLFS113 | Pseudomonas sp. | 3282 | 2549 | 92.2 | globlastp |
| 1457 | BLFS113 | Pseudomonas sp. | 3283 | 2549 | 91 | globlastp |
| 1458 | BLFS113 | Pseudomonas sp. | 3284 | 2549 | 90.4 | globlastp |
| 1459 | BLFS113 | Pseudomonas sp. | 3285 | 2549 | 89.2 | globlastp |
| 1460 | BLFS113 | Pseudomonas sp. | 3286 | 2549 | 88 | globlastp |
| 1461 | BLFS113 | Erwinia sp. | 3287 | 2549 | 87.4 | globlastp |
| 1462 | BLFS113 | Pseudomonas sp. | 3288 | 2549 | 86.2 | globlastp |
| 1463 | BLFS113 | Pseudomonas sp. | 3289 | 2549 | 85 | globlastp |
| 1464 | BLFS113 | Pseudomonas sp. | 3290 | 2549 | 84.2 | globlastp |
| 1465 | BLFS113 | Pseudomonas sp. | 3291 | 2549 | 83 | globlastp |
| 1466 | BLFS113 | Pseudomonas sp. | 3292 | 2549 | 82 | globlastp |
| 1467 | BLFS113 | Pseudomonas sp. | 3293 | 2549 | 81.4 | globlastp |
| 1468 | BLFS113 | Pseudomonas sp. | 3294 | 2549 | 80.1 | globlastp |
| 1469 | BLFS113 | Pseudomonas sp. | 3295 | 2549 | 79 | globlastp |
| 1470 | BLFS113 | Pseudomonas sp. | 3296 | 2549 | 78.4 | globlastp |
| 1471 | BLFS113 | Pseudomonas sp. | 3297 | 2549 | 77.8 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 1472 | BLFS113 | Environmental sample | 3298 | 2549 | 76.6 | globlastp |
| 1473 | BLFS113 | Pseudomonas sp. | 3299 | 2549 | 74.9 | globlastp |
| 1474 | BLFS113 | Pseudomonas sp. | 3300 | 2549 | 71.4 | globlastp |
| 817 | BLFS13 | Arthrobacter sp. | 2669 | 2456 | 99.4 | globlastp |
| 815 | BLFS13 | Environmental sample | 2667 | 2456 | 73.3 | globlastp |
| 821 | BLFS13 | Arthrobacter sp. | 2673 | 2456 | 71.4 | globlastp |
| 822 | BLFS13 | Arthrobacter sp. | 2674 | 2456 | 70.3 | globlastp |
| 1611 | BLFS124 | Pseudomonas sp. | 3435 | 2559 | 99 | globlastp |
| 1612 | BLFS124 | Pseudomonas sp. | 3436 | 2559 | 93.3 | globlastp |
| 1613 | BLFS124 | Pseudomonas sp. | 3437 | 2559 | 92.4 | globlastp |
| 1614 | BLFS124 | Pseudomonas sp. | 3438 | 2559 | 83.8 | globlastp |
| 1615 | BLFS124 | Pseudomonas sp. | 3439 | 2559 | 82.9 | globlastp |
| 1616 | BLFS124 | Pseudomonas sp. | 3440 | 2559 | 81 | globlastp |
| 1617 | BLFS124 | Pseudomonas sp. | 3441 | 2559 | 80 | globlastp |
| 1618 | BLFS124 | Pseudomonas sp. | 3442 | 2559 | 79 | globlastp |
| 1619 | BLFS124 | Pseudomonas sp. | 3443 | 2559 | 78.1 | globlastp |
| 1620 | BLFS124 | Pseudomonas sp. | 3444 | 2559 | 77.3 | globlastp |
| 1621 | BLFS124 | Environmental sample | 3445 | 2559 | 76.2 | globlastp |
| 1622 | BLFS124 | Pseudomonas sp. | 3446 | 2559 | 75.2 | globlastp |
| 1623 | BLFS124 | Pseudomonas sp. | 3447 | 2559 | 74.5 | globlastp |
| 1624 | BLFS124 | Environmental sample | 3448 | 2559 | 73.3 | globlastp |
| 1625 | BLFS124 | Environmental sample | 3449 | 2559 | 72.4 | globlastp |
| 1626 | BLFS124 | Environmental sample | 3450 | 2559 | 71.4 | globlastp |
| 1627 | BLFS124 | Pseudomonas sp. | 3451 | 2559 | 70.5 | globlastp |
| 2147 | ZLFS24 | Meta sp. | 3961 | 2620 | 98.8 | globlastp |
| 2148 | ZLFS24 | Environmental sample | 3962 | 2620 | 98.6 | globlastp |
| 2149 | ZLFS24 | Environmental sample | 3963 | 2620 | 98.3 | globlastp |
| 2150 | ZLFS24 | Pantoea sp. | 3964 | 2620 | 98.2 | globlastp |
| 2151 | ZLFS24 | Environmental sample | 3965 | 2620 | 98 | globlastp |
| 2152 | ZLFS24 | Environmental sample | 3966 | 2620 | 97.9 | globlastp |
| 2153 | ZLFS24 | Pantoea sp. | 3967 | 2620 | 93.6 | globlastp |
| 2154 | ZLFS24 | Pantoea sp. | 3968 | 2620 | 93.3 | globlastp |
| 2155 | ZLFS24 | Environmental sample | 3969 | 2620 | 92.8 | globlastp |
| 2156 | ZLFS24 | Environmental sample | 3970 | 2620 | 92.7 | globlastp |
| 2157 | ZLFS24 | Environmental sample | 3971 | 2620 | 88.7 | globlastp |
| 2158 | ZLFS24 | Pantoea sp. | 3972 | 2620 | 88.6 | globlastp |
| 2159 | ZLFS24 | Pantoea sp. | 3973 | 2620 | 87.7 | globlastp |
| 2160 | ZLFS24 | Environmental sample | 3974 | 2620 | 80.3 | globlastp |
| 2161 | ZLFS24 | Pantoea sp. | 3975 | 2620 | 80 | globlastp |
| 2162 | ZLFS24 | Pantoea sp. | 3976 | 2620 | 79.4 | globlastp |
| 2084 | ZLFS11 | Collimonas sp. | 3898 | 2608 | 81.5 | globlastp |
| 2085 | ZLFS11 | Collimonas sp. | 3899 | 2608 | 79 | globlastp |
| 825 | BLFS15 | Multievos46 sp. | 2677 | 2458 | 93.2 | globlastp |
| 826 | BLFS15 | Environmental sample | 2678 | 2458 | 89.2 | globlastp |
| 827 | BLFS15 | Arthrobacter sp. | 2679 | 2458 | 84.4 | globlastp |
| 828 | BLFS15 | Arthrobacter sp. | 2680 | 2458 | 83.6 | globlastp |
| 829 | BLFS15 | Arthrobacter sp. | 2681 | 2458 | 83.4 | globlastp |
| 830 | BLFS15 | Arthrobacter sp. | 2682 | 2458 | 83.2 | globlastp |
| 831 | BLFS15 | Arthrobacter sp. | 2683 | 2458 | 76.9 | globlastp |
| 832 | BLFS15 | Arthrobacter sp. | 2684 | 2458 | 76.7 | globlastp |
| 833 | BLFS15 | Arthrobacter sp. | 2685 | 2458 | 76 | globlastp |
| 1753 | BLFS134 | Pseudomonas sp. | 3577 | 2569 | 98.9 | globlastp |
| 1754 | BLFS134 | Pseudomonas sp. | 3578 | 2569 | 96.8 | globlastp |
| 1755 | BLFS134 | Pseudomonas sp. | 3579 | 2569 | 95.8 | globlastp |
| 1756 | BLFS134 | Pseudomonas sp. | 3580 | 2569 | 93.7 | globlastp |
| 1757 | BLFS134 | Pseudomonas sp. | 3581 | 2569 | 92.6 | globlastp |
| 1758 | BLFS134 | Pseudomonas sp. | 3582 | 2569 | 91.6 | globlastp |
| 1759 | BLFS134 | Pseudomonas sp. | 3583 | 2569 | 90.5 | globlastp |
| 1760 | BLFS134 | Pseudomonas sp. | 3584 | 2569 | 89.5 | globlastp |
| 1761 | BLFS134 | Environmental sample | 3585 | 2569 | 88.4 | globlastp |
| 1762 | BLFS134 | Environmental sample | 3586 | 2569 | 87.4 | globlastp |
| 1763 | BLFS134 | Environmental sample | 3587 | 2569 | 86.3 | globlastp |
| 1764 | BLFS134 | Pseudomonas sp. | 3588 | 2569 | 85.3 | globlastp |
| 1765 | BLFS134 | Pseudomonas sp. | 3589 | 2569 | 84.2 | globlastp |
| 1766 | BLFS134 | Pseudomonas sp. | 3590 | 2569 | 83.2 | globlastp |
| 1767 | BLFS134 | Pseudomonas sp. | 3591 | 2569 | 82.1 | globlastp |
| 1768 | BLFS134 | Environmental sample | 3592 | 2569 | 81.1 | globlastp |
| 1769 | BLFS134 | Environmental sample | 3593 | 2569 | 80 | globlastp |
| 1770 | BLFS134 | Pseudomonas sp. | 3594 | 2569 | 79.2 | globlastp |
| 1771 | BLFS134 | Environmental sample | 3595 | 2569 | 78.1 | globlastp |
| 1772 | BLFS134 | Pseudomonas sp. | 3596 | 2569 | 77.1 | globlastp |
| 1773 | BLFS134 | Pseudomonas sp. | 3597 | 2569 | 76 | globlastp |
| 1774 | BLFS134 | Pseudomonas sp. | 3598 | 2569 | 75 | globlastp |
| 1775 | BLFS134 | Pseudomonas sp. | 3599 | 2569 | 74 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 1776 | BLFS134 | Environmental sample | 3600 | 2569 | 73.7 | globlastp |
| 1777 | BLFS134 | Pseudomonas sp. | 3601 | 2569 | 72.4 | globlastp |
| 1778 | BLFS134 | Environmental sample | 3602 | 2569 | 71.6 | globlastp |
| 1779 | BLFS134 | Azotobacter sp. | 3603 | 2569 | 70.5 | globlastp |
| 2163 | ZLFS25 | Curtobacterium sp. | 3977 | 2621 | 95.4 | globlastp |
| 2164 | ZLFS25 | Environmental sample | 3978 | 2621 | 91.3 | globlastp |
| 2165 | ZLFS25 | Curtobacterium sp. | 3979 | 2621 | 90.1 | globlastp |
| 2166 | ZLFS25 | Curtobacterium sp. | 3980 | 2621 | 89.9 | globlastp |
| 2167 | ZLFS25 | Environmental sample | 3981 | 2621 | 76.6 | globlastp |
| 2168 | ZLFS25 | Environmental sample | 3982 | 2621 | 74.4 | globlastp |
| 2169 | ZLFS25 | Environmental sample | 3983 | 2621 | 73.8 | globlastp |
| 834 | BLFS16 | Environmental sample | 2686 | 2459 | 94.7 | globlastp |
| 835 | BLFS16 | Arthrobacter sp. | 2687 | 2459 | 78.1 | globlastp |
| 836 | BLFS16 | Arthrobacter sp. | 2688 | 2459 | 78 | globlastp |
| 837 | BLFS16 | Arthrobacter sp. | 2689 | 2459 | 77.7 | globlastp |
| 838 | BLFS16 | Arthrobacter sp. | 2690 | 2459 | 77 | globlastp |
| 984 | BLFS43 | Burkholderia sp. | 2832 | 2484 | 99.3 | globlastp |
| 985 | BLFS43 | Burkholderia sp. | 2833 | 2484 | 76.8 | globlastp |
| 986 | BLFS43 | Burkholderia sp. | 2834 | 2484 | 71.4 | globlastp |
| 987 | BLFS43 | Burkholderia sp. | 2835 | 2484 | 70.7 | globlastp |
| 2127 | ZLFS22 | Paenibacillus sp. | 3941 | 2618 | 99.1 | globlastp |
| 2128 | ZLFS22 | Paenibacillus sp. | 3942 | 2618 | 98.2 | globlastp |
| 2129 | ZLFS22 | Paenibacillus sp. | 3943 | 2618 | 97.7 | globlastp |
| 2130 | ZLFS22 | Paenibacillus sp. | 3944 | 2618 | 96.4 | globlastp |
| 2131 | ZLFS22 | Paenibacillus sp. | 3945 | 2618 | 95.9 | globlastp |
| 2132 | ZLFS22 | Paenibacillus sp. | 3946 | 2618 | 95.5 | globlastp |
| 2133 | ZLFS22 | Paenibacillus sp. | 3947 | 2618 | 95 | globlastp |
| 2134 | ZLFS22 | Paenibacillus sp. | 3948 | 2618 | 93.7 | globlastp |
| 2135 | ZLFS22 | Paenibacillus sp. | 3949 | 2618 | 93.2 | globlastp |
| 2136 | ZLFS22 | Paenibacillus sp. | 3950 | 2618 | 91.9 | globlastp |
| 2137 | ZLFS22 | Paenibacillus sp. | 3951 | 2618 | 85.6 | globlastp |
| 2138 | ZLFS22 | Paenibacillus sp. | 3952 | 2618 | 84.7 | globlastp |
| 2139 | ZLFS22 | Paenibacillus sp. | 3953 | 2618 | 83.8 | globlastp |
| 998 | BLFS47 | Salinibacillus sp. | 2846 | 2488 | 90.9 | globlastp |
| 999 | BLFS47 | Cellulosimicrobium sp. | 2847 | 2488 | 77.3 | globlastp |
| 1000 | BLFS47 | Cellulosimicrobium sp. | 2848 | 2488 | 71.8 | globlastp |
| 1001 | BLFS47 | Multievos46 sp. | 2849 | 2488 | 70.2 | globlastp |
| 1258 | BLFS94 | Paenibacillus sp. | 3093 | 2530 | 99 | globlastp |
| 1259 | BLFS94 | Paenibacillus sp. | 3094 | 2530 | 98.1 | globlastp |
| 1260 | BLFS94 | Paenibacillus sp. | 3095 | 2530 | 96.3 | globlastp |
| 1261 | BLFS94 | Paenibacillus sp. | 3096 | 2530 | 95 | globlastp |
| 1262 | BLFS94 | Paenibacillus sp. | 3097 | 2530 | 94 | globlastp |
| 1263 | BLFS94 | Paenibacillus sp. | 3098 | 2530 | 93.1 | globlastp |
| 1264 | BLFS94 | Paenibacillus sp. | 3099 | 2530 | 74.6 | globlastp |
| 1265 | BLFS94 | Paenibacillus sp. | 3100 | 2530 | 73.4 | globlastp |
| 1266 | BLFS94 | Paenibacillus sp. | 3101 | 2530 | 71.7 | globlastp |
| 1104 | BLFS75 | Paenibacillus sp. | 2944 | 2513 | 99.4 | globlastp |
| 1105 | BLFS75 | Paenibacillus sp. | 2945 | 2513 | 98.8 | globlastp |
| 1106 | BLFS75 | Paenibacillus sp. | 2946 | 2513 | 98.6 | globlastp |
| 1107 | BLFS75 | Paenibacillus sp. | 2947 | 2513 | 98.3 | globlastp |
| 1108 | BLFS75 | Paenibacillus sp. | 2948 | 2513 | 98 | globlastp |
| 1109 | BLFS75 | Paenibacillus sp. | 2949 | 2513 | 97.7 | globlastp |
| 1110 | BLFS75 | Paenibacillus sp. | 2950 | 2513 | 97.1 | globlastp |
| 1111 | BLFS75 | Paenibacillus sp. | 2951 | 2513 | 92.5 | globlastp |
| 1112 | BLFS75 | Paenibacillus sp. | 2952 | 2513 | 92.2 | globlastp |
| 1113 | BLFS75 | Paenibacillus sp. | 2953 | 2513 | 91.9 | globlastp |
| 1114 | BLFS75 | Paenibacillus sp. | 2954 | 2513 | 88.7 | globlastp |
| 1725 | BLFS132 | Pseudomonas sp. | 3549 | 2567 | 98.5 | globlastp |
| 1726 | BLFS132 | Pseudomonas sp. | 3550 | 2567 | 97.1 | globlastp |
| 1727 | BLFS132 | Pseudomonas sp. | 3551 | 2567 | 95.6 | globlastp |
| 1728 | BLFS132 | Pseudomonas sp. | 3552 | 2567 | 94.1 | globlastp |
| 1729 | BLFS132 | Pseudomonas sp. | 3553 | 2567 | 92.6 | globlastp |
| 1730 | BLFS132 | Pseudomonas sp. | 3554 | 2567 | 91.4 | globlastp |
| 1731 | BLFS132 | Pseudomonas sp. | 3555 | 2567 | 88.6 | globlastp |
| 1732 | BLFS132 | Pseudomonas sp. | 3556 | 2567 | 87 | globlastp |
| 1733 | BLFS132 | Pseudomonas sp. | 3557 | 2567 | 85.5 | globlastp |
| 1734 | BLFS132 | Pseudomonas sp. | 3558 | 2567 | 84.1 | globlastp |
| 1735 | BLFS132 | Environmental sample | 3559 | 2567 | 83.1 | globlastp |
| 1736 | BLFS132 | Pseudomonas sp. | 3560 | 2567 | 82.6 | globlastp |
| 1737 | BLFS132 | Pseudomonas sp. | 3561 | 2567 | 81.2 | globlastp |
| 1738 | BLFS132 | Pseudomonas sp. | 3562 | 2567 | 80 | globlastp |
| 1739 | BLFS132 | Environmental sample | 3563 | 2567 | 79.4 | globlastp |
| 1740 | BLFS132 | Pseudomonas sp. | 3564 | 2567 | 78.3 | globlastp |
| 1741 | BLFS132 | Pseudomonas sp. | 3565 | 2567 | 77.9 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 1742 | BLFS132 | Pseudomonas sp. | 3566 | 2567 | 76.5 | globlastp |
| 1743 | BLFS132 | Pseudomonas sp. | 3567 | 2567 | 75 | globlastp |
| 1744 | BLFS132 | Pseudomonas sp. | 3568 | 2567 | 74 | globlastp |
| 1745 | BLFS132 | Pseudomonas sp. | 3569 | 2567 | 73 | globlastp |
| 1746 | BLFS132 | Pseudomonas sp. | 3570 | 2567 | 72 | globlastp |
| 1747 | BLFS132 | Pseudomonas sp. | 3571 | 2567 | 71 | globlastp |
| 1748 | BLFS132 | Pseudomonas sp. | 3572 | 2567 | 70.7 | globlastp |
| 809 | BLFS10 | Amycolatopsis sp. | 2661 | 2453 | 97.4 | globlastp |
| 810 | BLFS10 | Amycolatopsis sp. | 2662 | 2453 | 94.9 | globlastp |
| 804 | BLFS10 | Amycolatopsis sp. | 2656 | 2453 | 94 | globlastp |
| 600 | BLFS10 | Amycolatopsis sp. | 2452 | 2453 | 75.2 | globlastp |
| 803 | BLFS10 | Amycolatopsis sp. | 2655 | 2453 | 74.4 | globlastp |
| 811 | BLFS10 | Streptomyces sp. | 2663 | 2453 | 70.9 | globlastp |
| 2312 | ZLFS37 | Serratia sp. | 4126 | 2632 | 99.1 | globlastp |
| 2313 | ZLFS37 | Environmental sample | 4127 | 2632 | 97.3 | globlastp |
| 2314 | ZLFS37 | Serratia sp. | 4128 | 2632 | 96.4 | globlastp |
| 2315 | ZLFS37 | Serratia sp. | 4129 | 2632 | 95.5 | globlastp |
| 2316 | ZLFS37 | Serratia sp. | 4130 | 2632 | 94.6 | globlastp |
| 2317 | ZLFS37 | Serratia sp. | 4131 | 2632 | 93.8 | globlastp |
| 2318 | ZLFS37 | Serratia sp. | 4132 | 2632 | 92.9 | globlastp |
| 2319 | ZLFS37 | Serratia sp. | 4133 | 2632 | 91.1 | globlastp |
| 2320 | ZLFS37 | Serratia sp. | 4134 | 2632 | 84.8 | globlastp |
| 2321 | ZLFS37 | Serratia sp. | 4135 | 2632 | 83.9 | globlastp |
| 2322 | ZLFS37 | Serratia sp. | 4136 | 2632 | 83 | globlastp |
| 2323 | ZLFS37 | Yersinia sp. | 4137 | 2632 | 82.1 | globlastp |
| 2324 | ZLFS37 | Serratia sp. | 4138 | 2632 | 81.6 | globlastp |
| 2325 | ZLFS37 | Yersinia sp. | 4139 | 2632 | 81.2 | globlastp |
| 2326 | ZLFS37 | Hafnia sp. | 4140 | 2632 | 80.5 | globlastp |
| 2327 | ZLFS37 | Yersinia sp. | 4141 | 2632 | 80.4 | globlastp |
| 2328 | ZLFS37 | Yersinia sp. | 4142 | 2632 | 79.5 | globlastp |
| 2329 | ZLFS37 | Yersinia sp. | 4143 | 2632 | 78.6 | globlastp |
| 2330 | ZLFS37 | Enterobacteriaceae sp. | 4144 | 2632 | 77.9 | globlastp |
| 2331 | ZLFS37 | Rahnella sp. | 4145 | 2632 | 77.7 | globlastp |
| 2332 | ZLFS37 | Ewinyella sp. | 4146 | 2632 | 76.8 | globlastp |
| 2333 | ZLFS37 | Rahnella sp. | 4147 | 2632 | 76.5 | globlastp |
| 2334 | ZLFS37 | Rahnella sp. | 4148 | 2632 | 75.7 | globlastp |
| 2335 | ZLFS37 | Yersinia sp. | 4149 | 2632 | 74 | globlastp |
| 2336 | ZLFS37 | Candidatus sp. | 4150 | 2632 | 71.3 | globlastp |
| 2337 | ZLFS37 | Serratia sp. | — | 2632 | 70.54 | glotblastn |
| 2338 | ZLFS37 | Serratia sp. | 4151 | 2632 | 70.5 | globlastp |
| 2339 | ZLFS37 | Candidatus sp. | 4152 | 2632 | 70.4 | globlastp |
| 2340 | ZLFS37 | gamma sp. | 4153 | 2632 | 70.2 | globlastp |
| 1038 | BLFS62 | Erwinia sp. | 2881 | 2502 | 83.2 | globlastp |
| 1039 | BLFS62 | Pantoea sp. | 2882 | 2502 | 81.5 | globlastp |
| 1040 | BLFS62 | Environmental sample | 2883 | 2502 | 79.2 | globlastp |
| 1041 | BLFS62 | Environmental sample | 2884 | 2502 | 78.2 | globlastp |
| 1042 | BLFS62 | Environmental sample | 2885 | 2502 | 77 | globlastp |
| 1043 | BLFS62 | Environmental sample | 2886 | 2502 | 76.2 | globlastp |
| 1044 | BLFS62 | Pantoea sp. | 2887 | 2502 | 75.2 | globlastp |
| 1045 | BLFS62 | Pantoea sp. | 2888 | 2502 | 74.1 | globlastp |
| 1046 | BLFS62 | Pantoea sp. | 2889 | 2502 | 73.5 | globlastp |
| 1047 | BLFS62 | Pantoea sp. | 2890 | 2502 | 71.5 | globlastp |
| 1048 | BLFS62 | Enterobacter sp. | — | 2502 | 70.51 | glotblastn |
| 1006 | BLFS51 | Herbaspirillum sp. | — | 2492 | 76.51 | glotblastn |
| 1007 | BLFS51 | Collimonas sp. | 2854 | 2492 | 73.7 | globlastp |
| 1008 | BLFS51 | Collimonas sp. | — | 2492 | 72.89 | glotblastn |
| 1009 | BLFS51 | Herbaspirillum sp. | 2855 | 2492 | 70.3 | globlastp |
| 1701 | BLFS131 | Pseudomonas sp. | 3525 | 2566 | 98.4 | globlastp |
| 1702 | BLFS131 | Pseudomonas sp. | 3526 | 2566 | 94.5 | globlastp |
| 1703 | BLFS131 | Pseudomonas sp. | 3527 | 2566 | 91.2 | globlastp |
| 1704 | BLFS131 | Pseudomonas sp. | 3528 | 2566 | 90.1 | globlastp |
| 1705 | BLFS131 | Pseudomonas sp. | 3529 | 2566 | 89 | globlastp |
| 1706 | BLFS131 | Pseudomonas sp. | 3530 | 2566 | 88 | globlastp |
| 1707 | BLFS131 | Pseudomonas sp. | 3531 | 2566 | 87 | globlastp |
| 1708 | BLFS131 | Pseudomonas sp. | 3532 | 2566 | 86.3 | globlastp |
| 1709 | BLFS131 | Environmental sample | 3533 | 2566 | 85.2 | globlastp |
| 1710 | BLFS131 | Environmental sample | 3534 | 2566 | 84.1 | globlastp |
| 1711 | BLFS131 | Environmental sample | 3535 | 2566 | 83 | globlastp |
| 1712 | BLFS131 | Pseudomonas sp. | 3536 | 2566 | 82.2 | globlastp |
| 1713 | BLFS131 | Pseudomonas sp. | 3537 | 2566 | 81.1 | globlastp |
| 1714 | BLFS131 | Pseudomonas sp. | 3538 | 2566 | 80 | globlastp |
| 1715 | BLFS131 | Environmental sample | 3539 | 2566 | 79.1 | globlastp |
| 1716 | BLFS131 | Pseudomonas sp. | 3540 | 2566 | 78.1 | globlastp |
| 1717 | BLFS131 | Pseudomonas sp. | 3541 | 2566 | 77 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 1718 | BLFS131 | Pseudomonas sp. | 3542 | 2566 | 76 | globlastp |
| 1719 | BLFS131 | Pseudomonas sp. | 3543 | 2566 | 75.3 | globlastp |
| 1720 | BLFS131 | Environmental sample | 3544 | 2566 | 74.2 | globlastp |
| 1721 | BLFS131 | Pseudomonas sp. | 3545 | 2566 | 73.1 | globlastp |
| 1722 | BLFS131 | Pseudomonas sp. | 3546 | 2566 | 72 | globlastp |
| 1723 | BLFS131 | Pseudomonas sp. | 3547 | 2566 | 71.4 | globlastp |
| 1724 | BLFS131 | Pseudomonas sp. | 3548 | 2566 | 70.3 | globlastp |
| 997 | BLFS46 | Burkholderia sp. | 2845 | 2487 | 84.9 | globlastp |
| 1072 | BLFS73 | Paenibacillus sp. | 2914 | 2511 | 99.2 | globlastp |
| 1073 | BLFS73 | Paenibacillus sp. | 2915 | 2511 | 98.4 | globlastp |
| 1074 | BLFS73 | Paenibacillus sp. | 2916 | 2511 | 96.7 | globlastp |
| 1075 | BLFS73 | Paenibacillus sp. | 2917 | 2511 | 95.9 | globlastp |
| 1076 | BLFS73 | Paenibacillus sp. | 2918 | 2511 | 95.1 | globlastp |
| 1077 | BLFS73 | Paenibacillus sp. | 2919 | 2511 | 84.6 | globlastp |
| 1078 | BLFS73 | Paenibacillus sp. | — | 2511 | 82.93 | glotblastn |
| 1079 | BLFS73 | Paenibacillus sp. | 2920 | 2511 | 82.1 | globlastp |
| 1080 | BLFS73 | Paenibacillus sp. | 2921 | 2511 | 81.3 | globlastp |
| 1081 | BLFS73 | Paenibacillus sp. | 2922 | 2511 | 78.9 | globlastp |
| 1082 | BLFS73 | Paenibacillus sp. | 2923 | 2511 | 78 | globlastp |
| 1083 | BLFS73 | Paenibacillus sp. | 2924 | 2511 | 77.2 | globlastp |
| 1084 | BLFS73 | Environmental sample | 2925 | 2511 | 76.4 | globlastp |
| 1085 | BLFS73 | Paenibacillus sp. | 2926 | 2511 | 75 | globlastp |
| 1086 | BLFS73 | Paenibacillus sp. | 2927 | 2511 | 74 | globlastp |
| 1087 | BLFS73 | Paenibacillus sp. | — | 2511 | 73.17 | glotblastn |
| 1088 | BLFS73 | Paenibacillus sp. | 2928 | 2511 | 72.4 | globlastp |
| 1089 | BLFS73 | Paenibacillus sp. | 2929 | 2511 | 71.2 | globlastp |
| 1652 | BLFS127 | Pseudomonas sp. | 3476 | 2562 | 98.3 | globlastp |
| 1653 | BLFS127 | Pseudomonas sp. | 3477 | 2562 | 98.1 | globlastp |
| 1654 | BLFS127 | Pseudomonas sp. | 3478 | 2562 | 97.7 | globlastp |
| 1655 | BLFS127 | Pseudomonas sp. | 3479 | 2562 | 97.4 | globlastp |
| 1656 | BLFS127 | Pseudomonas sp. | 3480 | 2562 | 96.7 | globlastp |
| 1657 | BLFS127 | Pseudomonas sp. | 3481 | 2562 | 96 | globlastp |
| 1658 | BLFS127 | Pseudomonas sp. | 3482 | 2562 | 95.8 | globlastp |
| 1659 | BLFS127 | Pseudomonas sp. | 3483 | 2562 | 95.2 | globlastp |
| 1660 | BLFS127 | Pseudomonas sp. | 3484 | 2562 | 86.2 | globlastp |
| 1661 | BLFS127 | Pseudomonas sp. | 3485 | 2562 | 75.5 | globlastp |
| 1662 | BLFS127 | Pseudomonas sp. | 3486 | 2562 | 75.3 | globlastp |
| 1663 | BLFS127 | Pseudomonas sp. | 3487 | 2562 | 75.2 | globlastp |
| 1664 | BLFS127 | Pseudomonas sp. | 3488 | 2562 | 75.1 | globlastp |
| 1665 | BLFS127 | Pseudomonas sp. | 3489 | 2562 | 75 | globlastp |
| 1666 | BLFS127 | Pseudomonas sp. | 3490 | 2562 | 74.8 | globlastp |
| 1667 | BLFS127 | Pseudomonas sp. | 3491 | 2562 | 73.3 | globlastp |
| 1067 | BLFS68 | Janthinobacterium sp. | 2909 | 2507 | 98.7 | globlastp |
| 1068 | BLFS68 | Janthinobacterium sp. | 2910 | 2507 | 90.3 | globlastp |
| 1069 | BLFS68 | Janthinobacterium sp. | 2911 | 2507 | 89.6 | globlastp |
| 1070 | BLFS68 | Janthinobacterium sp. | 2912 | 2507 | 88.5 | globlastp |
| 1049 | BLFS63 | Erwinia sp. | 2891 | 2503 | 85.7 | globlastp |
| 1050 | BLFS63 | Erwinia sp. | 2892 | 2503 | 83.8 | globlastp |
| 1051 | BLFS63 | Environmental sample | 2893 | 2503 | 82.9 | globlastp |
| 1052 | BLFS63 | Environmental sample | 2894 | 2503 | 81 | globlastp |
| 1053 | BLFS63 | Environmental sample | 2895 | 2503 | 80.3 | globlastp |
| 1054 | BLFS63 | Erwinia sp. | 2896 | 2503 | 79.4 | globlastp |
| 1055 | BLFS63 | Erwinia sp. | 2897 | 2503 | 78 | globlastp |
| 1056 | BLFS63 | Pantoea sp. | 2898 | 2503 | 76.8 | globlastp |
| 1057 | BLFS63 | Meta sp. | 2899 | 2503 | 75 | globlastp |
| 1058 | BLFS63 | Plautia sp. | 2900 | 2503 | 74 | globlastp |
| 1059 | BLFS63 | Pantoea sp. | 2901 | 2503 | 73.2 | globlastp |
| 1060 | BLFS63 | Environmental sample | 2902 | 2503 | 72 | globlastp |
| 1061 | BLFS63 | Environmental sample | 2903 | 2503 | 71.8 | globlastp |
| 1002 | BLFS48 | Collimonas sp. | 2850 | 2489 | 98.9 | globlastp |
| 1003 | BLFS48 | Collimonas sp. | 2851 | 2489 | 78.9 | globlastp |
| 1004 | BLFS48 | Collimonas sp. | 2852 | 2489 | 76.5 | globlastp |
| 2080 | ZLFS7 | Collimonas sp. | 3894 | 2604 | 70.4 | globlastp |
| 937 | BLFS33 | Bacillus sp. | 2787 | 2475 | 99.1 | globlastp |
| 938 | BLFS33 | Bacillus sp. | 2788 | 2475 | 98.1 | globlastp |
| 939 | BLFS33 | Bacillus sp. | 2789 | 2475 | 96.4 | globlastp |
| 940 | BLFS33 | Bacillus sp. | 2790 | 2475 | 94 | globlastp |
| 941 | BLFS33 | Bacillus sp. | 2791 | 2475 | 93.1 | globlastp |
| 942 | BLFS33 | Bacillus sp. | 2792 | 2475 | 92.1 | globlastp |
| 943 | BLFS33 | Bacillus sp. | 2793 | 2475 | 90.5 | globlastp |
| 944 | BLFS33 | Bacillus sp. | 2794 | 2475 | 80 | globlastp |
| 945 | BLFS33 | Bacillus sp. | 2795 | 2475 | 78.1 | globlastp |
| 946 | BLFS33 | Bacillus sp. | 2796 | 2475 | 76.7 | globlastp |
| 947 | BLFS33 | Bacillus sp. | 2797 | 2475 | 76 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 948 | BLFS33 | *Bacillus* sp. | 2798 | 2475 | 75.4 | globlastp |
| 1431 | BLFS110 | Environmental sample | 3257 | 2546 | 83.8 | globlastp |
| 1227 | BLFS91 | *Paenibacillus* sp. | 3062 | 2527 | 99.2 | globlastp |
| 1228 | BLFS91 | *Paenibacillus* sp. | 3063 | 2527 | 96.8 | globlastp |
| 1229 | BLFS91 | *Paenibacillus* sp. | 3064 | 2527 | 96 | globlastp |
| 1230 | BLFS91 | *Paenibacillus* sp. | 3065 | 2527 | 95.2 | globlastp |
| 1231 | BLFS91 | *Paenibacillus* sp. | 3066 | 2527 | 93.6 | globlastp |
| 1232 | BLFS91 | *Paenibacillus* sp. | 3067 | 2527 | 88.8 | globlastp |
| 1233 | BLFS91 | *Paenibacillus* sp. | 3068 | 2527 | 87.2 | globlastp |
| 1234 | BLFS91 | *Paenibacillus* sp. | 3069 | 2527 | 86.4 | globlastp |
| 1235 | BLFS91 | *Paenibacillus* sp. | 3070 | 2527 | 84.8 | globlastp |
| 1236 | BLFS91 | *Paenibacillus* sp. | 3071 | 2527 | 81.6 | globlastp |
| 1237 | BLFS91 | *Paenibacillus* sp. | 3072 | 2527 | 80.8 | globlastp |
| 2255 | ZLFS31 | *Serratia* sp. | 4069 | 2626 | 99.2 | globlastp |
| 2256 | ZLFS31 | *Serratia* sp. | 4070 | 2626 | 98.8 | globlastp |
| 2257 | ZLFS31 | *Serratia* sp. | 4071 | 2626 | 97 | globlastp |
| 2258 | ZLFS31 | Multievos46 sp. | 4072 | 2626 | 92.1 | globlastp |
| 2259 | ZLFS31 | *Serratia* sp. | 4073 | 2626 | 91.3 | globlastp |
| 2260 | ZLFS31 | *Serratia* sp. | 4074 | 2626 | 89 | globlastp |
| 2261 | ZLFS31 | *Serratia* sp. | 4075 | 2626 | 88.2 | globlastp |
| 2262 | ZLFS31 | *Serratia* sp. | 4076 | 2626 | 83.1 | globlastp |
| 2263 | ZLFS31 | *Serratia* sp. | 4077 | 2626 | 82.1 | globlastp |
| 2264 | ZLFS31 | *Serratia* sp. | 4078 | 2626 | 81 | globlastp |
| 2265 | ZLFS31 | *Yersinia* sp. | 4079 | 2626 | 75.3 | globlastp |
| 2266 | ZLFS31 | *Yersinia* sp. | 4080 | 2626 | 74.8 | globlastp |
| 2267 | ZLFS31 | *Yersinia* sp. | 4081 | 2626 | 73 | globlastp |
| 903 | BLFS27 | *Bacillus* sp. | 2753 | 2470 | 89.4 | globlastp |
| 904 | BLFS27 | *Bacillus* sp. | 2754 | 2470 | 87.6 | globlastp |
| 905 | BLFS27 | *Bacillus* sp. | 2755 | 2470 | 86.6 | globlastp |
| 906 | BLFS27 | *Bacillus* sp. | 2756 | 2470 | 78.6 | globlastp |
| 907 | BLFS27 | *Bacillus* sp. | 2757 | 2470 | 75.1 | globlastp |
| 1475 | BLFS114 | *Pseudomonas* sp. | 3301 | 2550 | 93.6 | globlastp |
| 1476 | BLFS114 | *Pseudomonas* sp. | 3302 | 2550 | 93.1 | globlastp |
| 1477 | BLFS114 | *Pseudomonas* sp. | 3303 | 2550 | 92.5 | globlastp |
| 1478 | BLFS114 | *Pseudomonas* sp. | 3304 | 2550 | 91 | globlastp |
| 1479 | BLFS114 | Environmental sample | 3305 | 2550 | 90.2 | globlastp |
| 1480 | BLFS114 | Environmental sample | 3306 | 2550 | 89 | globlastp |
| 1481 | BLFS114 | Environmental sample | 3307 | 2550 | 88.4 | globlastp |
| 1482 | BLFS114 | *Pseudomonas* sp. | 3308 | 2550 | 87.3 | globlastp |
| 1483 | BLFS114 | *Pseudomonas* sp. | 3309 | 2550 | 86.2 | globlastp |
| 1484 | BLFS114 | *Pseudomonas* sp. | 3310 | 2550 | 85 | globlastp |
| 1485 | BLFS114 | *Pseudomonas* sp. | 3311 | 2550 | 84.4 | globlastp |
| 1486 | BLFS114 | *Erwinia* sp. | 3312 | 2550 | 83.2 | globlastp |
| 1487 | BLFS114 | *Pseudomonas* sp. | 3313 | 2550 | 82.1 | globlastp |
| 1488 | BLFS114 | *Pseudomonas* sp. | 3314 | 2550 | 81 | globlastp |
| 1489 | BLFS114 | *Pseudomonas* sp. | 3315 | 2550 | 80.3 | globlastp |
| 1490 | BLFS114 | Environmental sample | 3316 | 2550 | 79.2 | globlastp |
| 1491 | BLFS114 | Environmental sample | 3317 | 2550 | 78 | globlastp |
| 1492 | BLFS114 | *Pseudomonas* sp. | 3318 | 2550 | 77.3 | globlastp |
| 1493 | BLFS114 | *Pseudomonas* sp. | 3319 | 2550 | 76 | globlastp |
| 1494 | BLFS114 | Environmental sample | 3320 | 2550 | 75.1 | globlastp |
| 1495 | BLFS114 | Environmental sample | 3321 | 2550 | 74 | globlastp |
| 1496 | BLFS114 | Environmental sample | 3322 | 2550 | 73.4 | globlastp |
| 1497 | BLFS114 | *Pseudomonas* sp. | 3323 | 2550 | 72 | globlastp |
| 1498 | BLFS114 | Environmental sample | 3324 | 2550 | 71.1 | globlastp |
| 1499 | BLFS114 | Environmental sample | 3325 | 2550 | 70.5 | globlastp |
| 1030 | BLFS61 | *Pseudomonas* sp. | 2873 | 2501 | 99 | globlastp |
| 1031 | BLFS61 | *Pseudomonas* sp. | 2874 | 2501 | 96 | globlastp |
| 1032 | BLFS61 | *Pseudomonas* sp. | 2875 | 2501 | 95.7 | globlastp |
| 1033 | BLFS61 | Environmental sample | 2876 | 2501 | 92.5 | globlastp |
| 1034 | BLFS61 | *Pseudomonas* sp. | 2877 | 2501 | 85.5 | globlastp |
| 1035 | BLFS61 | Environmental sample | 2878 | 2501 | 79.2 | globlastp |
| 1036 | BLFS61 | *Pseudomonas* sp. | 2879 | 2501 | 78.2 | globlastp |
| 1037 | BLFS61 | *Pseudomonas* sp. | 2880 | 2501 | 74.5 | globlastp |
| 1577 | BLFS121 | *Pseudomonas* sp. | 3402 | 2556 | 99 | globlastp |
| 1578 | BLFS121 | *Pseudomonas* sp. | 3403 | 2556 | 98.8 | globlastp |
| 1579 | BLFS121 | *Pseudomonas* sp. | 3404 | 2556 | 98.3 | globlastp |
| 1580 | BLFS121 | *Pseudomonas* sp. | 3405 | 2556 | 97.8 | globlastp |
| 1581 | BLFS121 | *Pseudomonas* sp. | 3406 | 2556 | 93.2 | globlastp |
| 1582 | BLFS121 | *Pseudomonas* sp. | 3407 | 2556 | 92.3 | globlastp |
| 1583 | BLFS121 | *Pseudomonas* sp. | 3408 | 2556 | 87 | globlastp |
| 1584 | BLFS121 | *Pseudomonas* sp. | 3409 | 2556 | 86 | globlastp |
| 1585 | BLFS121 | *Pseudomonas* sp. | 3410 | 2556 | 85 | globlastp |
| 1586 | BLFS121 | Environmental sample | 3411 | 2556 | 84.1 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 1587 | BLFS121 | *Pseudomonas* sp. | 3412 | 2556 | 83.1 | globlastp |
| 1588 | BLFS121 | Environmental sample | 3413 | 2556 | 82.1 | globlastp |
| 1589 | BLFS121 | *Pseudomonas* sp. | 3414 | 2556 | 81.4 | globlastp |
| 1590 | BLFS121 | *Pseudomonas* sp. | 3415 | 2556 | 80 | globlastp |
| 1591 | BLFS121 | *Pseudomonas* sp. | 3416 | 2556 | 79.2 | globlastp |
| 1592 | BLFS121 | Environmental sample | 3417 | 2556 | 78 | globlastp |
| 1593 | BLFS121 | *Pseudomonas* sp. | 3418 | 2556 | 77.5 | globlastp |
| 1594 | BLFS121 | *Pseudomonas* sp. | 3419 | 2556 | 76.1 | globlastp |
| 1595 | BLFS121 | *Polaromonas* sp. | 3420 | 2556 | 75.7 | globlastp |
| 1596 | BLFS121 | *Pseudomonas* sp. | 3421 | 2556 | 74.2 | globlastp |
| 1597 | BLFS121 | *Pseudomonas* sp. | 3422 | 2556 | 72 | globlastp |
| 1598 | BLFS121 | *Pseudomonas* sp. | 3423 | 2556 | 71 | globlastp |
| 2092 | ZLFS15 | *Collimonas* sp. | 3906 | 2612 | 89.2 | globlastp |
| 2093 | ZLFS15 | *Collimonas* sp. | 3907 | 2612 | 87.2 | globlastp |
| 2094 | ZLFS15 | *Collimonas* sp. | 3908 | 2612 | 85.6 | globlastp |
| 1115 | BLFS76 | *Paenibacillus* sp. | 2955 | 2514 | 95.4 | globlastp |
| 1116 | BLFS76 | *Paenibacillus* sp. | 2956 | 2514 | 94.6 | globlastp |
| 1117 | BLFS76 | *Paenibacillus* sp. | 2957 | 2514 | 93.4 | globlastp |
| 1118 | BLFS76 | *Paenibacillus* sp. | 2958 | 2514 | 92.7 | globlastp |
| 1119 | BLFS76 | *Paenibacillus* sp. | 2959 | 2514 | 90 | globlastp |
| 1120 | BLFS76 | *Paenibacillus* sp. | 2960 | 2514 | 82.6 | globlastp |
| 1121 | BLFS76 | *Paenibacillus* sp. | 2961 | 2514 | 72.3 | globlastp |
| 1122 | BLFS76 | *Paenibacillus* sp. | — | 2514 | 71.04 | glotblastn |
| 1123 | BLFS76 | *Paenibacillus* sp. | 2962 | 2514 | 70.1 | globlastp |
| 1530 | BLFS116 | *Pseudomonas* sp. | 3355 | 2552 | 95.8 | globlastp |
| 1531 | BLFS116 | *Pseudomonas* sp. | 3356 | 2552 | 90.2 | globlastp |
| 1532 | BLFS116 | *Pseudomonas* sp. | 3357 | 2552 | 89.2 | globlastp |
| 1533 | BLFS116 | Environmental sample | 3358 | 2552 | 88.1 | globlastp |
| 1534 | BLFS116 | *Pseudomonas* sp. | 3359 | 2552 | 87.8 | globlastp |
| 1535 | BLFS116 | *Pseudomonas* sp. | 3360 | 2552 | 86.3 | globlastp |
| 1536 | BLFS116 | *Pseudomonas* sp. | 3361 | 2552 | 85.5 | globlastp |
| 1537 | BLFS116 | *Pseudomonas* sp. | 3362 | 2552 | 84.8 | globlastp |
| 1538 | BLFS116 | *Pseudomonas* sp. | 3363 | 2552 | 83 | globlastp |
| 1539 | BLFS116 | *Pseudomonas* sp. | 3364 | 2552 | 82.1 | globlastp |
| 1540 | BLFS116 | *Pseudomonas* sp. | 3365 | 2552 | 81 | globlastp |
| 1541 | BLFS116 | *Pseudomonas* sp. | 3366 | 2552 | 80.1 | globlastp |
| 1542 | BLFS116 | *Pseudomonas* sp. | 3367 | 2552 | 79.1 | globlastp |
| 1543 | BLFS116 | *Pseudomonas* sp. | 3368 | 2552 | 78 | globlastp |
| 1544 | BLFS116 | *Pseudomonas* sp. | 3369 | 2552 | 77 | globlastp |
| 1545 | BLFS116 | *Pseudomonas* sp. | 3370 | 2552 | 76.4 | globlastp |
| 1546 | BLFS116 | *Pseudomonas* sp. | 3371 | 2552 | 75.1 | globlastp |
| 1547 | BLFS116 | *Pseudomonas* sp. | 3372 | 2552 | 74 | globlastp |
| 1548 | BLFS116 | *Pseudomonas* sp. | 3373 | 2552 | 73.2 | globlastp |
| 1549 | BLFS116 | *Pseudomonas* sp. | 3374 | 2552 | 72.3 | globlastp |
| 1550 | BLFS116 | *Pseudomonas* sp. | 3375 | 2552 | 71 | globlastp |
| 1551 | BLFS116 | Environmental sample | 3376 | 2552 | 70.2 | globlastp |
| 1344 | BLFS103 | *Pantoea* sp. | 3179 | 2539 | 94.1 | globlastp |
| 1345 | BLFS103 | unknown sp. | 3180 | 2539 | 89.2 | globlastp |
| 1346 | BLFS103 | *Pantoea* sp. | 3181 | 2539 | 86.5 | globlastp |
| 1347 | BLFS103 | *Photorhabdus* sp. | — | 2539 | 74.65 | glotblastn |
| 1348 | BLFS103 | *Yersinia* sp. | — | 2539 | 74.31 | glotblastn |
| 1349 | BLFS103 | *Serratia* sp. | — | 2539 | 73.96 | glotblastn |
| 1350 | BLFS103 | *Salmonella* sp. | — | 2539 | 73.61 | glotblastn |
| 1351 | BLFS103 | *Salmonella* sp. | — | 2539 | 73.26 | glotblastn |
| 1352 | BLFS103 | *Serratia* sp. | — | 2539 | 73.1 | glotblastn |
| 1353 | BLFS103 | *Yersinia* sp. | 3182 | 2539 | 71.9 | globlastp |
| 1354 | BLFS103 | *Yersinia* sp. | — | 2539 | 71.53 | glotblastn |
| 1355 | BLFS103 | *Serratia* sp. | — | 2539 | 71.18 | glotblastn |
| 1356 | BLFS103 | *Pantoea* sp. | — | 2539 | 70.14 | glotblastn |
| 1668 | BLFS128 | *Pseudomonas* sp. | 3492 | 2563 | 99.3 | globlastp |
| 1669 | BLFS128 | *Pseudomonas* sp. | 3493 | 2563 | 95.2 | globlastp |
| 1670 | BLFS128 | Environmental sample | 3494 | 2563 | 94.3 | globlastp |
| 1671 | BLFS128 | *Pseudomonas* sp. | 3495 | 2563 | 93.3 | globlastp |
| 1672 | BLFS128 | *Pseudomonas* sp. | 3496 | 2563 | 92.9 | globlastp |
| 1673 | BLFS128 | *Pseudomonas* sp. | 3497 | 2563 | 91.7 | globlastp |
| 1674 | BLFS128 | *Pseudomonas* sp. | 3498 | 2563 | 89.2 | globlastp |
| 1675 | BLFS128 | *Pseudomonas* sp. | 3499 | 2563 | 80.1 | globlastp |
| 1676 | BLFS128 | *Pseudomonas* sp. | 3500 | 2563 | 79.5 | globlastp |
| 1677 | BLFS128 | *Pseudomonas* sp. | 3501 | 2563 | 78 | globlastp |
| 1678 | BLFS128 | *Pseudomonas* sp. | 3502 | 2563 | 77 | globlastp |
| 1679 | BLFS128 | *Pseudomonas* sp. | 3503 | 2563 | 76 | globlastp |
| 1680 | BLFS128 | *Pseudomonas* sp. | 3504 | 2563 | 75.7 | globlastp |
| 1681 | BLFS128 | *Erwinia* sp. | 3505 | 2563 | 73 | globlastp |
| 1682 | BLFS128 | *Pseudomonas* sp. | 3506 | 2563 | 72 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 1683 | BLFS128 | Pseudomonas sp. | 3507 | 2563 | 71 | globlastp |
| 1684 | BLFS128 | Pseudomonas sp. | 3508 | 2563 | 70 | globlastp |
| 1937 | BLFS148 | Serratia sp. | 3760 | 2583 | 99.2 | globlastp |
| 1938 | BLFS148 | Serratia sp. | 3761 | 2583 | 98.4 | globlastp |
| 1939 | BLFS148 | Serratia sp. | 3762 | 2583 | 95.2 | globlastp |
| 1940 | BLFS148 | Serratia sp. | 3763 | 2583 | 89.2 | globlastp |
| 1941 | BLFS148 | Serratia sp. | 3764 | 2583 | 87.2 | globlastp |
| 1942 | BLFS148 | Serratia sp. | 3765 | 2583 | 86.4 | globlastp |
| 1943 | BLFS148 | Serratia sp. | 3766 | 2583 | 85.6 | globlastp |
| 1944 | BLFS148 | Yersinia sp. | 3767 | 2583 | 84 | globlastp |
| 1945 | BLFS148 | Yersinia sp. | 3768 | 2583 | 83.2 | globlastp |
| 1946 | BLFS148 | Pantoea sp. | 3769 | 2583 | 82 | globlastp |
| 1947 | BLFS148 | Yersinia sp. | 3770 | 2583 | 81.2 | globlastp |
| 1948 | BLFS148 | Pectobacterium sp. | 3771 | 2583 | 80 | globlastp |
| 1949 | BLFS148 | Pectobacterium sp. | 3772 | 2583 | 79.2 | globlastp |
| 1950 | BLFS148 | Erwinia sp. | 3773 | 2583 | 78 | globlastp |
| 1951 | BLFS148 | Environmental sample | 3774 | 2583 | 77.3 | globlastp |
| 1952 | BLFS148 | Pantoea sp. | 3775 | 2583 | 76 | globlastp |
| 1953 | BLFS148 | Pantoea sp. | 3776 | 2583 | 75 | globlastp |
| 1954 | BLFS148 | Buttiauxella sp. | 3777 | 2583 | 74.2 | globlastp |
| 1955 | BLFS148 | Salmonella sp. | 3778 | 2583 | 73 | globlastp |
| 1956 | BLFS148 | Proteus sp. | 3779 | 2583 | 72 | globlastp |
| 1957 | BLFS148 | Enterobacter.2 sp. | 3780 | 2583 | 71 | globlastp |
| 1958 | BLFS148 | Environmental sample | 3781 | 2583 | 70.2 | globlastp |
| 1959 | BLFS148 | Citrobacter sp. | — | 2583 | 70 | glotblastn |
| 859 | BLFS19 | Bacillus sp. | 2711 | 2462 | 96.4 | globlastp |
| 860 | BLFS19 | Bacillus sp. | 2712 | 2462 | 96.1 | globlastp |
| 861 | BLFS19 | Bacillus sp. | 2713 | 2462 | 95.8 | globlastp |
| 862 | BLFS19 | Bacillus sp. | 2714 | 2462 | 95.5 | globlastp |
| 863 | BLFS19 | Bacillus sp. | 2715 | 2462 | 94.7 | globlastp |
| 864 | BLFS19 | Bacillus sp. | 2716 | 2462 | 92 | globlastp |
| 865 | BLFS19 | Bacillus sp. | 2717 | 2462 | 91.7 | globlastp |
| 988 | BLFS44 | Burkholderia sp. | 2836 | 2485 | 99.4 | globlastp |
| 2095 | ZLFS16 | Collimonas sp. | 3909 | 2613 | 94.5 | globlastp |
| 2096 | ZLFS16 | Collimonas sp. | 3910 | 2613 | 85.1 | globlastp |
| 2097 | ZLFS16 | Herminiimonas sp. | 3911 | 2613 | 74 | globlastp |
| 2098 | ZLFS16 | Duganella sp. | 3912 | 2613 | 73 | globlastp |
| 2099 | ZLFS16 | Janthinobacterium sp. | 3913 | 2613 | 72 | globlastp |
| 2100 | ZLFS16 | Massilia sp. | 3914 | 2613 | 71.2 | globlastp |
| 2101 | ZLFS16 | Oxalobacteraceae sp. | 3915 | 2613 | 70 | globlastp |
| 1893 | BLFS145 | Bacillus sp. | 3716 | 2580 | 99.2 | globlastp |
| 1894 | BLFS145 | Bacillus sp. | 3717 | 2580 | 97.9 | globlastp |
| 1895 | BLFS145 | Bacillus sp. | 3718 | 2580 | 94 | globlastp |
| 1896 | BLFS145 | Bacillus sp. | 3719 | 2580 | 93.2 | globlastp |
| 1897 | BLFS145 | Bacillus sp. | 3720 | 2580 | 92.7 | globlastp |
| 1898 | BLFS145 | Bacillus sp. | 3721 | 2580 | 92.1 | globlastp |
| 1899 | BLFS145 | Bacillus sp. | 3722 | 2580 | 91.1 | globlastp |
| 1900 | BLFS145 | Bacillus sp. | 3723 | 2580 | 84.3 | globlastp |
| 1901 | BLFS145 | Bacillus sp. | 3724 | 2580 | 78.1 | globlastp |
| 1902 | BLFS145 | Bacillus sp. | 3725 | 2580 | 77.5 | globlastp |
| 1903 | BLFS145 | Bacillus sp. | 3726 | 2580 | 74.2 | globlastp |
| 1904 | BLFS145 | Bacillus sp. | 3727 | 2580 | 74 | globlastp |
| 1905 | BLFS145 | Bacillus sp. | 3728 | 2580 | 73.2 | globlastp |
| 1906 | BLFS145 | Bacillus sp. | 3729 | 2580 | 71 | globlastp |
| 1500 | BLFS115 | Pseudomonas sp. | 3326 | 2551 | 98.5 | globlastp |
| 1501 | BLFS115 | Pseudomonas sp. | 3327 | 2551 | 98.3 | globlastp |
| 1502 | BLFS115 | Pseudomonas sp. | 3328 | 2551 | 98.1 | globlastp |
| 1503 | BLFS115 | Pseudomonas sp. | 3329 | 2551 | 97.7 | globlastp |
| 1504 | BLFS115 | Pseudomonas sp. | 3330 | 2551 | 95.2 | globlastp |
| 1505 | BLFS115 | Pseudomonas sp. | 3331 | 2551 | 94.1 | globlastp |
| 1506 | BLFS115 | Pseudomonas sp. | 3332 | 2551 | 93.1 | globlastp |
| 1507 | BLFS115 | Pseudomonas sp. | 3333 | 2551 | 92 | globlastp |
| 1508 | BLFS115 | Environmental sample | 3334 | 2551 | 91 | globlastp |
| 1509 | BLFS115 | Pseudomonas sp. | 3335 | 2551 | 90 | globlastp |
| 1510 | BLFS115 | Pseudomonas sp. | 3336 | 2551 | 89.7 | globlastp |
| 1511 | BLFS115 | Pseudomonas sp. | 3337 | 2551 | 88.1 | globlastp |
| 1512 | BLFS115 | Pseudomonas sp. | 3338 | 2551 | 87.9 | globlastp |
| 1513 | BLFS115 | Pseudomonas sp. | 3339 | 2551 | 86.2 | globlastp |
| 1514 | BLFS115 | Pseudomonas sp. | 3340 | 2551 | 85.2 | globlastp |
| 1515 | BLFS115 | Pseudomonas sp. | 3341 | 2551 | 85.1 | globlastp |
| 1516 | BLFS115 | Pseudomonas sp. | 3342 | 2551 | 84 | globlastp |
| 1517 | BLFS115 | Pseudomonas sp. | 3343 | 2551 | 83.4 | globlastp |
| 1518 | BLFS115 | Pseudomonas sp. | 3344 | 2551 | 82.8 | globlastp |
| 1519 | BLFS115 | Environmental sample | 3345 | 2551 | 80 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 1520 | BLFS115 | Environmental sample | 3346 | 2551 | 79 | globlastp |
| 1521 | BLFS115 | *Pseudomonas* sp. | 3347 | 2551 | 78 | globlastp |
| 1522 | BLFS115 | *Pseudomonas* sp. | 3348 | 2551 | 77 | globlastp |
| 1523 | BLFS115 | *Pseudomonas* sp. | 3349 | 2551 | 76 | globlastp |
| 1524 | BLFS115 | *Pseudomonas* sp. | 3350 | 2551 | 75.2 | globlastp |
| 1525 | BLFS115 | Environmental sample | 3351 | 2551 | 74.2 | globlastp |
| 1526 | BLFS115 | Environmental sample | 3352 | 2551 | 73 | globlastp |
| 1527 | BLFS115 | *Azotobacter* sp. | 3353 | 2551 | 72.1 | globlastp |
| 1528 | BLFS115 | *Pseudomonas* sp. | 3354 | 2551 | 71 | globlastp |
| 1529 | BLFS115 | *Pseudomonas* sp. | — | 2551 | 70.48 | glotblastn |
| 1780 | BLFS135 | *Erwinia* sp. | 3604 | 2570 | 97.6 | globlastp |
| 1781 | BLFS135 | *Pseudomonas* sp. | 3605 | 2570 | 97.2 | globlastp |
| 1782 | BLFS135 | *Pseudomonas* sp. | 3606 | 2570 | 97 | globlastp |
| 1783 | BLFS135 | *Pseudomonas* sp. | 3607 | 2570 | 96.6 | globlastp |
| 1784 | BLFS135 | *Pseudomonas* sp. | 3608 | 2570 | 96.4 | globlastp |
| 1785 | BLFS135 | *Pseudomonas* sp. | 3609 | 2570 | 95.2 | globlastp |
| 1786 | BLFS135 | Environmental sample | 3610 | 2570 | 94.6 | globlastp |
| 1787 | BLFS135 | *Pseudomonas* sp. | 3611 | 2570 | 88.6 | globlastp |
| 1788 | BLFS135 | *Pseudomonas* sp. | 3612 | 2570 | 87.3 | globlastp |
| 1789 | BLFS135 | *Pseudomonas* sp. | 3613 | 2570 | 73 | globlastp |
| 1790 | BLFS135 | *Pseudomonas* sp. | 3614 | 2570 | 72.8 | globlastp |
| 1791 | BLFS135 | *Pseudomonas* sp. | 3615 | 2570 | 70.9 | globlastp |
| 1882 | BLFS144 | *Salinibacillus* sp. | 3705 | 2579 | 99.1 | globlastp |
| 1883 | BLFS144 | *Bacillus* sp. | 3706 | 2579 | 96.9 | globlastp |
| 1884 | BLFS144 | *Bacillus* sp. | 3707 | 2579 | 95.2 | globlastp |
| 1885 | BLFS144 | *Bacillus* sp. | 3708 | 2579 | 94.1 | globlastp |
| 1886 | BLFS144 | *Bacillus* sp. | 3709 | 2579 | 88 | globlastp |
| 1887 | BLFS144 | *Bacillus* sp. | 3710 | 2579 | 87 | globlastp |
| 1888 | BLFS144 | *Bacillus* sp. | 3711 | 2579 | 86.7 | globlastp |
| 1889 | BLFS144 | *Bacillus* sp. | 3712 | 2579 | 85.4 | globlastp |
| 1890 | BLFS144 | *Bacillus* sp. | 3713 | 2579 | 85 | globlastp |
| 1891 | BLFS144 | *Bacillus* sp. | 3714 | 2579 | 84.4 | globlastp |
| 1892 | BLFS144 | *Bacillus* sp. | 3715 | 2579 | 84.1 | globlastp |
| 1063 | BLFS65 | *Duganella* sp. | 2905 | 2505 | 84.5 | globlastp |
| 2424 | ZLFS49 | *Curtobacterium* sp. | 4233 | 2640 | 93.2 | globlastp |
| 2425 | ZLFS49 | *Pantoea* sp. | 4234 | 2640 | 85.7 | globlastp |
| 1811 | BLFS139 | *Salinibacillus* sp. | 3634 | 2574 | 99.4 | globlastp |
| 1812 | BLFS139 | *Salinibacillus* sp. | 3635 | 2574 | 98.8 | globlastp |
| 1813 | BLFS139 | *Bacillus* sp. | 3636 | 2574 | 97.9 | globlastp |
| 1814 | BLFS139 | *Bacillus* sp. | 3637 | 2574 | 93.8 | globlastp |
| 1815 | BLFS139 | *Bacillus* sp. | 3638 | 2574 | 89.5 | globlastp |
| 1816 | BLFS139 | *Bacillus* sp. | 3639 | 2574 | 88 | globlastp |
| 1817 | BLFS139 | *Bacillus* sp. | 3640 | 2574 | 87.3 | globlastp |
| 1818 | BLFS139 | *Bacillus* sp. | 3641 | 2574 | 86.4 | globlastp |
| 1819 | BLFS139 | *Bacillus* sp. | 3642 | 2574 | 85.8 | globlastp |
| 1820 | BLFS139 | *Bacillus* sp. | 3643 | 2574 | 83.9 | globlastp |
| 1821 | BLFS139 | *Bacillus* sp. | 3644 | 2574 | 77.3 | globlastp |
| 1822 | BLFS139 | *Bacillus* sp. | 3645 | 2574 | 76.3 | globlastp |
| 1823 | BLFS139 | *Bacillus* sp. | 3646 | 2574 | 75.1 | globlastp |
| 823 | BLFS14 | Environmental sample | 2675 | 2457 | 95.7 | globlastp |
| 824 | BLFS14 | *Arthrobacter* sp. | 2676 | 2457 | 84 | globlastp |
| 1628 | BLFS125 | *Pseudomonas* sp. | 3452 | 2560 | 96.6 | globlastp |
| 1629 | BLFS125 | *Pseudomonas* sp. | 3453 | 2560 | 87.6 | globlastp |
| 1630 | BLFS125 | *Pseudomonas* sp. | 3454 | 2560 | 86.5 | globlastp |
| 1631 | BLFS125 | *Pseudomonas* sp. | 3455 | 2560 | 85.4 | globlastp |
| 1632 | BLFS125 | *Pseudomonas* sp. | 3456 | 2560 | 84.3 | globlastp |
| 1633 | BLFS125 | Environmental sample | 3457 | 2560 | 83.1 | globlastp |
| 1634 | BLFS125 | *Meta* sp. | 3458 | 2560 | 82 | globlastp |
| 1635 | BLFS125 | *Pseudomonas* sp. | 3459 | 2560 | 80.9 | globlastp |
| 1636 | BLFS125 | *Pseudomonas* sp. | 3460 | 2560 | 79.8 | globlastp |
| 1637 | BLFS125 | *Pseudomonas* sp. | 3461 | 2560 | 78.8 | globlastp |
| 1638 | BLFS125 | *Pseudomonas* sp. | 3462 | 2560 | 78.7 | globlastp |
| 1639 | BLFS125 | Environmental sample | 3463 | 2560 | 77.5 | globlastp |
| 1640 | BLFS125 | Environmental sample | 3464 | 2560 | 76.4 | globlastp |
| 1641 | BLFS125 | Environmental sample | 3465 | 2560 | 75.3 | globlastp |
| 1642 | BLFS125 | Environmental sample | 3466 | 2560 | 74.2 | globlastp |
| 1643 | BLFS125 | Environmental sample | 3467 | 2560 | 73 | globlastp |
| 1181 | BLFS86 | *Paenibacillus* sp. | 3018 | 2522 | 95.1 | globlastp |
| 1182 | BLFS86 | *Paenibacillus* sp. | 3019 | 2522 | 92.7 | globlastp |
| 1183 | BLFS86 | *Paenibacillus* sp. | 3020 | 2522 | 89.2 | globlastp |
| 1184 | BLFS86 | *Paenibacillus* sp. | 3021 | 2522 | 89 | globlastp |
| 1185 | BLFS86 | *Paenibacillus* sp. | 3022 | 2522 | 87.8 | globlastp |
| 1186 | BLFS86 | *Paenibacillus* sp. | 3023 | 2522 | 84.7 | globlastp |
| 1336 | BLFS102 | Environmental sample | 3171 | 2538 | 98.5 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 1337 | BLFS102 | Environmental sample | 3172 | 2538 | 97.1 | globlastp |
| 1338 | BLFS102 | *Pantoea* sp. | 3173 | 2538 | 88.2 | globlastp |
| 1339 | BLFS102 | Environmental sample | 3174 | 2538 | 86.8 | globlastp |
| 1340 | BLFS102 | *Pantoea* sp. | 3175 | 2538 | 85.3 | globlastp |
| 1341 | BLFS102 | *Pantoea* sp. | 3176 | 2538 | 80.9 | globlastp |
| 1342 | BLFS102 | Environmental sample | 3177 | 2538 | 76.5 | globlastp |
| 1343 | BLFS102 | *Pantoea* sp. | 3178 | 2538 | 72.1 | globlastp |
| 909 | BLFS31 | *Bacillus* sp. | 2759 | 2473 | 99.2 | globlastp |
| 910 | BLFS31 | *Bacillus* sp. | 2760 | 2473 | 98.4 | globlastp |
| 911 | BLFS31 | *Streptococcus* sp. | 2761 | 2473 | 97.7 | globlastp |
| 912 | BLFS31 | *Bacillus* sp. | 2762 | 2473 | 96.9 | globlastp |
| 913 | BLFS31 | *Bacillus* sp. | 2763 | 2473 | 96.1 | globlastp |
| 914 | BLFS31 | *Bacillus* sp. | 2764 | 2473 | 95.3 | globlastp |
| 915 | BLFS31 | *Bacillus* sp. | 2765 | 2473 | 93 | globlastp |
| 916 | BLFS31 | *Bacillus* sp. | 2766 | 2473 | 89.1 | globlastp |
| 917 | BLFS31 | *Bacillus* sp. | 2767 | 2473 | 86.9 | globlastp |
| 918 | BLFS31 | *Bacillus* sp. | 2768 | 2473 | 86.2 | globlastp |
| 919 | BLFS31 | *Bacillus* sp. | 2769 | 2473 | 85.4 | globlastp |
| 1437 | BLFS112 | *Pseudomonas* sp. | 3263 | 2548 | 98.8 | globlastp |
| 1438 | BLFS112 | *Pseudomonas* sp. | 3264 | 2548 | 96.8 | globlastp |
| 1439 | BLFS112 | *Pseudomonas* sp. | 3265 | 2548 | 94.7 | globlastp |
| 1440 | BLFS112 | *Pseudomonas* sp. | 3266 | 2548 | 94.3 | globlastp |
| 1441 | BLFS112 | *Pseudomonas* sp. | 3267 | 2548 | 93.1 | globlastp |
| 1442 | BLFS112 | *Pseudomonas* sp. | 3268 | 2548 | 91.8 | globlastp |
| 1443 | BLFS112 | *Pseudomonas* sp. | 3269 | 2548 | 91.4 | globlastp |
| 1444 | BLFS112 | *Pseudomonas* sp. | 3270 | 2548 | 90.2 | globlastp |
| 1445 | BLFS112 | *Pseudomonas* sp. | 3271 | 2548 | 89.4 | globlastp |
| 1446 | BLFS112 | *Pseudomonas* sp. | 3272 | 2548 | 89 | globlastp |
| 1447 | BLFS112 | *Pseudomonas* sp. | 3273 | 2548 | 74.8 | globlastp |
| 1448 | BLFS112 | *Pseudomonas* sp. | 3274 | 2548 | 72.9 | globlastp |
| 1449 | BLFS112 | *Pseudomonas* sp. | 3275 | 2548 | 71.4 | globlastp |
| 2268 | ZLFS32 | *Serratia* sp. | 4082 | 2627 | 99.2 | globlastp |
| 2269 | ZLFS32 | *Serratia* sp. | 4083 | 2627 | 97 | globlastp |
| 2270 | ZLFS32 | *Serratia* sp. | 4084 | 2627 | 96.2 | globlastp |
| 2271 | ZLFS32 | *Serratia* sp. | 4085 | 2627 | 88.1 | globlastp |
| 2272 | ZLFS32 | *Serratia* sp. | 4086 | 2627 | 87 | globlastp |
| 2273 | ZLFS32 | *Serratia* sp. | 4087 | 2627 | 86.1 | globlastp |
| 2274 | ZLFS32 | *Serratia* sp. | 4088 | 2627 | 85 | globlastp |
| 2275 | ZLFS32 | *Serratia* sp. | 4089 | 2627 | 84.6 | globlastp |
| 2276 | ZLFS32 | *Serratia* sp. | 4090 | 2627 | 81.1 | globlastp |
| 2277 | ZLFS32 | *Serratia* sp. | 4091 | 2627 | 80.9 | globlastp |
| 2278 | ZLFS32 | *Serratia* sp. | 4092 | 2627 | 79.5 | globlastp |
| 2279 | ZLFS32 | *Serratia* sp. | 4093 | 2627 | 78.6 | globlastp |
| 2280 | ZLFS32 | *Serratia* sp. | 4094 | 2627 | 74.1 | globlastp |
| 2281 | ZLFS32 | *Serratia* sp. | 4095 | 2627 | 73.7 | globlastp |
| 2282 | ZLFS32 | *Yersinia* sp. | 4096 | 2627 | 72.4 | globlastp |
| 2283 | ZLFS32 | *Pectobacterium* sp. | 4097 | 2627 | 70.1 | globlastp |
| 1793 | BLFS137 | Environmental sample | 3617 | 2572 | 98.2 | globlastp |
| 1794 | BLFS137 | *Rhodococcus* sp. | 3618 | 2572 | 94.7 | globlastp |
| 1795 | BLFS137 | *Rhodococcus* sp. | 3619 | 2572 | 94.3 | globlastp |
| 1796 | BLFS137 | Environmental sample | 3620 | 2572 | 81.1 | globlastp |
| 1797 | BLFS137 | Environmental sample | 3621 | 2572 | 80.8 | globlastp |
| 1292 | BLFS99 | Environmental sample | 3127 | 2535 | 98.9 | globlastp |
| 1293 | BLFS99 | *Pantoea* sp. | 3128 | 2535 | 97.7 | globlastp |
| 1294 | BLFS99 | Environmental sample | 3129 | 2535 | 96.6 | globlastp |
| 1295 | BLFS99 | *Pantoea* sp. | 3130 | 2535 | 93.2 | globlastp |
| 1296 | BLFS99 | *Pantoea* sp. | 3131 | 2535 | 90.9 | globlastp |
| 1297 | BLFS99 | *Pantoea* sp. | 3132 | 2535 | 81.1 | globlastp |
| 1298 | BLFS99 | Environmental sample | 3133 | 2535 | 80 | globlastp |
| 1299 | BLFS99 | *Pantoea* sp. | 3134 | 2535 | 75 | globlastp |
| 1300 | BLFS99 | Environmental sample | 3135 | 2535 | 73.3 | globlastp |
| 1301 | BLFS99 | *Pantoea* sp. | 3136 | 2535 | 72.2 | globlastp |
| 1302 | BLFS99 | *Pantoea* sp. | 3137 | 2535 | 71.6 | globlastp |
| 1303 | BLFS99 | *Pantoea* sp. | 3138 | 2535 | 70.5 | globlastp |
| 1027 | BLFS60 | *Streptomyces* sp. | 2870 | 2500 | 75.2 | globlastp |
| 1028 | BLFS60 | *Streptomyces* sp. | 2871 | 2500 | 72.3 | globlastp |
| 1029 | BLFS60 | *Streptomyces* sp. | 2872 | 2500 | 71.8 | globlastp |
| 2102 | ZLFS17 | Environmental sample | 3916 | 2614 | 73.5 | globlastp |
| 971 | BLFS39 | *Brevibacillus* sp. | 2819 | 2481 | 98.4 | globlastp |
| 972 | BLFS39 | *Brevibacillus* sp. | 2820 | 2481 | 98.1 | globlastp |
| 973 | BLFS39 | *Brevibacillus* sp. | 2821 | 2481 | 97.8 | globlastp |
| 2364 | ZLFS39 | *Serratia* sp. | 4177 | 2634 | 98.8 | globlastp |
| 2365 | ZLFS39 | *Serratia* sp. | 4178 | 2634 | 98.5 | globlastp |
| 2366 | ZLFS39 | *Serratia* sp. | 4179 | 2634 | 98.3 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 2367 | ZLFS39 | *Serratia* sp. | 4180 | 2634 | 92.6 | globlastp |
| 2368 | ZLFS39 | *Serratia* sp. | 4181 | 2634 | 91.4 | globlastp |
| 2369 | ZLFS39 | Multievos46 sp. | 4182 | 2634 | 91.2 | globlastp |
| 2370 | ZLFS39 | *Serratia* sp. | 4183 | 2634 | 91.1 | globlastp |
| 2371 | ZLFS39 | Environmental sample | 4184 | 2634 | 90.9 | globlastp |
| 2372 | ZLFS39 | *Serratia* sp. | 4185 | 2634 | 87.3 | globlastp |
| 2373 | ZLFS39 | *Serratia* sp. | 4186 | 2634 | 87.1 | globlastp |
| 2374 | ZLFS39 | *Serratia* sp. | 4187 | 2634 | 87 | globlastp |
| 2375 | ZLFS39 | *Serratia* sp. | 4188 | 2634 | 86.8 | globlastp |
| 2376 | ZLFS39 | *Serratia* sp. | 4189 | 2634 | 86.7 | globlastp |
| 2377 | ZLFS39 | *Serratia* sp. | 4190 | 2634 | 86.5 | globlastp |
| 2378 | ZLFS39 | Environmental sample | 4191 | 2634 | 86.4 | globlastp |
| 2379 | ZLFS39 | *Serratia* sp. | 4192 | 2634 | 86.2 | globlastp |
| 2380 | ZLFS39 | *Serratia* sp. | 4193 | 2634 | 86.1 | globlastp |
| 2381 | ZLFS39 | *Serratia* sp. | 4194 | 2634 | 85.8 | globlastp |
| 2382 | ZLFS39 | *Serratia* sp. | 4195 | 2634 | 85.6 | globlastp |
| 2383 | ZLFS39 | *Serratia* sp. | 4196 | 2634 | 85.2 | globlastp |
| 2384 | ZLFS39 | *Serratia* sp. | 4197 | 2634 | 85 | globlastp |
| 2385 | ZLFS39 | *Serratia* sp. | 4198 | 2634 | 84.9 | globlastp |
| 2386 | ZLFS39 | *Serratia* sp. | 4199 | 2634 | 84.4 | globlastp |
| 2387 | ZLFS39 | *Serratia* sp. | 4200 | 2634 | 79.6 | globlastp |
| 2388 | ZLFS39 | *Serratia* sp. | 4201 | 2634 | 79.2 | globlastp |
| 2209 | ZLFS29 | *Pseudomonas* sp. | 4023 | 2624 | 95 | globlastp |
| 2210 | ZLFS29 | *Pseudomonas* sp. | 4024 | 2624 | 94.1 | globlastp |
| 2211 | ZLFS29 | *Pseudomonas* sp. | 4025 | 2624 | 93.1 | globlastp |
| 2212 | ZLFS29 | *Pseudomonas* sp. | 4026 | 2624 | 92.2 | globlastp |
| 2213 | ZLFS29 | *Pseudomonas* sp. | 4027 | 2624 | 91.6 | globlastp |
| 2214 | ZLFS29 | *Pseudomonas* sp. | 4028 | 2624 | 90.8 | globlastp |
| 2215 | ZLFS29 | *Pseudomonas* sp. | 4029 | 2624 | 89.1 | globlastp |
| 2216 | ZLFS29 | Environmental sample | 4030 | 2624 | 88.1 | globlastp |
| 2217 | ZLFS29 | *Pseudomonas* sp. | 4031 | 2624 | 87 | globlastp |
| 2218 | ZLFS29 | *Pseudomonas* sp. | 4032 | 2624 | 86.4 | globlastp |
| 2219 | ZLFS29 | *Pseudomonas* sp. | 4033 | 2624 | 85.7 | globlastp |
| 2220 | ZLFS29 | *Pseudomonas* sp. | 4034 | 2624 | 84.1 | globlastp |
| 2221 | ZLFS29 | *Pseudomonas* sp. | 4035 | 2624 | 83 | globlastp |
| 2222 | ZLFS29 | Environmental sample | 4036 | 2624 | 82 | globlastp |
| 2223 | ZLFS29 | Environmental sample | 4037 | 2624 | 81 | globlastp |
| 2224 | ZLFS29 | *Pseudomonas* sp. | 4038 | 2624 | 80.3 | globlastp |
| 2225 | ZLFS29 | Environmental sample | 4039 | 2624 | 79.1 | globlastp |
| 2226 | ZLFS29 | *Pseudomonas* sp. | 4040 | 2624 | 78 | globlastp |
| 2227 | ZLFS29 | Environmental sample | 4041 | 2624 | 77.4 | globlastp |
| 2228 | ZLFS29 | *Pseudomonas* sp. | 4042 | 2624 | 76.1 | globlastp |
| 2229 | ZLFS29 | *Pseudomonas* sp. | 4043 | 2624 | 75.3 | globlastp |
| 2230 | ZLFS29 | *Pseudomonas* sp. | 4044 | 2624 | 74.4 | globlastp |
| 2231 | ZLFS29 | *Pseudomonas* sp. | 4045 | 2624 | 73.4 | globlastp |
| 2232 | ZLFS29 | *Pseudomonas* sp. | 4046 | 2624 | 72.1 | globlastp |
| 2233 | ZLFS29 | *Pseudomonas* sp. | 4047 | 2624 | 71.1 | globlastp |
| 2234 | ZLFS29 | *Pseudomonas* sp. | 4048 | 2624 | 70.2 | globlastp |
| 1986 | BLFS153 | *Streptomyces* sp. | 3803 | 2588 | 98.6 | globlastp |
| 1987 | BLFS153 | *Streptomyces* sp. | 3804 | 2588 | 93.3 | globlastp |
| 1988 | BLFS153 | *Streptomyces* sp. | 3805 | 2588 | 71.7 | globlastp |
| 1989 | BLFS153 | *Streptomyces* sp. | 3806 | 2588 | 70.9 | globlastp |
| 1990 | BLFS153 | *Streptomyces* sp. | — | 2588 | 70.56 | glotblastn |
| 1991 | BLFS153 | *Streptomyces* sp. | 3807 | 2588 | 70.4 | globlastp |
| 1992 | BLFS153 | *Streptomyces* sp. | — | 2588 | 70.36 | glotblastn |
| 1993 | BLFS153 | *Streptomyces* sp. | 3808 | 2588 | 70.1 | globlastp |
| 1994 | BLFS153 | *Streptomyces* sp. | — | 2588 | 70 | glotblastn |
| 2086 | ZLFS12 | *Collimonas* sp. | 3900 | 2609 | 81.4 | globlastp |
| 2087 | ZLFS12 | *Collimonas* sp. | 3901 | 2609 | 81 | globlastp |
| 2088 | ZLFS12 | *Collimonas* sp. | 3902 | 2609 | 73.7 | globlastp |
| 1574 | BLFS120 | *Pseudomonas* sp. | 3399 | 2555 | 97.2 | globlastp |
| 1575 | BLFS120 | *Pseudomonas* sp. | 3400 | 2555 | 84.8 | globlastp |
| 1576 | BLFS120 | *Pseudomonas* sp. | 3401 | 2555 | 75.6 | globlastp |
| 2391 | ZLFS45 | *Streptomyces* sp. | 4204 | 2637 | 98.2 | globlastp |
| 2392 | ZLFS45 | *Streptomyces* sp. | 4205 | 2637 | 97.3 | globlastp |
| 2390 | ZLFS45 | *Streptomyces* sp. | 4203 | 2637 | 96.4 | globlastp |
| 2389 | ZLFS45 | *Streptomyces* sp. | 4202 | 2637 | 94 | globlastp |
| 2397 | ZLFS45 | *Streptomyces* sp. | 4209 | 2637 | 90.2 | globlastp |
| 2394 | ZLFS45 | *Streptomyces* sp. | 4207 | 2637 | 90.2 | globlastp |
| 2395 | ZLFS45 | *Streptomyces* sp. | 4207 | 2637 | 90.2 | globlastp |
| 2393 | ZLFS45 | *Streptomyces* sp. | 4206 | 2637 | 80.4 | globlastp |
| 2423 | ZLFS45 | *Streptomyces* sp. | 4232 | 2637 | 73.2 | globlastp |
| 2398 | ZLFS45 | *Streptomyces* sp. | 4210 | 2637 | 72.6 | globlastp |
| 2396 | ZLFS45 | *Streptomyces* sp. | 4208 | 2637 | 72.6 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 2399 | ZLFS44 | Streptomyces sp. | 4211 | 2636 | 98.7 | globlastp |
| 2400 | ZLFS44 | Streptomyces sp. | 4212 | 2636 | 98.1 | globlastp |
| 2401 | ZLFS44 | Streptomyces sp. | 4213 | 2636 | 96.8 | globlastp |
| 2402 | ZLFS44 | Streptomyces sp. | 4214 | 2636 | 75.8 | globlastp |
| 2403 | ZLFS44 | Streptomyces sp. | 4215 | 2636 | 75.2 | globlastp |
| 2404 | ZLFS44 | Microtetraspora sp. | 4216 | 2636 | 74.7 | globlastp |
| 2405 | ZLFS44 | Streptomyces sp. | 4217 | 2636 | 74.5 | globlastp |
| 2406 | ZLFS44 | Streptomyces sp. | 4218 | 2636 | 74.1 | globlastp |
| 2407 | ZLFS44 | Streptomyces sp. | 4219 | 2636 | 73.9 | globlastp |
| 2408 | ZLFS44 | Streptomyces sp. | — | 2636 | 73.89 | glotblastn |
| 2409 | ZLFS44 | Streptomyces sp. | 4220 | 2636 | 73.4 | globlastp |
| 2410 | ZLFS44 | Streptomyces sp. | 4221 | 2636 | 73.2 | globlastp |
| 2411 | ZLFS44 | Streptomyces sp. | 4222 | 2636 | 72.8 | globlastp |
| 2412 | ZLFS44 | Streptomyces sp. | 4223 | 2636 | 72.6 | globlastp |
| 2413 | ZLFS44 | Streptomyces sp. | 4224 | 2636 | 72.2 | globlastp |
| 2414 | ZLFS44 | Environmental sample | 4225 | 2636 | 72 | globlastp |
| 2415 | ZLFS44 | Streptomyces sp. | — | 2636 | 71.52 | glotblastn |
| 2416 | ZLFS44 | Streptomyces sp. | 4226 | 2636 | 71.5 | globlastp |
| 2417 | ZLFS44 | Streptomyces sp. | 4227 | 2636 | 71.3 | globlastp |
| 2418 | ZLFS44 | Streptomyces sp. | 4228 | 2636 | 71.1 | globlastp |
| 2419 | ZLFS44 | Streptomyces sp. | 4229 | 2636 | 70.8 | globlastp |
| 2420 | ZLFS44 | Streptomyces sp. | 4230 | 2636 | 70.7 | globlastp |
| 2421 | ZLFS44 | Streptomyces sp. | 4231 | 2636 | 70.1 | globlastp |
| 2422 | ZLFS44 | Streptomyces sp. | — | 2636 | 70.06 | glotblastn |
| 1022 | BLFS57 | Duganella sp. | 2865 | 2497 | 99 | globlastp |
| 1023 | BLFS57 | Janthinobacterium sp. | 2866 | 2497 | 98 | globlastp |
| 1024 | BLFS57 | Oxalobacteraceae sp. | 2867 | 2497 | 85.3 | globlastp |
| 1368 | BLFS105 | Pantoea sp. | 3194 | 2541 | 96.2 | globlastp |
| 1369 | BLFS105 | Environmental sample | 3195 | 2541 | 92.4 | globlastp |
| 1370 | BLFS105 | Environmental sample | 3196 | 2541 | 91.7 | globlastp |
| 1371 | BLFS105 | Environmental sample | 3197 | 2541 | 87.9 | globlastp |
| 1372 | BLFS105 | Environmental sample | 3198 | 2541 | 87.1 | globlastp |
| 1373 | BLFS105 | Environmental sample | 3199 | 2541 | 86.4 | globlastp |
| 1374 | BLFS105 | Environmental sample | 3200 | 2541 | 85.7 | globlastp |
| 1375 | BLFS105 | Environmental sample | 3201 | 2541 | 84.8 | globlastp |
| 1376 | BLFS105 | Environmental sample | 3202 | 2541 | 84.1 | globlastp |
| 1377 | BLFS105 | Pantoea sp. | 3203 | 2541 | 82.6 | globlastp |
| 1378 | BLFS105 | Pantoea sp. | 3204 | 2541 | 79.5 | globlastp |
| 1379 | BLFS105 | Erwinia sp. | 3205 | 2541 | 75.8 | globlastp |
| 1380 | BLFS105 | Ewingella sp. | 3206 | 2541 | 74.2 | globlastp |
| 1267 | BLFS95 | Paenibacillus sp. | 3102 | 2531 | 97.4 | globlastp |
| 1268 | BLFS95 | Paenibacillus sp. | 3103 | 2531 | 96.1 | globlastp |
| 1269 | BLFS95 | Paenibacillus sp. | 3104 | 2531 | 90.8 | globlastp |
| 1270 | BLFS95 | Paenibacillus sp. | 3105 | 2531 | 90.2 | globlastp |
| 1271 | BLFS95 | Paenibacillus sp. | 3106 | 2531 | 89.5 | globlastp |
| 1272 | BLFS95 | Paenibacillus sp. | 3107 | 2531 | 88.2 | globlastp |
| 1273 | BLFS95 | Paenibacillus sp. | 3108 | 2531 | 78.4 | globlastp |
| 1274 | BLFS95 | Paenibacillus sp. | 3109 | 2531 | 77.8 | globlastp |
| 1275 | BLFS95 | Paenibacillus sp. | 3110 | 2531 | 75.2 | globlastp |
| 967 | BLFS37 | Brevibacillus sp. | 2816 | 2479 | 99.1 | globlastp |
| 968 | BLFS37 | Brevibacillus sp. | 2817 | 2479 | 98.2 | globlastp |
| 969 | BLFS37 | Brevibacillus sp. | — | 2479 | 97.35 | glotblastn |
| 1570 | BLFS119 | Pseudomonas sp. | 3395 | 2554 | 96.2 | globlastp |
| 1571 | BLFS119 | Pseudomonas sp. | 3396 | 2554 | 95 | globlastp |
| 1572 | BLFS119 | Pseudomonas sp. | 3397 | 2554 | 92.5 | globlastp |
| 1573 | BLFS119 | Pseudomonas sp. | 3398 | 2554 | 91.2 | globlastp |
| 2284 | ZLFS33 | Serratia sp. | 4098 | 2628 | 99.2 | globlastp |
| 2285 | ZLFS33 | Serratia sp. | 4099 | 2628 | 96.4 | globlastp |
| 1025 | BLFS58 | Janthinobacterium sp. | 2868 | 2498 | 97.4 | globlastp |
| 1026 | BLFS58 | Oxalobacteraceae sp. | 2869 | 2498 | 83.5 | globlastp |
| 2002 | PUB6 | Bacillus sp. | 3816 | 2595 | 98.6 | globlastp |
| 2003 | PUB6 | Bacillus sp. | 3817 | 2595 | 98.5 | globlastp |
| 2004 | PUB6 | Bacillus sp. | 3818 | 2595 | 98.4 | globlastp |
| 2005 | PUB6 | Bacillus sp. | 3819 | 2595 | 97.9 | globlastp |
| 2006 | PUB6 | Bacillus sp. | 3820 | 2595 | 96.1 | globlastp |
| 2007 | PUB6 | Bacillus sp. | 3821 | 2595 | 94.7 | globlastp |
| 2008 | PUB6 | Bacillus sp. | 3822 | 2595 | 94.2 | globlastp |
| 2009 | PUB6 | Bacillus sp. | 3823 | 2595 | 93.2 | globlastp |
| 2010 | PUB6 | Bacillus sp. | 3824 | 2595 | 92.6 | globlastp |
| 2011 | PUB6 | Bacillus sp. | 3825 | 2595 | 92.1 | globlastp |
| 792 | BLFS5 | Streptomyces sp. | 2644 | 2448 | 76.4 | globlastp |
| 793 | BLFS5 | Streptomyces sp. | 2645 | 2448 | 75.5 | globlastp |
| 794 | BLFS5 | Kitasatospora sp. | 2646 | 2448 | 74.5 | globlastp |
| 795 | BLFS5 | Kitasatospora sp. | 2647 | 2448 | 73.8 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 796 | BLFS5 | Streptomyces sp. | 2648 | 2448 | 73.2 | globlastp |
| 797 | BLFS5 | Kitasatospora sp. | 2649 | 2448 | 72 | globlastp |
| 798 | BLFS5 | Streptomyces sp. | 2650 | 2448 | 71.5 | globlastp |
| 799 | BLFS5 | Streptomyces sp. | 2651 | 2448 | 70.1 | globlastp |
| 989 | BLFS45 | Burkholderia sp. | 2837 | 2486 | 97.9 | globlastp |
| 990 | BLFS45 | Environmental sample | 2838 | 2486 | 82.3 | globlastp |
| 991 | BLFS45 | Burkholderia sp. | 2839 | 2486 | 81.1 | globlastp |
| 992 | BLFS45 | Burkholderia sp. | 2840 | 2486 | 80.2 | globlastp |
| 993 | BLFS45 | Burkholderia sp. | 2841 | 2486 | 79.9 | globlastp |
| 994 | BLFS45 | Burkholderia sp. | 2842 | 2486 | 76.1 | globlastp |
| 995 | BLFS45 | Burkholderia sp. | 2843 | 2486 | 75.2 | globlastp |
| 996 | BLFS45 | Burkholderia sp. | 2844 | 2486 | 74.6 | globlastp |
| 1304 | BLFS100 | Environmental sample | 3139 | 2536 | 98.9 | globlastp |
| 1305 | BLFS100 | Environmental sample | 3140 | 2536 | 97.7 | globlastp |
| 1306 | BLFS100 | Pantoea sp. | 3141 | 2536 | 96.6 | globlastp |
| 1307 | BLFS100 | Environmental sample | 3142 | 2536 | 95.4 | globlastp |
| 1308 | BLFS100 | Pantoea sp. | 3143 | 2536 | 94.3 | globlastp |
| 1309 | BLFS100 | Pantoea sp. | 3144 | 2536 | 88.5 | globlastp |
| 1310 | BLFS100 | Environmental sample | 3145 | 2536 | 87.4 | globlastp |
| 1311 | BLFS100 | Pantoea sp. | 3146 | 2536 | 85.1 | globlastp |
| 1312 | BLFS100 | Pantoea sp. | 3147 | 2536 | 83.9 | globlastp |
| 1313 | BLFS100 | Pantoea sp. | 3148 | 2536 | 81.8 | globlastp |
| 1314 | BLFS100 | Pantoea sp. | 3149 | 2536 | 80.7 | globlastp |
| 1315 | BLFS100 | Pantoea sp. | 3150 | 2536 | 78.4 | globlastp |
| 1316 | BLFS100 | Pantoea sp. | 3151 | 2536 | 76.1 | globlastp |
| 1317 | BLFS100 | Pantoea sp. | 3152 | 2536 | 74.4 | globlastp |
| 1318 | BLFS100 | Plautia sp. | 3153 | 2536 | 71 | globlastp |
| 1319 | BLFS100 | Erwinia sp. | 3154 | 2536 | 70.1 | globlastp |
| 1218 | BLFS90 | Paenibacillus sp. | 3053 | 2526 | 99.3 | globlastp |
| 1219 | BLFS90 | Paenibacillus sp. | 3054 | 2526 | 98.9 | globlastp |
| 1220 | BLFS90 | Paenibacillus sp. | 3055 | 2526 | 96.1 | globlastp |
| 1221 | BLFS90 | Paenibacillus sp. | 3056 | 2526 | 95.4 | globlastp |
| 1222 | BLFS90 | Paenibacillus sp. | 3057 | 2526 | 93.6 | globlastp |
| 1223 | BLFS90 | Paenibacillus sp. | 3058 | 2526 | 92.1 | globlastp |
| 1224 | BLFS90 | Paenibacillus sp. | 3059 | 2526 | 91.4 | globlastp |
| 1225 | BLFS90 | Paenibacillus sp. | 3060 | 2526 | 90.7 | globlastp |
| 1226 | BLFS90 | Paenibacillus sp. | 3061 | 2526 | 72.9 | globlastp |
| 1011 | BLFS55 | Janthinobacterium sp. | 2857 | 2495 | 95.5 | globlastp |
| 1012 | BLFS55 | Duganella sp. | 2858 | 2495 | 78.5 | globlastp |
| 2306 | ZLFS35 | Serratia sp. | 4120 | 2630 | 99 | globlastp |
| 2307 | ZLFS35 | Serratia sp. | 4121 | 2630 | 98.8 | globlastp |
| 2308 | ZLFS35 | Serratia sp. | 4122 | 2630 | 98.1 | globlastp |
| 2309 | ZLFS35 | Serratia sp. | 4123 | 2630 | 88.3 | globlastp |
| 2310 | ZLFS35 | Serratia sp. | 4124 | 2630 | 73.2 | globlastp |
| 1152 | BLFS83 | Paenibacillus sp. | 2989 | 2519 | 99 | globlastp |
| 1153 | BLFS83 | Paenibacillus sp. | 2990 | 2519 | 97.4 | globlastp |
| 1154 | BLFS83 | Paenibacillus sp. | 2991 | 2519 | 97 | globlastp |
| 1155 | BLFS83 | Paenibacillus sp. | 2992 | 2519 | 96.4 | globlastp |
| 1156 | BLFS83 | Paenibacillus sp. | 2993 | 2519 | 95 | globlastp |
| 1157 | BLFS83 | Paenibacillus sp. | 2994 | 2519 | 94.3 | globlastp |
| 1158 | BLFS83 | Paenibacillus sp. | 2995 | 2519 | 93.2 | globlastp |
| 1159 | BLFS83 | Paenibacillus sp. | 2996 | 2519 | 92.3 | globlastp |
| 1160 | BLFS83 | Paenibacillus sp. | 2997 | 2519 | 80.6 | globlastp |
| 1161 | BLFS83 | Paenibacillus sp. | 2998 | 2519 | 80 | globlastp |
| 1162 | BLFS83 | Paenibacillus sp. | 2999 | 2519 | 79.6 | globlastp |
| 870 | BLFS21 | Bacillus sp. | 2722 | 2464 | 99.3 | globlastp |
| 871 | BLFS21 | Bacillus sp. | 2723 | 2464 | 83.1 | globlastp |
| 872 | BLFS21 | Bacillus sp. | 2724 | 2464 | 79.7 | globlastp |
| 873 | BLFS21 | Bacillus sp. | 2725 | 2464 | 71.3 | globlastp |
| 874 | BLFS21 | Bacillus sp. | 2726 | 2464 | 70.5 | globlastp |
| 875 | BLFS21 | Bacillus sp. | — | 2464 | 70.23 | glotblastn |
| 876 | BLFS21 | Bacillus sp. | 2727 | 2464 | 70.2 | globlastp |
| 877 | BLFS21 | Bacillus sp. | — | 2464 | 70.14 | glotblastn |
| 1685 | BLFS129 | Pseudomonas sp. | 3509 | 2564 | 95.4 | globlastp |
| 1686 | BLFS129 | Pseudomonas sp. | 3510 | 2564 | 95 | globlastp |
| 1687 | BLFS129 | Pseudomonas sp. | 3511 | 2564 | 94.5 | globlastp |
| 1688 | BLFS129 | Pseudomonas sp. | 3512 | 2564 | 93.1 | globlastp |
| 1689 | BLFS129 | Pseudomonas sp. | 3513 | 2564 | 91.3 | globlastp |
| 1690 | BLFS129 | Pseudomonas sp. | 3514 | 2564 | 90.8 | globlastp |
| 1691 | BLFS129 | Environmental sample | 3515 | 2564 | 87.6 | globlastp |
| 1692 | BLFS129 | Pseudomonas sp. | 3516 | 2564 | 83.9 | globlastp |
| 1693 | BLFS129 | Pseudomonas sp. | 3517 | 2564 | 79.8 | globlastp |
| 1694 | BLFS129 | Pseudomonas sp. | 3518 | 2564 | 76.6 | globlastp |
| 1695 | BLFS129 | Pseudomonas sp. | 3519 | 2564 | 76.1 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 920 | BLFS32 | *Bacillus* sp. | 2770 | 2474 | 99 | globlastp |
| 921 | BLFS32 | *Bacillus* sp. | 2771 | 2474 | 98 | globlastp |
| 922 | BLFS32 | *Bacillus* sp. | 2772 | 2474 | 97.6 | globlastp |
| 923 | BLFS32 | *Bacillus* sp. | 2773 | 2474 | 90.3 | globlastp |
| 924 | BLFS32 | *Bacillus* sp. | 2774 | 2474 | 89.3 | globlastp |
| 925 | BLFS32 | *Salinibacillus* sp. | 2775 | 2474 | 88.3 | globlastp |
| 926 | BLFS32 | *Bacillus* sp. | 2776 | 2474 | 87.6 | globlastp |
| 927 | BLFS32 | *Bacillus* sp. | 2777 | 2474 | 81.3 | globlastp |
| 928 | BLFS32 | *Bacillus* sp. | 2778 | 2474 | 80.2 | globlastp |
| 929 | BLFS32 | *Bacillus* sp. | 2779 | 2474 | 79.5 | globlastp |
| 930 | BLFS32 | *Bacillus* sp. | 2780 | 2474 | 76.8 | globlastp |
| 931 | BLFS32 | *Bacillus* sp. | 2781 | 2474 | 75.2 | globlastp |
| 932 | BLFS32 | *Bacillus* sp. | 2782 | 2474 | 74.7 | globlastp |
| 933 | BLFS32 | *Bacillus* sp. | 2783 | 2474 | 73.2 | globlastp |
| 934 | BLFS32 | *Cohnella* sp. | 2784 | 2474 | 72.2 | globlastp |
| 935 | BLFS32 | *Paenibacillus* sp. | 2785 | 2474 | 71.5 | globlastp |
| 936 | BLFS32 | *Bacillus* sp. | 2786 | 2474 | 70.1 | globlastp |
| 1798 | BLFS138 | *Bacillus* sp. | 3622 | 2573 | 98.7 | globlastp |
| 1799 | BLFS138 | *Bacillus* sp. | 3623 | 2573 | 82.2 | globlastp |
| 1800 | BLFS138 | *Bacillus* sp. | 3624 | 2573 | 81 | globlastp |
| 1801 | BLFS138 | *Bacillus* sp. | 3625 | 2573 | 80.1 | globlastp |
| 1802 | BLFS138 | *Bacillus* sp. | 3626 | 2573 | 79.4 | globlastp |
| 1803 | BLFS138 | *Bacillus* sp. | 3627 | 2573 | 78.2 | globlastp |
| 1804 | BLFS138 | *Bacillus* sp. | 3628 | 2573 | 77.1 | globlastp |
| 1805 | BLFS138 | *Bacillus* sp. | 3629 | 2573 | 76.1 | globlastp |
| 1806 | BLFS138 | *Bacillus* sp. | 3630 | 2573 | 74.3 | globlastp |
| 1807 | BLFS138 | *Bacillus* sp. | 3631 | 2573 | 73.6 | globlastp |
| 1808 | BLFS138 | *Bacillus* sp. | 3632 | 2573 | 72.5 | globlastp |
| 1809 | BLFS138 | *Bacillus* sp. | 3633 | 2573 | 71.1 | globlastp |
| 1810 | BLFS138 | *Bacillus* sp. | — | 2573 | 70 | glotblastn |
| 2103 | ZLFS18 | Environmental sample | 3917 | 2615 | 75.5 | globlastp |
| 1999 | BLFS158 | *Bacillus* sp. | 3813 | 2593 | 73.8 | globlastp |
| 1857 | BLFS142 | *Bacillus* sp. | 3680 | 2577 | 98.1 | globlastp |
| 1858 | BLFS142 | *Bacillus* sp. | 3681 | 2577 | 96.7 | globlastp |
| 1859 | BLFS142 | *Bacillus* sp. | 3682 | 2577 | 89 | globlastp |
| 1860 | BLFS142 | *Bacillus* sp. | 3683 | 2577 | 88.5 | globlastp |
| 1861 | BLFS142 | *Bacillus* sp. | 3684 | 2577 | 85.2 | globlastp |
| 1862 | BLFS142 | *Bacillus* sp. | 3685 | 2577 | 84.2 | globlastp |
| 1863 | BLFS142 | *Bacillus* sp. | 3686 | 2577 | 83.3 | globlastp |
| 1864 | BLFS142 | *Bacillus* sp. | 3687 | 2577 | 82.3 | globlastp |
| 1865 | BLFS142 | *Bacillus* sp. | 3688 | 2577 | 80.4 | globlastp |
| 1866 | BLFS142 | *Bacillus* sp. | 3689 | 2577 | 79.3 | globlastp |
| 1867 | BLFS142 | *Bacillus* sp. | 3690 | 2577 | 77.1 | globlastp |
| 1247 | BLFS93 | *Paenibacillus* sp. | 3082 | 2529 | 98.9 | globlastp |
| 1248 | BLFS93 | *Paenibacillus* sp. | 3083 | 2529 | 98.3 | globlastp |
| 1249 | BLFS93 | *Paenibacillus* sp. | 3084 | 2529 | 97.7 | globlastp |
| 1250 | BLFS93 | *Paenibacillus* sp. | 3085 | 2529 | 96 | globlastp |
| 1251 | BLFS93 | *Paenibacillus* sp. | 3086 | 2529 | 95.4 | globlastp |
| 1252 | BLFS93 | *Paenibacillus* sp. | 3087 | 2529 | 94.9 | globlastp |
| 1253 | BLFS93 | *Paenibacillus* sp. | 3088 | 2529 | 93.1 | globlastp |
| 1254 | BLFS93 | *Paenibacillus* sp. | 3089 | 2529 | 77 | globlastp |
| 1255 | BLFS93 | *Paenibacillus* sp. | 3090 | 2529 | 75.9 | globlastp |
| 1256 | BLFS93 | *Paenibacillus* sp. | 3091 | 2529 | 74.1 | globlastp |
| 1257 | BLFS93 | *Paenibacillus* sp. | 3092 | 2529 | 72.6 | globlastp |
| 2341 | ZLFS38 | *Serratia* sp. | 4154 | 2633 | 98.7 | globlastp |
| 2342 | ZLFS38 | *Serratia* sp. | 4155 | 2633 | 96.2 | globlastp |
| 2343 | ZLFS38 | *Serratia* sp. | 4156 | 2633 | 95 | globlastp |
| 2344 | ZLFS38 | *Serratia* sp. | 4157 | 2633 | 94.3 | globlastp |
| 2345 | ZLFS38 | *Serratia* sp. | 4158 | 2633 | 93.1 | globlastp |
| 2346 | ZLFS38 | *Serratia* sp. | 4159 | 2633 | 92.5 | globlastp |
| 2347 | ZLFS38 | *Pectobacterium* sp. | 4160 | 2633 | 89.3 | globlastp |
| 2348 | ZLFS38 | *Hafnia* sp. | 4161 | 2633 | 88.1 | globlastp |
| 2349 | ZLFS38 | *Dickeya* sp. | 4162 | 2633 | 87.4 | globlastp |
| 2350 | ZLFS38 | *Dickeya* sp. | 4163 | 2633 | 86.2 | globlastp |
| 2351 | ZLFS38 | *Enterobacter* sp. | 4164 | 2633 | 85 | globlastp |
| 2352 | ZLFS38 | *Achromobacter* sp. | 4165 | 2633 | 84.3 | globlastp |
| 2353 | ZLFS38 | Environmental sample | 4166 | 2633 | 83 | globlastp |
| 2354 | ZLFS38 | *Serratia* sp. | 4167 | 2633 | 82.2 | globlastp |
| 2355 | ZLFS38 | Environmental sample | 4168 | 2633 | 81.1 | globlastp |
| 2356 | ZLFS38 | Environmental sample | 4169 | 2633 | 80 | globlastp |
| 2357 | ZLFS38 | *Cronobacter* sp. | 4170 | 2633 | 79.5 | globlastp |
| 2358 | ZLFS38 | *Enterobacter* sp. | 4171 | 2633 | 78.1 | globlastp |
| 2359 | ZLFS38 | *Arsenophonus* sp. | 4172 | 2633 | 77.4 | globlastp |
| 2360 | ZLFS38 | *Pantoea* sp. | 4173 | 2633 | 76.1 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 2361 | ZLFS38 | Vibrio sp. | 4174 | 2633 | 72 | globlastp |
| 2362 | ZLFS38 | Sodalis sp. | 4175 | 2633 | 71 | globlastp |
| 2363 | ZLFS38 | Vibrio sp. | 4176 | 2633 | 70 | globlastp |
| 803 | BLFS9 | Amycolatopsis sp. | 2655 | 2452 | 92.3 | globlastp |
| 804 | BLFS9 | Amycolatopsis sp. | 2656 | 2452 | 78.6 | globlastp |
| 805 | BLFS9 | Streptomyces sp. | 2657 | 2452 | 71.8 | globlastp |
| 806 | BLFS9 | Streptomyces sp. | 2658 | 2452 | 71.4 | globlastp |
| 807 | BLFS9 | Streptomyces sp. | 2659 | 2452 | 70.9 | globlastp |
| 808 | BLFS9 | Streptomyces sp. | 2660 | 2452 | 70.1 | globlastp |
| 1090 | BLFS74 | Paenibacillus sp. | 2930 | 2512 | 99.4 | globlastp |
| 1091 | BLFS74 | Paenibacillus sp. | 2931 | 2512 | 99.1 | globlastp |
| 1092 | BLFS74 | Paenibacillus sp. | 2932 | 2512 | 98.6 | globlastp |
| 1093 | BLFS74 | Paenibacillus sp. | 2933 | 2512 | 97.4 | globlastp |
| 1094 | BLFS74 | Paenibacillus sp. | 2934 | 2512 | 97.1 | globlastp |
| 1095 | BLFS74 | Paenibacillus sp. | 2935 | 2512 | 96 | globlastp |
| 1096 | BLFS74 | Paenibacillus sp. | 2936 | 2512 | 95.7 | globlastp |
| 1097 | BLFS74 | Paenibacillus sp. | 2937 | 2512 | 95.4 | globlastp |
| 1098 | BLFS74 | Paenibacillus sp. | 2938 | 2512 | 92.2 | globlastp |
| 1099 | BLFS74 | Paenibacillus sp. | 2939 | 2512 | 91.7 | globlastp |
| 1100 | BLFS74 | Paenibacillus sp. | 2940 | 2512 | 90.5 | globlastp |
| 1101 | BLFS74 | Paenibacillus sp. | 2941 | 2512 | 89.7 | globlastp |
| 1102 | BLFS74 | Paenibacillus sp. | 2942 | 2512 | 89.1 | globlastp |
| 1103 | BLFS74 | Paenibacillus sp. | 2943 | 2512 | 87.1 | globlastp |
| 2140 | ZLFS23 | Curtobacterium sp. | 3954 | 2619 | 95.8 | globlastp |
| 2141 | ZLFS23 | Curtobacterium sp. | 3955 | 2619 | 95.4 | globlastp |
| 2142 | ZLFS23 | Curtobacterium sp. | 3956 | 2619 | 90.5 | globlastp |
| 2143 | ZLFS23 | Curtobacterium sp. | 3957 | 2619 | 80.5 | globlastp |
| 2144 | ZLFS23 | Environmental sample | 3958 | 2619 | 76.3 | globlastp |
| 2145 | ZLFS23 | Environmental sample | 3959 | 2619 | 74.5 | globlastp |
| 2146 | ZLFS23 | Environmental sample | 3960 | 2619 | 71.8 | globlastp |
| 1420 | BLFS108 | Pantoea sp. | 3246 | 2544 | 99.1 | globlastp |
| 1421 | BLFS108 | Environmental sample | 3247 | 2544 | 98.3 | globlastp |
| 1422 | BLFS108 | Klebsiella sp. | 3248 | 2544 | 76.9 | globlastp |
| 1423 | BLFS108 | Citrobacter sp. | 3249 | 2544 | 76.1 | globlastp |
| 1424 | BLFS108 | Meta sp. | 3250 | 2544 | 75.2 | globlastp |
| 1425 | BLFS108 | Environmental sample | 3251 | 2544 | 74.4 | globlastp |
| 1426 | BLFS108 | Salmonella sp. | 3252 | 2544 | 73.5 | globlastp |
| 1427 | BLFS108 | Escherichia sp. | 3253 | 2544 | 72 | globlastp |
| 1428 | BLFS108 | Kluyvera sp. | 3254 | 2544 | 71.8 | globlastp |
| 2311 | ZLFS36 | Serratia sp. | 4125 | 2631 | 99.2 | globlastp |
| 2170 | ZLFS27 | Pseudomonas sp. | 3984 | 2622 | 93 | globlastp |
| 2171 | ZLFS27 | Pseudomonas sp. | 3985 | 2622 | 92 | globlastp |
| 2172 | ZLFS27 | Pseudomonas sp. | 3986 | 2622 | 91 | globlastp |
| 2173 | ZLFS27 | Pseudomonas sp. | 3987 | 2622 | 90.8 | globlastp |
| 2174 | ZLFS27 | Pseudomonas sp. | 3988 | 2622 | 89 | globlastp |
| 2175 | ZLFS27 | Pseudomonas sp. | 3989 | 2622 | 88 | globlastp |
| 2176 | ZLFS27 | Pseudomonas sp. | 3990 | 2622 | 87.1 | globlastp |
| 2177 | ZLFS27 | Pseudomonas sp. | 3991 | 2622 | 86.1 | globlastp |
| 2178 | ZLFS27 | Pseudomonas sp. | 3992 | 2622 | 85.1 | globlastp |
| 2179 | ZLFS27 | Pseudomonas sp. | 3993 | 2622 | 84.1 | globlastp |
| 2180 | ZLFS27 | Pseudomonas sp. | 3994 | 2622 | 83.1 | globlastp |
| 2181 | ZLFS27 | Pseudomonas sp. | 3995 | 2622 | 82.4 | globlastp |
| 2182 | ZLFS27 | Pseudomonas sp. | 3996 | 2622 | 81.9 | globlastp |
| 2183 | ZLFS27 | Pseudomonas sp. | 3997 | 2622 | 79.1 | globlastp |
| 2184 | ZLFS27 | Pseudomonas sp. | 3998 | 2622 | 78 | globlastp |
| 2185 | ZLFS27 | Pseudomonas sp. | 3999 | 2622 | 77.1 | globlastp |
| 2186 | ZLFS27 | Pseudomonas sp. | 4000 | 2622 | 75.9 | globlastp |
| 2187 | ZLFS27 | Pseudomonas sp. | 4001 | 2622 | 75.3 | globlastp |
| 2188 | ZLFS27 | Pseudomonas sp. | 4002 | 2622 | 74.2 | globlastp |
| 2189 | ZLFS27 | Pseudomonas sp. | 4003 | 2622 | 73.8 | globlastp |
| 2190 | ZLFS27 | Environmental sample | 4004 | 2622 | 72 | globlastp |
| 2191 | ZLFS27 | Pseudomonas sp. | 4005 | 2622 | 71.5 | globlastp |
| 2192 | ZLFS27 | Pseudomonas sp. | 4006 | 2622 | 70.3 | globlastp |
| 2193 | ZLFS27 | Pseudomonas sp. | 4007 | 2622 | 70.1 | globlastp |
| 1824 | BLFS140 | Salinibacillus sp. | 3647 | 2575 | 99.4 | globlastp |
| 1825 | BLFS140 | Bacillus sp. | 3648 | 2575 | 98.4 | globlastp |
| 1826 | BLFS140 | Bacillus sp. | 3649 | 2575 | 95.6 | globlastp |
| 1827 | BLFS140 | Bacillus sp. | 3650 | 2575 | 88 | globlastp |
| 1828 | BLFS140 | Bacillus sp. | 3651 | 2575 | 87.1 | globlastp |
| 1829 | BLFS140 | Bacillus sp. | 3652 | 2575 | 86.1 | globlastp |
| 1830 | BLFS140 | Bacillus sp. | 3653 | 2575 | 85.2 | globlastp |
| 1831 | BLFS140 | Bacillus sp. | 3654 | 2575 | 85 | globlastp |
| 1832 | BLFS140 | Bacillus sp. | 3655 | 2575 | 84.9 | globlastp |
| 1833 | BLFS140 | Bacillus sp. | 3656 | 2575 | 84.7 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 1834 | BLFS140 | *Bacillus* sp. | 3657 | 2575 | 81.6 | globlastp |
| 1835 | BLFS140 | *Bacillus* sp. | 3658 | 2575 | 81.5 | globlastp |
| 1836 | BLFS140 | *Bacillus* sp. | 3659 | 2575 | 74 | globlastp |
| 1837 | BLFS140 | *Bacillus* sp. | 3660 | 2575 | 73.8 | globlastp |
| 2102 | ZLFS48 | Environmental sample | 3916 | 2639 | 79.4 | globlastp |
| 982 | BLFS42 | *Burkholderia* sp. | 2830 | 2483 | 97.6 | globlastp |
| 983 | BLFS42 | *Burkholderia* sp. | 2831 | 2483 | 97.2 | globlastp |
| 1927 | BLFS147 | *Salinibacillus* sp. | 3750 | 2582 | 98.9 | globlastp |
| 1928 | BLFS147 | *Bacillus* sp. | 3751 | 2582 | 97.7 | globlastp |
| 1929 | BLFS147 | *Bacillus* sp. | 3752 | 2582 | 95.7 | globlastp |
| 1930 | BLFS147 | *Bacillus* sp. | 3753 | 2582 | 88 | globlastp |
| 1931 | BLFS147 | *Bacillus* sp. | 3754 | 2582 | 87.3 | globlastp |
| 1932 | BLFS147 | *Bacillus* sp. | 3755 | 2582 | 86 | globlastp |
| 1933 | BLFS147 | *Bacillus* sp. | 3756 | 2582 | 85 | globlastp |
| 1934 | BLFS147 | *Bacillus* sp. | 3757 | 2582 | 84.8 | globlastp |
| 1935 | BLFS147 | *Bacillus* sp. | 3758 | 2582 | 74.1 | globlastp |
| 1936 | BLFS147 | *Bacillus* sp. | 3759 | 2582 | 73.9 | globlastp |
| 1170 | BLFS85 | *Paenibacillus* sp. | 3007 | 2521 | 99.4 | globlastp |
| 1171 | BLFS85 | *Paenibacillus* sp. | 3008 | 2521 | 98.3 | globlastp |
| 1172 | BLFS85 | *Paenibacillus* sp. | 3009 | 2521 | 97.6 | globlastp |
| 1173 | BLFS85 | *Paenibacillus* sp. | 3010 | 2521 | 97 | globlastp |
| 1174 | BLFS85 | *Paenibacillus* sp. | 3011 | 2521 | 96.6 | globlastp |
| 1175 | BLFS85 | *Paenibacillus* sp. | 3012 | 2521 | 95.3 | globlastp |
| 1176 | BLFS85 | *Paenibacillus* sp. | 3013 | 2521 | 93.2 | globlastp |
| 1177 | BLFS85 | *Paenibacillus* sp. | 3014 | 2521 | 92.7 | globlastp |
| 1178 | BLFS85 | *Paenibacillus* sp. | 3015 | 2521 | 91 | globlastp |
| 1179 | BLFS85 | *Paenibacillus* sp. | 3016 | 2521 | 90.4 | globlastp |
| 1180 | BLFS85 | *Paenibacillus* sp. | 3017 | 2521 | 89.1 | globlastp |
| 1552 | BLFS118 | *Pseudomonas* sp. | 3377 | 2553 | 98.8 | globlastp |
| 1553 | BLFS118 | *Pseudomonas* sp. | 3378 | 2553 | 98.5 | globlastp |
| 1554 | BLFS118 | *Pseudomonas* sp. | 3379 | 2553 | 98.2 | globlastp |
| 1555 | BLFS118 | *Pseudomonas* sp. | 3380 | 2553 | 97.7 | globlastp |
| 1556 | BLFS118 | *Pseudomonas* sp. | 3381 | 2553 | 97.1 | globlastp |
| 1557 | BLFS118 | *Pseudomonas* sp. | 3382 | 2553 | 96.8 | globlastp |
| 1558 | BLFS118 | *Pseudomonas* sp. | 3383 | 2553 | 96.2 | globlastp |
| 1559 | BLFS118 | *Pseudomonas* sp. | 3384 | 2553 | 88 | globlastp |
| 1560 | BLFS118 | *Pseudomonas* sp. | 3385 | 2553 | 85.9 | globlastp |
| 1561 | BLFS118 | *Pseudomonas* sp. | 3386 | 2553 | 78 | globlastp |
| 1562 | BLFS118 | *Pseudomonas* sp. | 3387 | 2553 | 77.1 | globlastp |
| 1563 | BLFS118 | *Pseudomonas* sp. | 3388 | 2553 | 76 | globlastp |
| 1564 | BLFS118 | Environmental sample | 3389 | 2553 | 75.1 | globlastp |
| 1565 | BLFS118 | *Pseudomonas* sp. | 3390 | 2553 | 74 | globlastp |
| 1566 | BLFS118 | *Pseudomonas* sp. | 3391 | 2553 | 73 | globlastp |
| 1567 | BLFS118 | *Pseudomonas* sp. | 3392 | 2553 | 72.1 | globlastp |
| 1568 | BLFS118 | Environmental sample | 3393 | 2553 | 71 | globlastp |
| 1569 | BLFS118 | *Pseudomonas* sp. | 3394 | 2553 | 70.1 | globlastp |
| 1357 | BLFS104 | *Pantoea* sp. | 3183 | 2540 | 99.2 | globlastp |
| 1358 | BLFS104 | *Pantoea* sp. | 3184 | 2540 | 98.3 | globlastp |
| 1359 | BLFS104 | Environmental sample | 3185 | 2540 | 95 | globlastp |
| 1360 | BLFS104 | *Pantoea* sp. | 3186 | 2540 | 94.1 | globlastp |
| 1361 | BLFS104 | *Pantoea* sp. | 3187 | 2540 | 93.3 | globlastp |
| 1362 | BLFS104 | *Pantoea* sp. | 3188 | 2540 | 90.8 | globlastp |
| 1363 | BLFS104 | Environmental sample | 3189 | 2540 | 89.1 | globlastp |
| 1364 | BLFS104 | *Pantoea* sp. | 3190 | 2540 | 84.9 | globlastp |
| 1365 | BLFS104 | *Pantoea* sp. | 3191 | 2540 | 78.2 | globlastp |
| 1366 | BLFS104 | Environmental sample | 3192 | 2540 | 77.3 | globlastp |
| 1367 | BLFS104 | *Pantoea* sp. | 3193 | 2540 | 73.9 | globlastp |
| 1381 | BLFS106 | Environmental sample | 3207 | 2542 | 99 | globlastp |
| 1382 | BLFS106 | *Pantoea* sp. | 3208 | 2542 | 98 | globlastp |
| 1383 | BLFS106 | *Pantoea* sp. | 3209 | 2542 | 97 | globlastp |
| 1384 | BLFS106 | *Pantoea* sp. | 3210 | 2542 | 94.4 | globlastp |
| 1385 | BLFS106 | Environmental sample | 3211 | 2542 | 92.1 | globlastp |
| 1386 | BLFS106 | *Pantoea* sp. | 3212 | 2542 | 88.1 | globlastp |
| 1387 | BLFS106 | *Pantoea* sp. | 3213 | 2542 | 86.9 | globlastp |
| 1388 | BLFS106 | *Pantoea* sp. | 3214 | 2542 | 83.2 | globlastp |
| 1389 | BLFS106 | *Pantoea* sp. | 3215 | 2542 | 82.2 | globlastp |
| 1390 | BLFS106 | *Pantoea* sp. | 3216 | 2542 | 80.2 | globlastp |
| 1391 | BLFS106 | Environmental sample | 3217 | 2542 | 79.2 | globlastp |
| 1392 | BLFS106 | *Pantoea* sp. | 3218 | 2542 | 78.2 | globlastp |
| 1393 | BLFS106 | *Plautia* sp. | 3219 | 2542 | 78.1 | globlastp |
| 1394 | BLFS106 | *Pantoea* sp. | 3220 | 2542 | 77.2 | globlastp |
| 1395 | BLFS106 | *Cedecea* sp. | 3221 | 2542 | 76.2 | globlastp |
| 1396 | BLFS106 | *Enterobacter* sp. | 3222 | 2542 | 75.2 | globlastp |
| 1397 | BLFS106 | Environmental sample | 3223 | 2542 | 74.3 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 1398 | BLFS106 | Environmental sample | 3224 | 2542 | 73.3 | globlastp |
| 1399 | BLFS106 | Environmental sample | 3225 | 2542 | 72.3 | globlastp |
| 1400 | BLFS106 | Citrobacter sp. | 3226 | 2542 | 71.3 | globlastp |
| 1401 | BLFS106 | Enterobacter sp. | 3227 | 2542 | 70.3 | globlastp |
| 1238 | BLFS92 | Paenibacillus sp. | 3073 | 2528 | 99.2 | globlastp |
| 1239 | BLFS92 | Paenibacillus sp. | 3074 | 2528 | 97.7 | globlastp |
| 1240 | BLFS92 | Paenibacillus sp. | 3075 | 2528 | 97.2 | globlastp |
| 1241 | BLFS92 | Paenibacillus sp. | 3076 | 2528 | 96.6 | globlastp |
| 1242 | BLFS92 | Paenibacillus sp. | 3077 | 2528 | 96.1 | globlastp |
| 1243 | BLFS92 | Paenibacillus sp. | 3078 | 2528 | 94.3 | globlastp |
| 1244 | BLFS92 | Paenibacillus sp. | 3079 | 2528 | 94 | globlastp |
| 1245 | BLFS92 | Paenibacillus sp. | 3080 | 2528 | 93.5 | globlastp |
| 1246 | BLFS92 | Paenibacillus sp. | 3081 | 2528 | 92 | globlastp |
| 1868 | BLFS143 | Salinibacillus sp. | 3691 | 2578 | 99.4 | globlastp |
| 1869 | BLFS143 | Bacillus sp. | 3692 | 2578 | 98.2 | globlastp |
| 1870 | BLFS143 | Bacillus sp. | 3693 | 2578 | 96.1 | globlastp |
| 1871 | BLFS143 | Bacillus sp. | 3694 | 2578 | 95.2 | globlastp |
| 1872 | BLFS143 | Bacillus sp. | 3695 | 2578 | 94.6 | globlastp |
| 1873 | BLFS143 | Bacillus sp. | 3696 | 2578 | 87.5 | globlastp |
| 1874 | BLFS143 | Bacillus sp. | 3697 | 2578 | 86.9 | globlastp |
| 1875 | BLFS143 | Bacillus sp. | 3698 | 2578 | 79.1 | globlastp |
| 1876 | BLFS143 | Bacillus sp. | 3699 | 2578 | 78.5 | globlastp |
| 1877 | BLFS143 | Bacillus sp. | 3700 | 2578 | 74.1 | globlastp |
| 1878 | BLFS143 | Bacillus sp. | 3701 | 2578 | 72.9 | globlastp |
| 1879 | BLFS143 | Bacillus sp. | 3702 | 2578 | 71.3 | globlastp |
| 1880 | BLFS143 | Bacillus sp. | 3703 | 2578 | 70.4 | globlastp |
| 1881 | BLFS143 | Bacillus sp. | 3704 | 2578 | 70.1 | globlastp |
| 800 | BLFS8 | Amycolatopsis sp. | 2652 | 2451 | 98.3 | globlastp |
| 801 | BLFS8 | Amycolatopsis sp. | 2653 | 2451 | 95.7 | globlastp |
| 802 | BLFS8 | Amycolatopsis sp. | 2654 | 2451 | 77.1 | globlastp |
| 961 | BLFS36 | Bradyrhizobium sp. | 2811 | 2478 | 82.9 | globlastp |
| 962 | BLFS36 | Bradyrhizobium sp. | 2812 | 2478 | 78.3 | globlastp |
| 963 | BLFS36 | Bradyrhizobium sp. | — | 2478 | 76.83 | glotblastn |
| 964 | BLFS36 | Bradyrhizobium sp. | 2813 | 2478 | 76.8 | globlastp |
| 965 | BLFS36 | Bradyrhizobium sp. | 2814 | 2478 | 75.6 | globlastp |
| 966 | BLFS36 | Bradyrhizobium sp. | 2815 | 2478 | 74.4 | globlastp |
| 1402 | BLFS107 | Environmental sample | 3228 | 2543 | 97.9 | globlastp |
| 1403 | BLFS107 | Pantoea sp. | 3229 | 2543 | 97.4 | globlastp |
| 1404 | BLFS107 | Pantoea sp. | 3230 | 2543 | 96.8 | globlastp |
| 1405 | BLFS107 | Environmental sample | 3231 | 2543 | 95.8 | globlastp |
| 1406 | BLFS107 | Pantoea sp. | 3232 | 2543 | 94.2 | globlastp |
| 1407 | BLFS107 | Pantoea sp. | 3233 | 2543 | 88.4 | globlastp |
| 1408 | BLFS107 | Environmental sample | 3234 | 2543 | 86.3 | globlastp |
| 1409 | BLFS107 | Environmental sample | 3235 | 2543 | 85.8 | globlastp |
| 1410 | BLFS107 | Environmental sample | 3236 | 2543 | 85.7 | globlastp |
| 1411 | BLFS107 | Environmental sample | 3237 | 2543 | 85.3 | globlastp |
| 1412 | BLFS107 | Pantoea sp. | 3238 | 2543 | 84.8 | globlastp |
| 1413 | BLFS107 | Pantoea sp. | 3239 | 2543 | 84.7 | globlastp |
| 1414 | BLFS107 | Pantoea sp. | 3240 | 2543 | 78.3 | globlastp |
| 1415 | BLFS107 | Erwinia sp. | 3241 | 2543 | 74.6 | globlastp |
| 1416 | BLFS107 | Erwinia sp. | 3242 | 2543 | 73.5 | globlastp |
| 1417 | BLFS107 | Erwinia sp. | 3243 | 2543 | 72.3 | globlastp |
| 1418 | BLFS107 | Pantoea sp. | 3244 | 2543 | 72 | globlastp |
| 1419 | BLFS107 | Environmental sample | 3245 | 2543 | 70.4 | globlastp |
| 866 | BLFS20 | Bacillus sp. | 2718 | 2463 | 99.1 | globlastp |
| 867 | BLFS20 | Bacillus sp. | 2719 | 2463 | 98.2 | globlastp |
| 868 | BLFS20 | Bacillus sp. | 2720 | 2463 | 97.2 | globlastp |
| 869 | BLFS20 | Bacillus sp. | 2721 | 2463 | 96.3 | globlastp |
| 2012 | PUB65 | Variovorax sp. | 3826 | 2598 | 98.9 | globlastp |
| 2013 | PUB65 | Variovorax sp. | 3827 | 2598 | 94.8 | globlastp |
| 2014 | PUB65 | Variovorax sp. | 3828 | 2598 | 94.5 | globlastp |
| 2015 | PUB65 | Variovorax sp. | 3829 | 2598 | 91.4 | globlastp |
| 2016 | PUB65 | Variovorax sp. | 3830 | 2598 | 91.3 | globlastp |
| 2017 | PUB65 | Variovorax sp. | 3831 | 2598 | 90.6 | globlastp |
| 2018 | PUB65 | Variovorax sp. | 3832 | 2598 | 90.5 | globlastp |
| 2019 | PUB65 | Variovorax sp. | 3833 | 2598 | 90.3 | globlastp |
| 2020 | PUB65 | Environmental sample | 3834 | 2598 | 90.1 | globlastp |
| 2021 | PUB65 | Environmental sample | 3835 | 2598 | 87.1 | globlastp |
| 2022 | PUB65 | Variovorax sp. | 3836 | 2598 | 84.5 | globlastp |
| 2023 | PUB65 | Variovorax sp. | 3837 | 2598 | 84.3 | globlastp |
| 2024 | PUB65 | Environmental sample | 3838 | 2598 | 78.4 | globlastp |
| 2025 | PUB65 | Environmental sample | 3839 | 2598 | 77.9 | globlastp |
| 2026 | PUB65 | Variovorax sp. | 3840 | 2598 | 77.4 | globlastp |
| 2027 | PUB65 | Acidovorax sp. | 3841 | 2598 | 75.5 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 2028 | PUB65 | Environmental sample | 3842 | 2598 | 75.4 | globlastp |
| 2029 | PUB65 | *Acidovorax* sp. | 3843 | 2598 | 75.2 | globlastp |
| 2030 | PUB65 | Environmental sample | 3844 | 2598 | 74.5 | globlastp |
| 2031 | PUB65 | Environmental sample | 3845 | 2598 | 72.3 | globlastp |
| 790 | BLFS1 | *Streptomyces* sp. | 2642 | 2444 | 72.8 | globlastp |
| 1976 | BLFS150 | *Pseudomonas* sp. | — | 2585 | 95.9 | glotblastn |
| 1977 | BLFS150 | *Xanthomonas* sp. | — | 2585 | 77.05 | glotblastn |
| 1978 | BLFS150 | *Xanthomonas* sp. | — | 2585 | 75.41 | glotblastn |
| 1979 | BLFS150 | *Xanthomonas* sp. | — | 2585 | 72.95 | glotblastn |
| 1980 | BLFS150 | *Xanthomonas* sp. | — | 2585 | 71.31 | glotblastn |
| 2081 | ZLFS8 | *Collimonas* sp. | 3895 | 2605 | 78.5 | globlastp |
| 2082 | ZLFS8 | *Collimonas* sp. | 3896 | 2605 | 78.3 | globlastp |
| 952 | BLFS35 | *Bradyrhizohium* sp. | 2802 | 2477 | 96.3 | globlastp |
| 953 | BLFS35 | *Mesorhizohium* sp. | 2803 | 2477 | 89.8 | globlastp |
| 954 | BLFS35 | *Bradyrhizohium* sp. | 2804 | 2477 | 87 | globlastp |
| 955 | BLFS35 | *Bradyrhizohium* sp. | 2805 | 2477 | 86 | globlastp |
| 956 | BLFS35 | *Bradyrhizohium* sp. | 2806 | 2477 | 76.8 | globlastp |
| 957 | BLFS35 | *Bradyrhizohium* sp. | 2807 | 2477 | 75.5 | globlastp |
| 958 | BLFS35 | *Bradyrhizohium* sp. | 2808 | 2477 | 75 | globlastp |
| 959 | BLFS35 | *Bradyrhizohium* sp. | 2809 | 2477 | 71.2 | globlastp |
| 960 | BLFS35 | *Bradyrhizohium* sp. | 2810 | 2477 | 70.2 | globlastp |
| 1429 | BLFS109 | *Pantoea* sp. | 3255 | 2545 | 89.2 | globlastp |
| 1430 | BLFS109 | *Pantoea* sp. | 3256 | 2545 | 76.2 | globlastp |
| 1320 | BLFS101 | Environmental sample | 3155 | 2537 | 95.2 | globlastp |
| 1321 | BLFS101 | *Pantoea* sp. | 3156 | 2537 | 94 | globlastp |
| 1322 | BLFS101 | *Pantoea* sp. | 3157 | 2537 | 87.3 | globlastp |
| 1323 | BLFS101 | Environmental sample | 3158 | 2537 | 86.1 | globlastp |
| 1324 | BLFS101 | Environmental sample | 3159 | 2537 | 85.3 | globlastp |
| 1325 | BLFS101 | *Pantoea* sp. | 3160 | 2537 | 84.1 | globlastp |
| 1326 | BLFS101 | *Erwinia* sp. | 3161 | 2537 | 79.3 | globlastp |
| 1327 | BLFS101 | *Serratia* sp. | 3162 | 2537 | 78.1 | globlastp |
| 1328 | BLFS101 | *Erwinia* sp. | 3163 | 2537 | 77.3 | globlastp |
| 1329 | BLFS101 | Environmental sample | 3164 | 2537 | 76.1 | globlastp |
| 1330 | BLFS101 | *Klebsiella* sp. | 3165 | 2537 | 75 | globlastp |
| 1331 | BLFS101 | *Yersinia* sp. | 3166 | 2537 | 74.1 | globlastp |
| 1332 | BLFS101 | Environmental sample | 3167 | 2537 | 73 | globlastp |
| 1333 | BLFS101 | *Rahnella* sp. | 3168 | 2537 | 72.1 | globlastp |
| 1334 | BLFS101 | *Enterobacter* sp. | 3169 | 2537 | 71 | globlastp |
| 1335 | BLFS101 | *Xenorhabdus* sp. | 3170 | 2537 | 70.1 | globlastp |
| 1607 | BLFS123 | *Pseudomonas* sp. | 3431 | 2558 | 96.2 | globlastp |
| 1608 | BLFS123 | *Pseudomonas* sp. | 3432 | 2558 | 95.9 | globlastp |
| 1609 | BLFS123 | *Pseudomonas* sp. | 3433 | 2558 | 79.8 | globlastp |
| 1610 | BLFS123 | *Pseudomonas* sp. | 3434 | 2558 | 79.5 | globlastp |
| 974 | BLFS41 | *Burkholderia* sp. | 2822 | 2482 | 99.2 | globlastp |
| 975 | BLFS41 | *Burkholderia* sp. | 2823 | 2482 | 98.9 | globlastp |
| 976 | BLFS41 | *Burkholderia* sp. | 2824 | 2482 | 76.3 | globlastp |
| 977 | BLFS41 | Environmental sample | 2825 | 2482 | 75.1 | globlastp |
| 978 | BLFS41 | *Burkholderia* sp. | 2826 | 2482 | 74 | globlastp |
| 979 | BLFS41 | *Burkholderia* sp. | 2827 | 2482 | 73.1 | globlastp |
| 980 | BLFS41 | *Burkholderia* sp. | 2828 | 2482 | 72.9 | globlastp |
| 981 | BLFS41 | *Burkholderia* sp. | 2829 | 2482 | 71.3 | globlastp |
| 1064 | BLFS67 | *Janthinobacterium* sp. | 2906 | 2506 | 98.6 | globlastp |
| 1065 | BLFS67 | *Janthinobacterium* sp. | 2907 | 2506 | 93.8 | globlastp |
| 1066 | BLFS67 | *Janthinobacterium* sp. | 2908 | 2506 | 92.5 | globlastp |
| 1276 | BLFS98 | *Pantoea* sp. | 3111 | 2534 | 96.3 | globlastp |
| 1277 | BLFS98 | Environmental sample | 3112 | 2534 | 95.3 | globlastp |
| 1278 | BLFS98 | *Pantoea* sp. | 3113 | 2534 | 93 | globlastp |
| 1279 | BLFS98 | Environmental sample | 3114 | 2534 | 91.4 | globlastp |
| 1280 | BLFS98 | Environmental sample | 3115 | 2534 | 89.8 | globlastp |
| 1281 | BLFS98 | *Pantoea* sp. | 3116 | 2534 | 83.3 | globlastp |
| 1282 | BLFS98 | Environmental sample | 3117 | 2534 | 82.9 | globlastp |
| 1283 | BLFS98 | *Pantoea* sp. | 3118 | 2534 | 81.5 | globlastp |
| 1284 | BLFS98 | Environmental sample | 3119 | 2534 | 79.4 | globlastp |
| 1285 | BLFS98 | *Pantoea* sp. | 3120 | 2534 | 77.2 | globlastp |
| 1286 | BLFS98 | *Pantoea* sp. | 3121 | 2534 | 76.1 | globlastp |
| 1287 | BLFS98 | Environmental sample | 3122 | 2534 | 75.3 | globlastp |
| 1288 | BLFS98 | *Pantoea* sp. | 3123 | 2534 | 74 | globlastp |
| 1289 | BLFS98 | Environmental sample | 3124 | 2534 | 72.6 | globlastp |
| 1290 | BLFS98 | *Erwinia* sp. | 3125 | 2534 | 71.6 | globlastp |
| 1291 | BLFS98 | Environmental sample | 3126 | 2534 | 70.2 | globlastp |
| 898 | BLFS26 | *Bacillus* sp. | 2748 | 2469 | 99 | globlastp |
| 899 | BLFS26 | *Bacillus* sp. | 2749 | 2469 | 98.4 | globlastp |
| 900 | BLFS26 | *Bacillus* sp. | 2750 | 2469 | 97.9 | globlastp |
| 901 | BLFS26 | *Bacillus* sp. | 2751 | 2469 | 96.3 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 902 | BLFS26 | Bacillus sp. | 2752 | 2469 | 72.3 | globlastp |
| 1838 | BLFS141 | Salinibacillus sp. | 3661 | 2576 | 98.1 | globlastp |
| 1839 | BLFS141 | Bacillus sp. | 3662 | 2576 | 97.5 | globlastp |
| 1840 | BLFS141 | Bacillus sp. | 3663 | 2576 | 95.9 | globlastp |
| 1841 | BLFS141 | Bacillus sp. | 3664 | 2576 | 90.1 | globlastp |
| 1842 | BLFS141 | Bacillus sp. | 3665 | 2576 | 89 | globlastp |
| 1843 | BLFS141 | Bacillus sp. | 3666 | 2576 | 88.1 | globlastp |
| 1844 | BLFS141 | Bacillus sp. | 3667 | 2576 | 87.2 | globlastp |
| 1845 | BLFS141 | Bacillus sp. | 3668 | 2576 | 86.6 | globlastp |
| 1846 | BLFS141 | Bacillus sp. | 3669 | 2576 | 86.4 | globlastp |
| 1847 | BLFS141 | Bacillus sp. | 3670 | 2576 | 83.7 | globlastp |
| 1848 | BLFS141 | Bacillus sp. | 3671 | 2576 | 82.6 | globlastp |
| 1849 | BLFS141 | Bacillus sp. | 3672 | 2576 | 77.1 | globlastp |
| 1850 | BLFS141 | Bacillus sp. | 3673 | 2576 | 76 | globlastp |
| 1851 | BLFS141 | Bacillus sp. | 3674 | 2576 | 75.6 | globlastp |
| 1852 | BLFS141 | Bacillus sp. | 3675 | 2576 | 74 | globlastp |
| 1853 | BLFS141 | Bacillus sp. | 3676 | 2576 | 73.2 | globlastp |
| 1854 | BLFS141 | Bacillus sp. | 3677 | 2576 | 72.4 | globlastp |
| 1855 | BLFS141 | Bacillus sp. | 3678 | 2576 | 71.5 | globlastp |
| 1856 | BLFS141 | Paenibacillus sp. | 3679 | 2576 | 70.4 | globlastp |
| 1198 | BLFS88 | Paenibacillus sp. | 3035 | 2524 | 99.2 | globlastp |
| 1199 | BLFS88 | Paenibacillus sp. | 3036 | 2524 | 96.9 | globlastp |
| 1200 | BLFS88 | Paenibacillus sp. | 3037 | 2524 | 95.3 | globlastp |
| 1201 | BLFS88 | Paenibacillus sp. | 3038 | 2524 | 95 | globlastp |
| 1202 | BLFS88 | Paenibacillus sp. | 3039 | 2524 | 94.4 | globlastp |
| 1203 | BLFS88 | Paenibacillus sp. | 3040 | 2524 | 93.6 | globlastp |
| 1204 | BLFS88 | Paenibacillus sp. | 3041 | 2524 | 92.5 | globlastp |
| 1205 | BLFS88 | Paenibacillus sp. | 3042 | 2524 | 88.3 | globlastp |
| 1206 | BLFS88 | Paenibacillus sp. | 3043 | 2524 | 72.9 | globlastp |
| 1010 | BLFS53 | Dickeya sp. | 2856 | 2494 | 99 | globlastp |
| 878 | BLFS22 | Bacillus sp. | 2728 | 2465 | 99.3 | globlastp |
| 879 | BLFS22 | Bacillus sp. | 2729 | 2465 | 97.8 | globlastp |
| 880 | BLFS22 | Bacillus sp. | 2730 | 2465 | 97.1 | globlastp |
| 881 | BLFS22 | Bacillus sp. | 2731 | 2465 | 96.4 | globlastp |
| 882 | BLFS22 | Bacillus sp. | 2732 | 2465 | 95.6 | globlastp |
| 883 | BLFS22 | Bacillus sp. | 2733 | 2465 | 94.9 | globlastp |
| 819 | BLFS12 | Arthrobacter sp. | 2671 | 2455 | 98.9 | globlastp |
| 820 | BLFS12 | Arthrobacter sp. | 2672 | 2455 | 92.3 | globlastp |
| 1960 | BLFS149 | Serratia sp. | 3782 | 2584 | 98.8 | globlastp |
| 1961 | BLFS149 | Serratia sp. | 3783 | 2584 | 97 | globlastp |
| 1962 | BLFS149 | Serratia sp. | 3784 | 2584 | 93.8 | globlastp |
| 1963 | BLFS149 | Serratia sp. | 3785 | 2584 | 91.7 | globlastp |
| 1964 | BLFS149 | Serratia sp. | 3786 | 2584 | 84 | globlastp |
| 1965 | BLFS149 | Serratia sp. | 3787 | 2584 | 83.8 | globlastp |
| 1966 | BLFS149 | Serratia sp. | 3788 | 2584 | 82 | globlastp |
| 1967 | BLFS149 | Serratia sp. | 3789 | 2584 | 81.3 | globlastp |
| 1968 | BLFS149 | Serratia sp. | 3790 | 2584 | 78 | globlastp |
| 1969 | BLFS149 | Serratia sp. | 3791 | 2584 | 77.8 | globlastp |
| 1970 | BLFS149 | Yersinia sp. | 3792 | 2584 | 76 | globlastp |
| 1971 | BLFS149 | Yersinia sp. | 3793 | 2584 | 75 | globlastp |
| 1972 | BLFS149 | Yersinia sp. | 3794 | 2584 | 74 | globlastp |
| 1973 | BLFS149 | Yersinia sp. | 3795 | 2584 | 73.1 | globlastp |
| 1974 | BLFS149 | Edwardsiella sp. | 3796 | 2584 | 72 | globlastp |
| 1975 | BLFS149 | Environmental sample | 3797 | 2584 | 71.2 | globlastp |
| 1984 | BLFS152 | Streptomyces sp. | 3801 | 2587 | 82.9 | globlastp |
| 1985 | BLFS152 | Streptomyces sp. | 3802 | 2587 | 78.9 | globlastp |
| 1995 | BLFS154 | Streptomyces sp. | 3809 | 2589 | 98.2 | globlastp |
| 1996 | BLFS154 | Streptomyces sp. | 3810 | 2589 | 72.2 | globlastp |
| 1432 | BLFS111 | Chromobacterium sp. | 3258 | 2547 | 97 | globlastp |
| 1433 | BLFS111 | Chromobacterium sp. | 3259 | 2547 | 89.9 | globlastp |
| 1434 | BLFS111 | Chromobacterium sp. | 3260 | 2547 | 84.4 | globlastp |
| 1435 | BLFS111 | Chromobacterium sp. | 3261 | 2547 | 83.4 | globlastp |
| 1436 | BLFS111 | Paludibacterium sp. | 3262 | 2547 | 71.4 | globlastp |
| 791 | BLFS2 | Alkanindiges sp. | 2643 | 2445 | 91.7 | globlastp |
| 1644 | BLFS126 | Pseudomonas sp. | 3468 | 2561 | 98.3 | globlastp |
| 1645 | BLFS126 | Pseudomonas sp. | 3469 | 2561 | 96.7 | globlastp |
| 1646 | BLFS126 | Pseudomonas sp. | 3470 | 2561 | 92.6 | globlastp |
| 1647 | BLFS126 | Pseudomonas sp. | 3471 | 2561 | 91.7 | globlastp |
| 1648 | BLFS126 | Pseudomonas sp. | 3472 | 2561 | 90.9 | globlastp |
| 1649 | BLFS126 | Pseudomonas sp. | 3473 | 2561 | 80.3 | globlastp |
| 1650 | BLFS126 | Pseudomonas sp. | 3474 | 2561 | 75.6 | globlastp |
| 1651 | BLFS126 | Pseudomonas sp. | 3475 | 2561 | 73.2 | globlastp |
| 2286 | ZLFS34 | Serratia sp. | 4100 | 2629 | 99 | globlastp |
| 2287 | ZLFS34 | Serratia sp. | 4101 | 2629 | 98.4 | globlastp |

TABLE 16-continued

Homologues (e.g., orthologues) of the identified antifungal genes/polypeptides

| Polyn. SEQ ID NO | Hom. to Gene Name | Organism | Polyp. SEQ ID NO | Hom. to SEQ ID NO | % glob. Iden. | Algor. |
|---|---|---|---|---|---|---|
| 2288 | ZLFS34 | Multievos46 sp. | 4102 | 2629 | 97 | globlastp |
| 2289 | ZLFS34 | Serratia sp. | 4103 | 2629 | 96 | globlastp |
| 2290 | ZLFS34 | Serratia sp. | 4104 | 2629 | 95.9 | globlastp |
| 2291 | ZLFS34 | Serratia sp. | 4105 | 2629 | 93 | globlastp |
| 2292 | ZLFS34 | Serratia sp. | 4106 | 2629 | 92.1 | globlastp |
| 2293 | ZLFS34 | Serratia sp. | 4107 | 2629 | 91.4 | globlastp |
| 2294 | ZLFS34 | Serratia sp. | 4108 | 2629 | 88.1 | globlastp |
| 2295 | ZLFS34 | Serratia sp. | 4109 | 2629 | 87 | globlastp |
| 2296 | ZLFS34 | Serratia sp. | 4110 | 2629 | 84.3 | globlastp |
| 2297 | ZLFS34 | Xenorhabdus sp. | 4111 | 2629 | 83.5 | globlastp |
| 2298 | ZLFS34 | Xenorhabdus sp. | 4112 | 2629 | 82 | globlastp |
| 2299 | ZLFS34 | Xenorhabdus sp. | 4113 | 2629 | 80.6 | globlastp |
| 2300 | ZLFS34 | Yersinia sp. | 4114 | 2629 | 78.8 | globlastp |
| 2301 | ZLFS34 | Yersinia sp. | 4115 | 2629 | 75 | globlastp |
| 2302 | ZLFS34 | Environmental sample | 4116 | 2629 | 74.5 | globlastp |
| 2303 | ZLFS34 | Rahnella sp. | 4117 | 2629 | 73.1 | globlastp |
| 2304 | ZLFS34 | Ewingella sp. | 4118 | 2629 | 71.5 | globlastp |
| 2305 | ZLFS34 | Rhodanobacter sp. | 4119 | 2629 | 70.1 | globlastp |
| 1907 | BLFS146 | Bacillus sp. | 3730 | 2581 | 98.8 | globlastp |
| 1908 | BLFS146 | Bacillus sp. | 3731 | 2581 | 97.2 | globlastp |
| 1909 | BLFS146 | Bacillus sp. | 3732 | 2581 | 96 | globlastp |
| 1910 | BLFS146 | Bacillus sp. | 3733 | 2581 | 95.4 | globlastp |
| 1911 | BLFS146 | Bacillus sp. | 3734 | 2581 | 94 | globlastp |
| 1912 | BLFS146 | Bacillus sp. | 3735 | 2581 | 93.4 | globlastp |
| 1913 | BLFS146 | Bacillus sp. | 3736 | 2581 | 92.9 | globlastp |
| 1914 | BLFS146 | Bacillus sp. | 3737 | 2581 | 91.7 | globlastp |
| 1915 | BLFS146 | Bacillus sp. | 3738 | 2581 | 89.1 | globlastp |
| 1916 | BLFS146 | Bacillus sp. | 3739 | 2581 | 85 | globlastp |
| 1917 | BLFS146 | Bacillus sp. | 3740 | 2581 | 84.7 | globlastp |
| 1918 | BLFS146 | Bacillus sp. | 3741 | 2581 | 84 | globlastp |
| 1919 | BLFS146 | Bacillus sp. | 3742 | 2581 | 81.2 | globlastp |
| 1920 | BLFS146 | Bacillus sp. | 3743 | 2581 | 78.2 | globlastp |
| 1921 | BLFS146 | Bacillus sp. | 3744 | 2581 | 77.9 | globlastp |
| 1922 | BLFS146 | Bacillus sp. | 3745 | 2581 | 76.4 | globlastp |
| 1923 | BLFS146 | Bacillus sp. | 3746 | 2581 | 74 | globlastp |
| 1924 | BLFS146 | Bacillus sp. | 3747 | 2581 | 73.1 | globlastp |
| 1925 | BLFS146 | Bacillus sp. | 3748 | 2581 | 71.1 | globlastp |
| 1926 | BLFS146 | Bacillus sp. | 3749 | 2581 | 70.8 | globlastp |
| 1749 | BLFS133 | Pseudomonas sp. | 3573 | 2568 | 93.2 | globlastp |
| 1750 | BLFS133 | Pseudomonas sp. | 3574 | 2568 | 91.8 | globlastp |
| 1751 | BLFS133 | Pseudomonas sp. | 3575 | 2568 | 79.5 | globlastp |
| 1752 | BLFS133 | Pseudomonas sp. | 3576 | 2568 | 78.1 | globlastp |
| 893 | BLFS25 | Bacillus sp. | 2743 | 2468 | 99.2 | globlastp |
| 894 | BLFS25 | Bacillus sp. | 2744 | 2468 | 98.8 | globlastp |
| 895 | BLFS25 | Bacillus sp. | 2745 | 2468 | 98.4 | globlastp |
| 896 | BLFS25 | Bacillus sp. | 2746 | 2468 | 98 | globlastp |
| 897 | BLFS25 | Bacillus sp. | 2747 | 2468 | 70.8 | globlastp |
| 2070 | ZLFS5 | Burkholderia sp. | 3884 | 2602 | 98.4 | globlastp |
| 2071 | ZLFS5 | Burkholderia sp. | 3885 | 2602 | 97.7 | globlastp |
| 2072 | ZLFS5 | Burkholderia sp. | 3886 | 2602 | 96.1 | globlastp |
| 2073 | ZLFS5 | Burkholderia sp. | 3887 | 2602 | 88.3 | globlastp |
| 2074 | ZLFS5 | Burkholderia sp. | 3888 | 2602 | 75 | globlastp |
| 1981 | BLFS151 | Stenotrophomonas sp. | 3798 | 2586 | 78.1 | globlastp |
| 1982 | BLFS151 | Stenotrophomonas sp. | 3799 | 2586 | 75.7 | globlastp |
| 1983 | BLFS151 | Stenotrophomonas sp. | 3800 | 2586 | 73.5 | globlastp |
| 2000 | BLFS159 | Xanthomonas sp. | 3814 | 2594 | 79.9 | globlastp |
| 2001 | BLFS159 | Xanthomonas sp. | 3815 | 2594 | 76.8 | globlastp |
| 2089 | ZLFS13 | Collimonas sp. | 3903 | 2610 | 96.7 | globlastp |
| 2090 | ZLFS13 | Collimonas sp. | 3904 | 2610 | 80.3 | globlastp |
| 2032 | ZLFS1 | Actinomyces sp. | 3846 | 2599 | 73.5 | globlastp |
| 1005 | BLFS50 | Collimonas sp. | 2853 | 2491 | 85.1 | globlastp |
| 2091 | ZLFS14 | Collimonas sp. | 3905 | 2611 | 75 | globlastp |
| 2083 | ZLFS9 | Collimonas sp. | 3897 | 2606 | 98.6 | globlastp |

"Polyn." = polynucleotide; "Polyp." = polypeptide; "Algor." = algorithm (used for sequence alignment and determination of percent homology); "Hom."—homology; "iden."—identity; "glob."—global. Environmental sample = unidentified organisms obtained from the sample.

The output of the functional genomics approach described herein is a set of genes highly predicted to improve plant resistance to fungal infection.

Example 13: Identification of Domains Comprised within Polypeptides Encoded by the Identified Genes Polypeptide domains were identified as described in Example 4 hereinabove. The polypeptides of some embodiments of the invention, the expression of which in a may result in fungal control by invoking antifungal effects, can be characterized by specific amino acid domains. According to certain embodiments of the invention, particular domains are conserved within a family of polypeptides as described in Table 17 hereinbelow. Without wishing to be bound by specific theory or mechanism of action, the conserved domain may indicate common function of the polypeptides comprising same. The domains are presented by an arbitrary identifier (*ID). Table 18 provides the details of each domain according to the InterPro Entry.

Table 17 summarizes the domains in each of the "core" polypeptides (e.g., the polypeptides from Table 15) identified by the present inventors as being capable of conferring resistant to fungi and/or Oomycetes infection when its expression is modified in a plant (e.g. enhanced or down-regulated), wherein each of the listed domains is conserved in the representative homologous polypeptides identified by the present inventors exhibiting at least 70% global identity to the "core" polypeptides (as detailed in Table 16 in Example 12 above). As explained above, each domain received an arbitrary ID number wherein description of these arbitrary domain IDs according to the InterPro database is provided in Table 18 below. In addition, the start and end position of each of the domains with respect to the amino acid sequence of the "core" polypeptide was identified, as well as the E-values for each of the conserved domains as indicated by the domain tool used for analyzing these sequences, as part of interproscan programs, e.g., SMART, prosite scans patterns and profiles (not shown). For example, in the case of the Prosite search, the Prosite profiles report normalized scores instead of E-values, which are defined as the base 10 logarithm of the size (in residues) of the database in which one false positive match is expected to occur by chance. The normalized score is independent of the size of the databases searched. The so-called bit scores reported by other database-search programs have a distinct meaning but are also independent of the size of the database searched For example, for SEQ ID NO:9060, the domain ID "1" appears at amino acid positions 37 through 124. For some domains the e-value was not specified. In these cases, the presence of the domain was verified by ScanRegExp, which is able to verify PROSITE matches using corresponding statistically-significant CONFIRM patterns. The CONFIRM patterns were generated based on the true positive SWISS-PROT PROSITE matches using eMOTIF software with a stringency of 10e-9 P-value. Further details can be found in hypertext transfer protocol://computing.bio.cam.ac.uk/local/doc/iprscan.html.

TABLE 17

Core and homologous polypeptides comprising the same domains

| Core Polypeptide (SEQ ID NO) | Gene Name (Core) | Characteristic Domains (Domain identifier) | Homologous Polypeptides Comprising the Domains (SEQ ID NOs) |
| --- | --- | --- | --- |
| 2444 | BLFS1 | 1; 2; 3 in core and homologs | 2642 |
| 2445 | BLFS2 | 4; 5; 6 in core and homologs | 2643 |
| 2446 | BLFS3 | 7; 8; 9; 10; 11; 12 in core | |
| 2447 | BLFS4 | 6 in core | |
| 2448 | BLFS5 | 13; 14 in core and homologs | 2644; 2645; 2646; 2647; 2648; 2649; 2650; 2651 |
| 2449 | BLFS6 | 2; 3 in core | |
| 2450 | BLFS7 | 15; 16 in core | |
| 2451 | BLFS8 | 1; 2; 3 in core and homologs | 2652; 2653; 2654 |
| 2452 | BLFS9 | 2; 1; 3 in core and homologs | 2655; 2656; 2657; 2658; 2659; 2660 |
| 2453 | BLFS10 | 1; 2; 3 in core and homologs | 2452; 2655; 2656; 2661; 2662; 2663 |
| 2454 | BLFS11 | no domains in core | |
| 2455 | BLFS12 | no domains in core | |
| 2456 | BLFS13 | no domains in core | |
| 2457 | BLFS14 | 17 in core and homologs | 2675; 2676 |
| 2458 | BLFS15 | 18; 19; 20 in core and homologs | 2677; 2678; 2679; 2680; 2681; 2682; 2683; 2684; 2685 |
| 2459 | BLFS16 | 21; 22; 23; 24 in core and homologs | 2686; 2687; 2688; 2689; 2690 |
| 2460 | BLFS17 | 25; 26 in core and homologs | 2691; 2692; 2693; 2694; 2695; 2696 |
| 2461 | BLFS18 | 27; 28; 29 in core and homologs | 2697; 2698; 2699; 2700; 2701; 2702; 2703; 2704; 2705; 2706; 2707; 2708; 2709; 2710 |
| 2462 | BLFS19 | 8; 30 in core and homologs | 2711; 2712; 2713; 2714; 2715; 2716; 2717 |
| 2463 | BLFS20 | 31; 32; 33 in core and homologs | 2718; 2719; 2720; 2721 |
| 2464 | BLFS21 | 34; 35; 36; 37; 38 in core and homologs | 2722; 2723; 2724; 2725; 2726; 2727 |
| 2465 | BLFS22 | no domains in core | |
| 2466 | BLFS23 | 39; 31; 40; 41; 42; 32; 24 in core and homologs | 2734; 2735; 2736; 2737; 2738; 2739; 2740; 2741; 2742 |
| 2467 | BLFS24 | no domains in core | |
| 2468 | BLFS25 | 43; 44 in core and homologs | 2743; 2744; 2745; 2746; 2747 |
| 2469 | BLFS26 | 31; 45; 32 in core and homologs | 2748; 2749; 2750; 2751; 2752 |
| 2470 | BLFS27 | 46; 47; 48 in core and homologs | 2753; 2754; 2755; 2756; 2757 |
| 2471 | BLFS29 | 8; 49; 30 in core and homologs | 2758 |

TABLE 17-continued

Core and homologous polypeptides comprising the same domains

| Core Polypeptide (SEQ ID NO) | Gene Name (Core) | Characteristic Domains (Domain identifier) | Homologous Polypeptides Comprising the Domains (SEQ ID NOs) |
|---|---|---|---|
| 2472 | BLFS30 | 6 in core | |
| 2473 | BLFS31 | 50 in core and homologs | 2759; 2760; 2761; 2762; 2763; 2764; 2765; 2766; 2767; 2768; 2769 |
| 2474 | BLFS32 | 52 in core and homologs | 2770; 2771; 2772; 2773; 2774; 2775; 2776; 2777; 2778; 2779; 2780; 2781; 2782; 2783; 2784; 2785; 2786 |
| 2475 | BLFS33 | 53; 35; 54 in core and homologs | 2787; 2788; 2789; 2790; 2791; 2792; 2793; 2794; 2795; 2796; 2797; 2798 |
| 2476 | BLFS34 | 31; 32; 33 in core and homologs | 2799; 2800; 2801 |
| 2477 | BLFS35 | 55 in core and homologs | 2802; 2803; 2804; 2805; 2806; 2807; 2808; 2809; 2810 |
| 2478 | BLFS36 | no domains in core | |
| 2479 | BLFS37 | 1; 56; 57 in core and homologs | 2816; 2817 |
| 2480 | BLFS38 | 58; 59 in core and homologs | 2818 |
| 2481 | BLFS39 | 6 in core and homologs | 2819; 2820; 2821 |
| 2482 | BLFS41 | 60; 61; 62; 63; 24; 64; 65; 66; 67 in core and homologs | 2822; 2823; 2824; 2825; 2826; 2827; 2828; 2829 |
| 2483 | BLFS42 | 60; 68 in core and homologs | 2830; 2831 |
| 2484 | BLFS43 | 51 in core and homologs | 2832; 2833; 2834; 2835 |
| 2485 | BLFS44 | 69; 70; 71; 7; 10; 24 in core and homologs | 2836 |
| 2486 | BLFS45 | 73 in core and homologs | 2837; 2838; 2839; 2840; 2841; 2842; 2843; 2844 |
| 2487 | BLFS46 | 31; 74; 32; 75 in core and homologs | 2845 |
| 2488 | BLFS47 | 1 in core and homologs | 2846; 2847; 2848; 2849 |
| 2489 | BLFS48 | 35; 52; 37 in core and homologs | 2850; 2851; 2852 |
| 2490 | BLFS49 | 7; 10 in core | |
| 2491 | BLFS50 | 60; 68 in core and homologs | 2853 |
| 2492 | BLFS51 | 76; 24 in core and homologs | 2854; 2855 |
| 2493 | BLFS52 | 7; 10 in core | |
| 2494 | BLFS53 | no domains in core | |
| 2495 | BLFS55 | 1; 57 in core and homologs | 2857; 2858 |
| 2496 | BLFS56 | 77; 17; 79 in core and homologs | 2859; 2860; 2861; 2862; 2863; 2864 |
| 2497 | BLFS57 | 80; 81; 7; 10; 82 in core and homologs | 2865; 2866; 2867 |
| 2498 | BLFS58 | 1; 83; 57 in core and homologs | 2868; 2869 |
| 2499 | BLFS59 | 1; 57 in core | |
| 2500 | BLFS60 | 1 in core and homologs | 2870; 2871; 2872 |
| 2501 | BLFS61 | 84; 85; 86; 87; 88 in core and homologs | 2873; 2874; 2875; 2876; 2877; 2878; 2879; 2880 |
| 2502 | BLFS62 | 31; 74; 32; 75 in core and homologs | 2881; 2882; 2883; 2884; 2885; 2886; 2887; 2888; 2889; 2890 |
| 2503 | BLFS63 | 89; 90; 31; 32 in core and homologs | 2891; 2892; 2893; 2894; 2895; 2896; 2897; 2898; 2899; 2900; 2901; 2902; 2903 |
| 2504 | BLFS64 | 8; 49; 30 in core and homologs | 2904 |
| 2505 | BLFS65 | 91 in core and homologs | 2905 |
| 2506 | BLFS67 | 1; 57 in core and homologs | 2906; 2907; 2908 |
| 2507 | BLFS68 | 92 in core and homologs | 2909; 2910; 2911; 2912 |
| 2508 | BLFS69 | 93; 94; 95; 96; 97 in core | |
| 2509 | BLFS70 | 98 in core | |
| 2510 | BLFS72 | 99; 100; 101; 102 in core and homologs | 2913 |
| 2511 | BLFS73 | 1 in core and homologs | 2914; 2915; 2916; 2917; 2918; 2919; 2920; 2921; 2922; 2923; 2924; 2925; 2926; 2927; 2928; 2929 |
| 2512 | BLFS74 | 34 in core and homologs | 2930; 2931; 2932; 2933; 2934; 2935; 2936; 2937; 2938; 2939; 2940; 2941; 2942; 2943 |
| 2513 | BLFS75 | 103; 104 in core and homologs | 2944; 2945; 2946; 2947; 2948; 2949; 2950; 2951; 2952; 2953; 2954 |
| 2514 | BLFS76 | no domains in core | |
| 2515 | BLFS77 | 17; 7; 78; 79; 10; 24; 76 in core and homologs | 2963; 2964; 2965 |
| 2516 | BLFS79 | 43; 44; 105 in core and homologs | 2966; 2967; 2968; 2969; 2970; 2971; 2972; 2973; 2974; 2975 |
| 2517 | BLFS80 | 17; 78; 19 in core | |
| 2518 | BLFS82 | no domains in core | |
| 2519 | BLFS83 | 106; 79; 107; 108; 17; 66; 78; 109 in core and homologs | 2989; 2990; 2991; 2992; 2993; 2994; 2995; 2996; 2997; 2998; 2999 |
| 2520 | BLFS84 | 86; 110 in core and homologs | 3000; 3001; 3002; 3003; 3004; 3005; 3006 |

TABLE 17-continued

Core and homologous polypeptides comprising the same domains

| Core Polypeptide (SEQ ID NO) | Gene Name (Core) | Characteristic Domains (Domain identifier) | Homologous Polypeptides Comprising the Domains (SEQ ID NOs) |
|---|---|---|---|
| 2521 | BLFS85 | 71; 24; 111 in core and homologs | 3007; 3008; 3009; 3010; 3011; 3012; 3013; 3014; 3015; 3016; 3017 |
| 2522 | BLFS86 | no domains in core | |
| 2523 | BLFS87 | 17; 60; 112; 76; 24; 113; 114 in core and homologs | 3024; 3025; 3026; 3027; 3028; 3029; 3030; 3031; 3032; 3033; 3034 |
| 2524 | BLFS88 | no domains in core | |
| 2525 | BLFS89 | 24; 113; 76 in core and homologs | 3044; 3045; 3046; 3047; 3048; 3049; 3050; 3051; 3052 |
| 2526 | BLFS90 | 115; 116 in core and homologs | 3053; 3054; 3055; 3056; 3057; 3058; 3059; 3060; 3061 |
| 2527 | BLFS91 | no domains in core | |
| 2528 | BLFS92 | 34; 35; 36; 37; 38 in core and homologs | 3073; 3074; 3075; 3076; 3077; 3078; 3079; 3080; 3081 |
| 2529 | BLFS93 | 117; 24 in core and homologs | 3082; 3083; 3084; 3085; 3086; 3087; 3088; 3089; 3090; 3091; 3092 |
| 2530 | BLFS94 | 17; 118 in core and homologs | 3093; 3094; 3095; 3096; 3097; 3098; 3099; 3100; 3101 |
| 2531 | BLFS95 | no domains in core | |
| 2532 | BLFS96 | 7; 10; 6 in core | |
| 2533 | BLFS97 | 119 in core | |
| 2534 | BLFS98 | 34 in core and homologs | 3111; 3112; 3113; 3114; 3115; 3116; 3117; 3118; 3119; 3120; 3121; 3122; 3123; 3124; 3125; 3126 |
| 2535 | BLFS99 | 120; 121; 122 in core and homologs | 3127; 3128; 3129; 3130; 3131; 3132; 3133; 3134; 3135; 3136; 3137; 3138 |
| 2536 | BLFS100 | 120; 121; 122 in core and homologs | 3139; 3140; 3141; 3142; 3143; 3144; 3145; 3146; 3147; 3148; 3149; 315 0; 3151; 3152; 3153; 3154 |
| 2537 | BLFS101 | 52 in core and homologs | 3155; 3156; 3157; 3158; 3159; 3160; 3161; 3162; 3163; 3164; 3165; 3166; 3167; 3168; 3169; 3170 |
| 2538 | BLFS102 | no domains in core | |
| 2539 | BLFS103 | no domains in core | |
| 2540 | BLFS104 | no domains in core | |
| 2541 | BLFS105 | 123 in core and homologs | 3194; 3195; 3196; 3197; 3198; 3199; 3200; 3201; 3202; 3203; 3204; 3205; 3206 |
| 2542 | BLFS106 | 124 in core and homologs | 3207; 3208; 3209; 3210; 3211; 3212; 3213; 3214; 3215; 3216; 3217; 3218; 3219; 3220; 3221; 3222; 3223; 3224; 3225; 3226; 3227 |
| 2543 | BLFS107 | 125 in core and homologs | 3228; 3229; 3230; 3231; 3232; 3233; 3234; 3235; 3236; 3237; 3238; 3239; 3240; 3241; 3242; 3243; 3244; 3245 |
| 2544 | BLFS108 | 126 in core and homologs | 3246; 3247; 3248; 3249; 3250; 3251; 3252; 3253; 3254 |
| 2545 | BLFS109 | 127 in core and homologs | 3255; 3256 |
| 2546 | BLFS110 | 128 in core and homologs | 3257 |
| 2547 | BLFS111 | 129 in core and homologs | 3258; 3259; 3260; 3261; 3262 |
| 2548 | BLFS112 | no domains in core | |
| 2549 | BLFS113 | 130; 131 in core and homologs | 3276; 3277; 3278; 3279; 3280; 3281; 3282; 3283; 3284; 3285; 3286; 3287; 3288; 3289; 3290; 3291; 3292; 3293; 3294; 3295; 3296; 3297; 3298; 3299; 3300 |
| 2550 | BLFS114 | 132 in core and homologs | 3301; 3302; 3303; 3304; 3305; 3306; 3307; 3308; 3309; 3310; 3311; 3312; 3313; 3314; 3315; 3316; 3317; 3318; 3319; 3320; 3321; 3322; 3323; 3324; 3325 |
| 2551 | BLFS115 | 34; 133; 35; 37 in core and homologs | 3326; 3327; 3328; 3329; 3330; 3331; 3332; 3333; 3334; 3335; 3336; 3337; 3338; 3339; 3340; 3341; 3342; 3343; 3344; 3345; 3346; 3347; 3348; 3349; 3350; 3351; 3352; 3353; 3354 |
| 2552 | BLFS116 | 86; 110 in core and homologs | 3355; 3356; 3357; 3358; 3359; 3360; 3361; 3362; 3363; 3364; 3365; 3366; 3367; 3368; 3369; 3370; 3371; 3372; 3373; 3374; 3375; 3376 |
| 2553 | BLFS118 | 31; 32 in core and homologs | 3377; 3378; 3379; 3380; 3381; 3382; 3383; 3384; 3385; 3386; 3387; 3388; 3389; 3390; 3391; 3392; 3393; 3394 |

TABLE 17-continued

Core and homologous polypeptides comprising the same domains

| Core Polypeptide (SEQ ID NO) | Gene Name (Core) | Characteristic Domains (Domain identifier) | Homologous Polypeptides Comprising the Domains (SEQ ID NOs) |
|---|---|---|---|
| 2554 | BLFS119 | no domains in core | |
| 2555 | BLFS120 | 134; 135 in core and homologs | 3399; 3400; 3401 |
| 2556 | BLFS121 | 136; 137; 138; 139; 140 in core and homologs | 3402; 3403; 3404; 3405; 3406; 3407; 3 408; 3409; 3410; 3411; 3412; 3413; 34 14; 3415; 3416; 3417; 3418; 3419; 342 0; 3421; 3422; 3423 |
| 2557 | BLFS122 | no domains in core | |
| 2558 | BLFS123 | 141; 8 in core and homologs | 3431; 3432; 3433; 3434 |
| 2559 | BLFS124 | 142 in core and homologs | 3435; 3436; 3437; 3438; 3439; 3440; 3 441; 3442; 3443; 3444; 3445; 3446; 34 47; 3448; 3449; 3450; 3451 |
| 2560 | BLFS125 | 72 in core and homologs | 3452; 3453; 3454; 3455; 3456; 3457; 3 458; 3459; 3460; 3461; 3462; 3463; 34 64; 3465; 3466; 3467 |
| 2561 | BLFS126 | no domains in core | |
| 2562 | BLFS127 | 24 in core and homologs | 3476; 3477; 3478; 3479; 3480; 3481; 3 482; 3483; 3484; 3485; 3486; 3487; 34 88; 3489; 3490; 3491 |
| 2563 | BLFS128 | 143; 144; 145 in core and homologs | 3492; 3493; 3494; 3495; 3496; 3497; 3 498; 3499; 3500; 3501; 3502; 3503; 35 04; 3505; 3506; 3507; 3508 |
| 2564 | BLFS129 | 146; 82 in core and homologs | 3509; 3510; 3511; 3512; 3513; 3514; 3 515; 3516; 3517; 3518; 3519 |
| 2565 | BLFS130 | 147; 148; 115; 116 in core and homologs | 3520; 3521; 3522; 3523; 3524 |
| 2566 | BLFS131 | 83 in core and homologs | 3525; 3526; 3527; 3528; 3529; 3530; 3 531; 3532; 3533; 3534; 3535; 3536; 35 37; 3538; 3539; 3540; 3541; 3542; 354 3; 3544; 3545; 3546; 3547; 3548 |
| 2567 | BLFS132 | no domains in core | |
| 2568 | BLFS133 | no domains in core | |
| 2569 | BLFS134 | 149 in core and homologs | 3577; 3578; 3579; 3580; 3581; 3582; 3 583; 3584; 3585; 3586; 3587; 3588; 35 89; 3590; 3591; 3592; 3593; 3594; 359 5; 3596; 3597; 3598; 3599; 3600; 3601; 3602; 3603 |
| 2570 | BLFS135 | 60; 68 in core and homologs | 3604; 3605; 3606; 3607; 3608; 3609; 3 610; 3611; 3612; 3613; 3614; 3615 |
| 2571 | BLFS136 | 150; 151 in core and homologs | 3616 |
| 2572 | BLFS137 | 152; 153 in core and homologs | 3617; 3618; 3619; 3620; 3621 |
| 2573 | BLFS138 | 154; 155 in core and homologs | 3622; '3623; '3624; 3625; :3626; 3627; :3 628; 3629; 3630; 3631; 3632; 3633 |
| 2574 | BLFS139 | 31; 32; 8; 30 in core and homologs | 3634; 3635; 3636; 3637; 3638; 3639; 3 640; 3641; 3642; 3643; 3644; 3645; 36 46 |
| 2575 | BLFS140 | 156; 157; 158; 159; 24; 160 in core and homologs | 3647; 3648; 3649; 3650; 3651; 3652; 3 653; 3654; 3655; 3656; 3657; 3658; 36 59; 3660 |
| 2576 | BLFS141 | 161; 162; 163; 24 in core and homologs | 3661; 3662; 3663; 3664; 3665; 3666; 3 667; 3668; 3669; 3670; 3671; 3672; 36 73; 3674; 3675; 3676; 3677; 3678; 367 9 |
| 2577 | BLFS142 | 45 in core and homologs | 3680; 3681; 3682; 3683; 3684; 3685; 3 686; 3687; 3688; 3689; 3690 |
| 2578 | BLFS143 | 164; 165; 166 in core and homologs | 3691; 3692; 3693; 3694; 3695; 3696; 3 697; 3698; 3699; 3700; 3701; 3702; 37 03; 3704 |
| 2579 | BLFS144 | 72; 167; 73; 168; 169; 170 in core and homologs | 3705; 3706; 3707; 3708; 3709; 3710; 3 711; 3712; 3713; 3714; 3715 |
| 2580 | BLFS145 | 103; 171; 172; 173 in core and homologs | 3716; 3717; 3718; 3719; 3720; 3721; 3 722; 3723; 3724; 3725; 3726; 3727; 37 28; 3729 |
| 2581 | BLFS146 | 74; 75 in core and homologs | 3730; 3731; 3732; 3733; 3734; 3735; 3 736; 3737; 3738; 3739; 3740; 3741; 37 42; 3743; 3744; 3745; 3746; 3747; 374 8; 3749 |
| 2582 | BLFS147 | 174; 143; 39 in core and homologs | 3750; 3751; 3752; 3753; 3754; 3755; 3 756; 3757; 3758; 3759 |
| 2583 | BLFS148 | 52 in core and homologs | 3760; 3761; 3762; 3763; 3764; 3765; 3 766; 3767; 3768; 3769; 3770; 3771; 37 72; 3773; 3774; 3775; 3776; 3777; 377 8; 3779; 3780; 3781 |

TABLE 17-continued

Core and homologous polypeptides comprising the same domains

| Core Polypeptide (SEQ ID NO) | Gene Name (Core) | Characteristic Domains (Domain identifier) | Homologous Polypeptides Comprising the Domains (SEQ ID NOs) |
|---|---|---|---|
| 2584 | BLFS149 | 175; 60; 61; 62; 63; 24; 64; 17; 65; 66; 67 in core and homologs | 3782; 3783; 3784; 3785; 3786; 3787; 3788; 3789; 3790; 3791; 3792; 3793; 3794; 3795; 3796; 3797 |
| 2585 | BLFS150 | no domains in core | |
| 2586 | BLFS151 | 86; 110 in core and homologs | 3798; 3799; 3800 |
| 2587 | BLFS152 | 176; 177 in core and homologs | 3801; 3802 |
| 2588 | BLFS153 | 34; 178; 179; 180; 181 in core and homologs | 3803; 3804; 3805; 3806; 3807; 3808 |
| 2589 | BLFS154 | 182 in core and homologs | 3809; 3810 |
| 2590 | BLFS155 | 4; 5 in core and homologs | 3811; 3812 |
| 2591 | BLFS156 | 1; 2; 3 in core | |
| 2592 | BLFS157 | 99; 100; 183; 184; 6; 102 in core | |
| 2593 | BLFS158 | 185; 186; 187 in core and homologs | 3813 |
| 2594 | BLFS159 | no domains in core | |
| 2595 | PUB6 | 188; 7; 10; 189 in core and homologs | 3816; 3817; 3818; 3819; 3820; 3821; 3822; 3823; 3824; 3825 |
| 2596 | PUB23 | 190; 191; 7; 10; 192; 193; 194; 19 in core | |
| 2597 | PUB31 | 195; 196; 7; 10; 19 in core | |
| 2598 | PUB65 | 197; 15; 7; 198; 10; 82; 199; 200; 201; 202 in core and homologs | 3826; 3827; 3828; 3829; 3830; 3831; 3832; 3833; 3834; 3835; 3836; 3837; 3838; 3839; 3840; 3841; 3842; 3843; 3844; 3845 |
| 2599 | ZLFS1 | 203; 204; 205 in core and homologs | 3846 |
| 2600 | ZLFS2 | 206 in core and homologs | 3847; 3848; 3849; 3850; 3851; 3852; 3853; 3854; 3855; 3856; 3857; 3858; 3859; 3860; 3861; 3862; 3863; 3864; 3865 |
| 2601 | ZLFS3 | 31; 32; 8; 30 in core and homologs | 3866; 3867; 3868; 3869; 3870; 3871; 3872; 3873; 3874; 3875; 3876; 3877; 3878; 3879; 3880; 3881; 3882; 3883 |
| 2602 | ZLFS5 | 123 in core and homologs | 3884; 3885; 3886; 3887; 3888 |
| 2603 | ZLFS6 | 207; 208 in core and homologs | 3889; 3890; 3891; 3892; 3893 |
| 2604 | ZLFS7 | 209 in core and homologs | 3894 |
| 2605 | ZLFS8 | 210; 211 in core and homologs | 3895; 3896 |
| 2606 | ZLFS9 | 113; 24 in core and homologs | 3897 |
| 2607 | ZLFS10 | no domains in core | |
| 2608 | ZLFS11 | 212; 213; 214 in core and homologs | 3898; 3899 |
| 2609 | ZLFS12 | 215; 216; 217; 218 in core and homologs | 3900; 3901; 3902 |
| 2610 | ZLFS13 | no domains in core | |
| 2611 | ZLFS14 | 126 in core and homologs | 3905 |
| 2612 | ZLFS15 | 219; 52 in core and homologs | 3906; 3907; 3908 |
| 2613 | ZLFS16 | 220; 221; 103; 171; 173; 172 in core and homologs | 3909; 3910; 3911; 3912; 3913; 3914; 3915 |
| 2614 | ZLFS17 | 2; 1; 222 in core and homologs | 3916 |
| 2615 | ZLFS18 | 99; 100; 102 in core and homologs | 3917 |
| 2616 | ZLFS19 | 31; 74; 32; 75 in core and homologs | 3918; 3919; 3920; 3921; 3922; 3923; 3924; 3925; 3926; 3927 |
| 2617 | ZLFS21 | 223; 101; 224 in core and homologs | 3928; 3929; 3930; 3931; 3932; 3933; 3934; 3935; 3936; 3937; 3938; 3939; 3940 |
| 2618 | ZLFS22 | 225; 31; 32; 226 in core and homologs | 3941; 3942; 3943; 3944; 3945; 3946; 3947; 3948; 3949; 3950; 3951; 3952; 3953 |
| 2619 | ZLFS23 | 82; 92; 227 in core and homologs | 3954; 3955; 3956; 3957; 3958; 3959; 3960 |
| 2620 | ZLFS24 | 176; 228; 229; 230; 231 in core and homologs | 3961; 3962; 3963; 3964; 3965; 3966; 3967; 3968; 3969; 3970; 3971; 3972; 3973; 3974; 3975; 3976 |
| 2621 | ZLFS25 | 176; 232; 177 in core and homologs | 3977; 3978; 3979; 3980; 3981; 3982; 3983 |
| 2622 | ZLFS27 | 31; 233; 32; 101; 234 in core and homologs | 3984; 3985; 3986; 3987; 3988; 3989; 3990; 3991; 3992; 3993; 3994; 3995; 3996; 3997; 3998; 3999; 4000; 4001; 4002; 4003; 4004; 4005; 4006; 4007 |
| 2623 | ZLFS28 | 86; 110 in core and homologs | 4008; 4009; 4010; 4011; 4012; 4013; 4014; 4015; 4016; 4017; 4018; 4019; 4020; 4021; 4022 |

TABLE 17-continued

Core and homologous polypeptides comprising the same domains

| Core Polypeptide (SEQ ID NO) | Gene Name (Core) | Characteristic Domains (Domain identifier) | Homologous Polypeptides Comprising the Domains (SEQ ID NOs) |
|---|---|---|---|
| 2624 | ZLFS29 | 235; 219; 52 in core and homologs | 4023; 4024; 4025; 4026; 4027; 4028; 4029; 4030; 4031; 4032; 4033; 4034; 4035; 4036; 4037; 4038; 4039; 4040; 4041; 4042; 4043; 4044; 4045; 4046; 4047; 4048 |
| 2625 | ZLFS30 | 136; 140; 236 in core and homologs | 4049; 4050; 4051; 4052; 4053; 4054; 4055; 4056; 4057; 4058; 4059; 4060; 4061; 4062; 4063; 4064; 4065; 4066; 4067; 4068 |
| 2626 | ZLFS31 | 228; 230; 229; 231 in core and homologs | 4069; 4070; 4071; 4072; 4073; 4074; 4075; 4076; 4077; 4078; 4079; 4080; 4081 |
| 2627 | ZLFS32 | 237; 238; 239 in core and homologs | 4082; 4083; 4084; 4085; 4086; 4087; 4088; 4089; 4090; 4091; 4092; 4093; 4094; 4095; 4096; 4097 |
| 2628 | ZLFS33 | 60; 68 in core and homologs | 4098; 4099 |
| 2629 | ZLFS34 | 240; 241; 242 in core and homologs | 4100; 4101; 4102; 4103; 4104; 4105; 4106; 4107; 4108; 4109; 4110; 4111; 4112; 4113; 4114; 4115; 4116; 4117; 4118; 4119 |
| 2630 | ZLFS35 | no domains in core | |
| 2631 | ZLFS36 | no domains in core | |
| 2632 | ZLFS37 | 243; 244 in core and homologs | 4126; 4127; 4128; 4129; 4130; 4131; 4132; 4133; 4134; 4135; 4136; 4137; 4138; 4139; 4140; 4141; 4142; 4143; 4144; 4145; 4146; 4147; 4148; 4149; 4150; 4151; 4152; 4153 |
| 2633 | ZLFS38 | 245; 246; 247; 248; 249 in core and homologs | 4154; 4155; 4156; 4157; 4158; 4159; 4160; 4161; 4162; 4163; 4164; 4165; 4166; 4167; 4168; 4169; 4170; 4171; 4172; 4173; 4174; 4175; 4176 |
| 2634 | ZLFS39 | 250; 60; 251; 24; 71; 17; 252; 111 in core and homologs | 4177; 4178; 4179; 4180; 4181; 4182; 4183; 4184; 4185; 4186; 4187; 4188; 4189; 4190; 4191; 4192; 4193; 4194; 4195; 4196; 4197; 4198; 4199; 4200; 4201 |
| 2635 | ZLFS42 | 1; 2; 3 in core and homologs | 2637; 2660; 4202; 4203; 4204; 4205; 4206; 4207; 4208; 4209; 4210 |
| 2636 | ZLFS44 | 8; 30 in core and homologs | 4211; 4212; 4213; 4214; 4215; 4216; 4217; 4218; 4219; 4220; 4221; 4222; 4223; 4224; 4225; 4226; 4227; 4228; 4229; 4230; 4231 |
| 2637 | ZLFS45 | 2; 1; 3 in core and homologs | 4202; 4203; 4204; 4205; 4206; 4207; 4208; 4209; 4210; 4232 |
| 2638 | ZLFS47 | 2; 1; 222; 92 in core | |
| 2639 | ZLFS48 | 2; 1; 222 in core and homologs | 3916 |
| 2640 | ZLFS49 | 4; 74; 5 in core and homologs | 4233; 4234 |
| 2641 | ZLFS51 | 31; 40; 41; 42; 32; 24 in core and homologs | 4235; 4236; 4237; 4238; 4239; 4240; 4241; 4242; 4243; 4244; 4245; 4246; 4247; 4248; 4249; 4250; 4251; 4252 |

TABLE 18

Details of identified domains presented in Table 17

| Domain Identifier | InterPro No. | Accession No. | Description |
|---|---|---|---|
| 1 | IPR011024 | SSF49695 | Gamma-crystallin-like |
| 2 | IPR015791 | G3DSA:2.60.20.30 | Antimicrobial/protein inhibitor, gamma-crystallin-like |
| 3 | IPR015161 | PF09076 | Beta/Gamma crystallin *Streptomyces* killer toxin-like, beta/gamma crystallin |
| 4 | IPR001480 | PS50927 | Bulb-type lectin domain profile. Bulb-type lectin domain |
| 5 | IPR036426 | G3DSA:2.90.10.10 | Bulb-type lectin domain superfamily |
| 6 | IPR004991 | PF03318 | Clostridium epsilon toxin ETX/*Bacillus* mosquitocidal toxin MTX2 Aerolysin-like toxin |
| 7 | IPR035992 | SSF50370 | Ricin B-like lectins |
| 8 | IPR038765 | SSF54001 | Papain-like cysteine peptidase superfamily |
| 9 | IPR013688 | PF08481 | GBS Bsp-like repeat GBS Bsp-like |

TABLE 18-continued

Details of identified domains presented in Table 17

| Domain Identifier | InterPro No. | Accession No. | Description |
|---|---|---|---|
| 10 | IPR000772 | cd00161 | RICIN Ricin B, lectin domain |
| 11 | IPR008999 | SSF50405 | Actin-crosslinking |
| 12 | IPR039564 | PF13529 | Peptidase C39 like family Peptidase C39-like |
| 13 | IPR001322 | PF00932 | Lamin Tail Domain Lamin tail domain |
| 14 | IPR036415 | SSF74853 | Lamin tail domain superfamily |
| 15 | IPR032812 | PF13205 | Bacterial Ig-like domain SbsA, Ig-like domain |
| 16 | IPR005077 | PF03415 | Clostripain family Peptidase C11, clostripain |
| 17 | IPR013783 | G3DSA:2.60.40.10 | Immunoglobulin-like fold |
| 18 | IPR003737 | PF02585 | GlcNAc-PI de-N-acetylase N-acetylglucosaminyl phosphatidylinositol deacetylase-related |
| 19 | IPR008979 | G3DSA:2.60.120.260 | Galactose-binding-like domain superfamily |
| 20 | IPR024078 | SSF102588 | Putative deacetylase LmbE-like domain superfamily |
| 21 | IPR008270 | PS00953 | Glycosyl hydrolases family 25 active sites signature. Glycoside hydrolase, family 25, active site |
| 22 | IPR002053 | PF01183 | Glycosyl hydrolases family 25 Glycoside hydrolase, family 25 |
| 23 | IPRO 18077 | SM00641 | Glycoside hydrolase, family 25 subgroup |
| 24 | IPR017853 | SSF51445 | Glycoside hydrolase superfamily |
| 25 | IPR009045 | G3DSA:3.30.1380.10 | Hedgehog signalling/DD-peptidase zinc-binding domain superfamily |
| 26 | IPR003709 | PF02557 | D-alanyl-D-alanine carboxypeptidase Peptidase M15B |
| 27 | IPRO 12340 | SSF50249 | Nucleic acid-binding, OB-fold |
| 28 | IPR003029 | PS50126 | S1 domain profile. S1 domain |
| 29 | IPR022967 | SM00316 | RNA-binding domain, S1 |
| 30 | IPR000064 | PF00877 | NlpC/P60 family Endopeptidase, NLPC/P60 domain |
| 31 | IPRO 18392 | SM00257 | LysM domain |
| 32 | IPR036779 | G3DSA:3.10.350.10 | LysM domain superfamily |
| 33 | IPR022887 | MF_02014 | Cell division suppressor protein YneA [yneA], Cell division suppressor protein, YneA |
| 34 | IPR009003 | SSF50494 | Peptidase S1, PA clan |
| 35 | IPR036034 | SSF50156 | PDZ superfamily |
| 36 | IPR008763 | PF05580 | SpoIVB peptidase S55 Peptidase S55, SpoIVB |
| 37 | IPR001478 | PS50106 | PDZ domain profile. PDZ domain |
| 38 | IPR014219 | TIGR02860 | spore_IV_B: stage IV sporulation protein B Peptidase S55, sporulation stage IV, protein B |
| 39 | IPR003646 | PF08239 | Bacterial SH3 domain SH3-like domain, bacterial-type |
| 40 | IPR001223 | PF00704 | Glycosyl hydrolases family 18 Glycoside hydrolase family 18, catalytic domain |
| 41 | IPR011583 | SM00636 | Chitinase II |
| 42 | IPR029070 | G3DSA:3.10.50.10 | Chitinase insertion domain superfamily |
| 43 | IPR011330 | SSF88713 | Glycoside hydrolase/deacetylase, beta/alpha-barrel |
| 44 | IPR002509 | PS51677 | NodB homology domain profile. NodB homology domain |
| 45 | IPR011105 | PF07486 | Cell Wall Hydrolase Cell wall hydrolase, SleB |
| 46 | IPR010310 | PF06013 | Proteins of 100 residues with WXG Type VII secretion system ESAT-6-like |
| 47 | IPR037146 | G3DSA:3.90.540.10 | Colicin/pyocin, DNase domain superfamily |
| 48 | IPR036689 | SSF140453 | ESAT-6-like superfamily |
| 49 | IPR001119 | PF00395 | S-layer homology domain S-layer homology domain |
| 50 | IPR019730 | PF10794 | Protein of unknown function (DUF2606) Protein of unknown function DUF2606 |
| 51 | IPR013784 | SSF49452 | Carbohydrate-binding-like fold |
| 52 | IPR001915 | PF01435 | Peptidase family M48 Peptidase M48 |
| 53 | IPR008915 | PF02163 | Peptidase family M50 Peptidase M50 |
| 54 | IPR004387 | TIGR00054 | TIGR00054: RIP metalloprotease RseP Peptidase M50, putative membrane-associated zinc metallopeptidase |
| 55 | IPR025493 | PF14326 | Domain of unknown function (DUF4384) Domain of unknown function DUF4384 |
| 56 | IPR015059 | PF08964 | Beta/Gamma crystallin Calcium-dependent cell adhesion molecule, N-terminal |
| 57 | IPR001064 | PS50915 | Crystallins beta and gamma 'Greek key' motif profile. Beta/gamma crystallin |
| 58 | IPR036404 | G3DSA:2.100.10.30 | Jacalin-like lectin domain superfamily |
| 59 | IPR001229 | PS51752 | Jacalin-type lectin domain profile. Jacalin-like lectin domain |

TABLE 18-continued

Details of identified domains presented in Table 17

| Domain Identifier | InterPro No. | Accession No. | Description |
|---|---|---|---|
| 60 | IPR014756 | SSF81296 | Immunoglobulin E-set |
| 61 | IPR015883 | PF00728 | Glycosyl hydrolase family 20, catalytic domain Glycoside hydrolase family 20, catalytic domain |
| 62 | IPR015882 | PF02838 | Glycosyl hydrolase family 20, domain 2 Beta-hexosaminidase, bacterial type, N-terminal |
| 63 | IPR012291 | G3DSA:2.60.40.290 | CBM2, carbohydrate-binding domain superfamily |
| 64 | IPR029018 | G3DSA:3.30.379.10 | Beta-hexosaminidase-like, domain 2 |
| 65 | IPR025705 | PR00738 | Glycosyl hydrolase family 20 signature Beta-hexosaminidase |
| 66 | IPR008965 | SSF49384 | CBM2/CBM3, carbohydrate-binding domain superfamily |
| 67 | IPR004866 | PF03173 | Putative carbohydrate binding domain Chitobiase/beta-hexosaminidases, N-terminal domain |
| 68 | IPR004302 | PF03067 | Lytic polysaccharide mono-oxygenase, cellulose-degrading Cellulose/chitin-binding protein, N-terminal |
| 69 | IPR013785 | G3DSA:3.20.20.70 | Aldolase-type TIM barrel |
| 70 | IPR002241 | PF16499 | Alpha galactosidase A Glycoside hydrolase, family 27 |
| 71 | IPR013780 | G3DSA:2.60.40.1180 | Glycosyl hydrolase, all-beta |
| 72 | IPR025711 | PF13670 | Peptidase propeptide and YPEB domain PepSY domain |
| 73 | IPR011096 | PF07504 | Fungalysin/Thermolysin Propeptide Motif FTP domain |
| 74 | IPR011055 | G3DSA:2.70.70.10 | Duplicated hybrid motif |
| 75 | IPR016047 | PF01551 | Peptidase family M23 Peptidase M23 |
| 76 | IPR001547 | PF00150 | Cellulase (glycosyl hydrolase family 5) Glycoside hydrolase, family 5 |
| 77 | IPR007484 | PF04389 | Peptidase family M28 Peptidase M28 |
| 78 | IPR036116 | SSF49265 | Fibronectin type III superfamily |
| 79 | IPR003961 | cd00063 | FN3 Fibronectin type III |
| 80 | IPR002594 | PF01670 | Glycosyl hydrolase family 12 Glycoside hydrolase family 12 |
| 81 | IPR013319 | G3DSA:2.60.120.180 | Glycoside hydrolase family 11/12 |
| 82 | IPR013320 | SSF49899 | Concanavalin A-like lectin/glucanase domain superfamily |
| 83 | IPR008816 | PF05433 | Glycine zipper 2TM domain Glycine zipper 2TM domain |
| 84 | IPR011049 | SSF51120 | Serralysin-like metalloprotease, C-terminal |
| 85 | IPR001343 | PF00353 | RTX calcium-binding nonapeptide repeat (4 copies) RTX calcium-binding nonapeptide repeat |
| 86 | IPR029058 | G3DSA:3.40.50.1820 | Alpha/Beta hydrolase fold |
| 87 | IPR003995 | PR01488 | Gram-negative bacterial RTX toxin determinant A family signature RTX toxin determinant A |
| 88 | IPR018511 | PS00330 | Hemolysin-type calcium-binding region signature. Hemolysin-type calcium-binding conserved site |
| 89 | IPR021731 | PF11741 | AMIN domain AMIN domain |
| 90 | IPR002508 | cd02696 | MurNAc-LAA N-acetylmuramoyl-L-alanine amidase, catalytic domain |
| 91 | IPR014262 | TIGR02913 | HAF_rpt: probable extracellular repeat, HAF family Extracellular HAF |
| 92 | IPR006311 | PS51318 | Twin arginine translocation (Tat) signal profile. Twin-arginine translocation pathway, signal sequence |
| 93 | IPR011050 | SSF51126 | Pectin lyase fold/virulence factor |
| 94 | IPR024973 | PF13018 | Extended Signal Peptide of Type V secretion system ESPR domain |
| 95 | IPR008638 | TIGR01901 | adhes_NPXG: filamentous hemagglutinin family N-terminal domain Filamentous haemagglutinin, N-terminal |
| 96 | IPR011493 | PF07581 | The GLUG motif GLUG |
| 97 | IPR012334 | G3DSA:2.160.20.10 | Pectin lyase fold |
| 98 | IPR003540 | PF03496 | ADP-ribosyltransferase exoenzyme ADP ribosyltransferase |
| 99 | IPR036365 | SSF47090 | PGBD-like superfamily |
| 100 | IPR002477 | PF01471 | Putative peptidoglycan binding domain Peptidoglycan binding-like |
| 101 | IPR023346 | SSF53955 | Lysozyme-like domain superfamily |
| 102 | IPR036366 | G3DSA:1.10.101.10 | PGBD superfamily |
| 103 | IPR012338 | SSF56601 | Beta-lactamase/transpeptidase-like |
| 104 | IPR001466 | PF00144 | Beta-lactamase Beta-lactamase-related |

TABLE 18-continued

Details of identified domains presented in Table 17

| Domain Identifier | InterPro No. | Accession No. | Description |
|---|---|---|---|
| 105 | IPR014235 | cd10948 | CE4_BsPdaA_like Peptidoglycan-N-acetylmuramic acid deacetylase PdaA |
| 106 | IPR036434 | SSF51989 | 1,4-beta cellobiohydrolase superfamily |
| 107 | IPR016288 | PF01341 | Glycosyl hydrolases family 6 1,4-beta cellobiohydrolase |
| 108 | IPR036966 | G3DSA:2.60.40.710 | Carbohydrate-binding module 3 superfamily |
| 109 | IPR001956 | PS51172 | CBM3 (carbohydrate binding type-3) domain profile. Carbohydrate-binding module 3 |
| 110 | IPR000073 | PF12697 | Alpha/beta hydrolase family Alpha/beta hydrolase fold-1 |
| 111 | IPR006047 | SM00642 | Glycosyl hydrolase, family 13, catalytic domain |
| 112 | IPR016282 | PIRSF001043 | Glycoside hydrolase, family 5, endoglucanase B |
| 113 | IPR018087 | PS00659 | Glycosyl hydrolases family 5 signature. Glycoside hydrolase, family 5, conserved site |
| 114 | IPR005102 | PF03442 | Carbohydrate binding domain X2 Carbohydrate binding X2 domain |
| 115 | IPR001611 | PS51450 | Leucine-rich repeat profile. Leucine-rich repeat |
| 116 | IPR032675 | G3DSA:3.80.10.10 | Leucine-rich repeat domain superfamily |
| 117 | IPR011683 | PF07745 | Glycosyl hydrolase family 53 Glycosyl hydrolase family 53 |
| 118 | IPR034641 | cd10318 | RGL11 Polysaccharide lyase family 11 |
| 119 | IPR020864 | PF01823 | MAC/Perforin domain Membrane attack complex component/perforin (MACPF) domain |
| 120 | IPR010854 | PF07338 | Protein of unknown function (DUF1471) Domain of unknown function DUF1471 |
| 121 | IPR036275 | SSF159871 | YdgH-like superfamily |
| 122 | IPR025543 | G3DSA:3.30.1660.10 | Dodecin-like |
| 123 | IPR009739 | PF07007 | Lysozyme inhibitor LprI Lysozyme inhibitor LprI, N-terminal |
| 124 | IPR010279 | PF05957 | Bacterial protein of unknown function (DUF883) Inner membrane protein YqjD/ElaB |
| 125 | IPR007893 | SM00972 | Spore coat protein U |
| 126 | IPR009241 | PF05973 | Phage derived protein Gp49-like (DUF891) Toxin HigB-like |
| 127 | IPR006914 | PF04829 | Pre-toxin domain with VENN motif VENN motif-containing domain |
| 128 | IPR013728 | PF08522 | Domain of unknown function (DUF1735) Domain of unknown function DUF1735 |
| 129 | IPR003848 | cd06259 | YdcF-like Domain of unknown function DUF218 |
| 130 | IPR005490 | PF03734 | L,D-transpeptidase catalytic domain L,D-transpeptidase catalytic domain |
| 131 | IPR038063 | SSF141523 | L,D-transpeptidase catalytic domain-like |
| 132 | IPR021109 | SSF50630 | Aspartic peptidase domain superfamily |
| 133 | IPR001940 | PR00834 | HtrA/DegQ protease family signature Peptidase S1C |
| 134 | IPR025425 | PF13665 | Domain of unknown function (DUF4150) Domain of unknown function DUF4150 |
| 135 | IPR028917 | PF15635 | GHH signature containing HNH/Endo VII superfamily nuclease toxin 2 Tox-GHH2 domain |
| 136 | IPR002933 | PF01546 | Peptidase family M20/M25/M40 Peptidase M20 |
| 137 | IPR001261 | PS00758 | ArgE/dapE/ACY1/CPG2/yscS family signature 1. ArgE/DapE/ACY1/CPG2/YscS. conserved site |
| 138 | IPR017150 | cd03885 | M20_CPDG2 Peptidase M20, glutamate carboxypeptidase |
| 139 | IPR011650 | PF07687 | Peptidase dimerisation domain Peptidase M20, dimerisation domain |
| 140 | IPR036264 | SSF55031 | Bacterial exopeptidase dimerisation domain |
| 141 | IPR000668 | PF00112 | Papain family cysteine protease Peptidase C1A, papain C-terminal |
| 142 | IPR012661 | PF09498 | Protein of unknown function (DUF2388) Conserved hypothetical protein CHP02448 |
| 143 | IPR002901 | PF01832 | Mannosyl-glycoprotein endo-beta-N-acetylglucosaminidase Mannosyl-glycoprotein endo-beta-N-acetylglucosamidase-like domain |
| 144 | IPR013377 | TIGR02541 | flagell_FlgJ: flagellar rod assembly protein/muramidase FlgJ Peptidoglycan hydrolase FlgJ |
| 145 | IPR019301 | PF10135 | Rod binding protein Flagellar protein FlgJ, N-terminal |
| 146 | IPR014895 | PF08787 | Alginate lyase Alginate lyase 2 |
| 147 | IPR029487 | PF14496 | C-terminal novel E3 ligase, LRR-interacting Novel E3 ligase domain |

TABLE 18-continued

Details of identified domains presented in Table 17

| Domain Identifier | InterPro No. | Accession No. | Description |
|---|---|---|---|
| 148 | IPR003591 | SM00369 | Leucine-rich repeat, typical subtype |
| 149 | IPR021357 | PF11191 | Protein of unknown function (DUF2782) Protein of unknown function DUF2782 |
| 150 | IPR007055 | PS50914 | BON domain profile. BON domain |
| 151 | IPR014004 | SM00749 | Transport-associated and nodulation domain, bacteria |
| 152 | IPR015286 | PF09203 | MspA Porin family, mycobacterial-type |
| 153 | IPR036435 | SSF56959 | Leukocidin/porin MspA superfamily |
| 154 | IPR005320 | cd03146 | GAT1_Peptidase_E Peptidase S51 |
| 155 | IPR029062 | G3DSA:3.40.50.880 | Class I glutamine amidotransferase-like |
| 156 | IPR001764 | PF00933 | Glycosyl hydrolase family 3 N terminal domain Glycoside hydrolase, family 3, N-terminal |
| 157 | IPR002772 | PF01915 | Glycosyl hydrolase family 3 C-terminal domain Glycoside hydrolase family 3 C-terminal domain |
| 158 | IPR036962 | G3DSA:3.20.20.300 | Glycoside hydrolase, family 3, N-terminal domain superfamily |
| 159 | IPR019800 | PS00775 | Glycosyl hydrolases family 3 active site. Glycoside hydrolase, family 3, active site |
| 160 | IPR036881 | SSF52279 | Glycoside hydrolase family 3 C-terminal domain superfamily |
| 161 | IPR016714 | PIRSF018168 | Mannan endo-1,4-beta-mannosidase |
| 162 | IPR000805 | PR00739 | Glycosyl hydrolase family 26 signature Glycoside hydrolase family 26 |
| 163 | IPR022790 | PF02156 | Glycosyl hydrolase family 26 Glycosyl hydrolase family 26 domain |
| 164 | IPR029045 | SSF52096 | ClpP/crotonase-like domain superfamily |
| 165 | IPR002142 | PF01343 | Peptidase family S49 Peptidase S49 |
| 166 | IPR004635 | TIGR00706 | SppA_dom: signal peptide peptidase SppA, 36K type Peptidase S49, SppA |
| 167 | IPR027268 | G3DSA:1.10.390.10 | Peptidase M4/M1, CTD superfamily |
| 168 | IPR001570 | PF02868 | Thermolysin metallopeptidase, alpha-helical domain Peptidase M4, C-terminal |
| 169 | IPR013856 | PF01447 | Thermolysin metallopeptidase, catalytic domain Peptidase M4 domain |
| 170 | IPR023612 | PR00730 | Thermolysin metalloprotease (M4) family signature Peptidase M4 |
| 171 | IPR012907 | PF07943 | Penicillin-binding protein 5, C-terminal domain Peptidase S11, D-Ala-D-Alacarboxypeptidase A, C-terminal |
| 172 | IPR018044 | PR00725 | D-Ala-D-Alacarboxypeptidase 1 (S11) family signature Peptidase S11, D-alanyl-D-alanine carboxypeptidase A |
| 173 | IPR001967 | PF00768 | D-alanyl-D-alanine carboxypeptidase Peptidase S11, D-alanyl-D-alanine carboxypeptidase A, N-terminal |
| 174 | IPR007730 | PS51724 | SPOR domain profile. Sporulation-like domain |
| 175 | IPR004867 | cd02847 | E_set_Chitobiase_C Chitobiase C-terminal domain |
| 176 | IPR036514 | G3DSA:3.40.50.1110 | SGNH hydrolase superfamily |
| 177 | IPR013830 | PF13472 | GDSL-like Lipase/Acylhydrolase family SGNH hydrolase-type esterase domain |
| 178 | IPR001316 | PR00861 | Alpha-lytic endopeptidase serine protease (S2A) signature Peptidase S1A, streptogrisin |
| 179 | IPR033116 | PS00135 | Serine proteases, trypsin family, serine active site. Serine proteases, trypsin family, serine active site |
| 180 | IPR004236 | PF02983 | Alpha-lytic protease prodomain Peptidase S1A, alpha-lytic prodomain |
| 181 | IPR001254 | PF00089 | Trypsin Serine proteases, trypsin domain |
| 182 | IPR007921 | PF05257 | CHAP domain CHAP domain |
| 183 | IPR006616 | SM00696 | DM9 repeat |
| 184 | IPR024518 | PF11901 | Protein of unknown function (DUF3421) Domain of unknown function DUF3421 |
| 185 | IPR011051 | SSF51182 | RmlC-like cupin domain superfamily |
| 186 | IPR006045 | PF00190 | Cupin Cupin 1 |
| 187 | IPR014710 | G3DSA:2.60.120.10 | RmlC-like jelly roll fold |
| 188 | IPR001434 | PF01345 | Domain of unknown function DUF11 Domain of unknown function DUF11 |
| 189 | IPR008966 | SSF49401 | Adhesion domain superfamily |
| 190 | IPR036399 | G3DSA:2.100.10.10 | Pesticidal crystal protein, central domain superfamily |
| 191 | IPR005639 | PF03945 | delta endotoxin, N-terminal domain Pesticidal crystal protein, N-terminal |

TABLE 18-continued

Details of identified domains presented in Table 17

| Domain Identifier | InterPro No. | Accession No. | Description |
|---|---|---|---|
| 192 | IPR001178 | PF00555 | delta endotoxin Pesticidal crystal protein, central domain |
| 193 | IPR005638 | PF03944 | delta endotoxin Pesticidal crystal protein, C-terminal |
| 194 | IPR036716 | SSF56849 | Pesticidal crystal protein, N-terminal domain superfamily |
| 195 | IPR000909 | PF00388 | Phosphatidylinositol-specific phospholipase C, X domain Phosphatidylinositol-specific phospholipase C, X domain |
| 196 | IPR017946 | SSF51695 | PLC-like phosphodiesterase, TIM beta/alpha-barrel domain superfamily |
| 197 | IPR022409 | SM00089 | PKD/Chitinase domain |
| 198 | IPR000601 | PF00801 | PKD domain PKD domain |
| 199 | IPR036909 | SSF46626 | Cytochrome c-like domain superfamily |
| 200 | IPR015943 | G3DSA:2.130.10.10 | WD40/YVTN repeat-like-containing domain superfamily |
| 201 | IPR009056 | PS51007 | Cytochrome c family profile. Cytochrome c-like domain |
| 202 | IPR035986 | SSF49299 | PKD domain superfamily |
| 203 | IPR036574 | G3DSA:3.30.30.10 | Knottin, scorpion toxin-like superfamily |
| 204 | IPR003614 | cd00107 | Knot1 Knottin, scorpion toxin-like |
| 205 | IPR001542 | PF01097 | Arthropod defensin Defensin, invertebrate/fungal |
| 206 | IPR000834 | PS00132 | Zinc carboxypeptidases, zinc-binding region 1 signature. Peptidase M14, carboxypeptidase A |
| 207 | IPR007048 | PF04965 | Gene 25-like lysozyme GpW/Gp25/IraD |
| 208 | IPR017737 | TIGR03357 | VI_zyme: type VI secretion system lysozyme-like protein Type VI secretion system-related protein |
| 209 | IPR021459 | PF11308 | Glycosyl hydrolases related to GH101 family, GH129 Glycosyl hydrolases related to GH101 family, GHL1-GHL3 |
| 210 | IPR003610 | SM00495 | Carbohydrate-binding module family 5/12 |
| 211 | IPR036573 | SSF51055 | Carbohydrate-binding module superfamily 5/12 |
| 212 | IPR000184 | PF01103 | Surface antigen Bacterial surface antigen (D15) |
| 213 | IPR016035 | SSF52151 | Acyl transferase/acyl hydrolase/lysophospholipase |
| 214 | IPR002641 | PS51635 | Patatin-like phospholipase (PNPLA) domain profile. Patatin-like phospholipase domain |
| 215 | IPR036852 | SSF52743 | Peptidase S8/S53 domain superfamily |
| 216 | IPR030400 | PS51695 | Sedolisin domain profile. Sedolisin domain |
| 217 | IPR023828 | PS00138 | Serine proteases, subtilase family, serine active site. Peptidase S8, subtilisin, Ser-active site |
| 218 | IPR015366 | PF09286 | Pro-kumamolisin, activation domain Peptidase S53, activation domain |
| 219 | IPR011990 | SSF48452 | Tetratricopeptide-like helical domain superfamily |
| 220 | IPR037167 | G3DSA:2.60.410.10 | D-Ala-D-Ala carboxypeptidase, C-terminal domain superfamily |
| 221 | IPR015956 | SSF69189 | Penicillin-binding protein, C-terminal domain superfamily |
| 222 | IPR015201 | PD068438 | ANTIMICROBIAL PEPTIDE FUNGICIDE 3D-STRUCTURE DEFENSE SEQUENCING DIRECT AMP1 PLANT PRECURSOR Antimicrobial protein MiAMP1 |
| 223 | IPR023099 | G3DSA:3.30.386.10 | Glycoside hydrolase, family 46, N-terminal |
| 224 | IPR000400 | PS60000 | Chitosanases families 46 and 80 active sites signature. Glycoside hydrolase, family 46 |
| 225 | IPR036908 | SSF50685 | RlpA-like domain superfamily |
| 226 | IPR010611 | PF06725 | 3D domain 3D domain |
| 227 | IPR000757 | PF00722 | Glycosyl hydrolases family 16 Glycoside hydrolase family 16 |
| 228 | IPR005546 | PS51208 | Autotransporter beta-domain profile. Autotransporter beta-domain |
| 229 | IPR017186 | PIRSF037375 | Lipase, autotransporter EstA |
| 230 | IPR036709 | SSF103515 | Autotransporter beta-domain superfamily |
| 231 | IPR001087 | PF00657 | GDSL-like Lipase/Acylhydrolase GDSL lipase/esterase |
| 232 | IPR037460 | cd01823 | SEST like *Streptomyces* scabies esterase-like |
| 233 | IPR008258 | PF01464 | Transglycosylase SLT domain Transglycosylase SLT domain 1 |
| 234 | IPR000189 | PS00922 | Prokaryotic transglycosylases signature. Prokaryotic transglycosylase, active site |

TABLE 18-continued

Details of identified domains presented in Table 17

| Domain Identifier | InterPro No. | Accession No. | Description |
|---|---|---|---|
| 235 | IPR030873 | MF_00997 | Beta-barrel assembly-enhancing protease [bepA]. Beta-barrel assembly-enhancing protease |
| 236 | IPR010964 | TIGR01887 | dipeptidaselike: putative dipeptidase Peptidase M20A, peptidase V-related |
| 237 | IPR012341 | G3DSA:1.50.10.10 | Six-hairpin glycosidase-like superfamily |
| 238 | IPR008928 | SSF48208 | Six-hairpin glycosidase superfamily |
| 239 | IPR002037 | PR00735 | Glycosyl hydrolase family 8 signature Glycoside hydrolase, family 8 |
| 240 | IPR024077 | G3DSA:1.10.1370.10 | Neurolysin/Thimet oligopeptidase, domain 2 |
| 241 | IPR001567 | PF01432 | Peptidase family M3 Peptidase M3A/M3B catalytic domain |
| 242 | IPR034005 | cd06456 | M3A_DCP Peptidyl-dipeptidase DCP |
| 243 | IPR036913 | SSF160113 | YegP-like superfamily |
| 244 | IPR010879 | PF07411 | Domain of unknown function (DUF1508) Domain of unknown function DUF1508 |
| 245 | IPR012347 | G3DSA:1.20.1260.10 | Ferritin-like |
| 246 | IPR002024 | cd00907 | Bacterioferritin Bacterioferritin |
| 247 | IPR009040 | PS50905 | Ferritin-like diiron domain profile. Ferritin-like diiron domain |
| 248 | IPR009078 | SSF47240 | Ferritin-like superfamily |
| 249 | IPR008331 | PF00210 | Ferritin-like domain Ferritin/DPS protein domain |
| 250 | IPR011837 | TIGR02100 | glgX_debranch: glycogen debranching enzyme GlgX Glycogen debranching enzyme, GlgX type |
| 251 | IPR004193 | PF02922 | Carbohydrate-binding module 48 (Isoamylase N-terminal domain) Glycoside hydrolase, family 13, N-terminal |
| 252 | IPR022844 | MF_01248 | Glycogen debranching enzyme [glgX]. Glycogen debranching enzyme, bacterial |

Example 14: Cloning of Resistance-Conferring Bacterial Genes for Expression in E. coli The fungicidal effect of isolated bacterial polypeptides was examined by expressing the polypeptides in E. coli and purifying the expressed proteins. For expression in E. coli, selected genes were synthesized by Genscript. The original bacterial sequences were modified such that the codons were optimized for protein expression in E. coli (further details are available at genscript.com/tools/codon-frequency-table), and a 6-Histidine sequence tag was inserted at either the 5' or the 3' end.

In cases where the original bacterial sequences included a nucleic acid sequence encoding a native signal peptide, it was removed up to the native cleavage site separating the encoded mature protein (i.e., the protein not including the signal peptide) from the native signal peptide. The polynucleotide encoding the mature protein was further modified by adding an artificial initiator Methionine codon immediately after the cleavage site.

All optimized genes were synthesized with 5' NcoI and 3' EcoRI restrictions sites, and in some of the genes as a result of the addition of the restriction site an additional glycine residue codon was added at the $2^{nd}$ position (after the initiator Methionine codon) in order to maintain the reading frame of the coding sequence.

Genes lacking an original (native) signal peptide were cloned into pET22bd (a modified version of pET22B+ in which the periplasmic signal peptide PelB SEQ ID NO:5 was removed).

Genes having an original (native) signal peptide that was replaced with an artificial signal peptide were cloned into either the pET22bd and/or the pET22B+(purchased from Merck Millipore, merckmillipore. com/INTL/en/product/pET-22b %28%2B %29-DNA---Novagen,EMD_BIO-69744?ReferrerURL=%3A%2F%2Fwww.google.co(dot)il%2F&bd=1#anchor_Description) by digesting the gene and the vector with NcoI and EcoRI.

The sequence of each gene was verified by Sanger sequencing in each expression vector. All aforementioned modifications are summarized in Table 19 below.

TABLE 19

Sequences synthesized for cloning in E. coli

| Gene Name | Native Polyp. SEQ ID NO | Derived Polyp. SEQ ID NO | Synthesized Polyn. SEQ ID NO | Synthesized Polyp. SEQ ID NO | Modifications |
|---|---|---|---|---|---|
| BLFS1 | 2444 | 4776 | 4420 | 4617 | Native signal peptide removed; Met & 3' His-tag added |
| BLFS2 | 2445 | — | 4442 | 4639 | Gly & 3' His-tag added |
| BLFS3 | 2446 | 4698 | 4316 | 4513 | Native signal peptide removed; Met & 3' His-tag added |

TABLE 19-continued

Sequences synthesized for cloning in *E. coli*

| Gene Name | Native Polyp. SEQ ID NO | Derived Polyp. SEQ ID NO | Synthesized Polyn. SEQ ID NO | Synthesized Polyp. SEQ ID NO | Modifications |
|---|---|---|---|---|---|
| BLFS4 | 2447 | — | 4392 | 4589 | 3' His-tag added |
| BLFS5 | 2448 | 4744 | 4373 | 4570 | Native signal peptide removed; Met & 3' His-tag added |
| BLFS6 | 2449 | 4682 | 4298 | 4495 | Native signal peptide removed; MetGly & 3' His-tag added |
| BLFS7 | 2450 | 4753 | 4386 | 4583 | Native signal peptide removed; Met & 3' His-tag added |
| BLFS8 | 2451 | 4771 | 4414 | 4611 | Native signal peptide removed; MetGly & 3' His-tag added |
| BLFS9 | 2452 | 4757 | 4394 | 4591 | Native signal peptide removed; MetGly & 3' His-tag added |
| BLFS10 | 2453 | 4690 | 4306 | 4503 | Native signal peptide removed; MetGly & 3' His-tag added |
| BLFS11 | 2454 | 4669 | 4284 | 4481 | Native signal peptide removed; MetGly & 3' His-tag added |
| BLFS12 | 2455 | 4788 | 4435 | 4632 | Native signal peptide removed; Met & 3' His-tag added |
| BLFS13 | 2456 | 4673 | 4288 | 4485 | Native signal peptide removed; Met & 3' His-tag added |
| BLFS14 | 2457 | 4722 | 4344 | 4541 | Native signal peptide removed; Met & 3' His-tag added |
| BLFS15 | 2458 | 4678 | 4294 | 4491 | Native signal peptide removed; MetGly & 3' His-tag added |
| BLFS16 | 2459 | 4681 | 4297 | 4494 | Native signal peptide removed; MetGly & 3' His-tag added |
| BLFS17 | 2460 | 4671 | 4286 | 4483 | Native signal peptide removed; Met & 3' His-tag added |
| BLFS18 | 2461 | — | 4265 | 4462 | Gly & 3' His-tag added |
| BLFS19 | 2462 | 4712 | 4334 | 4531 | Native signal peptide removed; MetGly & 3' His-tag added |
| BLFS20 | 2463 | 4774 | 4417 | 4614 | Native signal peptide removed; Met & 3' His-tag added |
| BLFS21 | 2464 | 4751 | 4382 | 4579 | Native signal peptide removed; MetGly & 3' His-tag added |
| BLFS22 | 2465 | 4787 | 4434 | 4631 | Native signal peptide removed; Met & 3' His-tag added |
| BLFS23 | 2466 | 4653 | 4259 | 4456 | Native signal peptide removed; Met & 3' His-tag added |
| BLFS24 | 2467 | — | 4395 | 4592 | 3' His-tag added |
| BLFS25 | 2468 | 4799 | 4449 | 4646 | Native signal peptide removed; Met & 3' His-tag added |
| BLFS26 | 2469 | 4784 | 4430 | 4627 | Native signal peptide removed; Met & 3' His-tag added |
| BLFS29 | 2471 | 4657 | 4263 | 4460 | Native signal peptide removed; MetGly & 3' His-tag added |
| BLFS30 | 2472 | — | 4408 | 4605 | 3' His-tag added |
| BLFS31 | 2473 | 4726 | 4348 | 4545 | Native signal peptide removed; Met & 3' His-tag added |
| BLFS32 | 2474 | 4752 | 4384 | 4581 | Native signal peptide removed; Met & 3' His-tag added |

TABLE 19-continued

Sequences synthesized for cloning in E. coli

| Gene Name | Native Polyp. SEQ ID NO | Derived Polyp. SEQ ID NO | Synthesized Polyn. SEQ ID NO | Synthesized Polyp. SEQ ID NO | Modifications |
|---|---|---|---|---|---|
| BLFS33 | 2475 | 4701 | 4319 | 4516 | Native signal peptide removed; MetGly & 3' His-tag added |
| BLFS34 | 2476 | 4650 | 4256 | 4453 | Native signal peptide removed; Met & 3' His-tag added |
| BLFS35 | 2477 | 4778 | 4423 | 4620 | Native signal peptide removed; Met & 3' His-tag added |
| BLFS36 | 2478 | 4772 | 4415 | 4612 | Native signal peptide removed; MetGly & 3' His-tag added |
| BLFS37 | 2479 | — | 4368 | 4565 | Gly & 3' His-tag added |
| BLFS38 | 2480 | — | 4281 | 4478 | Gly & 3' His-tag added |
| BLFS39 | 2481 | 4732 | 4356 | 4553 | Native signal peptide removed; MetGly & 3' His-tag added |
| BLFS41 | 2482 | 4781 | 4427 | 4624 | Native signal peptide removed; MetGly & 3' His-tag added |
| BLFS42 | 2483 | 4763 | 4404 | 4601 | Native signal peptide removed; MetGly & 3' His-tag added |
| BLFS43 | 2484 | 4683 | 4299 | 4496 | Native signal peptide removed; MetGly & 3' His-tag added |
| BLFS44 | 2485 | 4713 | 4335 | 4532 | Native signal peptide removed; Met & 3' His-tag added |
| BLFS45 | 2486 | 4745 | 4374 | 4571 | Native signal peptide removed; MetGly & 3' His-tag added |
| BLFS46 | 2487 | 4694 | 4311 | 4508 | Native signal peptide removed; Met & 3' His-tag added |
| BLFS47 | 2488 | 4686 | 4302 | 4499 | Native signal peptide removed; MetGly & 3' His-tag added |
| BLFS48 | 2489 | 4699 | 4317 | 4514 | Native lipid anchor removed; added MetGly; 3' His-tag |
| BLFS49 | 2490 | 4790 | 4438 | 4635 | Native lipid anchor removed; added MetGly; 3' His-tag |
| BLFS50 | 2491 | 4754 | 4388 | 4585 | Native signal peptide removed; MetGly & 3' His-tag added |
| BLFS51 | 2492 | 4692 | 4309 | 4506 | Native signal peptide removed; MetGly & 3' His-tag added |
| BLFS52 | 2493 | 4737 | 4364 | 4561 | Native signal peptide removed; Met & 3' His-tag added |
| BLFS53 | 2494 | — | 4433 | 4630 | Gly & 3' His-tag added |
| BLFS55 | 2495 | 4748 | 4378 | 4575 | Native signal peptide removed; Met & 3' His-tag added |
| BLFS56 | 2496 | 4651 | 4257 | 4454 | Native signal peptide removed; Met & 3' His-tag added |
| BLFS57 | 2497 | 4738 | 4365 | 4562 | Native signal peptide removed; Met & 3' His-tag added |
| BLFS58 | 2498 | 4743 | 4371 | 4568 | Native signal peptide removed; MetGly & 3' His-tag added |
| BLFS59 | 2499 | 4674 | 4290 | 4487 | Native signal peptide removed; Met & 3' His-tag added |
| BLFS60 | 2500 | 4730 | 4353 | 4550 | Native signal peptide removed; Met & 3' His-tag added |
| BLFS61 | 2501 | — | 4325 | 4522 | 3' His-tag added |
| BLFS62 | 2502 | 4691 | 4308 | 4505 | Native signal peptide removed; MetGly & 3' His-tag added |

TABLE 19-continued

Sequences synthesized for cloning in *E. coli*

| Gene Name | Native Polyp. SEQ ID NO | Derived Polyp. SEQ ID NO | Synthesized Polyn. SEQ ID NO | Synthesized Polyp. SEQ ID NO | Modifications |
|---|---|---|---|---|---|
| BLFS63 | 2503 | 4697 | 4315 | 4512 | Native signal peptide removed; Met & 3' His-tag added |
| BLFS64 | 2504 | 4654 | 4260 | 4457 | Native signal peptide removed; Met & 3' His-tag added |
| BLFS65 | 2505 | 4719 | 4341 | 4538 | Native signal peptide removed; MetGly & 3' His-tag added |
| BLFS67 | 2506 | 4782 | 4428 | 4625 | Native signal peptide removed; Met & 3' His-tag added |
| BLFS68 | 2507 | 4696 | 4314 | 4511 | Native signal peptide removed; MetGly & 3' His-tag added |
| BLFS69 | 2508 | 4655 | 4261 | 4458 | Native signal peptide removed; Met & 3' His-tag added |
| BLFS70 | 2509 | — | 4269 | 4466 | 3' His-tag added |
| BLFS72 | 2510 | — | 4278 | 4475 | Gly & 3' His-tag added |
| BLFS73 | 2511 | — | 4312 | 4509 | 3' His-tag added |
| BLFS74 | 2512 | 4758 | 4396 | 4593 | Native signal peptide removed; Met & 3' His-tag added |
| BLFS75 | 2513 | 4688 | 4304 | 4501 | Native signal peptide removed; MetGly & 3' His-tag added |
| BLFS76 | 2514 | 4710 | 4329 | 4526 | Native signal peptide removed; Met & 3' His-tag added |
| BLFS77 | 2515 | 4668 | 4279 | 4476 | Native signal peptide removed; MetGly & 3' His-tag added |
| BLFS79 | 2516 | 4665 | 4275 | 4472 | Native signal peptide removed; MetGly & 3' His-tag added |
| BLFS80 | 2517 | 4709 | 4328 | 4525 | Native signal peptide removed; Met & 3' His-tag added |
| BLFS82 | 2518 | — | 4282 | 4479 | Gly & 3' His-tag added |
| BLFS83 | 2519 | 4750 | 4380 | 4577 | Native signal peptide removed; Met & 3' His-tag added |
| BLFS84 | 2520 | 4663 | 4273 | 4470 | Native signal peptide removed; MetGly & 3' His-tag added |
| BLFS85 | 2521 | 4765 | 4406 | 4603 | Native signal peptide removed; Met & 3' His-tag added |
| BLFS86 | 2522 | 4724 | 4346 | 4543 | Native signal peptide removed; Met & 3' His-tag added |
| BLFS87 | 2523 | 4648 | 4254 | 4451 | Native signal peptide removed; Met & 3' His-tag added |
| BLFS88 | 2524 | 4786 | 4432 | 4629 | Native signal peptide removed; MetGly & 3' His-tag added |
| BLFS89 | 2525 | 4652 | 4258 | 4455 | Native signal peptide removed; Met & 3' His-tag added |
| BLFS90 | 2526 | — | 4376 | 4573 | 3' His-tag added |
| BLFS91 | 2527 | 4703 | 4321 | 4518 | Native signal peptide removed; MetGly & 3' His-tag added |
| BLFS92 | 2528 | 4769 | 4412 | 4609 | Native signal peptide removed; Met & 3' His-tag added |
| BLFS93 | 2529 | 4756 | 4391 | 4588 | Native signal peptide removed; Met & 3' His-tag added |
| BLFS94 | 2530 | 4687 | 4303 | 4500 | Native signal peptide removed; Met & 3' His-tag added |

TABLE 19-continued

Sequences synthesized for cloning in *E. coli*

| Gene Name | Native Polyp. SEQ ID NO | Derived Polyp. SEQ ID NO | Synthesized Polyn. SEQ ID NO | Synthesized Polyp. SEQ ID NO | Modifications |
|---|---|---|---|---|---|
| BLFS95 | 2531 | 4740 | 4367 | 4564 | Native signal peptide removed; Met & 3' His-tag added |
| BLFS96 | 2532 | — | 4419 | 4616 | 3' His-tag added |
| BLFS97 | 2533 | — | 4443 | 4640 | Gly & 3' His-tag added |
| BLFS98 | 2534 | 4783 | 4429 | 4626 | Native signal peptide removed; Met & 3' His-tag added |
| BLFS99 | 2535 | 4729 | 4352 | 4549 | Native signal peptide removed; Met & 3' His-tag added |
| BLFS100 | 2536 | 4746 | 4375 | 4572 | Native signal peptide removed; Met & 3' His-tag added |
| BLFS101 | 2537 | 4780 | 4425 | 4622 | Native signal peptide removed; MetGly & 3' His-tag added |
| BLFS102 | 2538 | 4725 | 4347 | 4544 | Native signal peptide removed; MetGly & 3' His-tag added |
| BLFS103 | 2539 | — | 4331 | 4528 | Gly & 3' His-tag added |
| BLFS104 | 2540 | 4768 | 4410 | 4607 | Native lipid anchor removed; added MetGly; 3' His-tag |
| BLFS105 | 2541 | 4739 | 4366 | 4563 | Native signal peptide removed; Met & 3' His-tag added |
| BLFS106 | 2542 | — | 4411 | 4608 | Gly & 3' His-tag added |
| BLFS107 | 2543 | 4773 | 4416 | 4613 | Native signal peptide removed; Met & 3' His-tag added |
| BLFS108 | 2544 | — | 4399 | 4596 | Gly & 3' His-tag added |
| BLFS109 | 2545 | 4779 | 4424 | 4621 | Native signal peptide removed; Met & 3' His-tag added |
| BLFS110 | 2546 | 4702 | 4320 | 4517 | Native lipid anchor removed; added MetGly; 3' His-tag |
| BLFS111 | 2547 | 4793 | 4441 | 4638 | Native signal peptide removed; MetGly & 3' His-tag added |
| BLFS112 | 2548 | — | 4349 | 4546 | Gly & 3' His-tag added |
| BLFS113 | 2549 | 4672 | 4287 | 4484 | Native signal peptide removed; Met & 3' His-tag added |
| BLFS114 | 2550 | 4705 | 4323 | 4520 | Native signal peptide removed; Met & 3' His-tag added |
| BLFS115 | 2551 | 4716 | 4338 | 4535 | Native signal peptide removed; Met & 3' His-tag added |
| BLFS116 | 2552 | — | 4330 | 4527 | 3' His-tag added |
| BLFS118 | 2553 | 4767 | 4409 | 4606 | Native signal peptide removed; MetGly & 3' His-tag added |
| BLFS119 | 2554 | 4741 | 4369 | 4566 | Native signal peptide removed; Met & 3' His-tag added |
| BLFS120 | 2555 | — | 4361 | 4558 | 3' His-tag added |
| BLFS121 | 2556 | 4707 | 4326 | 4523 | Native signal peptide removed; Met & 3' His-tag added |
| BLFS122 | 2557 | — | 4280 | 4477 | Gly & 3' His-tag added |
| BLFS123 | 2558 | — | 4426 | 4623 | 3' His-tag added |
| BLFS124 | 2559 | 4675 | 4291 | 4488 | Native signal peptide removed; MetGly & 3' His-tag added |
| BLFS125 | 2560 | 4723 | 4345 | 4542 | Native signal peptide removed; Met & 3' His-tag added |
| BLFS126 | 2561 | 4795 | 4445 | 4642 | Native signal peptide removed; Met & 3' His-tag added |
| BLFS127 | 2562 | 4695 | 4313 | 4510 | Native signal peptide removed; MetGly & 3' His-tag added |

TABLE 19-continued

Sequences synthesized for cloning in E. coli

| Gene Name | Native Polyp. SEQ ID NO | Derived Polyp. SEQ ID NO | Synthesized Polyn. SEQ ID NO | Synthesized Polyp. SEQ ID NO | Modifications |
|---|---|---|---|---|---|
| BLFS128 | 2563 | — | 4332 | 4529 | 3' His-tag added |
| BLFS129 | 2564 | — | 4383 | 4580 | Gly & 3' His-tag added |
| BLFS130 | 2565 | — | 4268 | 4465 | Gly & 3' His-tag added |
| BLFS131 | 2566 | 4693 | 4310 | 4507 | Native signal peptide removed; MetGly & 3' His-tag added |
| BLFS132 | 2567 | 4689 | 4305 | 4502 | Native signal peptide removed; Met & 3' His-tag added |
| BLFS133 | 2568 | 4798 | 4448 | 4645 | Native signal peptide removed; Met & 3' His-tag added |
| BLFS134 | 2569 | 4679 | 4295 | 4492 | Native signal peptide removed; Met & 3' His-tag added |
| BLFS135 | 2570 | 4717 | 4339 | 4536 | Native signal peptide removed; MetGly & 3' His-tag added |
| BLFS136 | 2571 | 4662 | 4272 | 4469 | Native signal peptide removed; Met & 3' His-tag added |
| BLFS137 | 2572 | 4728 | 4351 | 4548 | Native signal peptide removed; MetGly & 3' His-tag added |
| BLFS138 | 2573 | — | 4385 | 4582 | Gly & 3' His-tag added |
| BLFS139 | 2574 | 4721 | 4343 | 4540 | Native signal peptide removed; Met & 3' His-tag added |
| BLFS140 | 2575 | 4761 | 4402 | 4599 | Native signal peptide removed; MetGly & 3' His-tag added |
| BLFS141 | 2576 | 4785 | 4431 | 4628 | Native signal peptide removed; MetGly & 3' His-tag added |
| BLFS142 | 2577 | 4755 | 4390 | 4587 | Native signal peptide removed; MetGly & 3' His-tag added |
| BLFS143 | 2578 | 4770 | 4413 | 4610 | Native signal peptide removed; Met & 3' His-tag added |
| BLFS144 | 2579 | 4718 | 4340 | 4537 | Native signal peptide removed; Met & 3' His-tag added |
| BLFS145 | 2580 | 4715 | 4337 | 4534 | Native signal peptide removed; Met & 3' His-tag added |
| BLFS146 | 2581 | 4797 | 4447 | 4644 | Native signal peptide removed; Met & 3' His-tag added |
| BLFS147 | 2582 | 4764 | 4405 | 4602 | Native signal peptide removed; Met & 3' His-tag added |
| BLFS148 | 2583 | 4711 | 4333 | 4530 | Native signal peptide removed; MetGly & 3' His-tag added |
| BLFS149 | 2584 | 4789 | 4437 | 4634 | Native signal peptide removed; MetGly & 3' His-tag added |
| BLFS150 | 2585 | — | 4421 | 4618 | Gly & 3' His-tag added |
| BLFS151 | 2586 | 4664 | 4274 | 4471 | Native signal peptide removed; MetGly & 3' His-tag added |
| BLFS152 | 2587 | 4791 | 4439 | 4636 | Native signal peptide removed; Met & 3' His-tag added |
| BLFS153 | 2588 | 4734 | 4359 | 4556 | Native signal peptide removed; MetGly & 3' His-tag added |
| BLFS154 | 2589 | 4792 | 4440 | 4637 | Native signal peptide removed; Met & 3' His-tag added |
| BLFS155 | 2590 | 4659 | 4266 | 4463 | Native signal peptide removed; Met & 3' His-tag added |

TABLE 19-continued

Sequences synthesized for cloning in E. coli

| Gene Name | Native Polyp. SEQ ID NO | Derived Polyp. SEQ ID NO | Synthesized Polyn. SEQ ID NO | Synthesized Polyp. SEQ ID NO | Modifications |
|---|---|---|---|---|---|
| BLFS156 | 2591 | 4660 | 4267 | 4464 | Native signal peptide removed; Met & 3' His-tag added |
| BLFS157 | 2592 | 4747 | 4377 | 4574 | Native signal peptide removed; Met & 3' His-tag added |
| BLFS158 | 2593 | — | 4389 | 4586 | Gly & 3' His-tag added |
| BLFS159 | 2594 | — | 4289 | 4486 | Gly & 3' His-tag added |
| PUB6 | 2595 | — | 4372 | 4569 | 3' His-tag added |
| PUB23 | 2596 | — | 4355 | 4552 | Gly & 3' His-tag added |
| PUB31 | 2597 | — | 4398 | 4595 | 3' His-tag added |
| PUB65 | 2598 | 4775 | 4418 | 4615 | Native signal peptide removed; Met & 3' His-tag added |
| ZLFS1 | 2599 | — | 4381 | 4578 | 3' His-tag added |
| ZLFS2 | 2600 | 4667 | 4277 | 4474 | Native signal peptide removed; Met & 3' His-tag added |
| ZLFS3 | 2601 | 4649 | 4255 | 4452 | Native signal peptide removed; Met & 3' His-tag added |
| ZLFS5 | 2602 | 4647 | 4253 | 4450 | Native signal peptide removed; Met & 3' His-tag added |
| ZLFS6 | 2603 | — | 4283 | 4480 | Gly & 3' His-tag added |
| ZLFS7 | 2604 | 4700 | 4318 | 4515 | Native signal peptide removed; Met & 3' His-tag added |
| ZLFS8 | 2605 | 4777 | 4422 | 4619 | Native lipid anchor removed; added MetGly; 3' His-tag |
| ZLFS9 | 2606 | 4794 | 4444 | 4641 | Native signal peptide removed; MetGly & 3' His-tag added |
| ZLFS10 | 2607 | 4766 | 4407 | 4604 | Native signal peptide removed; Met & 3' His-tag added |
| ZLFS11 | 2608 | 4677 | 4293 | 4490 | Native signal peptide removed; Met & 3' His-tag added |
| ZLFS12 | 2609 | — | 4360 | 4557 | Gly & 3' His-tag added |
| ZLFS13 | 2610 | 4706 | 4324 | 4521 | Native signal peptide removed; Met & 3' His-tag added |
| ZLFS14 | 2611 | — | 4436 | 4633 | Gly & 3' His-tag added |
| ZLFS15 | 2612 | 4708 | 4327 | 4524 | Native signal peptide removed; Met & 3' His-tag added |
| ZLFS16 | 2613 | 4714 | 4336 | 4533 | Native signal peptide removed; MetGly & 3' His-tag added |
| ZLFS17 | 2614 | 4731 | 4354 | 4551 | Native signal peptide removed; MetGly & 3' His-tag added |
| ZLFS18 | 2615 | — | 4387 | 4584 | 3' His-tag added |
| ZLFS19 | 2616 | 4658 | 4264 | 4461 | Native lipid anchor removed; added MetGly; 3' His-tag |
| ZLFS21 | 2617 | 4670 | 4285 | 4482 | Native signal peptide removed; Met & 3' His-tag added |
| ZLFS22 | 2618 | 4685 | 4301 | 4498 | Native signal peptide removed; Met & 3' His-tag added |
| ZLFS23 | 2619 | 4759 | 4397 | 4594 | Native signal peptide removed; Met & 3' His-tag added |
| ZLFS24 | 2620 | 4676 | 4292 | 4489 | Native signal peptide removed; MetGly & 5' His-tag added |
| ZLFS25 | 2621 | 4680 | 4296 | 4493 | Native signal peptide removed; Met & 3' His-tag added |
| ZLFS27 | 2622 | 4760 | 4401 | 4598 | Native lipid anchor removed; added MetGly; 3' His-tag |

TABLE 19-continued

Sequences synthesized for cloning in *E. coli*

| Gene Name | Native Polyp. SEQ ID NO | Derived Polyp. SEQ ID NO | Synthesized Polyn. SEQ ID NO | Synthesized Polyp. SEQ ID NO | Modifications |
|---|---|---|---|---|---|
| ZLFS28 | 2623 | 4656 | 4262 | 4459 | Native signal peptide removed; Met & 3' His-tag added |
| ZLFS29 | 2624 | 4733 | 4358 | 4555 | Native signal peptide removed; Met & 3' His-tag added |
| ZLFS30 | 2625 | 4666 | 4276 | 4473 | Native signal peptide removed; MetGly & 3' His-tag added |
| ZLFS31 | 2626 | 4704 | 4322 | 4519 | Native signal peptide removed; MetGly & 5' His-tag added |
| ZLFS32 | 2627 | 4727 | 4350 | 4547 | Native lipid anchor removed; added Met; 3' His-tag |
| ZLFS33 | 2628 | 4742 | 4370 | 4567 | Native signal peptide removed; Met & 3' His-tag added |
| ZLFS34 | 2629 | 4796 | 4446 | 4643 | Native signal peptide removed; Met & 3' His-tag added |
| ZLFS35 | 2630 | 4749 | 4379 | 4576 | Native signal peptide removed; Met & 3' His-tag added |
| ZLFS36 | 2631 | — | 4400 | 4597 | Gly & 3' His-tag added |
| ZLFS37 | 2632 | — | 4307 | 4504 | 3' His-tag added |
| ZLFS38 | 2633 | — | 4393 | 4590 | Gly & 3' His-tag added |
| ZLFS39 | 2634 | — | 4357 | 4554 | Gly & 3' His-tag added |
| ZLFS42 | 2635 | 4661 | 4271 | 4468 | Native signal peptide removed; MetGly & 3' His-tag added |
| ZLFS44 | 2636 | 4736 | 4363 | 4560 | Native signal peptide removed; Met & 3' His-tag added |
| ZLFS45 | 2637 | 4735 | 4362 | 4559 | Native signal peptide removed; MetGly & 3' His-tag added |
| ZLFS47 | 2638 | 4684 | 4300 | 4497 | Native signal peptide removed; MetGly & 3' His-tag added |
| ZLFS48 | 2639 | 4762 | 4403 | 4600 | Native signal peptide removed; MetGly & 3' His-tag added |
| ZLFS49 | 2640 | 4720 | 4342 | 4539 | Native signal peptide removed; Met & 3' His-tag added |
| ZLFS51 | 2641 | — | 4270 | 4467 | 3' His-tag added |

"Polyp."—Polypeptide. "Polyn."—Polynucleotide

In most cases, following the optimization, the synthesized sequences exhibit at least 70% global identity to the curated sequences from which they were obtained. In several cases replacing the native signal peptide resulted in a polynucleotide and/or polypeptide having less than 70% global identity to their parent sequence. For the genes presented in Table 20, the optimized synthesized polypeptide sequences exhibit less than 70% global identity to the curated sequences from which they were obtained, due to a replacement of relatively long signal sequence. For example, the polypeptide of SEQ ID NO:4502 exhibits only 48.65% global identity to SEQ ID NO:2567 which is the original curated sequence of BLFS132. These polypeptides, however, comprise the core amino acid sequence of the parent polypeptides.

TABLE 20

Optimized polypeptides having less that 70% global identity to the parent not optimized polypeptide

| Gene Name | Native Polypeptide SEQ ID NO. | Synthesized Polypeptide SEQ ID NO. |
|---|---|---|
| ZLFS42 | 2635 | 4468 |
| ZLFS47 | 2638 | 4497 |
| BLFS132 | 2567 | 4502 |
| BLFS10 | 2453 | 4503 |
| BLFS86 | 2522 | 4543 |
| BLFS102 | 2538 | 4544 |
| BLFS52 | 2493 | 4561 |
| BLFS119 | 2554 | 4566 |
| BLFS9 | 2452 | 4591 |

TABLE 20-continued

Optimized polypeptides having less that 70% global
identity to the parent not optimized polypeptide

| Gene Name | Native Polypeptide SEQ ID NO. | Synthesized Polypeptide SEQ ID NO. |
|---|---|---|
| BLFS36 | 2478 | 4612 |
| BLFS20 | 2463 | 4614 |
| BLFS133 | 2568 | 4645 |

Example 15: Purification of Proteins Expressed in Bacterial Cells

Transformation of Bacterial Cells with the Polynucleotides Encoding the Polypeptides Having the Ability to Kill or Inhibit the Development of *Fusarium*

Genes encoding unknown toxin candidate proteins of the present invention were cloned in pET22/T7-lac promoter-based vector and coding DNA sequence was confirmed by sequencing. pET-based expression vectors were transformed into BL21(DE3) *E. coli* host using heat shock method. After overnight growth in Terrific Broth (TB) medium at 37° C. in the presence of Ampicillin (100 μg/mL), 5 mL starter cultures were used to inoculate 100 mL TB culture at $OD_{600}$ 0.03 in 1 L flat bottom flask. The cultures were allowed to grow until $OD_{600}$~0.5 (2-3 hours at 37° C. with 250 rpm). The incubator shaker temperature was reduced to 22° C. and Isopropyl β-D-1-thiogalactopyranoside (IPTG) was added at a final concentration of 1 mM. The cultures were incubated further for 15 to 18 hours for target protein expression and cells were harvested by centrifuging at 4,000 rpm/4° C./10 minutes. The cell pellet was washed with cold water and stored at −80° C. until used for protein purification.

Bacterial cell pellet was lysed using B-PER™ Bacterial Protein Extraction Reagent (Thermo Fisher Scientific, catalog number: 78248) at room temperature for 1 hour. The supernatant fraction (containing soluble protein) was clarified by centrifugation at 16000 rcf/4° C./20 minutes.

Purification of Expressed Recombinant Polypeptides:

Soluble fractions—The supernatant fraction containing soluble protein was incubated with Ni-NTA beads (washed with binding buffer prior to addition of supernatant fraction: 50 mM potassium phosphate pH 8.0, 600 mM NaCl and 20 mM imidazole) for 1 hour at 4° C. on a rotatory shaker with gentle shaker speed. The Ni-NTA-protein bound beads were collected by centrifugation at 800 rcf/4° C./3 minutes. The Ni-NTA-protein bound beads were washed with washing buffer (50 mM potassium phosphate pH 8.0, 600 mM NaCl, 0.5% Triton and 20 mM imidazole) for 3 times. The bound proteins were eluted with elution buffer (50 mM potassium phosphate pH 8.0, 600 mM NaCl and 250 mM imidazole). The salts in the eluted proteins were removed by dialysis. Samples were loaded on a Pur-A+Lyzer tubes (catalog number: PurR35100) and placed in a beaker containing 0.5 liter of sterile dialysis buffer (16.5 mM Potassium phosphate buffer pH 5.0) for 1 night/weekend in the refrigerator at 8° C. SDS-PAGE analysis was used to quantify protein using known concentrations of bovine serum albumin (BSA) as standard. The known concentrations of toxin candidates were used for bioassay.

Example 16: Effect of Isolated Proteins on Fungal Growth

The spore assay is an in vitro bioassay in a 96 wells plate format, implementing spores from a *Fusarium verticillioides* (Fv) GFP-labeled strain and the candidate protein purified from bacterial cells as described hereinabove. Mycelia growth of fungi treated with the protein was compared to the growth of untreated fungi and growth inhibition was quantified by detection of GFP fluorescence (475 nm excitation, 509 nm emission). Optical Density (OD) of 620 nm is also measured for QA purposes.

Fresh spores were prepared, quantified and dispensed in each well (500 spores) in 50 μl 2×PDB and incubated for 2-3 hours at 25° C. before protein addition.

Purified clean proteins prepared as described hereinabove were quantified and diluted with buffer phosphate pH 5.0 at the desired concentration and added to each assay well (up to 40 μM) for a final reaction volume of 100 μl. The plates are incubated for 72 hr at 25° C. and responses were measured every 24 hr.

Each protein treatment in each plate was compared to the corresponding spore growth in untreated control by t-test α=0.05 one tailed Table 21 summarizes the results of two independent assays using purified proteins from bacterial cells overexpressing the polypeptides of some embodiments of the invention.

TABLE 21

Inhibition of *Fusarium* mycelia growth by proteins of the invention isolated from bacteria

| Gene Name | General annotation | First assay % Inhibition ** | Second assay % Inhibition ** |
|---|---|---|---|
| ZLFS42 | Killer toxin like | 90% (72 hr) 20 μM | 86% (72 hr) 25 μM |
| ZLFS48 | Antimicrobial protein MiAMP1 | 56% (48 hr) 25 μM | 30% (72 hr) 20 μM |
| BLFS129 | Alginate lyase | 85% (48 hr) 6.4 μM | 69% (72 hr) 4 μM |
| BLFS139 | Peptidoglycan endopeptidase | 72% (48 hr) 14 μM | 64% (48 hr) 6 μM |
| BLFS128 | Peptidoglycan hydrolase flgj | 37% (48 hr) 14 μM | 52% (48 hr) 3 μM |
| BLFS70 | Hypothetical protein | 36% (48 hr) 2 μM | 52% (48 hr) 3 μM |
| BLFS111 | Hypothetical protein) | 20% (72 hr) 4.5 μM | 63% (48 hr) 10 μM |
| BLFS157 | Hypothetical protein | 37% (48 hr) 12 μM | 41% (48 hr) 10 μM |

TABLE 21-continued

Inhibition of *Fusarium* mycelia growth by proteins of the invention isolated from bacteria

| Gene Name | General annotation | First assay % Inhibition ** | Second assay % Inhibition ** |
|---|---|---|---|
| BLFS101 | Metalloprotease loiP | 47% (24 hr) 25 μM | 70% (48 hr) 25 μM |
| BLFS63 | n-acetylmuramoyl-1-alanine amidase amib | 44% (48 hr) 39 μM | 55% (48 hr) 2 μM |
| ZLFS1 | Arthropod defensin | 29% (48 hr) 13 μM | 32% (48 hr) 27 μM |
| BLFS155 | Mannose-binding protein | 45% (48 hr) 25 μM | 70% (48 hr) 44 μM |
| BLFS7 | Peptidase C11 clostripain | 65% (48 hr) <1 μM | 36% (48 hr) 5 μM |
| BLFS140 | Uncharacterized lipoprotein ybbd | 75% (48 hr) 9 μM | 63% (48 hr) 40 μM |
| BLFS103 | Toxin tccc3 | 67% (48 hr) 3 μM | 56% (48 hr) 3.75 μM |
| BLFS46 | Lysm domain protein | 46% (48 hr) 18 μM | 32% (48 hr) 40 μM |
| BLFS115 | Probable periplasmic serine endoprotease DegP-like | 39% (48 hr) 23 μM | 39% (48 hr) 40 μM |
| BLFS47 | Hypothetical protein | 11% (72 hr) 40 μM | 25% (48 hr) 0.5 μM |
| BLFS87 | Endoglucanase b | 25% (48 hr) 40 μM | 27% (48 hr) 40 μM |
| BLFS102 | Hypothetical protein | 30% (48 hr) 40 μM | 44% (48 hr) 40 μM |
| BLFS42 | Chitin-binding protein | 21% (72 hr) 25 μM | 60% (48 hr) 40 μM |
| ZLFS29 | Beta-barrel assembly-enhancing protease [bepA]. | 36.5% (48 hr) 40 μM | 44% (48 hr) 40 μM |
| BLFS154 | Peptidase s1 | 52% (48 hr) 40 μM | 33% (48 hr) 40 μM |
| BLFS62 | Murein hydrolase activator nlpd | 53% (24 hr) 40 μM | 27% (48 hr) 40 μM |
| BLFS19 | Peptidase p60 | 31% (48 hr) 40 μM | 29% (48 hr) 40 μM |
| ZLFS16 | d-alanyl-d-alanine carboxypeptidase dacd | 11% (24 hr) 41 μM | 36% (24 hr) 38 μM |
| ZLFS19 | Lipoprotein nlpd/lppb homolog | 21% (48 hr) 38 μM | 33% (24 hr) 37 μM |
| BLFS1 | Antifungal protein | 57% (48 hr) 40 μM | 31% (48 hr) 40 μM |
| BLFS9 | Oxidoreductase | 21% (48 hr) 25 μM | 15% (48 hr) 18 μM |
| BLFS80 | Hypothetical protein | 33% (48 hr) 40 μM | 43% (48 hr) 40 μM |
| BLFS123 | Peptidase c1 | 17% (72 hr) 20 μM | 1% (48 hr) 20 μM |
| BLFS113 | Transpeptidase | 11% (72 hr) 40 μM | 19% (48 hr) 25 μM |
| BLFS121 | Glutamate carboxypeptidase | 26% (48 hr) 40 μM | 14% (24 hr) 25 μM |
| BLFS142 | Uncharacterized protein ykvt | 34% (48 hr) 21 μM | 31% (48 hr) 42 μM |
| ZLFS5 | Hypothetical protein | 29% (48 hr) 20 μM | 15% (48 hr) 40 μM |
| ZLFS32 | Endoglucanase | 29% (48 hr) 20 μM | 16% (48 hr) 40 μM |
| ZLFS22 | Hypothetical protein | 95% (72 hr) 40 μM | 11% (24 hr) 40 μM |
| ZLFS51 | Glycosyl hydrolase | 36% (24 hr) 40 μM | 3% (24 hr) 40 μM |
| ZLFS27 | Lytic transglycosylase | 28% (48 hr) 40 μM | 87% (48 hr) 20 μM |
| ZLFS47 | Antimicrobial protein MiAMP1 | 5% (48 hr) 20 μM | 56% (48 hr) 25 μM |
| ZLFS45 | Oxidoreductase | 63% (24 hr) 20 μM | 81% (72 hr) 40 μM |

** = Best inhibition value scored at defined time and concentration; α = 0.05 and % inhibition > 10%

The foregoing description of the specific embodiments will so fully reveal the general nature of the invention that others can, by applying current knowledge, readily modify and/or adapt for various applications such specific embodiments without undue experimentation and without departing from the generic concept, and, therefore, such adaptations and modifications should and are intended to be comprehended within the meaning and range of equivalents of the disclosed embodiments. It is to be understood that the phraseology or terminology employed herein is for the purpose of description and not of limitation. The means, materials, and steps for carrying out various disclosed functions may take a variety of alternative forms without departing from the invention.

SEQUENCE LISTING (4799 sequences)

SEQ ID NO: 1 - DNA, 1358 bp, Zea mays
  Maize Ub1 Promoter (cultivar B73)
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 2 - DNA, 538 bp, Cauliflower mosaic virus
  CaMV 35S pEBbVNi Promoter
catggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggact

SEQ ID NO: 3 - DNA, 562 bp, Artificial sequence
  BAR_GA optimized for Brachypodium
agcagccatgagcccagagaggcgcccagccgatatcagaagggctacagaggccgatatgccggccgtgtgcaccatcgtgaaccactacatcgagacatccaccgtgaacttcaggaccgagccgcaagagccacaagagtggaccgatgatctcgtgaggctccgcgagagatacccatggctcgtggctgaagtggatggcgaggttgccggcattgcttatgctggcccatggaaggctaggaacgcctacgattggaccgccgagtccacagtgtacgtgtccccaaggcatcagagaaccggcctcggctctaccctctacacccatctgctcaagtcccttgaggcccaaggcttcaagtctgtggtggctgttatcggcctcccgaacgatccatccgtgaggatgcatgaggctctcggctatgccccaaggggaatgctcagagctgctggcttcaagcacggcaactggcacgatgtgggcttttggcagctcgacttcagcctcccagttccgccaagaccagtgctcccagtgaccgagatctgatga

SEQ ID NO: 4 - DNA, 66 bp, Erwinia carotovora
  PelB signal peptide (nucleotide)
atgaaatacctgctgccgaccgctgctgctggtctgctgctcctcgctgcccagccggcgatggcc

SEQ ID NO: 5 - protein, 22 aa, Erwinia carotovora
  PelB signal peptide (protein)
MKYLLPTAAAGLLLLAAQPAMA

SEQ ID NO: 6 - DNA, 17 bp, T7 bacteriophage
  T7 promoter
taatacgactcactata

SEQ ID NO: 7 - DNA, 47 bp, T7 bacteriophage
  T7 terminator
tagcataaccccttggggcctctaaacgggtcttgaggggttttttg

SEQ ID NO: 8 - DNA, 1027 bp, Artificial sequence
  hygromycin resistance
catgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagtttagcgagagcctgacctattgcatctcccgccgttcacagggtgtcacgttgcaagacctgcctgaaaccgaactgcccgctgttctacaaccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgactccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaagaaatag

SEQ ID NO: 9 - DNA, 253 bp, Agrobacterium tumefaciens
  Agrobacterium tumefaciens shorter NOS TERMINATOR
gatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatc

SEQ ID NO: 10 - DNA, 20 bp, Zea mays
  5prime gRNA
agatgcattgatctcgcgcg

SEQ ID NO: 11 - DNA, 20 bp, Zea mays
  3prime gRNA
atttgccaaagtattccggg

SEQ ID NO: 12 - DNA, 1000 bp, Zea mays
  Upstream flanking region
taacacaagtgtcgaataggaaattcacgagctgtcaaaaaccacatgaggtttgtttttgacccgcgaccgcgagcttgctaacgcaaggtttcagttctcgccgaaacgaaacaaaatgacggtgccgcgcttgcgctgtcatttttttgttttcgacggccaggctgaaactgtatggctgaggatgtcactgagcttcttgtttcctagtgaaaatggtagagagcagttacttgttcacgtgagagaagaaactaaagagaaaataaattagcctttctgcctttgtgactgttttgaacttttgatatatatatccagccttccgcatgctatatttgaatctcaataaacggtgctaggggggttttagcaaaagtacttcaatgttcaatactgtcttaatagacgtccttctctaacatcaaggagtacattgcgtacgggccctatttatttcggtttttggctgttagaatcggcttttggcagccaaatattttgtttttcagattgcttacatgagaatcgcgtctgtaaaaatcgtctaaatcaacgttaatataaaatcctaaattgtgcagagccctccacctttcttaacacacaacacaggtctcaggatattcaaatccatataagagctagattattcagtagtccagattccgaccaaaactctttaggatgctatcacaaacaaacatgtccatattctttcgtgattttaacgtatcgttttcgtgccctctaaccaaaacactcccaaacttgttttcgcttttcgaaaggaggctcgaaattatgaaactaaattttaggaataaagacacaattgcgacacaaaaataacctttttttacccaacttcacaccaccatatgtaggtcttcgtgctaccggatttgccaacacctataaaatttatgtcaggttgtcacggctttactattatcgcgtctaacttcaaacacatctggagatgcattgatctcgc

SEQ ID NO: 13 - DNA, 1000 bp, Zea mays
  Downstream flanking region
ggaatactttggcaaattctgctctgtccttgcaaccaagcataacatacaagtgaccgaaatagacaagcaaagtatatcagaacattgtcaaattgcaagttgcaacaaaactgaagcaaacacaatgtagaaaccattcggagcatcacaggggttggtagcaatctgagatacatgattaaaggaatggtttaatagtacatgcacaattaaatgtttctttttgtttccaagctaggctatgaattgtccacgatcaagctaaaaccccctacccactaaacaggagactgctaggcaggggcgaacagggagcattcctgcatgtaagcaaccagccaaccaaatcacagccatctatcatttcctcttcttagtaggtggttgggggacatcatcgtcatcatcctcttcctcttcttcctcctcatcttcctcattgtcaccatccccatcatcatcgtcgtcatcatcctcctcttcatcctctccaccatcatcatcgtcgtcacttcctccttcaccgttggctgcaggatcgttatcatcgtcgtcgtcatcttcctcctcattcccattgtcatctgatccctcatcaccaccatcatcttcttggttttcagcatcctcatcgtctccctcctcatcattatcatcatcagactctccatcatccttgttctcgaaatcagttgcatttttgtttttgctcagaatccttgtggagaaggaaacaaacaatcctcagctttgggagacgaaaaaaaatgcccatggcaataatgatgtggtacatgttttgacattatgcaccagtgggcattacctattaatcaaattctgatctccaccagatgtaaagatttcattatgaagaatctgcacaagaaagtcaaaacagtacacagtattagctaagacgaggtatatttccaattaaaagtgcacgaacaatgcaacaatggttattcccgggctttaaaggacataagacacg

SEQ ID NO: 14 - DNA, 17 bp, Zea mays
  5prime gRNA after cut
agatgcattgatctcgc

SEQ ID NO: 15 - DNA, 17 bp, Zea mays
  3prime gRNA after cut
ggaatactttggcaaat

SEQ ID NO: 16 - DNA, 3852 bp, Artificial Sequence
  Complete repair construct
taacacaagtgtcgaataggaaattcacgagctgtcaaaaaccacatgaggtttgtttttgacccgcgaccgcgagcttgctaacgcaaggtttcagttctcgccgaaacgaaacaaaatgacggtgccgcgcttgcgctgtcatttttttgttttcgacggccaggctgaaactgtatggctgaggatgtcactgagcttcttgtttcctagtgaaaatggtagagagcagttacttgttcacgtgagagaagaaactaaagagaaaataaattagcctttctgcctttgtgactgttttgaacttttgatatatatatccagccttccgcatgctatatttgaatctcaataaacggtgctaggggggttttagcaaaagtacttcaatgttcaatactgtcttaatagacgtccttctctaacatcaaggagtacattgcgtacgggccctatttatttcggtttttggctgttagaatcggcttttggcagccaaatattttgtttttcagattgcttacatgagaatcgcgtctgtaaaaatcgtctaaatcaacgttaatataaaatcctaaattgtgcagagccctccacctttcttaacacacaacacaggtctcaggatattcaaatccatataagagctagattattcagtagtccagattccgaccaaaactctttaggatgctatcacaaacaaacatgtccatattctttcgtgattttaacgtatcgttttcgtgccctctaaccaaaacactcccaaacttgttttcgcttttcgaaaggaggctcgaaattatgaaactaaattttaggaataaagacacaattgcgacacaaaaataacctttttttacccaacttcacaccaccatatgtaggtcttcgtgctaccggatttgccaacacctataaaatttatgtcaggttgtcacggctttactattatcgcgtctaacttcaaacacatctggagatgcattgatctcgcgcgcttgaaaatttagttattaggttggtaaaagactaggttaggtaagaaatttgaaaacaaaaatccatgggagatgtttttacgtagaagaatagtgagaatttgagaaactttatttcctaagaaacaaagaaagttttggtgaaataattgaaacgaaaaattcgagaaactagaagcccgataatgcccttctcctctaccaactaccagcgcagtcactcgcctctgcacacgtcgctgatgctcgtcttccttccttcccatcctttataaggcccggccgcggctctgctcgcctctcctcccttccctcccgtaccgtatcagtctcccggattctctccggttcgtgggagggccaaagcttcgagttaggaaaaccctaccgctgtgggagtagcctccggcgatggcttaccgcgcctttgctacgctgcttgcagtgctagcatttgtgggcttcgcttcagttccccgtggtctggcaactgacccgacccagctccaggacttctgcgttgctgataacaagaaccctgtgctggtgaacggggtggtgtgcaagaacccgaacatggtgaaggcaaccgacttcttctccacgatagtgccggtggcgccaaacgggcagggctccgccgtgacgccggtggcggtgaacgagatcccggggctgaacacgctgggcatctcgctggcgcgcatcgacttcgtccccggcgggcagaacccgccgcacacgcacccgcgcgggtccgagatcctgacggtcatccagggcacgctcctcgtcggcttcgtcacctccaaccagctgctcaacaacacgctcttcaccatgcagctgaacatgggcgacgtcttcgtgttcccgcaggggctcatccacttccagctcaacaacggcaagacccccgccgtggccatcgccgcgctcagcagccagaaccccggcaccgtcaccatcgccaacgccgtgttcggggccaagccgcccatcctggacgacatcctcgccagggcgttcatgctcgagaaggccaccgtcgactgggtccagcaggcgttcggcgcggcaccagtggccggcggcggcggtggcctgcccggaggaggtggctatcccggcagcggtggtggcctgcccggaggaggtggctatcccggcagcggctttccgggctaccccggccgtagctgagccagcgagagacgcaggataaaggccgtagttttgcaaggcgagtagagcagtatgtcagtaatacagcatctatggcatgtgcttttgctcgtccagttcatgagccccgttgtgtatttggtttccgttttcttggttggagtttttagttccaaggtccgatcatgttttgatcccataaattctcttccagccttcgagcaactgagtccatcttcctaagtcatcagccccagcgagacattgaagcatggggaaacttaaacagtatggtgatgattaatctcagcattttttttcttgcagcaatcaatatggactttgcttaaaatttcgttgtcttttcaaaacgatatgcaagcaaaatggaagtgatgttctttgaaactttgtttcaatgctatagcaaaggtttgcattttacaaagttcggtttagtgacgaccatttagatgacatagattatgcttttcgtattttggtagcttctcgtgcggacgcgcggtcatgcctagcatgccgaagaccttgtcatatagtgaaaggaattgcggtagcaattagttcatttttccctaatcccctccaatcactttctcaccaaacaaactccaaaggtcgtcaccgaagggggacgttcccggaatactttggcaaattctgctctgtccttgcaaccaagcataacatacaagtgaccgaaatagacaagcaaagtatatcagaacattgtcaaattgcaagttgcaacaaaactgaagcaaacacaatgtagaaaccattcggagcatcacaggggttggtagcaatctgagatacatgattaaaggaatggtttaatagtacatgcacaattaaatgtttctttttgtttccaagctaggctatgaattgtccacgatcaagctaaaaccccctacccactaaacaggagactgctaggcaggggcgaacagggagcattcctgcatgtaagcaaccagccaaccaaatcacagccatctatcatttcctcttcttagtaggtggttgggggacatcatcgtcatcatcctcttcctcttcttcctcctcatcttcctcattgtcaccatccccatcatcatcgtcgtcatcatcctcctcttcatcctctccaccatcatcatcgtcgtcacttcctccttcaccgttggctgcaggatcgttatcatcgtcgtcgtcatcttcctcctcattcccattgtcatctgatccctcatcaccaccatcatcttcttggttttcagcatcctcatcgtctccctcctcatcattatcatcatcagactctccatcatccttgttctcgaaatcagttgcatttttgtttttgctcagaatccttgtggagaaggaaacaaacaatcctcagctttgggagacgaaaaaaaatgcccatggcaataatgatgtggtacatgttttgacattatgcaccagtgggcattacctattaatcaaattctgatctccaccagatgtaaagatttcattatgaagaatctgcacaagaaagtcaaaacagtacacagtattagctaagacgaggtatatttccaattaaaagtgcacgaacaatgcaacaatggttattcccgggctttaaaggacataagacacg

SEQ ID NO: 17 - DNA, 792 bp, Zea mays
  gene CDS
atggcttaccgcgcctttgctacgctgcttgcagtgctagcatttgtgggcttcgcttcagttccccgtggtctggcaactgacccgacccagctccaggacttctgcgttgctgataacaagaaccctgtgctggtgaacggggtggtgtgcaagaacccgaacatggtgaaggcaaccgacttcttctccacgatagtgccggtggcgccaaacgggcagggctccgccgtgacgccggtggcggtgaacgagatcccggggctgaacacgctgggcatctcgctggcgcgcatcgacttcgtccccggcgggcagaacccgccgcacacgcacccgcgcgggtccgagatcctgacggtcatccagggcacgctcctcgtcggcttcgtcacctccaaccagctgctcaacaacacgctcttcaccatgcagctgaacatgggcgacgtcttcgtgttcccgcaggggctcatccacttccagctcaacaacggcaagacccccgccgtggccatcgccgcgctcagcagccagaaccccggcaccgtcaccatcgccaacgccgtgttcggggccaagccgcccatcctggacgacatcctcgccagggcgttcatgctcgagaaggccaccgtcgactgggtccagcaggcgttcggcgcggcaccagtggccggcggcggcggtggcctgcccggaggaggtggctatcccggcagcggtggtggcctgcccggaggaggtggctatcccggcagcggctttccgggctaccccggccgtagctga

SEQ ID NO: 18 - DNA, 20 bp, Zea mays
  KO gRNA
gggcgaccagcgctccagca

SEQ ID NO: 19 - DNA, 17 bp, Zea mays
  KO gRNA after cut
gggcgaccagcgctcca

SEQ ID NO: 20 - DNA, 1428 bp, Zea mays
  KO gene CDS
atgccgtcgtccacgatgcgcctgctgtccaggcgcaccgtcacgcctccaccgcgcccacgccaccgcattccgctcaccacctgggacatctcctttctctccgccgactacatccagaagggcctcctctacgccaagccgccgtttcccaccgaccgcctcctcgaccacctccaggcctcgctcgcccaggcgctcgacgcctactaccccgtcgccggccgcttcgtcacggaccagcaccgcgacgccaacggtcacgtcctcggctgctcggtctccatcgactgtgacggccagggggtcgacatcctccacgccgtcgccgacggcgtcgccgtggccgacgtcatcccgcccgacgcacgtgtcccgcgcctcgtccagtcactcttcccgctcgacggcgccgtcaaccacgacggccaccacctcccactcttcgccgtccaggtcaccgacctccacgacggcgtcttcctcggcttcgcctacaaccacgcgctctccgacggcaccgcactatggagattcatcaacgtatgggcgggcatcgcgcgcgacagcccctccccatccccagctccgccgccgccgcccttgctggagcgctggtcgcccgacgccggcccaaccacaccgccggtcgtcctcccctaccccgacctcacggggctcatcgagaggctgcccccgccgccactatgcgagcgcatgctgcaattctcggccgaaaccctggaggcgctcaaggaccgggcgcggcaggagctcctggcggccggggatacggccggcgcggccgccgttaccaagttccaggcgctcagctcgcttgtgtggcgctccgtcacccgcgcgcgccgcatgccgctcggccaaacaaccttttgccgcgccgccatcaacaaccgcacgcgcctccgcccgcagcttccgccggagtacttcgggaacaccatctacgccatcgcaacggaggccgtcaccgcgggggatctgctggagcgcggccacggctgggccacggcggccgtcggccgcgcggtggcggcgcacacggacgacgccatccgggcgcgcgtggccgcgtggatggccaaccctgtcctgtacaacctcaggttctttgaccccaacggcatcatgatgggcagctcgccgcggttcgacatgtacggcggctgcgacttcggctgggggccgcccctggcgccgcgcagcggcagggccaacaagtccgacgggaaggcgtcgctgtaccccggccgggagggagccgaaagcatcgccgcggagcttgtgctgacgtcggagcacatgacgctgctggagcaagacgacgagttctgggcggccgtttcgcccgacaggccttttccgccggcagcgctagccgcccagccaaagtcagacagacactga

SEQ ID NO: 21 - DNA, 1427 bp, Artificial Sequence
  KO anticipated change example
atgccgtcgtccacgatgcgcctgctgtccaggcgcaccgtcacgcctccaccgcgcccacgccaccgcattccgctcaccacctgggacatctcctttctctccgccgactacatccagaagggcctcctctacgccaagccgccgtttcccaccgaccgcctcctcgaccacctccaggcctcgctcgcccaggcgctcgacgcctactaccccgtcgccggccgcttcgtcacggaccagcaccgcgacgccaacggtcacgtcctcggctgctcggtctccatcgactgtgacggccagggggtcgacatcctccacgccgtcgccgacggcgtcgccgtggccgacgtcatcccgcccgacgcacgtgtcccgcgcctcgtccagtcactcttcccgctcgacggcgccgtcaaccacgacggccaccacctcccactcttcgccgtccaggtcaccgacctccacgacggcgtcttcctcggcttcgcctacaaccacgcgctctccgacggcaccgcactatggagattcatcaacgtatgggcgggcatcgcgcgcgacagcccctccccatccccagctccgccgccgccgcccttgcggagcgctggtcgcccgacgccggcccaaccacaccgccggtcgtcctcccctaccccgacctcacggggctcatcgagaggctgcccccgccgccactatgcgagcgcatgctgcaattctcggccgaaaccctggaggcgctcaaggaccgggcgcggcaggagctcctggcggccggggatacggccggcgcggccgccgttaccaagttccaggcgctcagctcgcttgtgtggcgctccgtcacccgcgcgcgccgcatgccgctcggccaaacaaccttttgccgcgccgccatcaacaaccgcacgcgcctccgcccgcagcttccgccggagtacttcgggaacaccatctacgccatcgcaacggaggccgtcaccgcgggggatctgctggagcgcggccacggctgggccacggcggccgtcggccgcgcggtggcggcgcacacggacgacgccatccgggcgcgcgtggccgcgtggatggccaaccctgtcctgtacaacctcaggttctttgaccccaacggcatcatgatgggcagctcgccgcggttcgacatgtacggcggctgcgacttcggctgggggccgcccctggcgccgcgcagcggcagggccaacaagtccgacgggaaggcgtcgctgtaccccggccgggagggagccgaaagcatcgccgcggagcttgtgctgacgtcggagcacatgacgctgctggagcaagacgacgagttctgggcggccgtttcgcccgacaggccttttccgccggcagcgctagccgcccagccaaagtcagacagacactga

SEQ ID NO: 22 - DNA, 3702 bp, Zea mays
aaacacgaccttcacgcgcgcgccgggagcggcatgcccgggaacgcgggagctgagggtccgtgcctcccggtcgtctgacgccgcgccggtcatcgcccacgcctcctcgcccggccatggccgaggaccacgggtcgtcgcgccacatgtcggcgtcgcagaaggagctgggcgacgaggacgcccgcgtggtgcgcgtggccgacgccgcgcgcaccaacgagcgcctcgacctcgcgggcaacgccgtgcgcaccgccaagtactcgccgctcaccttcctgccgcggaacctcttcgagcagttccaccgcctcgcctacgtctacttcctcgccatcgccgtgctcaaccagctgccccagctcgccgtcttcgggcggggcgcctccgtcatgccgctcgccttcgtcctcctcgtcaccgccgtcaaggacgcgtacgaggactggagacgccaccgctccgaccgcgccgagaacggccgcctcgccgcggtcctctccccggccgcccccgggggcgcccagttcgtcccgaccgagtggaagcacgttcgagtcggcgacgtcgtgcgcgtcgtgtccgacgagtcgctcccggcggacatggtcctcctcgccaccagcgagcccactggcgtcgcttacgtgcagacgctgaaccttgacggcgagtccaacctcaagacccgctacgccaagcaggagacgctgtccacgccgcccgagcgcctcgccggggccgtcatccgcagcgagcgcccaaaccgcaacatctacggcttccaggccaacctcgagctcgaaggggagagccgccggataccgctcggtccgtccaacatcgtgctgcgcggctgcgagctcaagaacacgccctgggccgtcggcgtggtggtttacgcggggcgggagaccaaggccatgctcaacaacgccggcgcgcccaagaagcgcagccgcctggagacgcacatgaaccgcgagacgctcttcctctctgccatcctcgtcgtgctctgctcgatcgtcgccgcgctctccggcgtctggctgcgcacccacgaggaggagctcgagctcgcgcagttcttccacaagaaggactacctgcaccgcgacaaggacaatgactacaagaactacaactactacggcatcgcggcccaaatcgtgttcatcttcctcatggcggtcatcgtgttccagatcatgatacccatctcgctctacatttccatggagctcgtcaggctgggacaggcctacttcatgatccgagacacgaggctgtacgacgagtcctccaattcgaggttccagtgccgggccctcaacatcaacgaggacctaggccagattaagtgcatattctccgacaagaccggcacgctcacgcagaataagatggagttccggtgcgcgagcattgacggaatcgattacagtgacatcgcacggcagcggcctcctgaaaagggcgatcggatttgggcgccaaaaatatcggtgaacaccgatccggagctggtgaagttgatcagggatgggggcgataccgagcgagggacgcagactcgggagttctttctcgccctggcatgttgcaacaccattgttcccatgatcgccgatggtccggaccctaaggagaaggtgatcgactaccaaggcgagtcaccggatgagcaggcattggtctctgccgctgcggcatatggctttgtgctagtcgaacgaacatcgggccacattgtgatcgacgtccttggtgagaagctcagatatgatgtccttggtcttcatgagtttgacagcgatcgcaagaggatgtctgtcataattggctgccctgataagtctgtcaagctgtttgtaaaaggcgctgacagttcgatgtttggagtcattgacaaaactgcgaattcagatgttgtccaagcaacagagaagcatctccattcatattcatcattaggtctgcgaacacttgtcattggtatgcgggaacttagccaagaagagtttcaggagtggcaaatggcttatgaaaaggctagcacggcactactaggaagaggaaaccaactccgcaacgtggctgccaacatcgagaggaacttgcgtctattgggtgccactggaattgatgacaagctgcaggatggtgtacccgaagcaattgagaaactgagggaagcagggattaaggtttgggtgctaacaggtgacaagcaagaaactgctatctccatcggctattcctgcaagcttttgacaagagacatgacacagattgtaattaacagtcgctcaagagaatcatgcaggaagagtctagaagatgcaatcgccatggttaacaaataccaatcgttctcgacagacccccaacttagggtgccccttgctttgattattgatggtaacagccttgtctacattttcgatacggattgggaggagaagctttttgaaatcgctatagcctgcgatgtcgtcctatgctgtcgggtagctccccttcagaaggctggtattgttgatctcattaagaagcgaacaagtgacatgactttagctattggagatggtgcaaatgatgtatccatgattcaaatggctgacgttggcatcggcatcagtgggcaagagggaaggcaagctgttatggcctcagattttgccatgggtcaattcagatttttggttcctctgttgttggttcatggccattggaactaccagaggatggcctacatgatcctgtataacttctacagaaatgctacttttgtctttgtgctattctggtatgtactttacactggtttcaccctaacaacagcgataactgagtggagcagcgtgctatactctgtgatatatactgctgtccctactattgtcgtcgccattctcgacaaggatctcagccggcggacattgctgaagtatccccaactctatggcccagggcagcgtgatgagaactacaacctgaggctattcatattcatcatgatagactccgtctggcagagccttgcatgtttcttcatcccctaccttgcatacaggaagagtataattgatggttccagccttggagacctatggacactatccgttgttattcttgtcaatattcacctggcaatggatgtcatcagatggaactggattacgcatgcggcaatatggggtagcattgctgcgacatggatttgtgtcatgatcatagattccataccaatcatgcctggtttttgggcaatctacaaagtgatgggaactgggctgttctgggcactgctgcttgcggtaactgttgttgggatgattcctcattttgccgcaaaggccttcagtgagtatttcatccccagtgacattcagattgcaagagaaatggagaagtcgcaagatttccatgatgtaactcatccagaagttcaaatgagtacagtgagtagagcttagggtagggggttacacagtgatcttttgttcattcgagtaggatatagctctacactttctttggttctttttgttgtgtgtacaggcaattctttcagcagtgtgcaagctttcttgatgcttgctcccttgccaactatccaaaggataggccccttgtaccattctgtgtatccaccagccaaattttgttgatttacatgaaaggagatca

SEQ ID NO: 23 - DNA, 2094 bp, Triticum aestivum
ctccatccctttcgccttcccctctctccccctcccctgtttctccctctaccagtctcccctacggatacatcgccgacgacccaagcaagcaagccgccagcagcaacaaaccaacccaacccaatccctgccggccaaactccaaacttccaaagccatgggcacctacaagtgctgcctcgtcttcaagcgccggtaccgctggacggacgcgccgccgccggacgacgtgcgggcgctcttcgccgtgcactccggcggggcagccaccatgggcgccgacggcctgcgccgctacctcgagtcctccgaccctgacgccgccgacgacgccgagggcgaggcggaccgcctgctggaccagatccgcctgcagggacaccagcaccagcgcgccggcccgcgcctcccgcgcctcggccgcggccagctgctcggcctcgacgacttccaccgcttcctcttctccgccgacctcaacccgcccgtccgccgcccgcaggtccaccacgacatgtcccaggccctctcccactactacgtctacacgggccacaactcgtacctcaccggcaaccagctcagcagcgactgcagcgacgtccccatcatcaaggccctgcagcgcggcgtccgggtcatcgagctcgacatgtggcccaactccgccaaggacgacatcagcatcctccatggcaggactttgaccaccccggtttcgctgctgaaatgcttgaaatccatcaaagagtacgccttcgtcgcgtctccctacccggttatcatcacactggaagaccaccttacacccgagctgcaggaaaaagttgcaaagatggtccttgaagtgtttggcaccatactgtactaccctgaagaagaacatcccaaagaactcccttcgcctgagtccctcaagggccgtgtgctcctatcaacaaagcccccaaaggagtaccttgaagccaaggatggtggtgccgcgaaagacggcgatgcggagcagaatcctggcaaaggaactgacgatgatgcggcttggggaacagaagtcccagatttcaagactgaaatccagtctgctaaagaggaggatgcctcagagcaccgtagagatgacgacgaggacgatgacgatgaggacgaacagaaaatgcaacagcatctagcaccacagtataaacaccttattactattagagcaggaaagccaaaggggggtactacgtctgatgccttgaagtgtgacccaaacaaagttaggcggctcagtttgagcgagcaacagcttgccaaagctgtagttaatcatggcactgaaatagtgaggtttacacagaggaatctactgaggatatacccaaagggcactcgggttacttcttccaactacaatccatttattggttgggtgcatggtgctcagatggtagccttcaatatgcagggatatggaagagccctttggttaatgcatggattttataaagccaatggtggctgtggctacgtgaagaaaccggatttcttgatgcagtctgagccggaagtttttgatccaaaaaagcctcaacctgttaagaagaccttgaaggtaaaagtgtacatgggtgatggttggcggatggacttcaagcagacacactttgaccagtattctcctccagatttttacgcacgggtcgggatcgccggcgttccagcagactcggtgatgaggaagaccaaggcggtggaggacaactgggtgccggtgtggggtgaggagttctcctttggcctgacggtgccggagctggccctgctgcgggtggaggcgcacgagtacgacatgtcggagaaggacgactttgcggggcagacggtgctgccggtgtcggagctgcagcctgggatccgcgcggtggcgctgttcgaccgcaaggggaacaagttccccaacgtcaagctcctcatgcgctttgagttcgtctgatttggtatggtttggtttgggtgatgatggtgtgtcggcggccggccatggttggtactctgtgcattctttgttcatcctgtacatacgtgatgcgtcgcggtgccggtctgtgt

SEQ ID NO: 24 - DNA, 1197 bp, Triticum aestivum
gcgccgagtgacatgacgacgagccaggacgtggttgtttcggagatgggcattgggccgggtggggcggccatgccgggctccggcgccgcgggcctcttcgcgtgccgcagcgccgccagcgccggagccatgtccatggggcagacgtaccgcgacctcgccgccgccgcctcgcgctccgcgaactgcacatgggccgagctcgaggccatgcgcgccgcctcgcccacccgctcccggcccggcaccgacgtcgacgagctcacggcctggatgaggaagcacccgtcggcgctaggcaagttcgagcaaatcgccagcgcgtccaaggggaagaagatcgtcatgttcctggactacgacggcaccctctcgcccatcgtcgccaaccccgacgccgcctacatgagcgacgcgatgagggaggcggtgcgcgacgttgccaagcacttcccgacggcgatcgtgagcgggcggtgccgcgacaaggtgcacaacttcgtcggcctctccgagctgtactacgccggcagccacggcgtggacatcaaggggccaggctccaatccggagtctgtgctgtgccaacctgcaagcgagttcctccccatgatcgatgaggtgtacaaggtgcttgtggaaaagacgaagtccacacctggagccaaggtggagaacaacaagttctgcctgtccgtccacttcagatgtgtggatgaaaagagatggaacttcttggctgagcaggtcaaggccgtgatcaaggactaccccatgctgaagctcacccaagggaggaaggtcttcgagctccggcccagcattatgtgggacaagggcaaggcgctggagttcttgcttgaatcgctaggattcgccagctgcagcgacgtcctgccggtgtacatcggcgacgaccgcaccgacgaggacgccttcaaggtgctgaggaagaggggccagggcgtggggatcctggtgtccaagtgcgccaaggagaccagcgcgtcctactcgctgcaggacccggcggaggtcatggagttcctgctccggctggtggactggaagcggaggtcgtcggcgccgcccatggtccggccgcgggtgtaaccccggccggcccaccagctatagcctagcacagatccaagacgccggtcgggtcgaccaccggtcaatccagctcgtcgc

SEQ ID NO: 25 - DNA, 642 bp, Zea mays
tcgatcgaacctgcgctagcctatatataggtcttggttgacaccgcctggtctccgagtccaagaggggaagcagcggctctggacctctgatcaatctagcttagctttcttcgagttcagacttcagagcgcatatggccatggaagttcagggcaccaggcggccgcaggatgccggcgtgaaggtcaagttcatcgagacgcagttcattagctccgacgccgccagcttcaaggccgtcgtgcagcgcctcaccggcaagtccccagccgcctcgtcgcagacgactcagccgccggcgcatcctcagccacaaagcctgcgcccgtgccggccgaccttcattggcgctgggcagcagcagaccactggatggacagatctacaggctgccggcggctacctggcgacgatgccggcgccgaagcaagagcacctcgcggcggcgcctcggctggaggacatgaacgagctctgcgactttgcagacctgttctacaccaccgccgcgagcaatcggcccgacggcggcgccagcgtctttccttactgaaaccacggtgcgtggtgtgtccttgcgccttggtggtgttttcggaatgcatgaatgaatgatgaagcgcggatacttgaagttt

SEQ ID NO: 26 - DNA, 1197 bp, Zea mays
cgccccgccggtaccaatctccggaatcttatcattttcgtggctttgttcagggatcatcgtcagtcacatgcttttgatggatcaaaagcgaccgcatagatagcacagagtggcatatcctcccttggggcaattttcagaattgtcttgatattttaggaaccagttttcttttgcatttgatgatgcatttcttgatttcacaccagttgacgtgtggtctgtgggctgtatctttgcggaaatggtgaaccaaaagccactattccctggtgattctgagatcgacgaactgttcaagatattcagggtgctaggtacaccgaatgaacaaagttggcctgtagtcagttgtttgcctgacttcaagactgctttccccaggtggcaatctcaggacctggcaataatagtcccaaatcttgaacctgctggcttggaccttctctctaagatgcttcggtatgagccaagcaaaagaatcacagctaggcaagcacttgagcacgagtacttcaaggaccttgatatggtacagtgacctgctaaatgtgcttggcgttgctttggcatttgtaattgtctgagctgagtcgctcattcctttttatgggcgtctgtactctctgtgtataatcaaactctttgatgccaatgtcatgcagattgacgatgatgaaaaaattacagtgattgactttccacagatggtgtctgtttctcaccgtaatgcccaaatgttttttgaccgagacattgaatgcatctacaagttctttaacaaaagattcaatctgaggtcagtgaaaaatgaagaacaagctggatctgaaaatgatgatgaaggaaacaacagaccttcctttttgtccgtggaaaagggtgctggttccttggacaaggaactagctgccagtggatttaccaggaaagagcaagtggatatggagaagtacaccgaggaagttgttgaagggcatgattccagttcagatgatgagaatgatgaagttggtgatgttgtgactttggtttccttgaagatagaccaagtacgtctgcctagcaagttagtttgaacatgtgcagactgtaccagtgatcaggtcgtcgggccagtctctggttaggggtcactattattgaagtgtattttggttgtctctcaggacagttccgatgagcctgattgtg

SEQ ID NO: 27 - DNA, 1175 bp, Triticum aestivum
aggtaactaattaatgggttctatctccgacgacgaggcggcttgcatctacgcgatgcagctggcagcggcagctgtcttgccgatgacgctcaagaacgccatcgagctgggcatgatcgagatcctcgttggcgctggcgggaagatgctttcgccgtctgaggtggccgcccagctgccgtcgacggccaacgcggaagcaccggccatcgtcgaccgcatgctgcggctgctggcatcgcacaacgttgtgtcgtgcgaggtggaggaaggtaaggacggccgcctcgcacgccggtacggcaccgcgccggtgtgcaagtggctcagccccgacgaggacggcgtgtccttggccccgatggtcctcttgaacgacaaggtcatgctggagagctggtaccatttgaaggacactgtccttaacggtggcctgccattcgaaaaagcgtacggaatgacagcgtttgattaccaaggaacggacccgcgctttaatcgcgtcttcaatgaggccatgaagacccactccatgatcatcaccaagaagctcctggagttctacaagggcttcgatggtgtgggcaccctcgtggacgtcggtggcggtgtgggcgccaccatccacaccatcctttgcaggtacccaagcatcgagggggtcaacttcgacctccctcacgtcatctccgaggcaccatcctttgcaggtgtgcaccacataggtggtgacatgttcaagaaggttccctctggggacgcaatcctcatgaagtggatactccacgactggaacgatgagcattgcacaacgctgctgagcaactgctacgatgcactacccgcgcatggcaaggtggtcatagtggaatacatcctgccagtgaagcccgacgaaacggccacagcacagaggtccttcgaagccgacatgattatgctcacacacacacccggcggcaaggagaggtacctgagggagtacgaagagctcgccaggagcgccgggtttgccagcgtcaaggccacctacgtctacagcaacatatgggtcattgagttgaacaaatagaacctgcatgtgtgctagtatgtggagtttccactgctcccttaaatttctcttactctgaatcagcaatatacataataaaggattggctacaagaaaa

SEQ ID NO: 28 - DNA, 1638 bp, Aegilops tauschii
acacaaacacacacacacacacagttgaagagatgtttccagtgacgggttcgccgaaatgcgttgctttccgatcaaagcatacccgcaagtaccttggtagcgtgcatgtagggagcgaggagagcgccgtcggcggaggcaggttcttcgaggagctgagcgacggcgccgacgacgtcgatgtccttgcaagcccgtacactagattctacctggagccatccaaggagcacgacgggctcctgcacgtcaggtgctgccacaacaacaagtactgggtggccaaacatggcggtgaaggcagcggccactggatcattggcatcgtcaatgaaccgaacgacgacctgtccaagccgtcatgcacgctttttgagcccgtccctctcacggacggggacaataatctatccatcaggttcttccgtccccagcagacaaccagctctgaatctgagatggtcatggaaaaggagacagcagaagaagcctacttgcgtctgggaaccggagggcatgaaaaaacagttgatcaagtgaaatctcttcatgacttctccgccattgatctgtcgaagcaattggtactgcccaaatatgttgcttttaaaggcgacaatgacatgtacctccgggcaaggatcatccagaaatacaattacctggaattctcatcatctgatattgcagattcaactgtggtcaacactattttccccaactacgctaatggaaacgtgcgcataaaatctaaccacttcaacaggttttggaggctcagccccaactggatctgggctgactccgccgacagcagcagcagagaccgtgacacactcttcagggtggtcatgttgcctgactacatcggtctccagaacctgggaaactccaggtactgcaagaggctaactgccgacagaaagacaagctgccttaacgccgccgtcgataccatcacactggaagcaaggttacgggtggaagaagccgtactttcacgagagatctatggcgtggagttcaagctctccgaagctaggatctacggcgagaagcctattacctttcccagcatgacttcaaccaatgacaccaacgaaccacatgccaagaccctgaccctgaaatacgaggagacgcaggccaagacctggagctcgactgttagcctcaagattggtgtcacggccaagttaagagctgggatcccagtcatagcagaagggaaggttgaggtatccactgaattcaattcagaatacgagtggggatcatccgttcatacaacggcctcacaagaggcctcctaccatgctgtggtgcctccgatgaccaaggtgacagtcagagcggctgtgacacagggttctgttgacgtcccgttctcctacactcagagggacattctgaccacaggagaggttgttacctacaagatggatgatggtctgttcactggtatgaacaactataatttccaatttgaagccacacaagagcccatttgaagtgacgatgcatgcattagttagccgtattaaataaagccatccctgccttggagtggcccggcttttctgtgtggtgatttgatggtgtgttgtgactttcattttattttttagtttgtgg

SEQ ID NO: 29 - DNA, 1275 bp, Aegilops tauschii
cctcctcactccacagcaggttcatctccaccccgtcagtcagtcaggcggcagcaatggcggaagaggggaacagcgcgggcagcggcgggcgcggcgtccgggtgtgcgtcaccggcggcgccgggttcatcggctcctggctcgtcaggaagctgctccaggccgggtacaccgtccacgccaccctgcggagcatcggggacgaggggaaagtggggctgctgcggcggctcgtccccggcgccgcgccgccggagcggctggtgctgttcgaggccgacctcttcgacgccgccagcttcgcgccggccatcgccggctgccagttcgtcttcctcgtcgccaacccctccgcgcacgaggccgccgcctccaagtacaagacatcggcggaagccgccacggatggggtgcgcatcatcctccggctatgcgcggaatctatgacggtgaagcgcgtcatccacaccgcatcggtgacggccgcttcgccgctgacaaagtcctccagcgccgcggccgctgtgtacagcgatttcatctctgaatcttgttggactctgttggatgtcgattaccctctccggagcgtgcacttcgataagtacatagagtccaaggtcctgtcagagaaggagctcctcagctacaacgacggcgagagcccggcgttcgaggtggtcaccctgtcgttgggccttgtcgggggcgacacagtgctcagccacctcccagagacggtggagagcatggtggccccggtaacaaagcaagagccctacttcatgctgccgaggatcctgcagaggttgctgggctcgctgccgctggtgcacgtcgacgacgtgtgctccgcgctcatcttctgcatcgagcaacctgccctctcaggtcggttcctctgtgccgctgcctacccgacaatccacgacatcctggaccactacagcagcaagtacccccatctggatctcctcagagaggctgatgaggtagcgagggtgcaacccgagaagaacaagcttgtggagctgggcttcaggtacaagtatggggtggaggagatactagacgaaagcattgactgtgctgtgaggctgggctccctggatgcatccaagctcatcgtccagcaggagtgatgaactcaatgatgtcgagggcaagtgatcacagtatcctctttacttgttcagcatttacagtaacacatgtattaaaagaagaaaaacggtacataaataacagagctgctttgttatttactggcag

SEQ ID NO: 30 - DNA, 1630 bp, Aegilops tauschii
aacaagttgattcgatcgacgacaagtcgctgtctttgccaacttggttacagagaattttccaccgcgtgcggcttgattcatgtgaacaaagagcggcaccgaatcgaatccaatccaatccagttgaagactttctcgccgagctgggccgatcgacgggcatggacatcgacatggagggtggctcgcagccgcagccgcagggcgcctcgctctcgccggcgccgttcctgatcaagacctacgagatggtggaggacccggcgaccaaccgcgtggtgtcgtggggccccggcggcgccagcttcgtggtgtggaacccgcccgacttctcgcgggacctgctgcccaagtacttcaagcacaacaacttctccagcttcatcaggcagctcaacacctacggttttcggaagatcgacccggagcgatgggagttcgccaacgacgacttcatcagggggcacatgcacctcctcaagaacatccaccggcgcaagccggtgcacagccactcgccgcagacccaggtgaacgggccgctggcggaggccgagaggcgcgagtacgaggaggacatcagcaggctcaagcacgagaacagcgtgctcgtggcagagctccagaggcaggcgcggcagcagtgcgggctcagctggctgatgcagtcgctggaggaccggctgatggcgatggagcggcggcaggcggacgtcgtcgcctccgtgcgcgacaccctgcagaggagacggggcggcgttcatccagggcagcagaccatgctggaactggagccgaccgaccatttcagcaagaagaggagggttccgaggctcggtttcttcgtcgaggagcactcggcggcagcggccgaggagcagcgggtgccgcatctgcgggcgatgggtggtgagacgccgggcatggtcatggtgaacgccgagccttttgagaagatggagctggccctggtctccatggagaaactcgtccagagggcgggcgactatgcgtcctctgaagacatgtacaacgccgccgccgctgcacccagcaccgatgatccggctcatgcagatctgcaggcagcaccagtaaatcttcagccgtcttcaccggagatagcagagtctccgggttacgctgtccagagtccaatgctactattcccagaaattcacgaggacaagcacaagacgatggccgaagttgacatgagctccgaggccagcaccacagacacttcacaggacgagacgaccgccgaggccgaggccgagaccggagttccccatgaaccggccgtggcgaacgatctgttctgggagcggtttctcacggacacgcccaagccgctagccgtcgaggatagccatgaatccaaggacgatgtgaagaccggcctagactgctactggttcggtcaccggaacaatgttgaacagatcaccgagcagatggggcacctcgcttctgctcagaagacctgatggctggcctaccatttccgcccatgtatagcccatctgtaaattatagtttagcccgtctcacatgccctcatactctacaagcatctccctttcagatatatttgtatatagcttcctcgtcacacacactgtac

SEQ ID NO: 31 - DNA, 1587 bp, Aegilops tauschii
ctaatctcttgcccctccgccatgtggtttctatataagacacagtctgaggccacacatcaaggcaattcttatcgtagatagcaactaaaatggagaccatgtcatatccttgttcccctcttctctccctccccacacacgaagagagtaactttttcatgtggtctcctcaagtagctctccacgagaatgccaccatccatgttgatcatcccactgatcagcaacctgataatgtgttcttggacactgcagttcaagattatgctaatgattggcatcaacaagatgcttctgatgttggtgtgttcacctattgtgatgagaggattcagggccaagagagtggtaacttggtcgcgatccaggaagagctcatggaggagaacagtgtaactgatctcctcctcactggtgcagaggcggtcgaggcgggggatccaagatttgccttggcagtgttctcgaggcttgatggcctcctccttggcagccctgaaaatgcagcagccggctcttttgatcgcctggcctaccactttgcccaaggtctgcggtcccggatctccagtgcaagcaccagttgctctctgccggagccactgccgtctgatagaatgtcggtgcaacatattatacaagagctgtcgccgtttgccaagtttgcgcacttcactgccaaccaggccattctagacgccaccaagggcgatacacatgtgcacatcgtcgacctgaacattggtgagggcatccagtggccatcgctcatgtcagatcttgcccgtcatggtggcatgtcattccacctcacggcggtcacagcagacgccgactacagcgacggcgttcaccatgcatctgcgctgcggctctcggagttcgcggactccttgaaccttcctttccagtacagctctctctgtttacacagtgatgaagacctgcatgaattctccaagaactgtaaaggctcggtgatcctctcatgtgacacaacaagcatgccttacaagttgctgagcaagttaccggcactcctacctgcctgtgttaaactgttacagccaaagttaatggtcatcgtagaagaggagctggttagagtcggaaaggaggcgtctctatgtaaggcctcctttgtcgacttcttcttcgaggcattgcaccactttaccacggtgttcgagtcactggcgagctgcttctttggtggtaaccagggggcgtgcctgagacttgtggagagggagatggtggggccaaggatacaggactttgtggggcagtatgggtctgtgacagttgaggtcactactcctgtggttttggaaaggtatggggcttgtgacctgagtggctgcaatgttgctcaagccaggatgctggttgggttgttcaatagggggtttgaggttgtgcatgagaagggtaggcttgtgttgtgctggaagtccaggccactgacctctgtgtctgtttgggctccaatcttaaaagaaaggagctcatgacgttctttatttttgttgttgtaagcgttgcagtgaagaattttgaggaaaacgtatttggttagtgagc

SEQ ID NO: 32 - DNA, 1705 bp, Aegilops tauschii
acaaaaatcgcaagcaacgcacgcaacaagaactcgatcgacatcgaagctcgagctaaccttcgccacttgcagcaatctctctctctttctttctctctcgccgatcaaacttggtcaacgtcgaccgagcaactacacccagctgcaaggtgcaagcaagcaagctagctcgacagttagcaatggaggttaaggtgttgggctccaagctcgtcaagcccgcctacaatgccggcgccgcgccggcaccttccaccgagtacatccctctgtccatcttcgacaaggtgacgttcaacatgcagatggccatcatctacgccttcgccgcgccggcgccatccacagccgccatcgagaatggcctcgccacggtcctcgcccagtaccgagccttcgcgggccagctcggcgaggcgcccgacggcacgccgtccttcatcctcaacgaccgtggcgcgcgcctggttgaggcgaccgtagacgccgtgctcatcgacatggcgccagcgaaacccacgccggagctgctcaagctgcaccccgacctggaggcggagcacgaggaggttgtgctgctgcagctcacgcggttccggtgcggctccctcgccgtggggttcacgtccaaccacgtcgtcgccgacggccacgccaccagcaacttcctcatcgcctgggggcgcggcacgagagggctcccaatgggccttccgcccgtgcaccaccacaaggaccttttcaagccacggtcgtcgcctcgcgtggagcacgaccaccgtaacagggagtactacctgccgtcgcccaccgacgtggtcggtcaccacagcgacgccgccgacaacatcgtcatccacaaggcgcacttcaccaaggacttcatcgccggtctccgcgccaaggcgtcagaagggcgcggccggccgttcagccggttcgagaccatcctcgcccacctctggcgcaccatgacgcgcgcgcgcgacctgagccccgaggagaccaccaagatccggctgtccgtggacgggcgacaccggctcggccagccggcagagtacttcggcaacatggtgctttgggcattcccgcgctccaccgtgggtgacctcctgaaccggccgctgaagcacgcggctcaggtgatccatgacgaggtggcgaaggtggatggtgcatacttccagtcgttcgtagacttcgcaagctccggcgccgccgagaaggaggggctggctcggagcgccgtgtgcaaggacgcgcagtgcccggacgtggaggtggacagctggctgacgttcccgttctacgagctggacttcggcacggggagcccaagctacttcatgccggcctacttccccacggaggggatgcttttcctcgtgccgtccaacttcggcgacggcagcgtcgatgccttcgtacccctattccaagagaacctccaggcgttcaaagaatgctgctattccatggagtaggtggcctaactgttaatttgtcgaagaaacagtgaggcatacattagttcattcattgagagggtggcagaaaaaaataatgtcttttcttttttctctttgagaattgaatagtgctactgtgtgtacacagatgtcatcttgtacaagtacgtaacacgagttttcagataaaataaatttactagcgaaaggacccgtgtgttgcaacggga

SEQ ID NO: 33 - DNA, 960 bp, Aegilops tauschii
gctagcatgacacaccacatagacaaatcaacgcggccaactttggaatcattcgtagaggattcgcctatataacacaccaacgttgtgttgccacaagaatggaacagcttaggatatccctaatcgaccacacgatggcgtcatcatctccatcttcgaccgtgatccagatgcctccaactccacgcaccaacggcagccagccgacggctccgaccacgcccaaggacgtcgatgatgtcccgaccacggagcctgcaccagctgccggaccagcagccacggcaaccgacaaggtcatgtcgagcgcggcgaaccttgcgcagctcctgccgacgggcaccgtgctggcgtaccaggcgctgtccccgtccttcaccaaccacggcaagtgcttctcctccaaccagtggctcaccgcggcgcttgtcatcgtcctcaccatctcgtgcgtcctcttctccttcaccgacagccttctcggccgcgaccagaagctctactatggcatcgccacgccgcgcggtttcaacgtattcaacttctcagacgaagaggagaagctgcagtggactcccgctgagttccggaagctccgcatccggccgctggacttcgtgcgcgccgtcttcacggccctggtgttcctcaccgtggctttcagcgacgtggggctgcagaattgcttcttccctggcgctggcaggaacaccgaggagctgctgaagaacctgccactgggcatcgcgtttctgtccagttttgtgttcatgatattccccacaaagaggaaaggcatcggctacagcgacaccactcctcgcgaaaagctcacttgatgttaatatcagttgtttctgaacagttagatggattttagattataacgtaatcacgctatgtagtattataccatgaggatagagtcggaacattgtttatgaacagttagataaa

SEQ ID NO: 34 - DNA, 560 bp, Aegilops tauschii
ccaacaaaagcagaggcatctatgcgaagcagattcggtactgcatataaatcgttggaagtagctagccatgaaaagcagcacgctgatggtgatcatggtcctccaggccactctggtcatggggatctttatcctcccggacatgtgcaacggagatgtgcatgcaacgtccgtgggtgagggcaaggccatcgacctcaacctgggcaagctaaggtgctgcagcaactgcaactcctcctcgggcctctacacatgcgaagacgtcgtgaagatatgcgaccctgtctgcaagcgatgcgccgtcgtgaagaagaaccttgtcaaggagttcaggtgcaccgacaccttcctcggtctgtgcgaaaatccgtgcaagaaccactgaagatgaaagtagctaataagcggcacgctagctgctactgtgatttgatatgtgctacggtgcacagtaggcatgtatgccaggattgggattggatgattttcgatccatgttatacgcggaacagtaagtcgttgtttacgtgtttattgacacaataaaatcggtg

SEQ ID NO: 35 - DNA, 1834 bp, Aegilops tauschii
accaagccagctataaaaccgcgcgccagctaaacgcccccattcaacaccgaccagcaccatcactgcttggaaggttcaaatctcccagcactacttggtcttgaaggaaagtgagaggcaaaagcagaggagtgactttgcccgtagcccgccgccggccatggcctcctacgacaaggccatggagtcgtacaagaaggccgtcaccacggcggcctccctcgcggcgtccgcgatgctggtgcggggcgtcgtcaacgagctggtgccctacgaggtgcgtgacctgctcttctccggcatgggctaccttcgctcgcacatgtcctcccagcacaccatcatcatagaggagaccgaggggtgggccaacaaccagctctacgacgccgcgcgggcgtacctggcgacgcggatcaacaccgacatgcagcgcctccgggtcagccgcgtcgacgaaaccaagagcatgatgttcagcatggaggagggcgaagagatggccgatgtccatgagggcaccgagttcaagtggcgccttgtctgccgggacaaccccagcgccagcagcagcaacaccaacggccgtggcggcagcggcaatttcaagcttgaggtccggtccttcgagatgagcttccacaggaagcacaaggacaaagcacttacctcctacctccctcacatcctcgccgtggccaagaaaatcaaagagcagaacaggacgctcaagatctacatgaacgaaggtgagtcatggtttgccattgatctccaccacccatcaaccttcagcacgcttgccatggatcacaagctcaagcagtcagtcatggatgatctcgagaggtttgtcaagagaaaggaatactacaagaagatcggcaaggcatggaaacgagggtacctgctgtatggcccacctgggactggcaagtcaagcatgattgcagcaatggccaattacctcaaatttgatgtatatgatcttgagctcactgaggtcaactggaactcaacacttcggaggttgctcatcgggatgaccaaccggtcaattcttgtcattgaggacatcgactgcactgtcgagctgcaacagcgggaggaaggtcaggagggcaccaaatccaacccttcagaggacaaggtgacactatccgggctactcaacttcgttgatgggctttggtcaacaagtggggaggagaggataattatcttcacaacaaactacaaagaaaggctcgatcctgcgcttctgcgccctggcaggatggacatgcacattcacatggggtactgctgcccagagtcgttccgaatcttggcctccaactaccactctatagatcaccatgccacatacccggagatagaagaattgatcaaggaggtcatggtgactccagcagaggtcgcagaggtgctcatgaggaatgaagagacggacgtcgcactcaaaggtcttatccagttcctcaagagaaagaaagatggcgctggcaaaccggaaaatgtggaccaggtggcgaaggaggaagaacaagagaaggagatgatgacgaaaagtgatgtcccagataatgaagatcagcaagatgggagcaaagaatgatgtgtatacagtgtgaatatcatacaattagtgccaggaacttcgagcaacaatgtatcattttgctataataagagatcaattttggtaacaataaaataatctggtattgtgaacagttatactatttgagtgcatataaacccagttatgaactcagtattggtagttatttcaatgcagaaatactgttcaatataagcagtcaacaag

SEQ ID NO: 36 - DNA, 1105 bp, Aegilops tauschii
cataaataggctagcccgacgaagatcgacatggccgaccatggcgacgagatgacgacgaacaagaaggtggtgctgaggaggtacgtgacaggctacccgacggcggaggacatggaggtggtcgtcccctcccacgtccggctgcgggtgccggaggggtcgacggccgccgtggtggtcaagaatctgtacctttcctgcgacccgtggatgcgcggccgcatgagcaagcacgacgacggcgacgccgtgccggccgaggacttcgtgcttggagaggccttggtcaatttcactgtcggcgaggtgctcgattcgacgcacccggagttcgacgccggcgacctcgtctgggggatgagtgcatgggaggagtacaccctcatcacccaaacggagggcctgttcaagatcaaccaccccgagctgccactctcacactacacaggtgttcttggcttggcagggctcactgcatatgctggactttttgaggttggcaagccaaagcaaggtgaatctgtttttgtgtcggcagcgtctggcgccgtcggtcagatcgttggacagctcgccaagatagcaggatgctatgtggttggaagtgccggctccgatgagaaggtgaatctcttgaagagcaagatgggcttcgacgacgcgttcaactacaagttggagggggacgacctcggcgcggcgctcgggcggcgcctcccgggcggcatcagcgtctacttcgacagcgtgggcggcgcgacgctggacgcggcgctgctgcggatgcggccgggcggccgggtggtggcgtgcgggatgatctcgcagtacaacctgctggagcaccagggggtgcgcaacctgtggtgcatcatcccaaagcgcgtccgggtggagggcttctcctgcatggactaccaccacctgtatcccaggttcgaggaggaaatggccggctatatcaaggcagggaaggtgaccgtcgtggaggacgtcgtccgagggattgagagggcgcctgaggctctgctgggcctgttttctgggagaaatgttggcaagctgctggttgctcttgcatgagtcatgagtgtgagtccat

SEQ ID NO: 37 - DNA, 640 bp, Aegilops tauschii
tcctctagactccggctcgtgcgtactctgcttccgcgtgccctccgaattccaaccggagacccgcacgcacagggcgaccctataaaatcccaaccccgacgtccagctggatcaccaagcaaacaagaatatcttccttcgttctaccagcagcagcaagtaatccttgatgccagactgcctgatcaaagcatccggcagtagaggatccatggctatggagaggttcttcacggcgctcgtcttctgcgaggccccgctggacggctacggcacatcggtgcttaccgccggcacggtcaaaaggctggtctcaggtggcggccacgcgacgaagccagcagtggctaacaagccggactctgagaaggcgcagggttacttcactggcaagccgacggcgcagcggcgccccgggttcgagctcgcgttcgacgggctcaattgctttgacaccatcgtcatgcactaagcaagtcagtgtcatgccggctttcttgattttgatcagtaattctgtatagaattggatcggttagatgcttgacacgtacttggggctgtgatgttttttgttcattcgattgtactgttcgactggtgcataagcttcaatacaaatgaaaagagtttaaag

SEQ ID NO: 38 - DNA, 914 bp, Aegilops tauschii
atcccacgaacctaccgcgcgccccgcaaccggcctcgcttaggcgcttgcttctatttaaagggcatggcagcagacaccacagcaacccaaaccccgctaagcatcagcattcagcagcaccagccttctacctcctctgctttgcattccgccttccagttccaattccaaccgcaatcaatggctgccatgaagatcgccctccttgccgtggccgcgatggccgtcttgctaggcaccgcgtcagcggtaacctacaacgtcggcgatcagggcggttggaccctcagcaccgactacagcagctgggtgtccggcaagaagttcaacgtgggtgatgagatcgtcttcaagtactcgaccccaacgcacgacgtggtcgaggtcagcaaggccggctacgactcctgcagcatcgacggcgccatcaacaccttggcctccggcaacgacgtcatcaccctcaacgccaccggcacccggtacttcatctgtggcgtccctaaccattgcagccccaccgccgccgccagcatgaaggtcgtgatcaacgtcgcctcgggctcctcctcgccgtcgtcacccatgccagctgcaggtcctggcgcgagcaactctcccccggcgccgccctccaacgccgctacctccgtcggtgccacagcaggatttggcctcgtcgccctactggcggccggtctcatggcttgaacgcatatattgatcagctgccgcgcgcacatacgagcttttatattgttaactactatactgtagttattatcacgggtgaatacatgtattcttttttagagcgagaatgtgatagttacttgtatctatcacgtctatatgtaatctgcaggccttcatgtctttttatataatgattctagactattattttataa

SEQ ID NO: 39 - DNA, 1069 bp, Aegilops tauschii
tagcagtacagatctccatcgatccacgcacatacacgtacgcagctgagcttgctcgacctagctcgatcaatggcctcaaccggagtttcgcgtaggtcgtccatcatggcgtcccggctgagcgcgtctgcagaggccatgcgcgcgagcgagggggggaagcagcgacacgccgtgctggcgcggcgggtggagtacgacgaggagtctctggccggtgaaccccaatacgacgtgttcatcaaccaccgcggcgtggacacgaagcggacggtggcgcgcctgctctacgaccgcctcgcgcagagcggcatccgcggcttcctggacaacatgtcgatgcggccgggcgaccggctcagggagacgatcagcgccggaatcagcgaatgcagcgtcgccgttgccatcttctccccgagctacttcgactcggagtactgcctgtgggagctcgccacgctcgtagagtcacgcaagaccatcatccccatcttctacaacatcaagccctccgacctcgtgctccccgaggccctcgccgcctccgacgactacctcccgcaagacgtcgagcgctacaagtacgcgctccgcgaggccaagaacaccgtcggcctcacctacgactcggccacaggggacatagccgagctggtgtcagcggcagccgacgcggtgctgtaccacatggaaaaaatggtgagagtgcagaggagggaaacgatcgtttcaaggctctaattttgaatggaaaatcaacggctactattcagcgaagtacccggctccacgtcaggaataacaaatagtcgaaggggcagattaacagtcaaataattaacatgcagaggattcattcgttcgtttttttttcttttcttttgagaggacattcgtttttctttggttgattctttgtcggtaaattaggttcatgggtgcatgccttagccgccaatgtgtagtaaaataagctatacggctggccatacaggcaccgcaacttcagattttgcaaataatgacgggcatatgtacatgtactgcacaaagtcaaataaat

SEQ ID NO: 40 - DNA, 3273 bp, Aegilops tauschii
tgcatgtatggaacacgtgtggccggcgcggggatgattccacgtcgcgctcgtggtttcccagccctcgcacgaccgcgcgctccctctgccgccctgggttagatacccttcgctctcctcctgcccaagccccccgcgagcgcgcgcgacctatatataatgcgctcccagcccccactacgagagagaaaggcagcagagaagaaaacaggggctggtgtccggtccaagatccagagcgagaaacaaaatataccccccttcccggccagctgctttgacccatttcgtgtccggcgatcgatcttaaccttggtctactgcgccgacgaggggagagcttctttctacggtcatcgcgccgatggagctgctggggagatcgctcttgcaggcaggctctgccagcaccgcggcgccgcgcggcggccgggagcgcgcgggcggcgggctctgcttcgcgagcctgggcgggaggccgtcgaggaggacggtgcggtcgaaggcgccggtgggcgccctggccgagcgggtcgtcctcaccccggcgccggcggagagggtggcccggccggaggcgcacccgcagagcgtggcggcgagggccgtggtcaccgtgcgccggaagcgcaaggtggaggtcaaggagcaggtcgccgagcagatggacgcctacgccgacagggtcggccggagcgtcctgctcgagctcatcagcacggagacggacccgagaaagggaggccccaagaagagcaggaagtcgaggctggtggggtggttcgagaagcgggacgtcaaggcggagctggtggtgtacacggcggagttcaccgtcgacgcggccttcggcgagccgggcgcggtcaccgtgctcaaccggcaccagcgcgagttcttcatcgagagcatcctggtggagggcttcccgtccggcccggcgcacttcacctgcaactcgtgggtccagcccacccgcgtcgaccccgccccgcgggtcttcttcaccaacaagccctacctgccgtccaagacgccgccggggctgagggagctccggcgacgggagctcaaggagctgcgcggcagcggcaccggcgtgcgcaagaccaccgaccgggcctacgactacgacgtgtacaacgacctgggcaacccggacaagggcgccgggttcgagcgccccgtcctcggcggcgacaagctcccgtacccgcggcggatgcggacggcccggccaagcaccgtcacagacgagggcgcggagagcagggtggagtacccggagcccatctacgtgtcgcgggacgaggagttcgaggagggcaagaacgagatgctgtccgagggcgccatcaaggcgctgctccacaacttcatgccgctgctggtgagctccgtctcgccggacagccgcgacttcgccggcttccacgacgtggacaacctcttcaaggagggcctccgcctcaagcaggccctgcacgaccagctcttccagaagatccccttcgtgcgcaagatccaggagaacagcgagggcctcctccgctacgacacccccgacatcatcaagaaggacaagttcgcgtggctgcgcgacgacgagttcgcgaggcaggcgctggctggcatcaaccccgtcaacatcgagcggcttcaggtgttcccgccggtgagcaggctcgacccggccgtctacggcccgccggagtcggccatcacggaggagcacatcatcgggaacctggacggcatgtcggtgcagcaggcgctggaggagaacaagctctacatgctggactaccacgacatcttcatgcctttcctggaccggatcaactcgctggacggccgcaaggcctacgggacgcgcacgctcttcttcctgacggccgggggcacgctgaagcccatcgccatcgagctgtgcctgccgcccatgaccgacgactgcaagcgcgccaagcgggtgttcacgccccccgccgacgccaccagtatctggctgtggcagctcgccaaggcccatgtctgctccaacgacgccggcgtccaccagctcatcaaccactggctgaggacgcacgcgtgcatggagcccttcatcatcgcggcgcaccggcagatgagcgccatgcaccccatcttcaagctgctcaagccgcacatgcggtacacgcttaagatcaacgcgctggcgcggcagatcctcatcaacggagacggcgtcatcgagtccgggttcacccctggccgctactgcatggagatgagctccttcgcctacgacaacctctggcggctcgatcaggaaggcctccccgccgacctcatcagaagaggcatggccgtggaggacgcgagccagccgcacgggctccggctgctcatcgaggactacccctacgccaccgacgggctgctcctctggtcggccatcgcgcggtggtgcgaggcctacgtggcggcctactacccgtccgacgaggccgtgcaggacgactacgagctgcagtcgtggtacacggaggccgtgcaggtggggcacccggacaagtgcgacgcgccgtggtggccgcgcctcacgacggccggcgacctcgcgtccctgctcacgacgctggtgtggctgtgctcggcgcagcacgcggcgctcaacttcggccagtacccgctcggcggctacatccccaaccggccgccgctcatgcgccggctggtgccggccgagggcgacccggagtacgagcacctcgtcgcggacccgcaccggttctacctgtcggcgctgcccagcctcacgcagacgacgacgttcatgacggtcatcgacacgctgtccacgcactccgccgacgagcagtacctcggggagcggcccaacgaggagtggacggcggacccggcggcgctggctgctgcgcaagagttcgcggcggaggtgcgccgcgccgaggaggagatcgagcggcgcaacgccgaccccgcccggcgcaaccgctgtggcgccggcgtgctgccgtacgagctcatggcgccgtcgtccgggccgggcatcacctgccgaggcgtcccgaacagcgtcaccatctagcccgcagagagtaaattcaagggaccgtgggaatttttcagcctcgatatactttggccagggaacgtctcagggaaagtagatataagagagaaacgccattgatttgggccctcgccatgaaggccgaatcgccattgatttgggcccagataggagaagatttaattgca

SEQ ID NO: 41 - DNA, 877 bp, Aegilops tauschii
atagcccatatagctacctcgtatagcatacaaagttgcctgcacacattgccaaaacccagcgtccaagtcgtacacacttgttgcaaagagagaagagacacaagaggaggagggttgcaagaaagctaaggttgacgacatggccgccgtgaggaggatgaggcccgctctgctggtgatcgtggcagcgctcatgctgctggcggtgctcggcgaggcgcggccgctgggtggcgccgactgggcggccgccggagggaccccgctgccggccgcgggcggcgcgtcgaccgtggtccaggcgctccggcggctgtacatgcagcagctgggcagcgggccgggcccctcgtgcggcaccaacagcccaaacgtccactgcccgtagatggccgaggtcgagcgccgcagctcggccggcgtacgtcctctcgggttcgaagttccaacgcgtgttttttggcgaccccaagaggtagactctggtgatcgactctaggattggatttgttgcttggtttgttggtgatttttgcccacgcgtacgtgtacgctggttggcactttgtacatacatacagaagaaaagatacacatatagtacgcaggattttgtttcaatagaacgtaggtaagctgaacaagcatcagcaatacatttgtatttgtgttaaaaaaatacatttgtatttacattacatatgtaaacctttgtttatgaattgaattgatatactctagtctacttcctcataagttctcaaatcttgaccaagaacagttctgtgtattttgttacgtatgcttgcctggaagtggaagctgacattcgcatgcgtcacccatggcctcatgaggcaagaggcagaacgtg

SEQ ID NO: 42 - DNA, 1557 bp, Aegilops tauschii
caccgcacgccacgagtcacgacggaccaaatcttttcttatccccagcccaccagcgccatgccgtcgcggtcgccgtccccgtctccgatggtgcgcgtcgtgtcgtcgtccacggtgaagccgccgccgcggccgcgcgagcgcatcccgctcacctcctgggacgcctccatgctctcctccaactacatccagaagggcctcctcttccacaggcccacctcatgctccccggtcaacgccaccgaccacctcgccgcggcactcggcgaagcgctcgtcccctactaccccatcgccggccgcttcgctaccgagcagcacagggacgaactcaccggcgccgtcgtgggctgctccgtccacgttgactgcgacggccagggcgtcgaggtcgtccacgccgtggccgacggggtgaccatggcggacgtgctcccccgcgacgccgacgtgccgcgcggcgtgctggcgcacttcttccagctcaccgacgccgtcaactacggcggccaggagcagccgctgttcgccgtccaggtcacccacctcgccgacggcgtcttcgtcggcttcgcctacaaccacgcgctctccgacggcaccgccttctgggacttcgtcaactactgggccgccctcgcgcgcgccaggctcggcctcgctgcggcgccaccggcggctaagccctcgttcgagcgctggtcgcccgacggtggcccggcggggccggccgtgctgccgtgcgccgacgtgtcggagctcatcgagcgggcgcccccgctgcagctgcgcgagcggatgctgcacttctcggccgagtcgctggcggcgctcaaggagcgcgcgcgggaggagctcctggccgccggcgacacggcgggcgcggccgcactaaccaagttccaggcgctctcctcgctgctctggcgctgcatcacccgcgcgcggcggctctcgccggagcaggagacgacgtgccgcgccgccatcaacaaccgcgggcggctccggccgcagctcccgcaggagtacttcggcaacaccatctacgccatcgggaccgaggcaacgcgcgccgcggacgtcctcaaccgcgggcacgggtgggcggcggcggccgtggggcgggccgtggcggcgcacacggacgcgtccatcagggcgcgcgtggcggcgtggacggccaagcccatggtgtacacgcaccgcttcttcgaccccaccggcaccatgatgggcagctcgccgcggttcgacatgtacggctgcgacttcgggtggggcagccccgtggcggcgcgcagcggcctggccaacaagttcgacggcaagacctcgctctaccccggccgcgagggcggcggcagcatcgacgccgagctcacgctgtcgcccgacaacatggcggcgcttgaggaggacgacgagttctgggccgccgtgaccccggacgcgccggtgccggcggcgccggagaagaaggccatttgaatcttcctgatgcatgtcaccaccgtacctctgctcttcttcctgattcttctgattggt

SEQ ID NO: 43 - DNA, 3753 bp, Aegilops tauschii
attaacccctaaacaacctcagacttttgttttgtctttcctttcctcgcttgcttacttcacacccctcgtcggcctcgtcttcggattgtggggcaagccaagcgaacaccgagcagagcagaggcgccgagccaagaagaagcataggcataggcggctcgcgcatgaggagaggcacacctttcgtctaggattcgattcgtccatgattattcaggagggcaagccatgtctcccctgctcctccggttcctctgcctactcctcctcgcaggtgaggcggcgctgacaggcgcgcagagcggcggcgacaaggaggtgctggtggagctcaagcgcttcctggttgccaacaacaggttcaaccgcggcgactacgacgggtggcaggagtcggacctgtcgccgtgccagtggaagggcgtcggctgcgacaggggcagccgcgtcgcgtctctgaacctggcgggctcgaccatctccggccaggtgttcggcaacttctcgcggctctcggcgctcacgtcgctcgacctctccggcaactccatcaacggcccgctcccggccgccgacctcaaccaatgccgcggcctcctgcacctcaacctctcccacaacctcatcaccggtccgctcaacctctccgggctgaccaggctacagacgctcgacgtgtcggggaaccggctcgagggcggcgtcgccgtcaacttcccggcgatatgcgccgacctcaacttgctcgacctgtccaccaacaatctcacgggcaacatcaccggcctgttcgatggctgcgtcaggctcgacaaggtcgacctcagctccaacaacttcaccggcgagctatggcctggaatcgcgaaattcagggaattcagcgccgccgagaacaacctcaccgggagcgtcccgtggagcacgtttcctgacggctgcaggctccagtccttggacctctccgataaccagctggtcgggggcttcccggattccgtcgccaattgcacgaatttgacgtacatgtcgctgtgggggaataatttcactgggattatacctgccggaatcgggaagctcgccgtcctcgagacgttgattcttgggaacaacaagttcgatcggaagataccgccggagctgacgaactgcgggagacttcagttcttggacatgagcaccaacaactttggaggcgacgtgcaacagattttcggcaactttacgagcttgaagtatcttgtgcttcatcacaacaattacaccggcggcatcgtggcctccggcgtgccccgcctaccgctgctcgccaggctcgacctcagcttcaaccagttcaccggcgaactccctccagaggtggccaacatgaagagcctcaagtacctgatgctcgccgagaacaacttctccggcaccataccgccggtgtacggctgtctcgccgagctccaggcgctagacctgtctaacaacacgctcacaggtgggatcccagcgagcataggaaacctcacgtcgctcctatggctgatgctcgccgggaaccagctctccggagagataccacctgaaatcggcaactgcaccagcttgctctggctgaacctggccgacaaccggttgactggcaagattccaccggagatggcagagatagggaggaatcccggcccgaccttcgccaagaaccggaatgatacgagcgtgctcgccggctccggcgagtgccaggccatgaaacggtggatcccggcgagctatcccccgttcagcttcgtctactccgtcatgacccgggagaactgccgcagcatatgggaccgcatcctcaagggctacggaatcgtcccaatttgcaccaactcgtcgtcgccggcgaggtccaacacggtctccgggtacgtgcagctgtcagggaacctgctttccggcgagataccgtcacagatcggcgcaatgcggagcctcagcttgctccacctcgacggcaaccgtctcacggggcagctgccaccggagatcggccggctcccgctcgtcatgctgaacgtctcgaggaacaacctctcgggcccgattccgtcggagatcggcgacattctgtgcatcgagaggatggacctgtccttcaacaacctctccggcgagctcccggcgagcctgttcaagctcaccgagctatcaatgttcaacgtgtcgtacaacccactcctctccggcaatgtctccaccaccggccagttcggcaccttcgacgagcagtctttcctcggcaacccgctcatttcgttgcatcagggtggagctgccggtaagcagcaaccaccaccggaagctgccgacgctcctgcagttcggacgcgcagcataccgagaaccatcgtcatgtggctgcttttctccctcgtcatcgccttcatcgccgccaccgtcgtgttcgctgttaccagcctgcgcgcccggttcccggtggaccaggagccggagccggacccattctcgtgcgagcaccccaagggcaagtgcgcgttcggaatgtcctcgtcgccgccgtcctggtcgtcgtcggccacggggtgctcctcctcgacggagggagtgaaggtgttccggctggacaagacggcgttcacctaccgcgacatcgtggcggccacgggcaacttctccgacgaccgggtgatcgggcgcggcggctccggcgtggtgtaccgcggcgtgctccccgacggccgcgccgtggcggtgaagaagctctccaggccgcgcgacggcgtggacggcgacggcgagcgcgagttccgcgccgagatggaggtgctcgccgaccggatggggttcacgtggccgcacccgaacctcgtcacgctctacgggtggtgcctctccggcggcgccaagatactggtctacgagcgcctcgacggcgggagcctggaggcgctgatctgcgacacgggcgcgttcgggcgggcggcgcggctggacgcggcggtgggagtggcgcgggcgctggcgttcctgcaccacgagtgcgtgcccgccgtggtgcaccgcgacgtgaaggccagcaacgtgctcctggacggcgacgggcgcgccaaggtgacggacttcgggctggccagggtggtccgccccggcgacacccacgtgagcacgatggtggccggcacggtcggttacgtggcgccggagtacgcacagacgtggcgcgccacgacgaaaggcgacgtgtacagctacggcgtgctcctcatggagctcgccacggcccggcgcgcggtcgacggcggcgaggagtgcctcgtcgactgggcccggcgcaccgcgaaggagggccggaagcagcaaacggaggatcaacagacgaccggcacggtgttctgggagctgctcgagctgggcatgcggtgcacggccgacgcgccgcacgagcggccggacatgccggtcgtcctcgccgcgctgctggacatcgccggcgatgtgggctgtgcatactgcaagagctcaggacacagcgacggcgagcaaacaagttctctgacataggtgttgaaggttacaaaaacaaatttattctttgtgtacaaaaatgcggttgtttagttcagctgggcgttcattcatgtatgtaggtaggggcaaagataaagaagcaaagttttggtagcgcacaatacaatacggtgaaaaaccaatgaaaaaaatagcatggcccctaacatatgctattagctt

SEQ ID NO: 44 - DNA, 3062 bp, Aegilops tauschii
cgtgccgctcggccggacccagtaaacaaacaaaacccaaccaaacccaagccgaacaagtcaaaacgcaccaccaagtcccaacccagcacaccacagcacaacaacaacgcagccgccggcaaggcgggcaggcagcaacaactgcggcaccagccagagcagaatatcgattccgcaagtcaatcctcacctccgtccgtcgcgtttccatcctccccacctcgcccgggccaccggagatggctccctcgcctatccccctcctcctcctcctcctcctcgccgtcgcggccctctgccccctcgccgccgcgcagcagcgcaacgtccagacccgcttcccctccacgcgcaccccggcagtcgccgccccgccgccgccgatcgtgcccccgtcgccgtcccccaccggcccggccatcctgcccccgcagtccgcctcctcgtcctcctcctcctccacgaagcgcagcgacatcgccgtggccgtggtgagcacggcgctgagcagcttcgcgctctgcggcctcgccttcttcctcttcctccgccacggcaagaagaaggagctgacgcacgtcggcggcaacggtcactccaaccggccccaggacgccgcgctcgccggcaagctgccggagagggcgccgaagcggccgccccgcggcggcatggtggacgagaacgggctcgacgcgatatactggcgggagttcgagaaggagggcgagggcggcggcaggggcaggaagcccgcggggggctggcgcccgccgcagccgccgccccggcagagccgcgcggagaggtggccggaggcgcaggcgtcgccggccccatccccgccgcggccgaggaagggcaagatagatcaggaaccgctcatacccaggggctccctggattcctcatccgccgtgttcgacgagtcgccgcgcccgcccagcgccagctccagctcgtccttctccgtcgctgcccccgaggcctacgcgcggccgccgccgccggcgatcgccgtcccccgcccgtccccgccaccagcccctgctgccccaccaagcgcgtcggcatcggcatcggcatccctggcgcggccgccaggaagaggaagcccgccaccgccgccaccaccaatggccaccacgtcgccaccgcctaaaggcccgccgccgccaccagcgccgaagggcccaccacccccgccagcacccaaaggcccacctcctccaccagcacccagaggcccgcctccgccaccgccacccggaggaaagaagggagggccgccgccaccaccacctcccggtggcaagaagggagggccgcccccgccgcctgcctgggcgtcgtcctcgaggccaccggcggccccgggcgggccgtccggcgcggacgacctggcgaagctgaagccgctgcattgggacaaggtcaacgtggcggccaccgaccactccatggtgtgggacaagctcaccggcggctcattcaacttggacgaaggcaccatcgaggcgctgttcggcaccgcggcggtgaaccgcaagacgaaatccgcggacgccaaggactcctcgagcggcctcgggcgctcgacctcggaggagcagatattcctgattgagccacgcaagtcgcacaacatctccatcatcctccggtccctcaccgtggggcgggacgagatcatcgacgcgctgcgtgatggcaacaccgagctcggcacggacgtcctcgagaagctgtcccggctcagcatctccaaggaggaagaggccaccatcctgaagttctctgggaaccccgacagacttgcccccgcagaggccttccttcttcgactcctgctcgacgtgcccaacccgtttgcccgtgtcaatgcgctgctattcaaggtgaactacggttctgagattgctgtgctcaagcaatcgctccagactttggagatggcgagccaggagctgaggacgaaggggctcttctttaaactgcttgaggcggtgctaaaggcgggcaaccggatgaatgccggcacggcgcgggggaacgcgcaggccttcaacctcacagcactgcgcaagctcaacgacgtgaagagcaccgatggaggcaccacactgctccactttgtcatcgaggaggttgtgcgcgcagaggggaaacgccttgccgtcaaccgcaactacaccatccgccgctctggtagcctcgccaagagcagcgtcgatggcggaatttcagcagctggctccgctggccaggggccatcacgcgaggacaggcagaatgagtacttgaacctaggattgcccattgttggaggtctcagcagtgagtttgccaatgtgaagaaggctgcaactgtggactacgatgtgactgccaatgaatgcacaatcttaggcaaccgactcgcgggcatcaagaagctcctggagacctgcggggacgatggattctcaagagggttgagaggctttgtcaatgctgcggagcaagagatgaaggcactgagtggagtgcaggagaaggtgcttgatctggttcagcggacgacggagtactaccatgcaggtgctaccaaggacaggaacgcgcatcccctccagttgttcgtcattgtgagggatttcctggggatggtggaccaggcatgtgtggacatcaagagaagactgcagcagcaaaagaagccaacacccccgtcatcacagccaacaacggcggcggctgctaaggggccagctgaagccgctaagggggcacctgatggtgctaaggcggtagctggtggcgcggcggcagcaccaccggctcaaaaaccaccaccagaagaagcagatagcaaaaggaagagggtcatgccaagattcccaaacttgccagcgcactttatgaaggacggcgcagactctgattcaagtagtgatgaggaatagaatgtatggggaggtgtaaatggagattgtttgcattggcttgaattggttgttttggaggtttaggttagctgcagactgtacataatgaaattgtttgtgttggttcttttc

SEQ ID NO: 45 - DNA, 1943 bp, Aegilops tauschii
ccctcccccggccgctacgtcgtacgtctcgcgcctcgcccatctccattaatcgccggaagcgctagcttctgaggttcttagacagacgatcgatcgagaggctggagagatcaattgggcgtttgggtgtacatgaacctgacgttgagtctaggcgtcaatggtggcgccgctgcggccaagaagcgcaaggtgatggacggcgtcggcgacgttggcgtcctcggcgccggtgacggcggtgaccgcgccactgtcatgaggctcctccaggccagagatcgcatggtgaaggttgagcttgatcacgacgacggggacgtgagtgaccgcggagcctcgccgctgatgcgcttgctcctctcgtcggcggccgccggggaggtcggcgacatgcacgcagcggccgtggccttgcaggaggtctaccggcacgcgtccttccgcggcggcgaccccgcccagcgggtcgcatcctacttcgcggacgcgctggcgtcgaggctcctgctgccgccgccggcgaaggcgaagacgacgacgacgactcgcgaagagcagttcctggcgttcaccatgttctaccaggcgtccccgttctaccagttcgcgcacttcacggcgaaccaggccatcgtggaggcgttcgaggccggcggccggcgccgcctccacgtcgtggacttcgacgtctcgttcggcttccagtggccgtccctgatgcagtccctttccgacgccgccaccacaagctcctctctatcctcccaggacgacagcggcgactgctgcgacgagccggtgtccctgcgcatcaccgggttcggcgcgagcgccgacaagctgcgggacacggaggcccgcctcgcccgcttcgcggacggctgccccaacctacggttcgagttcgagggcgtcgtcaacaacgtcaacaacgggccggaggagggccgccatgagcgcatcacgaccgaccccgccgcgacggtggtcgtcaacctggtgttcccggccgcacagaacgtgaggcagagctcatgggatccgcgcagcgcatcggctcacatccggtctctgaacccgtccttggtcttcctgatcgacaaggtcgacgaaggcaacggcggcgttaaaggcgccggaagatgcggaagcgcgagcctgctcccgcggttcgcggccaacctccggtactacgcggccgtgttcgagtccctgcacgagtgcctcccggccgacagcgctgagaggatcgccatcgagagggaccacctcggcgtggagatcagcgacgcaatggcctctctggaccgtcggcgccacgacggcgatcgcgcggcggacaaggtgagtcgcggttggaaggagaggctggagagcgcggggttcgaagacgcgaggctgagctcgaggacggtgagccaggcgaagctgctgctcaagatgaagagcggcgggtgcggcggcggcgggttccgcgtcatggaggccggcgacggcaaggccatggcgctggggtggcgagacagggccctcatcacggccagcgcgtggcggccgtgccggccatcggtcggcaagaacgagccctgaaacacgcgcccattcattcattcagtacatagatattgtgatagaccgtgtgctcatccgattcttcttggtttcttcttcattggttccttattggcagagagagagcttgattcttagtttcttttctcttgatttcttgagtgatatatacatgtatactcgtacaagtaaaaagaggttatatacagctgatatcatattcatacgtacgttcatatacacatgaatcattttatcctcacgtatgaataataattaactgcatcacgagcttttgcgcactaattaaccattggttttttagatgaattaaccatggttggtagtgatgagatttaatacgg

SEQ ID NO: 46 - DNA, 2192 bp, Aegilops tauschii
gtctcccacccgagcccgaaaagccacaaggcgctagctagcttaaccttaatatcggtggccattttttgttcgatttcactccatcggggttttagcaagagcagctagctagcttgatatcggtgcagcaatggacgccatggagagaggacagagctcgccgcggctgccaaagatccggggctcaaagatcgacgaggaaagcctcagggtgccgctgatagagagcaagaaggccggcagccgggcgccggcggtggtcctcgggttcgagtgcctcgagagcacggccttcaacggcgtcgccaccaacctggtgctgtacctggagagcgtcctgcacggcagcggcctcgccagcgcctccaacgtcaccacctggatcggcaccagcttcctcacgcccgtcctcggcgccatcctcgccgacaccttctggggcaactacaacaccatcctcgtctccctcgtcgtctaccttctgggtatgatgctcatcaccttctccgcgttactcccgaccaccgagctgtgcgggctgggctcgtcgtgccacccgatgttcggcgcgcacaccgtcgccttctccggcctctacctcgtggcgttcggcagcggcggcgtgcgggcggcgctgctgccgttcggcgcggagcagttcgacgacgacaacgccgtggaccgggagcggaagatggcattcttcagctggttctacatctgcgtcgacttcggcatgatcgtgtccgggctcttcctcgtgtggatccagcagaacgtcagctggggcctcggcttcggcatcgccacggcctgcatcgcgctcgccttcgtcggcttcgtgcttttcacgcccatgtacaagcgtagcatgccgaccggcagcccgttcaagagcctgtgccaggtcgtagtcgccgcgtgcaggaaggtcacactccgcgtccccgccgacgccgccgtcctctacgaggtcagcgacaagatcgaccagccaaggatcgcgcacaccaaagagttcacgttcctcgacaaggcggccgtggtcgcggactcggacctggaggaggtgacgaacgtcgacgccgcggcggcggccgcgggctcgtggaggctgtgcacggtgacgcaggtggaggagctcaagatcctgatgcggctgctaccgatctgggcgacgagcatcgtgctgtcggcggcgtacgcgcagctcaacaccacgttcgtgcagcagggcagcgccatggacatgcgggtcatgtcgttcaccatcccggccgcgtccatggtgtccttcgaggtgatctgcgtcctggcgtgggtgctcatctacggctcggtgatcgtgccggcgctcaggagactgtccccggcgagcggcgagccgtcgcagctgcggcggatgggcgccgggcggctgctcatggcgttcgcgatggccgtggcggcgctggtggagatgaggagactggaggccgccgggagcggggagtccatcagcatcgggtggcagatgccgcagtacttcgtgctggccggcggggaggtgttctgctacatcgcgcagctggagttcttctacagcgaggcgccggagtcgatgaagagcatgtgcacgtccttcgcgctgctcaccgtggcgctgggcagctacgcgagctcgctgatctacgccgtcgtgaacgcgctcacggccaccggcggccggcccgggtggatatcggacgacctcaacgaggggcacctcgactacttcttctggaccatggcggcgctgtgcacgctcaacttcgtcgtctacagcgccttcgccaggaactaccaggtgaagacggtcgtgtcgtgatcgtgatcgtgatcgttccttactcgtcggcgtacataaggagagcatcagatttcgcattgcaacgcgcagtgcggtggtaaaaaagatttgttttgttcttgttgcagaattcaaaaagttctttctttaggtagcagcacggttataaaagcatttagaactagtttggtatgatgcaaatacggcaacacgcaaaagcaattgggtttgtgatactgtgtagttgtcttcgttttgtttgtaagacgttttagcagttcaaattaaactgcaaaaacatctttattattgtttgcagttaaaattgaactgcaaaaatatattacattaatgcatagag

SEQ ID NO: 47 - DNA, 1333 bp, Aegilops tauschii
gcgacgcagcaaaggtgtctcccagctgcctaccacacgcactcgctacgagcagtcccatcactagccagccaaaacgtgaaccgctccggtcaacttcctcgtcgcaaccacacgatcgaccgcacctctcccatggcgtcctccttgccgccgcacgtcgtggaggacgtgcccccgttcctgcagctcctcagcgacggcacggtgatccgcttcactgacggctacccgctccccatcccgtcaccgccgcccggccagcccgtcgtcgactggaaggacgtcgtgtacgacgccagccacggcctcaagctccgcatctacaggccggcggcggcctcctcctccgggaacaagctcccggtgatcgtctacttccacggcggcgggtacagcatcggcagcttcgacatgcccaacttccacgcgtgctgcgtccgcctcgccggcgagctcccggctgtggtgctctctgcagactaccgcctcgcccccgagcaccggttccccgcgggcctcgacgacgcggcgaacgtcgtgtcctgggtgcgcgcccaggcggcggctgttggggacaacgccgacccatggctctgggagacggcggacttcggccgagtgttcgtcgccggggactcggccggcgggggcatcgtccaccacacggccgtccgcctcgggtcaggccggctaggccccctcgaccccgttcgcgtcgccgggtgcgcgatgctctgcccgatgttcggcggggaggagaggacggcgtcggaggcggagttcccgccgggcccgttcctgtcgctgccggcggtcgaccaggcgtggcgcctggtgctgccgcctgggtccacgagggaccacccgctggccaacccattcggcccggacagcccggcccttgacggcgtcgcgctgcctccgatgctcgtggtggccgccgcgcacgacctgctgcgcgatcgcgccgcggactatgccgcgaggctcaaggccatggggaagccggtggagctcgtggagttcgaggggcagcaccacgggttcttcgcggtcgagccgtacggcaacgccggcagcgaggtggtccggctcgtcaaacggtttgtctacggcaacggcggcgcctccgactaaattggagatcgagcaaagctgttcagtttgtatcgctgccttgtgaaggacgagtggagtaacattttgttttggacactcgtatgtcatactcctcaaaatacaaagatgccataaacttagacattattcatttttcccttctcaacatatgcatctgatttgaatgtatcgccaatttattaaggattcc

SEQ ID NO: 48 - DNA, 3308 bp, Aegilops tauschii
acccacgaatgcttcatacataagcgtccctaacttcgtgcggtgcttagacactttcttccttttccctctccccccaaaaaccttgttcctctgtttctctcaacaacagaaaacagcagcacccacctcagctattattctctcaatacctgctgcatacctatagccgcgttcttcaatacctaagaatcgacattctcttttaacgtcacctaccatggccgaagagaaggcagtcggcgcgcccgcgctcgacaccaacatcgagactggcggcttcgatgagaagcgaggacaagctcccgctacccacaaccctaaggctcccgtcgccgaggatgaggagcccgatgaggacatggatgccctgatcgaggacctcgagtccgaggacggccacgagatcgacgacgacgaggaggccacccccggcggtggacgtgtcgtccccgaggaccagctccagactgactctcgtgttggtttgactgaggctgaggttatcgcacgtcgcaagaaatggggtctcaacgccatgaaagaagagcaagagaacatgattctcaagttcctcatgttcttcgttggccctattcagttcgttatggaagctgccgctgttcttgctgctggtcttgaagactggattgatttcggtgtcatttgcgctcttctccttcttaacgcatgtgttggcttcattcaggagtaccaagctggttccattgtcgaggagctcaagaaaactcttgctctcaaggctgttgtcctccgtgatggcactctcaaggagatcgaggcccctgaagtcgttcctggtgacattttacaggtcgaagaaggcacgattatcccggctgatggccgtttcgtcactgagggctgcttctgccaggttgatcagtccgccatcactggagagtctctcgccgtcgacaagcaccatggtgacaactgttacgcttcttccgctgtcaagcgtggtgaggccttcgttatcgttactgccactggtgacaacaccttcgtcggtcgtgccgctgctctcgtctctcagtctgctggtggcactggtcacttcactgaggttctgaacggaattggaacaattttgctcgttctcgtcgtcgccaccctgctaattgtttgggtcagctctttctacagatccaatggcattgttgatatcctccgtttcacacttgctattactatcgtcggtgtccctgtcggtcttcccgctgtcgtcactaccactatggccgtcggtgccgcctacctcgccaagaagcaggccatcgtccagaagctttccgccattgagtcccttgctggtgttgagattctctgctctgacaagaccggtactctgactaagaacaagctctctctcgctgagcctttctgtgttgctggcgttgagcccgatgacctgatgcttactgcttgtttggctgcttcccgcaagaagaagggtattgatgccatcgacaaggctttcctcaaggctctcaagttctacccccgcgccaagggtgttctgtccaagtacaaggttctcgacttccacccctttgaccccgtctccaagaaggtccaggctgttgtcgagtcccctcaaggcgagcgtatcatctgtgtcaagggtgccccactttttgttctcaagaccgtcgaggaggaccaccccatccctgaggaagtcgattcggcgtacaaaaactgtgtggctgagtttgctacccgtggcttccgatctcttggtgttgctcgcaagcgaggtgagggtgcttgggagattctcggaatcatgccttgctctgaccctccccgtcacgatactgcccgcaccatcaacgaggccaagcgccttggtctctccatcaagatgcttactggtgatgccgtcggtattgctcgtgagacttctcgtcagctcggtctcggtaccaacgtttacaacgctgagcgtcttggccttggcggtggtggtgacatgcctggttctgaggtctacgatttcgtcgaggctgccgatggtttcgctgaggttttcccccagcacaagtacaacgttgtcgagatcctccagcagcgtggttaccttgttgccatgactggtgatggtgtcaacgatgctccctctctgaagaaggctgataccggtattgctgttgagggtgcttccgatgctgcccgctctgcttccgacattgttttccttgctcccggtcttggtgctatcattgatgctttgaaaacttcacgccaaattttccatcgtatgtacgcctacgttgtttaccgtattgcgctgtctctccacatggagatcttccttggtctctggatcgccatcctcaacaagagcttgaacattgagcttgtcgttttcattgctatcttcgccgatattgctactcttgccattgcttacgacaacgctcccttctcccagacacccgtcaagtggaacctccctaagctctggggtatgtccgtccttctcggtgttgtcctggctgttggtacctggattgctcttactaccatgtacgccaactctgaggatggtggtatcgtccagaacttcggtaagatcgacgaggttctcttccttgagatctctctcactgagaactggctcatcttcatcacccgtgccaacggccccttctggtcttccatcccctcttggcagctgtctggtgccattctgatcgtcgatatccttgccaccctcttctgtatcttcggttggttcgttggtggccagaccagcatcgtcgctgtcgtccgtatctggattttctctttcggtgtcttctgtgtcatgggtggtctctactacttcatgcagggcagcactggatttgacaacctgatgcacggcaagtcccctaagcagaaccagaagcagcgatcccttgaggatttcgttgtctctcttcagcgtgtctcgacccagcacgagaagtctcagtaaactagatggtatatacccggaccaccatcgcccggacttttcactttcgctctgtccaaatttgaactgtattactcgcacccgagtattaagactcctggagtggttgaggaaactttcatacccctagagaacgtctactagacacctaataatacaagtaaaataaataaatcgtcctccaaaacatagtgatctttcatttgaacctgtgtcttatctggtcttgttctttctgttcattttgatggtttatgttagttcctctacttgcacctgtgctcatttgattgctattttcctcaactcctcaactccg

SEQ ID NO: 49 - DNA, 1547 bp, Aegilops tauschii
ccctcgctatatccctcttccctcttcgtcttccgcctccgtactgtgactcgttgctccatttgggtcaaccggagctcttcagcgcctgggtagctgagcggataagctgcaccggccatgggaaacttttgtgtgtgcatgggcggctccgccaagtgcgccagcgcctccactcccttccaatcaaaggtgaacccgaggagcagcacctccaactccaactcgaaggcgtcgcgccggagcagctccggcccggacaagccgccgcagccggcggaggcgccgacggcggcgggggaggcgcaggcggtgccgccggcgtcgctcaagtcgttcagcatggcggacctgcgggcggccaccaagaacttcggctccacgtcctacctcggggagggcgggttcgggtgcgtctacaaggggtggatcgacgagaccacgctcgcccccgccaggcccggcgccaccaacgccatgatggtggccatcaagaagctcaagaaggagagcttccagggccacagggagtggctcaccgaggtcacctacctcggcgacctccaccacgacaacctcgtcaagctcgtcggctactgctccgactccgacagcaacaagctgctggtctacgagtacatgccccgcggcagcctcgagaaccacctgttccggcggggcagccagccgccgctgccgtggtccacgcgcgtgtccgtcgccgtcgacgtcgcccgcggcctcgccttcctccactcccgcgacgtcatcttccgggacctcaagtcctccaacgtgctcctcggccccgaccaccgcgccaagctctccgacttcggcctcgcccgggccggccccaccggcggcaagacccacgtctccacccgcgtcgtcggcacgcgcgggtacgccgcgccggagtacgtcgccacgggccacctctcggccaagagcgacgtctacggcttcggggtggtgctcctggagctcatgaccgggcggcgcgcgctcgacgaggcccgcggggtggcgtcggagctgctggtggactgggcgatgccgatgctgcagggggagcggcgcaaggtgatacgggtcatggacaccaggctcggcgggcagtaccccaagaggcaggcgcaggacatggccgcgctcgcgctccgctgcctccagaacgaccctaagagccgcccctccatggccgacgacgtcctaccctccctcgagctcctgctgcagccaagcgccgccaagtccttctcctcctcctcgacgacgacgacgtcgagatcgccggccgcgtcggcggcgctggtgcacagaggccaccgtcgaaacaaagcctagctagctagctaggagactcggttcatttaattactgtgttcaattagtgtgttcgtctgtgcagtagaatagaatttgtagattggaaattggacatcttttttctctctcgtttcagccgtttggaatattggaagcatgagcgtacgtacatttgggtacgggtcaagattttctttcctcccttctgttggaat

SEQ ID NO: 50 - DNA, 1375 bp, Aegilops tauschii
cccccctctccgcccccaaaaaatctcaacagcacctccctaatcgcctcctctcctccttccatccaggccaaaagccctttgcttttcgccttcccctcaccacttcctccgtgccggagttcgccggcggtggtgccttcgcccccgcctgccttgggttttagcgggattcttgaggggttttaggtaggccgcgtccggggcgcaggcaaatgcgagtggagttttagggtgagttttttcctttcctcgatgtggcccatggaggaggagtttttcgtggcggtgaagaggacggagcacgtcgaggtgacgtcccgttctgtggcggcgtcggccatggggaaggaggggtttggtggcggcgagcagcccaagatggtgcgggtgttctgcgacgacttcgacgccaccgattcctccagcgatgaggaggagggcgagcgccggcgcgtgaaacgctacgtccaggagatccggctgcagcccgctgtccaggtgaaggtggaggagtcggcgccggtggccaaggccgcgtcggcgacggcgacgacgaggcccagggtgatggttcccgtgcggaagaggaaggccgaggccggcggcgagcggcggttccgcggcgtgcggcgccgtccatggggcaagtatgccgcggagatccgcgacccgtggcgacgcgtccgcgtgtggctgggcaccttcgacaccgccgaggaggccgccaaggtctacgactcggccgccatcaagctgcgcggccccgacgccaccgtcaacttccagcagtccgaggacggggaggacatggaggtccccgccgaggtcgccgagcgccttccgcagccaccggcgggctccaagaacgcgtcctcctcggccacctcctacgactcgtgcgaggagtcccacgtcgcggccgcgtccccgacatccgtcctgcgctccttccctcagtccaccctgggcgccgccgtcgacgacgactcctccaagaagccgtcctcgtcttccagcaccgccgggaccgacgagtcgagcggcgtgttcggctgctcgttctccggcgacgacttcgccggcgagctggccccgctctacagcgacttcgacctcctctccgacttcgcggagccgcccatggacttcctgtccaacctcccggagccggccttcgcattctccagcgactgctcgtcgtcggcctacaacccgtgcccgccgtccccggcggcgttgcagcaggcggacgccttcttcgaggacataaccgacttgttccaaatcgatcccctccccgtcatctagcggaacaaatgtaaaacaccggattaggcgcctaattcggacaaattttgtttgcattcgttat

SEQ ID NO: 51 - DNA, 1095 bp, Setaria italica
cacaactccacaccgcaactccgcaagcaaccacccgcactccgatcccgccgagccaaagccccccgagctcacacagcaagaagcgagctccctcggctcggtcgccttcgccttcgtctcgccaggacccggcaagctagcgagcagtcgaggcgctctcggacgttaacgggcggcagaggtagagaagagagatggggcgcgctccgtgctgcgagaagatgggcctgaagagggggccctggacgccggaggaggacaggatcctggtggcgcacatcgagcgccacggccacagcaactggcgcgcgctgcccaagcaggcgggcctcctgcgctgcggcaagagctgccgcctccgatggatcaactacctccgcccggacatcaagcgcggcaacttcacccgggaggaggaggacgccatcatccacctccacaccgtgctcggcaacagatggtcggcaattgctgccaggctgccggggaggacggacaacgagatcaagaacgtctggcacacgtacctcaagaagcgcctcgagcccaagccagccacccagcaggcgcccaggcgcaagtccaagaagcagcagcagcagcagcctgcggagatcgtgatgctcgacggcccggccagcgccgtgccggtgtcgtcgccggagcagtcgctctccacgtccaccaccagcagcactgactactcggcggcctcgtcggtggagaacaacgcggacagcagcttcacctcggaggaggactaccagatcgaggacagcttctggtcggagacgctggcgatgacggtggacagctccgattctttcgggatggaaagggaggacgcctgcgttgaggcggcgccgtcggccaacgatgacatggacttctggctcaagctgttcatgcaggccagcgacatgcagaatctgtcccagatctaggcgtgcgggaggagctagatggtccctcgcctgacgatgatatatattctttgcctcacaattctttgaatctttgttctgctccgtttcggcgggtgtatatccgactgaaaacttgggaagcgaaaagaaattgcttgttcatggc

SEQ ID NO: 52 - DNA, 1496 bp, Setaria italica
gtcacccccgacgtgatcgatcgccacgacggtttccaacgcgatcacctacgtacttagctgctgcacgaccagacggccggccgtcacacaggaagaagacagcgtgcttttgagtatatggacgcggcggcggcggcggcggagatctaccggctgccggaggagtgcgtggcgtacgccatctcgctgacgacgcccggcgacgcgtgccactcgtccgcggtgtcgccggcgttccggaccgccgcggactccgacgccgtctgggcacggttcctgccgcccgaccacgccgccgtcctggcgcgcgccgacgagcccgtggagtgcgagtccaagaaggagctcttctcccgactctgcgacacccccgtcctcctcgacggcgccaccatgagctttgggctggagagacggagcggggcgaaatgcttcatgctctcggcgagggcgctcagcattgcctggggagacgatccgacttgctggatatggaccgctagccttccgggatccaggtttcctgaggtcgccgagctcgtcgacgtgtgctggctggagatcagcgggaagctcagcctctcgctgctctccccgggcacaacctacgccgcctacctcgtcttcgccatcgccgacgactcgtacggcctggagtgccacgtcggcatgctgccacccaaggccacagtcaccgtcgtctccgggaccagcggcaagccggcggcgacgtcgaccgagcacgccatctgcctgcagcacatgcagggggaggaggaggtcgccgtgcaccggcggaagcagcagtacatgcggctccgcaagggctacggccgcaagatggtgacgagggaggccgaccccgacatcaggtgcccgcgccggaggggcgacgggtgggtggaggtcgagctgggcgagttcgccgtggccaccggcgacggcgaggacggcggcgtggtggaggtgaggctcgaggaggtggatagccggaggtggaagaggggcctcatcgtgcaaggcatcgagatcaggcccaagcacgcttgctagctgccgccatatagccgaacgcctgcgttgattcttttttatcaacagttagccatcggattaatttttaatctaggaaaaaatcattaagaattaccgatgaattaggtccagagaggaacagctagccgacgaagctctcagcctgattcttttctggactgacgcaacttaaaaattcagctactggagaatggtcaattgcgtcagtgcttgcatgcggactagtacgtagtacgtgctgctgcagagcgctaatgtacttgatgcatggcccgcaagctgtttgctaaccacaacggcctgtatgtagatgatcgcatgaggagcctgctgtgtgcgtacgtggtcaagttggtgatccggggaccaaaatgagatagcaagtgtattatttcgatggaatgttaattccatatgatttaacgtgattgttcact

SEQ ID NO: 53 - DNA, 2509 bp, Setaria italica
cctctcatctttaggaggagatacagagagagataataatgtcggccttaacagcagctgctgcacccacggtcacgacgttcctccgagcacgcactgctaggacatgggttcaacctgccctgccccaacgctccccgcaccggccgtgtgagcgcattttggcaatagcaaatgggaaaggcacgggtgcagtgacgacttgcgaaccatctgaacgtctaaaggatgaaccaagaaatgtgtcagaaaaaattgatgccattagagcaaagcttaagtccataagtgatggcaatatcaatgtctcggcctacgacacggcgtgggtagctcttgtgaagaggctcgatggaggtggcggcccgcagttccccaccagtattgactggatcaccaaaaatcagctgccggatggctcatggggcgacgacactttcttcatggttcacgataggattatcaacaccctagcctgcattgtggcccttaaatcgtggaacattcaccattaccagtgccaaagaggtctgtcatttattcatggaaatctatggagattaactgaggaagatgcggaatggatgccagttggctttgagataaccttgccaacactactagagatggccaaggatcttggcctcgacttgccctatgatgagcccgcgctccaagaaatatattccagaagagagctaaagctatccaagattcctatagatgcacttcatgccgggccaacaactttgcttcttagcatagaaggaatgccaggtctagactgggaaaggcttttaacgctccagtgtcccgatggctcctttatgtcatcacctgcccccacagcttatgctcttatgcaaactggggacaggaagtgccttcaattccttgaagaaattgtcgataacttcaaggagggagtgccctttacatatcctgtcgatatctttgagcgcttatgggtggttgatcggttggagcgactaggcatttcgaggtacttcacaagtgaaatccaagagtgcttggattatgtctacaggcacttgactcaaaaaggcttggctgctacaagggattgtccggttaatgacatcgatgacacagccatgggttttcgtctactgcggttgcatggctactatgtctctccaagtatgttcaagcatttcgagaaggatggagagtttgtctgctaccacggacagacaaacaaatcaatcacggcgatgtacaacacataccgtgccgcacaggtctccttccccggcgagagcgagcttgagcgggccgacgtctactgccgcgggttcctggaagagaagcgagcctccggcaattttggcgacaaatgggtcatccccaaggacttagctggcgaggtcggctacgcactggacttcccctggagagcaagcctgccccggatcgaagcaaggatgtatctggagcagtacggtggcagtgccgatgtgtggatcgggaaggtcctctataggatgcccctagtcagtaacgaactgttcctcgagaccgcaagggaagattttcgcagtttccagaaactctgccgactcgaatggaatggcctcagaaagtggtatgacaggaacaagcttgcagcgttcggcgtggagccaaagtgcgtgttgagagcctacttccaagccgcagccagcatcttcgagcccgaccgagcagcggagcgtctcgcatgggcgcgcacggcggtgatcgccgaggctgtttctttgcacttgcgaggcaaagcttctgatgttagcacaagggttcacggcgcaattagtgagctcgagaaccatggccgtgatgcactaactagggtaaatgaggatccaaagaaagccctcctgggtgcaattggtgaacttatcgaccaatcttcgtctgagaatgcttctcactgtcttcgtgaagcttggaagcagtggcttaggtcatggaccgcaaaggagggatttgaatcatgtggagggaatacagcattgttgatagttcgtacagtagagattgcttccggaaggtatagtttgaaggagcatgatgtgaaccgttcggagtatacccaacttgagaggctcacgtcttccatctgcagcaaactgacttctagagttcctgttcagaatggaggattaaagaaatctgagaattcagtcagtcaagtggatttggagatgaaggagctggctcaatctgttcttcagagctgcgactctatcgacagggtgaccaggcagacatttctccatgtggcgaagagctactactatgcttcttattgctcaactgaaacaattgatagtcacatctccaaggtcctattcgaggatgtcgtttcggaatagcacccagttccagtaaatgaagatgtcatatgaatcctctgataaaaaatctcttgttcatttgaatactacaagacaagagacttatacttgtattacatacttgtaccgctacagccattactacgatgttt

SEQ ID NO: 54 - DNA, 1632 bp, Setaria italica
tacgcatggagtacccttctacagtattatgctgcaaagcggcgactgctgactcttaatacaaaagactgcgggaaatgcatctgctgatctgctgctatataaacgcacgacgcccgtggctttcagcaaagccacctgcgacagcaacatctactcaacaagctctctctccgtgtctccgtgttactgctggtagcaatagcaagtagtagcatagcagaaagccagcaaccatgggaagggctcccgctccggccaacgtccacgagatctgccgcgcacggcgtgccgacggccccgcggccgtgctcgccatcggcaccgccaacccgggcaactgcgtgctccaggaagacttccccgacttctacttccgcgccaccaagagcgagcacctcactggcctcaaagaaaagttcaagagagtttgccagaaactgggcgtgcagaggcgctacctgcaccacaccgaggagctcctgagcgcgcacccggagttcctcgaccacatcttctcgccgtccctcgacgagcggctggacatcgttaagaccgcggtgccggagctcgccgcggaggcctcccggaaggccatcgccgagtggggccgcccggccgccgacatcacgcacctcgtcgtcaccaccaactccggcgcgcacatcccgggcgtcgacttccagctggtcccgctcctgggcctccgcccgaccgtgcgccgcaccatgctctacctcaacggctgcttcgctggcgccgccgcgctgcgcgtcgccaaggacctcgccgagaacaaccgcggcgcgcgcgtgctcgtcgtctgcgccgagctcaccgtcctgatgttcaccaggcccgctgaggggcccttccagttccagacgctcatcaaccagggcctgttcggcgacggcgcgggggccgtcatcgtcggcgccgaccccgtggcgacccccgccgagcgaccgctgttcgagatcgtgtccgccgcgcagaacatcataccggagtccgaggacgccgtctccatgcacctcacgaaaggcggcttcggcggcaacatctccgccaggcaggtccccacgctcatcggggacaacatcgagcgctgcctcctggacgcgttcgagccgctcggcattggcgccggatggaacgacctgttctgggatgtgcacccgggctcgtcggcgatcctggaccagatcgacgccgtgctccagctcaagcccgagaagatggcggcgagcagacgcgtcctgagcgactacgggaacatgttcggcgtcacggtgatcttcgtgcttgacgagctgcggcgccggatggagaagggggaagaggagggggcgccggagtggggggtcatggtggcgttcggacccgggctcaccgttgaaacgatggtgctgcaccggtgcgtggcgcaggccacaggcgccacagcagaggagaaactgactgtggcttgagaacgtggcgcagtgaccaaagtatttgtgttgggtttggatcaggcttccatgcatgttgcttggtcaacatttcgttcctgccagtgtaaagtattgtgcaaataaagactttgcttgtgttgactgcttgtgtaataaattcagagctggacaa

SEQ ID NO: 55 - DNA, 2257 bp, Setaria italica
tcaccccgatcgatcgttctcttctcccgcccccgccaagtttgcgcgccactactctgcctgctgtgagagcgtacaggcgcggcgcggccctccctcctaaacctaccgctccgcctccgcaggtgcgaggtggttgacggccgcttacccgcaccgcgcgccgtgcgcgtgcgctacgcttggcgctcgaggtcaagccaaacgctgcccaccgcctctcagcctccctatatcctcgcgcgcacgtcttcgctcgtttctcactcgctccctcccttcggctcatcgtccatccatcagtgatcagcccctcacgtctcgatcaagaccaccaccggccgtgccgatggtgatgatgccggcgtcgccggcgtcgccgcgcgcccggcagtccgtggtggcggagctggagggcgggctgctccggtgcgcggacaccttcccctacttcatgctcgtggcgttcgaggcgtccggcctgccgcggttcgcggcgctgctggcgctgtggcccctgctgcggctgctggagctggccggccggggcggcctggcgctgcgcgccgcggcgctcgtggccaccgccggggtgccgcgggccgaggtggaggccgtgtcccgcggcgtgctgcccaagttcatggccgacgacgtcgaccccgccgcgtgggcggccttcgggtcctgcgagggcaggcgcgtcgtcgtcgccacgcggttgccccgcgtcatggtggagcggttcgccaaggagcacctcggcgcacacgaggtggtgggctgcgagctcgagtacagccgcctcaggcggtgcacggggctcctcaggggcggcggcgacgaggccgtcgcgggccgcgtccgcacgctgttcgccggcggcaaccggccggacctcggcatcggccggtcagagatggcgcgctccttcttgccattctgcaaggagcagctcaagccgccgttcgccgctgggggcgccgcgacgacggacgccccgccgttccggccggtcatcttccacgacggccgcctagtgtgccgtcccacgccgttcatgtccctcgtcatcctcctctggctgcccctcggcgcgctggtcgccttcgttcgcatcgccgtcggcctcatggtgcccatctggaccatcccccacatcgcgcccatcttcggcggcgccatcatcacgcacggccgcgcgcctgcccccgtccgcgccgcccgcgacgacgacggtggcggctcgccgtcgggcgtgctcttcgtgtgcacgcaccgcacgctcatggaccccgtggtccttgccaccgtgctcgggcgccgcgtggccgccgtgacctactccatctcccggctctcggaggtcctgtccccgatcccgactgtgcggctgacccgcgaccgggacgtggacgcggcgcggatgcgcgccgagctggcccggggcgacgtggccgtgtgccccgagggcaccacgtgccgggagcccttcctgctccgcttctcggcgctgttcgcggagctcagcgaccggatcgtgcccgtggcgatgaactaccgggtggggctcttccacccgacgacggcgcgcgggtggaaggccatggaccccatcttcttcttcatgaacccgaggcccgtgtacgaggtgacgttcctgaaccagctcccggcggaggcgacgtgcgcggcggggaagagccccgtggacgtggccaactacgtgcagcggatactcgccgccacgctggggttcgagtgcaccagcctcacgcgcaaggacaagtatagggtgctcgccggcaacgacggcatcgtcaacgccgccaagccggcggcgcccgggaaggcggcgtggcagggccggatcaaggaggtgctcgggttcctgctccactaaccacactagctgcagagagagacgccacggagctctggtcaaatctccgctcaccaatttgattgagttgtacttatacatgtacctagtcacgtaaagaatctactcatagtagaatacagttttagttttttcttacacaaaataatgtatttttcttttcattttactttaatctgtaaatggtttggcaaattttactggttgtaatcaaagatcagcgttgctccctcatcaaacagttacgttcctgcgtcatctacacaattggcactcttcatcttacccagggaggtttaatatatggtcatagtaggtattaattaggtgagcagatttttcctgccttcacga

SEQ ID NO: 56 - DNA, 1438 bp, Setaria italica
aagtggacctagcgagctcatctggctatagcagctagggaacatgagggacatgggggagaagaggagacatggaggacatcatgtccatggtgttgggtttggagttggacatgccgagcacgacgagaagcacagggagccgaagaagctggacatgagcggcatgtccatggacaccatcccgcatctcagcatgcctcttggcaacatcaccaccttggatctctccaacaacaacctacagaggattccggagtccataatcgcgaggcttctgaacgtggtggtgctggacgtgcggtccaaccagctcaagtcgctgcccaactccatcggctgcctctcaaagctcaaggtcctcaacgtctccggcaacctcctccaggacctgcccgccaccatcgaggagtgccgcgctctggaggagctcaacgccaacttcaaccagctgacgcggctgccggacacgctcgggttcgagctccacagcctccgccgcctctccgtcaactccaacaagctcgcctacctcccctcgtccaccgaccacatgacggcgctccggtcgctggacgcccgcctcaactgcctccgctccctccccgacgggctcgagaacctgggcagcctcgagaccctcaacgtgagccagaacttccagtacctgcgcgagctcccctacgggatcggcctccttgtctcgctccgggagctggatgtcagctacaactccatctccgcgctcccggactccatgggatgcctcaccaagctcgcccggttcagcgccgtcgggaacccgctggtgtgtccccccatggacgtcgtcgagcagagcctcgacgccatgcgcgcatacctcagcgcgcggatgaacgggacggacaaggacaggaggaagaagaggagctgggtgcccaagctcgtcaagtacggcaccttcacggcggggatgatgacgcccggccgcgccaccaaggtgcacggcaacgccgagggactcctcatgtcggattaccggtcgctcaacggcggcggcatcgcgtcgccggggttcctcagcatgctgtcgccccgccggatcttctcgccgcggaggaactcgaccaagcattaattagtaggcactaggcagtggtccagctagctgccttgctagtatacacgtgtgcagtgtgctcactccatatagcctgctttcttgcttgctgcttcgtgtgtagcgtgagctgatgctgttgctactgcagatgtatatgttttgaggagatacatatacataaagtgtgtatagtgttgttgttgtagtagtagtagtagtagtgtgggatagggcattgatgtacataagaatcaagggtgtccaattttcctatttcttgtaatttttttcggctacttgggcactaatgcttatgcaagcagtattttcgag

SEQ ID NO: 57 - DNA, 1067 bp, Setaria italica
ctctcgatcacttgcaaacattggcatagctagcatagacgaagccatggcttcccgtgccttcgctgcgctgctcaccgtggtagcatttgtaggctttgcttcagttccccgtgctctggcaactgatccgacccagctccaagacttctgcgttgctgataacaacaaccaagtgttggtgaatggggtggtgtgcaagaacgcaaaggtggtgacggcgaacgacttcttcttccacataatgccccagacccctaacgcgcagggatcgggggttgcggcggtggcggtggacaagctcccgggtctgaacacgctgggcatctcgctggcgcgcatcgacttcgtccccggcgggcagaacccgccgcacacgcacccgcggggttccgagatcctgaccgtgatccagggcaccctgctcgtggggttcgtgacctccaaccagctgctgaacaacacgctcttcaccaagcagctggtggagggggacgtgttcgtgttcccgcaggggctcatccacttccagctcaacaacggcaagagccccgccgtggcgatcgcggcgctgagcagccagaaccccgggaccatcaccatcgccaacgccgtgttcgggtccaagccgcccatctcggacttgatcctcgccaaggcgttcatgctcgagaaggacaccgtcgactgggtccagcaggcgttcggcgcggccgcggtcggcggcggcggcggcatgccgggcggcggcggatatcccggcggtggctaccccggcggcaacggaaccggcggcgggtaccccggcgggccagggtacccgtaaggccgacgagagcacgctgcatgagtgcagatgctgatcaggccggccgtcatacaagtataggccgaccacacacgtagtgtgtactaagctatagtatgtgcgcgcaatgcgcttgtgttgatcgaggagtagtagctctcgatctggttgaataatttgtggcgaaaccgcgccactgtaccacaaactttactgttgcattccctccatacgaaataaactaaaagtttcagtgtct

SEQ ID NO: 58 - DNA, 2394 bp, Setaria italica
gcgcacgcacaccagccacagcatgatcggatggagcatccgcagcagcacgtggtccaggtcgggcgtccgccctcgcgtggctcgtcttcagacgatgccgcacgcttggtcggcatgtgccctgctctctatcgcgctgccaaccgagggcgcacggaggaggtcatggcgctgcttctgcaacaacacgccgccggagctgcggccaaagatcgtcaagccactggcattattcagcatggacagtgtgacatactcgaagtgagcgcggagggtaacaccgttattcacgtggctgcagagcaagggcaccacgagttgatccaggagctctacgctaggttcaataacatcaagggcctcctctctcaccagaactcagcgctggacacgccgttgcactgcgcgtcgagggcggggcacgtcaggacagtggccatcctcatccagcttgcccaggactactgcggcgagagcatcctgggatgcaagaacaaggccggggacacggccctgcacatggcggcgaggcacggccatggcgcggcgacggaagtcctgatctcggtggcgcccgagctggcggccgaactgaacaacgccggcgtgtcgccgctgtacttggcggtaatgagcgggtcggtgcaagcccttagggccattatcgcgtgcagggacgcgtcggctgtcgggccgagcttgcagaagcagaacgctctgcacgctgccgtcttcaagagctcagtaatggttgacctgctcctggaatggagaccggctctggcggaacaagtcgacggcagcggcagcagcccgctccacttcgcgtcgtccgacggagacagcgacgtcgtgcgcgcgatcctgcgagcggcgccgccgagaacggtgtacaagaaggactccggtggcctctcggccctcttcgtcgcggctcggatgggccaccaccgcgtcgtcaatgagattctggagtggtgccccgacgccgcggagctccgcgacgacaatggcgggaccttcgtgcacgctgcggccaaggagaagagcgactcgttcgcaaaggagaagcaccgccactcggtcgtatctctcgcaatcgagaaccccatgctgcgcggcctcctggacgtgcaggacaaggacgggaacacgccgctccacctcgcggtggccgccggcgcgccgcgcgtcgtggatgaactgctacggaagggcaaggtgcacgccgatattctgaacaacgacgggcgcacggcattggacctcgccgccggatcgacaagcttcttcacgacggtaaaactggtggtgatgctggtcggattcggtgcacagctccggccgcaaaggcaggaccatctgaagctgtggagcggccacgacagcatagcgaaggatatagagagaacatcggacagcctcgcggtggtggccgtgctcatcgccaccgccgcgctcgccgcagggttcaacgtgcccggtgggtacggcgagaaaacgggcgaggcgaacctcgaggacagactcgtctttaagggcttcctggtcctggacatttccgcggtggcagcgtccgttgtcgcggtgatcctgctcgtctacgggaaggcgtcccgctccgctggctcgtggaagagcttcgccgcggcgctgcagtgcatgtgggcgtcgctcatctgcctcatgctggcgttctacgctgtgctggatgctgtgacgaccacgaaggcggtctatcgctacgggtttccggtgatcttcgcgtgcatcgttgtcttgagtatcttcatcatgtcgcggatcgaaccggtgaggacgtcgctcacggtctggagattcatgtgtcatcgtgcgaagtcgtcgcgccagacaggctggagattcatgtgccagcagcgttgtcacttgaaaggatggcatgctgtccagaggcagtttccgctcgccggtgcttacgtgctcaacttgtgtctgtttacagctacatatgttctaatagggattgtaggttttgtaggcatctcttggttagagcagctccagcgtatgttttaagagggtgctccaaataaagcatcagtatcactttttctaggcgccaaaccccggagggcacggtgtcaggaagcaccaacttagcagtggtgctagcttttgcagccggtgcttcaaataaaatagtatattttactcttgactactacattacatgcatgggaggaaaaagctgacagccagaattgtctataggataaaaggttgcttttgctttagggtctgtttggatacaccgtgttaaactttaacaggatattaaagtttaacaccctcaaatggagtgttaaaatacaacacattaaggtgtttggatgatctgttaaactttaa

SEQ ID NO: 59 - DNA, 1978 bp, Setaria italica
gcaagtatagcaacataattgctcattgttggctgctatggggaagatctccatggcggcatccatcctctggctggcccttgtcgccctggccgtcgtcggcgaggcggccatcgtcgagcacacctttgttgtgcatgagatgaacatgacccacctgtgcaactcgaccaaggtctacgtggtcaacggtcagctccccggcccacagctggacgtcgtcgacggcgacacggtggtcgtccacctcgtcaacgagctcccacacggcgtcaccatccactggcacggcgtccggcagctccggagctgctgggccgacggcgccggctacgtcaccgagtgccccgtcgcccccggcggcaaccgcacctaccgcttcgacgtctccggccaggtgggcacgctgtggtggcacgcccacgtgacctgcctccgcgccagcgtccatggcgccatcgtcgtccgccccaaggacggcaggtacccgttcccgaccccggcgagggacgtgcccatcgtcatcggcgagtggtggacgctagacctcgtcgagctcgaccgccggaatctcgacggcaacttcgaggacgacccgctgtcggcgaccctcaacgggaagctcggcgatctcagcaactgctccggcgtaccggaggagagcttcgtgctcgacgtcgagcccggcaagacctacctgcttcggttcatcaacacggcgctcttctccgagtacttcttcaaggtcgccggccacacgttcacggtggtcggcgccgacgccaactacctgacgccgttccggacggacatggtgaccatctcccctggcgagaccatggacgtgctcatggtcgccgacgcgccgccgggactctaccacatgaccgccgtcgccaaccagccgccaccgccggacctgcagatccgcgcgctgacctcccgcggcctggtgcgctacgccggcgtgcgcgccgacaacggcggcgcccccgtgccggcgcccctcatgcccggccagcacgacaccatgccgtcctactacttccgcggcaacttcacggggctcgcgttcccgtcgcgccaccgcgttccggcgcacgtcgacgagcgcctcttcgtcacgctagggctcggctccatctgccgcggcggcaagaaggactgcaagctccgccggagcaacgagaccatcacggtggcgaccatgaacaacgtctccttccaccaccagacggcggcgtcgctgctcgagcgccactacgacggcaccggcgagggcctgtacacggaggacttcccggaccggccgccgcggccgtacaactacaccaacatggacctgatcccggtcgggccgctggaggaggtgctcgagccgacgaccaaggcgatcagggtccggcggttcaagtacaactcgtcggtggagatcgtgttccagagcacggcgctgctgcagagcgaccccaaccccatgcacctccatggacacgacttcttcgtgctcgcgcaggggctcggcaacttcgaccccaagaaggacgtcaagaagttcaactaccacaacccgcagatcaggaacaccgtgcacgtgccaagggtaggctggaccgcaattcgcttcatcgcagacaatccagggatgtggtatttgcattgccactttgagttccacatcgtcatgggcatggcgacggcgttcatcgtggaggatgggccgacgcctgagacgagcctgccaccaccgccagcggacttcaagagatgcggcaccaatggtttcagtaagccttaggttataaatagagatggattggattattgggtccggaatttttatttttatttatttatttatcaaggtaacgaataaagatgaaggcagcattatcgtcctccatcgcgttattggttgtaattgatgtatttttttaatatttatttacgtgtgcatgttaatgcggagagttggcgc

SEQ ID NO: 60 - DNA, 2004 bp, Aegilops tauschii
gacagcaggaagtgggaccaagaagaaagcgggggcaacatggccggcggcgagggctccagcgcggcgggcgggacgggggagatgcggtcgctggcgctcacgcccacctggtccgtcgccaccgtgctcacgctcctcgtcgccgcctcgctcatcgtcgagcgctccatccaccgcctcagccactggctgaagaagactcaccggaacccgctccacaaggcaatggagaagatgaaagaagaaatgatgttgctcggcttcatatccctgcttttagcggcgacgtcgaggatgatctccggtatctgcatcgactccaagtactacaacagcaggttctccccgtgcaacaaagaagaggctgaggagtcattgagcaccgagcacgacctgactcgcaagcgcaaccacataatcgatgccatcctgcatcgttctctcaggaggaaccttaaggcgcagtcccatcaggtggagagctgccacgagggcttcgagtcgtttgtttcgcatgagggtctcgagcagctccaccgcttcatatttgtcatggcggtaacccatgtgacctacagttgcttgacgatgttgctagctatactcaaggtccatacatggagaaaatgggaagatgaagcatttagagataatcacgaatctttttcccagattgcgtatgcatcagcaactagaaggcaaccaccagcacttaccaaatcctcttcattcagattttggagtcaaaataatgcggtcatgtgggtgttttgcttccttgctcaatttggtcaatctgttgttcgagctgactaccttatccttcgcaagggctttataatgaaccacaatcttgcaccaacgtacgacttccacacttacatgatacgctcaatggaagaggagtttgagaagattgttggagtgagtggagtgctgtggggcttcgttgttgctttcatgctatttaatgttgatggatctaacctgtacttttggatagccatcctccctgttgctcttgttcttctagtcggtgcgaaactgcagcatataatagccattttaacatcagagggtgcaaagctgactgcatttggaccaaggataaagccacgcgatgatctcttttggttcaagaaaccaaagtttctcctgtggctgattcactttgttctcttccagaatgcattcgagctggcctctttcttctggttctggtggcaatttggttatgagtcatgcttcatcaaaaaccacctactggtttactgccgccttgtattggggtttgccggacagtttctctgcagttacagtacgttgcctgtttatgcgcttgtcacacagatgggatcaaagtacaaggctgccctgatccccaacaggatcagagaaaccatgcacgggtggggcaaggacacaaggaagaagaggaagaagcggcgcggcgacgattccaccattcgtacggagaccagcaccgtgtgctccctcgactacgaggacgaagacgacgacggccatggccattccgatgatgccatgacacccaggttgccgccatacctgaagatcgagctacggccaatgcagggcggcggtggcattcctacaccaggcatgccgagccaccagcttccgactggcggcagcaactggacccccggcggcagctcccagcacgctctgctccagcgacagggctcggcctcagcctccgcgccgtcgtcaccgccaccgagcagccatggccgcggcgtcgtaaggtcggtgtcgatgccggggatcgctgccgtggcaacgatagcctcgacgataggccttagcaccccgccgactcggctcagcgatgatgcccatgcataggaggacactggacttatttgtgttactataggatgatgatgacgatgactgatgagagataatgctaggatcatatcatagatgagagaaagatatagtacttcatattgtggtcatataagatggtgtata

SEQ ID NO: 61 - DNA, 1844 bp, Setaria italica
cacgaacgacagcgcagcgcactcgatcgagccgtccccgatggagaccatgttggcatccctcgtccccgcaagcggcacggcggcggcggcggcggctgccggagggctggtcgcggcggccgcgctcgtcgcggggggcggccgactggtggggcaaaaggaccgcctcaacgcgcccccagctgttcctggtttacctatcattgggaaccttcatcagctgaaagaaagaaagcctcatcagaccttcgcaagatgggcccaagtctacgggccaatatacactataagaacaggtgcttcttctgtggctgtcctcaattcaacagaagttgctaaagaggctatggttgcaaagttctcatcaatatctactcggaagctatctaatgcattgtcagtgctcacttgtgacaaaaagatagttgctacaagcgactatggcgacttccataaaatggtgaagcgctatgtaatggtgagcatgctgggcgcttctagccagaaacaatttcggggcataagggacatggtgattgataacatgctaagcactttccacacattggtgactgatgatcccaaagctgctctgaacttccgggaagttttcaagaatgagctgttccgcctatccttaattcaggctttaggtgaggatatgagctcggtctacgtagaagagtttgggaaaactatatcaaaggaggaaatctaccagaccactgtggttgacctgatgatgtgtgctcttgcggtcgattggagggatttcttcccatacctccgttggattccaaacaggaactttgaaacaaaagtgagtacaacagaagctaggcgaactgcagtgatacgagccttgatcaatcagcagaagaaaagaatcgcacgcggagaggctcgggtatcctatctggacttcctggtagcacagaatacactgactgatgagcaagtgacaacactggtctgggaggcagtcatagaagctgcagatactactcttgtcacaaccgaatgggccatgtatgagctctgcaagaaccaagaaaaacaggaacgtcttttcgaggaaattcaagaggtatgcggctatgagacagtcactgaggatgacctcccacggttgccttacttgaatgcggtgttccatgagacccttaggcgtcatcctccagtttcactagtgcctccacgatttgtccatgagaacaccaccttggctggctatgacattccagccggcacagagctgatcatcaacctctacggatgcaacatgaacaagaatgattgggacgagcccgaggaatggaagccagagcggtttctggatgggaggtttgagcaggcggacatgtttaagaccatggccttcggcgccgggaggagggcctgcgctggcgccacgcaggcgacgaacatcgcgtgcacggccatcgcgaggttcgtgcaggacttcgcctggaggctcaaggaaggcgacgaggacaaggacgacaccatccagcttacgaccaacaggctttacccgttgcacgtgtacctcacaccgagaggaaggaaataagcggctgtcactcctgggcaggttgcttgacggttctggtaattttgctgttgcgtgtgtgtggtgaaataaagttctgggatgaaaatctatagggttttcgtccgtggaaaaaatgtccaccaatgacagtatcatatagagcctggacataaacttgcagcatatatagtgaataggttaatatatagcatacaggttcacgttattgttaccctgatgtttacttgcttggttccatgaatgataatatgatatatgccgctac

SEQ ID NO: 62 - DNA, 1571 bp, Zea mays
aataaaatggagggtggaatgcgctagagcagagcaacccaccagcagcgagcagtctcctctcctgctgcaactgcagccatgccgtcgtccacgatgcgcctgctgtccaggcgcaccgtcacgcctccaccgcgcccacgccaccgcattccgctcaccacctgggacatctcctttctctccgccgactacatccagaagggcctcctctacgccaagccgccgtttcccaccgaccgcctcctcgaccacctccaggcctcgctcgcccaggcgctcgacgcctactaccccgtcgccggccgcttcgtcacggaccagcaccgcgacgccaacggtcacgtcctcggctgctcggtctccatcgactgtgacggccagggggtcgacatcctccacgccgtcgccgacggcgtcgccgtggccgacgtcatcccgcccgacgcacgtgtcccgcgcctcgtccagtcactcttcccgctcgacggcgccgtcaaccacgacggccaccacctcccactcttcgccgtccaggtcaccgacctccacgacggcgtcttcctcggcttcgcctacaaccacgcgctctccgacggcaccgcactatggagattcatcaacgtatgggcgggcatcgcgcgcgacagcccctccccatccccagctccgccgccgccgcccttgctggagcgctggtcgcccgacgccggcccaaccacaccgccggtcgtcctcccctaccccgacctcacggggctcatcgagaggctgcccccgccgccactatgcgagcgcatgctgcaattctcggccgaaaccctggaggcgctcaaggaccgggcgcggcaggagctcctggcggccggggatacggccggcgcggccgccgttaccaagttccaggcgctcagctcgcttgtgtggcgctccgtcacccgcgcgcgccgcatgccgctcggccaaacaaccttttgccgcgccgccatcaacaaccgcacgcgcctccgcccgcagcttccgccggagtacttcgggaacaccatctacgccatcgcaacggaggccgtcaccgcgggggatctgctggagcgcggccacggctgggccacggcggccgtcggccgcgcggtggcggcgcacacggacgacgccatccgggcgcgcgtggccgcgtggatggccaaccctgtcctgtacaacctcaggttctttgaccccaacggcatcatgatgggcagctcgccgcggttcgacatgtacggcggctgcgacttcggctgggggccgcccctggcgccgcgcagcggcagggccaacaagtccgacgggaaggcgtcgctgtaccccggccgggagggagccgaaagcatcgccgcggagcttgtgctgacgtcggagcacatgacgctgctggagcaagacgacgagttctgggcggccgtttcgcccgacaggccttttccgccggcagcgctagccgcccagccaaagtcagacagacactgacagccacagagcatacaataaatatatctcagatcatatgacttctaaatctttcttcttac

SEQ ID NO: 63 - DNA, 3401 bp, Zea mays
ctcgcccggccatggccgaggaccacgggtcgtcgcgccacatgtcggcgtcgcagaaggagctgggcgacgaggacgcccgcgtggtgcgcgtggccgacgccgcgcgcaccaacgagcgcctcgacctcgcgggcaacgccgtgcgcacagccaagtactcgccgctcaccttcctgccgcggaacctcttcgagcagttccaccgcctcgcctacgtctacttcctcgccatcgccgtgctcaaccagctgccccagctcgccgtcttcgggcggggcgcctccgtcatgccgctcgcctttgtcctcctcgtcaccgccgtcaaggacgcgtacgaggactggcgacgccaccgctccgaccgcgccgagaacggccgcctcgccgcggtcctctccccggccgcccccgggggcgcccagtttgtcccgaccgagtggaagcacgtccgagtcggcgacgtcgtgcgcgtcgtgtccgacgagtcgctcccggcggacatggtcctcctcgccaccagcgagcccactggcgtcgcctacgtgcagacgctgaaccttgacggcgagtccaacctcaagacccgctacgccaagcaagaaacgctgtccacgccgcccgagcgcctagccggtggtgccgtcatccgcagcgagcgcccaaaccgcaacatctacggcttccaggccaacctcgagctcgaaggggagagccgccggataccgctcggtccgtccaacatcgtgctgcgcggctgcgagctcaagaacacgccctgggccgtcggcgttgtggtgtacgcggggcgggagaccaaggccatgctcaacaacgccggcgcgcccaagaagcgcagccgcctggagacgcacatgaaccgcgagacgctcttcctctctgccatcctcgtcgtgctctgctcgatcgtcgccgcgctctccggcgtctggctgcgcactcacgaggaggagctcgagctggcgcagttcttccacaagaaggactacctgcaccgcgacaaggacaatgactacaagaactacaactactacggcatcgcggcccaaatcgtgttcatcttcctcatggcggtcatcgtgttccagatcatgatacccatctcgctctacatctccatggagctcgtcaggctggggcaggcctacttcatgatccgagacacgaggctgtacgacgagtcctccaattcgaggttccagtgccgggccctcaacatcaacgaggacctaggccagattaagtgcatattctccgacaagaccggcacgctcacgcagaataagatggagttccggtgcgcgagcattgacggagtcgattacagtgacatcgcccggcagcggcctcctgaaaagggcgatcggatttgggcgccaaaaatatcggtgaacaccgatccggagctggtgaagttgatcagggatgggggcgataccgagcgagggacgcagactcgggagttctttctcgccctggcatgttgcaacaccattgttcccatgatcgccgatggtccggaccctaaggagaaggtgatcgactaccaaggcgagtcaccggatgagcaggcattggtctctgccgctgcggcatatggctttgtgctagtcgaacgaacatcgggccacattgtgatcgacgtccttggtgagaagctcagatatgatgtccttggtcttcatgagtttgacagcgatcgcaagaggatgtctgtcataattggctgccctgataagtctgtcaagctgtttgtaaaaggcgctgacagttcgatgtttggagtcattgacaaaactgcgaattcagatgttgtccaagcaacagagaagcatctccattcatattcatcattaggtctgcgaacacttgtcattggtatgcgggagcttagccaagaagagtttcaggagtggcaaatggcttatgaaaaggctagcacggcactactaggaagaggaaaccaactccgcaacgtggctgccaacatcgagaggaacttgcgtctattgggtgccactggaattgatgacaagctgcaggatggagtacccgaagcaattgagaaactgagggaagcagggattaaggtttgggtgctaacaggtgacaagcaagaaactgccatctccatcggctattcctgcaagcttttgacaagggacatgacacagattgtaattaacagtcgctcaagagaatcatgcaggaagagtctagaagatgcaatcgccatggttaacaaataccaatcgttctcgacagacccccaacttagggtgccccttgctttgattattgatggtaacagccttgtctacattttcgatacggattgggaggagaagctttttgaaatcgctatagcctgcgatgtcgtcttatgctgtcgggtagctccccttcagaaggctggtattgttgatctcattaagaagcgaacaagtgacatgactttagctattggagatggtgcaaatgatgtatccatgattcaaatggctgacgttggcatcggcatcagtgggcaagagggaaggcaagctgttatggcctcagattttgccatgggtcaattcagatttttggttcctctgttgttggttcatggccattggaactaccagaggatggcctacatgatcctgtataacttctacagaaatgctacttttgtctttgtgctattctggtatgtactttacactggtttcaccctaacaacagcgataactgagtggagcagcgtgctatactctgtgatatatactgctgtccctactattgtcgtcgccattctcgacaaggatctcagccggcggacattgctgaagtatccccaactctatggcccagggcagcgtgatgagaactacaacctgaggctattcatattcatcatgatagactccgtctggcagagccttgcatgtttcttcatcccctaccttgcatacaggaagagtataattgatggttccagccttggagacctatggacactatccgttgttattcttgtcaacattcacctggcaatggatgtcatcagatggaactggattacgcatgcggcaatatggggtagcattgctgcgacatggatttgtgtcatgatcatagattccataccaatcatgcctggtttttgggcaatctacaaagtgatgggaactgggctgttctgggcactgctgcttgcggtaactgttgttgggatgattcctcattttgccgcaaaggccttcagtgagtatttcatccccagtgacattcagattgcaagagaaatggagaagtcgcaagatttccatgatgtaactcatccagaagttcaaatgagtacagtgagtagagcttagggtagggggttacactga

SEQ ID NO: 64 - DNA, 1971 bp, Triticum aestivum
cgccagcagcaacaaaccaacccaacccaatccctgccggccaaactccaaacttccaaagccatgggcacctacaagtgctgcctcgtcttcaagcgccggtaccgctggacggacgcgccgccgccggacgacgtgcgggcgctcttcgccgtgcactccggcggggcagccaccatgggcgccgacggcctgcgccgctacctcgagtcctccgaccccgacgccgccgacgacgccgagggcgaggcggaccgcctgctggaccagatccgcctgcagggacaccagcaccagcgcgccggcccgcgcctcccgcgcctcggccgcggccagctgctcggcctcgacgacttccaccgcttcctcttctccgccgacctcaacccgcccgtccgccggccccaggtccaccacgacatgtcccagcccctctcccactactacgtctacacgggccacaactcgtacctcaccggcaaccagctcagcagcgactgcagcgacgtccccatcatcaaggccctgcagcgcggcgtccgggtcatcgagctcgacatgtggcccaactccgccaaggacgacatcagcatcctccatggcaggactttgaccaccccggtttcgctgctgaaatgcttgaaatccatcaaagaatatgctttcgccgcgtctccctacccggttatcatcacactcgaagaccaccttacacccgagctgcaggacaaagttgccaagatggtccttgaagtgtttggcaccatactgtactaccctgaagaagaacatcccaaagagctcccttcacctgagtccctcaagggtcgcgtgctcctatcaacaaagcccccaaaggagtaccttgaagccaaggatggtggtgccgcgaaagacggtgatgcggagcagaatcctggcaaaggaactgacgatgatgcggcttggggaacagaagtcccagatttcaagactgaaatccaatctgctaaagaagatgatgcctcagagaaccgtagagacggcgatgaggacgacgacgatgaggacgaacagaaaatgcaacagcatctagctccacagtataagcgccttattactataagagcaggaaagccaaaggggggtactacgtctgatgccttgaagtgtgacccgaacaaagttaggcggctcagtttgagcgagcaacagcttgccaaagctgtagttaatcatggcaccgaaatagtgaggtttacacagaggaatctactgaggatatacccaaagggcactcgggttacttcatccaactacaatccatttattggttgggtgcatggtgctcagatggtagccttcaatatgcagggatatggaagagctctttggttaatgcatggattttataaagccaatggtggctgtggctacgtgaagaaaccggatttcttgatgcagtccgagccggaagttttcgatccaaaaaagcctcagcctgttaagaaaaccttgaaggtgaaagtgtacatgggagatggttggcggatggacttcaagcagactcactttgaccaatattctcctccagatttttacgcacgggtcgggatcgccggcgtcccggcggactcggtgatgaagaagaccaaggcggtggaggacaactgggtgccggtgtggggggaggagttctcgttcgacctgacggtgccggagctggcgctgctgcgggtggaggcgcacgagtacgacatgtcggagaaggacgactttgcggggcagacggtgctgccggtgtcggagcttcagcccgggatccgcgcggtggcgctgttcgaccgcaaggggaacaagctccccaacgtcaagctcctcatgcgctttgagtttgtgtgatttggaatggtttggtttggtttgagagatgatggcgtgtcggcggccattgttggtacttggtgctcgtgcattctttgttcatcctgt

SEQ ID NO: 65 - DNA, 1113 bp, Triticum aestivum
cgtgacatgacgacgagccaggacgtggttgtttcggagatgggcattgggccgggtggggcggccatgccgggctccggcgccgcgggcctcttcgcgtgccgcagcgccgccagcgccggagccatgtccatggggcagacgtaccgcgacctcgccgccgccgcctcgcgctccgcgaactgcacatgggccgagctcgaggccatgcgcgccgcctcgcccacccgctcccggcccggcaccgacgtcgacgagctcacggcctggatgaggaagcacccgtcggcgctaggcaagttcgagcaaatcgccagcgcgtccaaggggaagaagatcgtcatgttcctggactacgacggcaccctctcgcccatcgtcgccaaccccgacgccgcctacatgagcgacgcgatgagggaggcggtgcgcgacgttgccaagcacttcccgacggcgatcgtgagcgggcggtgccgcgacaaggtgcacaacttcgtcggcctctccgagctgtactacgccggcagccacggcgtggacatcaaggggccaggctccaatccggagtctgtgctgtgccaacctgcaagcgagttcctccccatgatcgatgaggtgtacaaggtgcttgtggaaaagacgaagtccacacctggagccaaggtggagaacaacaagttctgcctgtccgtccacttcagatgtgtggatgaaaagagatggaacttcttggctgagcaggtcaaggccgtgatcaaggactaccccatgctgaagctcacccaagggaggaaggtcttcgagctccggcccagcattatgtgggacaagggcaaggcgctggagttcttgcttgaatcgctaggattcgccagctgcagcgacgtcctgccggtgtacatcggcgacgaccgcaccgacgaggacgccttcaaggtgctgaggaagaggggccagggcgtggggatcctggtgtccaagtgcgccaaggagaccagcgcgtcctactcgctgcaggacccggcggaggtcatggagttcctgctccggctggtggactggaagcggaggtcgtcggcgccgcccatggtccggccgcgggtgtaatag

SEQ ID NO: 66 - DNA, 428 bp, Zea mays
cgcatatggccatggaagttcagggcaccaggcggccgcaggatgccggcgtgaaggtcaagttcatcgagacgcagttcattagctccgacgccgccagcttcaaggccgtcgtgcagcgcctcaccggcaagtccccagccgcctcgtcgcagacgactcagccgccggcgcatcctcagccacaaagcctgcgcccgtgccggccgaccttcattggcgctgggcagcagcagaccactggatggacagatctacaggctgccggcggctacctggcgacgatgccggcgccgaagcaagagcacctcgcggcggcgcctcggctggaggacatgaacgagctctgcgactttgcagacctgttctacaccaccgccgcgagcaatcggcccgacggcggcgccagcgtctttccttactgataa

SEQ ID NO: 67 - DNA, 1070 bp, Triticum aestivum
aattaatgggttctatctccgacgacgaggcggcttgcatctacgcgatgcagctggcagcggcagctgtcttgccgatgacgctcaagaacgccatcgagctgggcatgatcgagatcctcgttggcgctggcgggaagatgctttcgccgtctgaggtggccgcccagctgccgtcgacggccaacgcggaagcaccggccatcgtcgaccgcatgctgcggctgctggcatcgcacaacgttgtgtcgtgcgaggtggaggaaggtaaggacggccgcctcgcacgccggtacggcaccgcgccggtgtgcaagtggctcagccccgacgaggacggcgtgtccttggccccgatggtcctcttgaacgacaaggtcatgctggagagctggtaccatttgaaggacactgtccttaacggtggcctgccattcgaaaaagcgtacggaatgacagcgtttgattaccaaggaacggacccgcgctttaatcgcgtcttcaatgaggccatgaagacccactccatgatcatcaccaagaagctcctggagttctacaagggcttcgatggtgtgggcaccctcgtggacgtcggtggcggtgtgggcgccaccatccacaccatcctttgcaggtacccaagcatcgagggggtcaacttcgacctccctcacgtcatctccgaggcaccatcctttgcaggtgtgcaccacataggtggtgacatgttcaagaaggttccctctggggacgcaatcctcatgaagtggatactccacgactggaacgatgagcattgcacaacgctgctgagcaactgctacgatgcactacccgcgcatggcaaggtggtcatagtggaatacatcctgccagtgaagcccgacgaaacggccacagcacagaggtccttcgaagccgacatgattatgctcacacacacacccggcggcaaggagaggtacctgagggagtacgaagagctcgccaggagcgccgggtttgccagcgtcaaggccacctacgtctacagcaacatatgggtcattgagttgaacaaatagtag

SEQ ID NO: 68 - DNA, 1588 bp, Aegilops tauschii
acacacagttgaagagatgtttccagtgacgggttcaccgaaatgcgttgctttccgatcaaagcatacccgcaagtaccttggtagcgtgcatgtagggagcgaggagagcgccgtcggcggaggcaggttcttcgaggagctgagcgacggcgccgacgacgtcgatgtccttgcaagcccgtacaccagattctacctggagccctccagggagcacgacgggctactccacgtcaggtgctgccacaacaacaagtactgggtggccaaacatggcggtgaaggcagcggccactggatcattggcatcgtcaatgaaccgaacgacgacctgtccaagccgtcatgcacgctttttgagcccgtccctctcacggacggggacaataatctatccatcaggttcttccgtccccagcaaacaaccagctctgaatctgagatggtcatggaaaaggagacagcagaagaagcctacttgcgtctgggaaccggagggcatgaaaaaacagttgatcaagtgaaatctctttatgacttctccgccattgatctgtcgaagcaattggtactgcccaaatatgttgcttttaaaggcgacaatgacatgtacctccgggcgaggatcatccagaaatacaattacctggaattctcatcatctgatattgcagattcaactgtggtcaacactattttccccaactatgctaatggaaacgtgcgcataaaatctaaccacttcaacaggttttggaggctcagccccaactggatctgggctgactccgccgacagcagcaacagggaccgtgacacactcttcagggtggtcatgttgcctgactacatcggtctccagaacctgggaaactccaggtactgcaagaggctaactgccgacagaaagacaagctgccttaacgccgccgtcgataccatcacactggaagcaaggttacgggtggaagaagccgtactttcacgagagatctatggcgtggagttcaagctctccgaagctaggatctacggagagaagcctattacctttcccagcatgacttcaaccaatgacaccaacgaaccacatgccaagaccctgaccctgaaatacgaggagacgcaggccaagacctggagctcgactgttagcctcaagatcggtgtcacggccaagttaagagctgggatcccagtcatagcagaagggaaggttgaggtatccactgaattcaactcagaatacgagtgggggtcatccattcatacaacggcctcacaagaggcctcctaccaggctgtggtgcctccgatgaccaaggtgacagtcagagcggctgtgacacagggttctgtagacgtcccgttctcctacactcagagggacattctgaccacaggagaggttgttacctacaagatggatgatggtctgttcactggtatgaacaactataatttccaatttgaagccacacaagagcccatttgaagtgacgatgcatgctttagttagccgtattaaataaagccatcactgccttagagtggcccggcttttctgtgtggtgatttgatggtg

SEQ ID NO: 69 - DNA, 1267 bp, Aegilops tauschii
actccacagcaggttcatctccaccccgtcagtcagtcaggcggcagcaatggcggaagaggggaacagcgcgggcagcggcgggcgcggcgtccgggtgtgcgtcaccggcggcgccgggttcatcggctcctggctcgtcaggaagctgctccaggccgggtacaccgtccacgccaccctgcggagcatcggggacgaggggaaagtggggctgctgcggcggctcgtccccggcgccgcgccgccggagcggctggtgctgttcgaggccgacctcttcgacgccgccagcttcgcgccggctatcgccggctgccagttcgtcttcctcgtcgccaacccctccgcgcacgaggccgccgcctccaagtacaagacatcggcggaagccgccacggatggggtgcgcatcatcctccggctatgcgcggaatctatgacggtgaagcgcgtcatccacaccgcatcggtgacggccgcttcgccgctgacaaagtcctccagcgccgcggccgctgtgtacagcgatttcatctctgaatcttgttggactctgttggatgtcgattaccctctccggagcgtgcacttcgataagtacatagagtccaaggtcctgtcagagaaggagctcctcagctacaacgacggcgagagcccggcgttcgaggtggtcaccctgtcgttgggccttgtcgggggcgacacagtgctcagccacctcccagagacggtggagagcatggtggccccggtgacaaagcaagagccctacttcatgctgccgaggatcctgcagaggttgctgggctcgctgccgctggtgcacgtcgacgacgtgtgctccgcgctcatcttctgcatcgagcagcctgccctctcaggtcggttcctctgtgccgctgcctacccgacaatccacgacatcctggaccactacagcagcaagtacccccatctggatctcctcagagaggctgatgaggtagcgagggtgcaacccgagaagaacaagcttgtggagctgggcttcaggtacaagtatggggtggaggagatactagacgaaagcattgactgtgctgtgaggctgggctccctggatgcatccaagctcatcgtccagcaggagtgatgaactcaatgatgtcgagggcaagtgatcacagtatcctctttacttgttcagcatttacagtaacacatgtattaaaagaagaacaacggtacataaataacagagctgctttgttatttactggca

SEQ ID NO: 70 - DNA, 1342 bp, Aegilops tauschii
tcgacgggcatggacatggacatggaggggggctcgcagccgcagccgcagggcgcctcgctctcgccggcgccgttcctgatcaagacctacgagatggtggaggacccggcgaccagccgcgtggtgtcgtggggccccggcggcgccagcttcgtggtgtggaacccgcccgacttctcccgggacctgctgcccaagtacttcaagcacaacaacttctccagcttcatcaggcagctcaacacctacggttttcggaagatcgacccggagcgatgggagttcgccaacgacgacttcgtcagggggcacatgcacctcctcaagaacatccaccggcgcaagccggtgcacagccactcgccgcagaaccaggtgaacgggccgctggcggaggccgagaggcgcgagtacgaggaggagatcagcaggctcaagcacgagaacagcgtgctcgtggcagagctccagagacaggcgcagcagcagtgcgggctcggctggctgatgcagtcgctggaggaccggctgatggcgatggagcggcggcaggcggacgtcgtggcctccgtgcgcgacaccctgcagaggagacgcggcggcgttcatccagggccggaggccatgcttgaactggagccgaccgaccatttcagcaagaagaggagggttccgacgatcggtttcttcgccaaggagcccgccgcggcggccgaggagcagcgggtgccgcatctgcgggcgacgggtggtgagacgccgggcatggtcatggtgaacgccgagccctttgagaagatggagctggccctggtctccatggagaagctcgtgcagagggcgggcgactatgcgtcctctgaagacatgtacaacgccgccgccgctgcacccagcaccgatgatccggctcacgcagatctgcaggcagcaccagtaaatcttcagccgtcttcaccggagatagcagagtctccgggttacgctgtccagagtccaatgctactattcccagaaattcacgaggacaagcacaagacgacggccgaagtcgatatgagctccgaggccagcaccacagacgcttcgcaggacgagacgaacgccgaggccgagaccggagctccccatgaaccggccgtggcgaacgatctgttctgggagcggtttctcacggacacgccgaagccgctagccgtcgaggatagccatgaatccaaggacgatgtgaagaccggcctagactgctactggttcggccaccggaacaatgttgatcagatcaccgagcagatggggcacctcgcttctgctcagaagacctgatggctggctttag

SEQ ID NO: 71 - DNA, 1433 bp, Aegilops tauschii
ctaaaatggagaccatgtcatatccttgttcccctcttctctccctccccacacacgaagagagtaactttttcatgtggtctcctcaagtagctctccacgagaatgccaccatccatgttgatcatcccactgatcagcaacctgataatgtgttcttggacactgcagttcaagattatgctaatgattggcatcaacaagatgcttctgatgttggtgtgttcacctattgtgatgagaggattcagggccaagagagtggtaacttggtcgcgatccaggaagagctcatggaggagaacagtgtaactgatctcctcctcactggtgcagaggcggtcgaggcgggggatccaagatttgccttggcagtgttctcgaggcttgatggcctcctccttggcagccctgaaaatgcagcagccggctcttttgatcgcctggcctaccactttgcccaaggtctgcggtcccggatctccagtgcaagcaccagttgctctctgccggagccactgccgtctgatagaatgtcggtgcaacatattatacaagagctgtcgccgtttgccaagtttgcgcacttcactgccaaccaggccattctagacgccaccaagggcgatacacatgtgcacatcgtcgacctgaacattggtgagggcatccagtggccatcgctcatgtcagatcttgcccgtcatggtggcatgtcattccacctcacggcggtcacagcagacgccgactacagcgacggcgttcaccatgcatctgcgctgcggctctcggagttcgcggactccttgaaccttcctttccagtacagctctctctgtttacacagtgatgaagacctgcatgaattctccaagaactgtaaaggctcggtgatcctctcatgtgacacaacaagcatgccttacaagttgctgagcaagttaccggcactcctacctgcctgtgttaaactgttacagccaaagttaatggtcatcgtagaagaggagctggttagagtcggaaaggaggcgtctctatgtaaggcctcctttgtcgacttcttcttcgaggcattgcaccactttaccacggtgttcgagtcactggcgagctgcttctttggtggtaaccagggggcgtgcctgagacttgtggagagggagatggtggggccaaggatacaggactttgtggggcagtatgggtctgtgacagttgaggtcactactcctgtggttttggaaaggtatggggcttgtgacctgagtggctgcaatgttgctcaagccaggatgctggttgggttgttcaatagggggtttgaggttgtgcatgagaagggtaggcttgtgttgtgctggaagtccaggccactgacctctgtgtctgtttgggctccaatcttaaaagaaaggagctcatgatag

SEQ ID NO: 72 - DNA, 1563 bp, Aegilops tauschii
aactacacccagctgcaaggtgcaagcaagctagctagctcgacagttagcaatggaggttaaggtgttgggctccaagctcgtcaagcccgcctacaatgccggcgccgcgccggcaccttccaccgagtacatccctctgtccatcttcgacaaggtgacgttcaacatgcagatggccatcatctacgccttcgccgcgccggcgccatccacagccgccatcgagaatggcctcgccacggtcctcgcccagtaccgagccttcgcgggccagctcggcgaggcgcccgacggcacgccgtccttcatcctcaacgaccgtggcgcgcgcctggttgaggcgaccgtagacgccgtgctcatcgacatggcgccagcgaaacccacgccggagctgctcaagctgcaccccgacctggaggcggagcacgaggaggttgtgctgctgcagctcacgcggttccggtgcggctccctcgccgtggggttcacgtccaaccacgtcgtcgccgacggccacgccaccagcaacttcctcatcgcctgggggcgcgccacgagaggcctccccatcggcctccctcccgtgcaccaccacaaggacctcttcaagccacggtcgtcgcctcgcgtggagcacgaccaccgcaacagggagtactacctgccgtcgcccaccgacgtcgtcggtcaccacggcgatgccgccgacaacatcgtcatccataaggcgcacttctccaaggacttcatcgccggtctccgagccaaggcgtcagaagggcgcggccggccgttcagccggttcgagaccatcctcgcccacctctggcgcaccatgacgcgcgcgcgcgacctgagccccgaggagaccaccaagatccggctgtccgtggacgggcgacaccggctcggccagccggcggagtacttcggcaacatggtgctttgggcattcccgcgctccaccgtgggtgacctcctgaaccggccgctgaagcacgcggctcaggtgatccatgacgaggtggcgaaggtggatggtgcatacttccagtcgttcgtagacttcgcaagctccggcgccgccgagaaggaggggctggctcggagcgccgtgtgcaaggacgcgcagtgcccggacgtggaggtggacagctggctgacgttcccgttctacgagctggacttcggcacggggagcccaagctacttcatgccggcctacttccccacggaggggatgcttttcctcgtgccgtccaacttcggcgacggcagcgtcgatgccttcgtacccctattccaagagaacctccaggcgttcaaagaatgctgctattccatggagtaggtggcctaactgttaatttgtcgaagaaacagtgaggcatacattagttcattcattgagagggtggcagaaaaaaataatgtcttttcttttttctctttgagaattgaatagtgctactgtgtgtacacagatgtcatcttgtataagtacgtaacacgagttttcagataaaataaatttactagcgaaaggacccgtgtgtt

SEQ ID NO: 73 - DNA, 819 bp, Aegilops tauschii
tcgcctatataacacaccaacgttgcgttaccacaagaatggaacagcttaggatatctctaatcaacaacacgatggcgtcatcttctccgtcttccaccgtgatccagatgcctccaagtccacacaacaacggcgggatagccggcccggtcccggccacgcccaaggacgctggcgacgtcccaaccttggcgcctacagcagccacggcgacggacaaggtcatgtcgagcgcagcaaaccttgcgcagctgctgccgacgggcacggtgctggcgtaccaggcgttgtccccgtccttcaccaaccacggcaagtgcttctcctccaaccagtggctcaccgcggcgctggtcatcgtcctcaccatctcgtgcgtcctcttctccttcaccgacagcgttctcggccgcgaccagaagctctactacggcatcgccacgccgcgcggtttcaacgtattcaacttctcagacgaagaggagaagctgcagtggactcccgccgagttccggaggctccgcatccggccactcgacttcatgcgcgccgtcttcacggccctggtgttcctcaccgtggctttcagcgacgtggggctgcagaattgcttcttccctggcgctggcaggaacaccgaggagctgctgaagaacctgccattgggcatcgcgtttctgtccagttttgtgttcatgatcttccccacaaagaggaagggcatcggctacagcgacaccactcctcgcgaaaagctcacttgatgttaatatcagttgtttctgaacagttagatggattttagattataacgta

SEQ ID NO: 74 - DNA, 515 bp, Aegilops tauschii
agcagaggcatctatgcgaaacagattaagtactgcatataaatcattggaagtagctagccatgaagagcagcgcgctgatggtgatcatggtcctccaggccgctctggtcatggggatcttcatcctcccggacatgtgcaacggagatgtgcatgcaacgtccgtgggtgagggcaaggcgatcgacgtcaacccgggcaagctaaggtgctgcagtaactgcaactcctccttctcaggcctctacacatgcgacgacgtcgtgaagatatgcgaccctgtctgcaagcgatgcgccgtcgtgaagaagatccttgtcaaggagtttaggtgcaccgacaccttcctcggtgtgtgcgaaaatccgtgcaagaaccactgaagatgaaagtagctaataagcggcaagctagctgctactgtgatttgatatgtgctacggtgcacagtagacatgtatgcaaggattggaactggatgattttcgatccatgttatacgcggaacagta

SEQ ID NO: 75 - DNA, 1613 bp, Aegilops tauschii
ctgcttggaaggttcaaatctcccagcactacttggtcttgaaggaaagtgagaggcgaaagcagaggagtgactttgcccgtagcccgccgccggccatggcctcctacgacaaggccatggagtcgtacaagaaggccgtcaccacggcggcctccctcgcggcgtctgcgatgctggtgcggggagtcgtcaacgagctggtgccctacgaggtgcgtgacctgctcttctccggcatgggctaccttcgctcgcacatgtcctcccagcacaccatcatcatagaggagaccgaggggtgggccaacaaccagctctacgacgtcgcgcgggcgtacctggcgacgcggatcaacaccgacatgcagcgcctccgggtcagccgcgtcgacgagaccaagagcatgatgttcagcatggaggagggcgaagagatggccgatgtccatgagggcaccgagttcaagtggcgccttgtctgccgggacaactccagcgccagcagcaccaacgccaacggccgtggcggcagcggcaatttcaagcttgaggtccggtccttcgagatgagcttccacaggaagcacaaggacaaagcacttacctcctacctccctcacatcctcgccgtggccaagaagatcaaagagcagaacaggacgctcaagatctgcatgaacgaaggtgagtcatggtttgccattgatctccaccacccatcaaccttcaacacgcttgccatggatcacaagctcaagcagtcagtcatggatgatctcgagaggtttgtcaagagaaaggaatactacaagaagatcggcaaggcgtggaaacgagggtacctgctgtatggcccacctgggactggcaagtcaagcatgattgcagcaatggccaattacctcaaatttgatgtatatgatcttgagctcaccgaggtcaactggaactcaacacttcggaggttgctcatcaggatgaccaaccagtcaattcttgtcattgaggacatcgactgcactgtcgagctgcaacagcgggaggaaggtcaggagggcaccagatccaacccttcagaggacaaggtgacactatccgggctactcaacttcattgatgggctttggtcaacaagtggggaggagaggataattatcttcacaacaaactacaaagaaaggctcgatcctgcgcttctgcaccctggcaggatggacatgcacattcacatggggtactgctgcccagagtcgttccgaatcttggcctccaactaccactctatagatcaccatgccacatacccggagatagaagaattgatcaaggaggttatggtgactccagcagaggtcgcagaggtgctcatgaggaatgaagagatggacgtcacactcgaaggtcttatccagttcctcaagagaaagaaagatggcgctggcaaaccggaaaatgtggaccaggtggcgaaggaggaagaacaagagaaggagatgatgacgaaaagtgatgtcccagacaatgaagatcagcaagatgggagcaaagaatgatgtgtgtacagtgtgaatatcatacaattagtgccaggaacttcgagcaacaattag

SEQ ID NO: 76 - DNA, 1089 bp, Aegilops tauschii
cataaataggctagcccgacgaagatcgacatggccgaccatggcgacgagatgacgacgaacaagaaggtggtgctgaggaggtacgtgacaggctacccgacggcggaggacatggaggtggtcgtcacctcccacgtccggctgcgggtgccggaggggtcgacggccgccgtggtggtcaagaatctgtacctttcctgcgacccgtggatgcgcggccgcatgagcaagcacgacgacggcgacgccgtgccggccgaggacttcgtgcttggagaggccttggtcaatttcactgtcggcgaggtggtcgattcgacgcacccggagttcgacgccggcgacctcgtctgggggatgagtgcatgggaggagtacaccctcatcacccaaacggagggcctgttcaagatcaaccaccccgagctgccactctcacactacacaggtgttcttggcttggcagggctcactgcatatgctggactttttgaggttggcaagccaaagcaaggtgaatctgtttttgtgtcggcagcgtctggcgccgtcggtcagatcgttggacagctcgccaagatagcaggatgctatgtggttggaagtgccggctccgatgagaaggtgaatctcttgaagagcaagatgggcttcgacgacgcgttcaactacaagttggagggggacgacctcggcgcggcgctcgggcggcgcctcccgggcggcatcaacgtctacttcgacaacgtgggcggcgcgacgctggacgcggcgctgctgcggatgcggccgggcggccgggtggtggcgtgcgggatgatctcgcagtacaacctgctggagcaccagggggtgcgcaacctgtggtgcatcatcccaaagcgcgtccgggtggagggcttctcctgcatggactaccaccacctgtatcccaggttcgaggaggaaatggccggctatatcaaggcagggaaggtgaccgtcgtggaggacgtcgtccgagggattgagagggcgcctgaggctctgctgggcctgttttctgggagaaatgttggcaagctgctggttgctcttgcatgatga

SEQ ID NO: 77 - DNA, 461 bp, Aegilops tauschii
tctaccagcagcagcaagtaatccttgatgccagactgcctgatcaaagcatccggcagtagaggatccatggctatggagaggttcttcacggcgctcgtcttctgcgaggcaccactggacggctacggcacctcggtgctcaccgccggcacgatcaacaggcgggtctctggtggcggccacgcgacgaagccagcagtggctaacaagccggactctgagaaggcgcagggttacttcactggcaagccgacggcgcagcggcgccccgggttcgagctcgcgttcgacgggctcaattgctttgacaccatagtcatgcactaagcaagtcagtgtcatgccggctttcttgattttgatcagtaattctgtatagaattggatcggttagatgcttgacacgtacttggggctgtgattttttttgttcattcgattgtactgttcgactggtg

SEQ ID NO: 78 - DNA, 822 bp, Aegilops tauschii
ggcgcttgcttctatttaaagggcatggcagcagacaccacagcaacccaaaccccgctaagcatcagcattcagcagcacctcccttctacctcctctgctttgcattcctccttccggttccagccgcaatcaatggctgccatgaagacaaccctcctcgccgtggccgcgatggccgtcttactaggcaccgcgtcagcggtaacctacaacgtcggcgatcagggcggttggaccctcagcaccgactacagcagctgggtgtccggcaagaagttcaacgtgggtgatgagatcgtcttcaagtactcgaccccagcgcacgacgtggtcgaggtcagcaaggccggctacgactcctgcagcatcgacggcgccatcaacaccttggcctccggcaacgacgtcatcaccctcaacgccaccggcacccggtacttcatctgtggcgtccctaaccattgcagccccaccgccgccgccagcatgaaggtcgtgatcgacgtcgcctcgggctcctcctcgccgtcgtcacccatgccagctgcaggtcctggcgcgagcaactctcccccggcgccgccctcctccgcggctacctccgtcggtgccacagcaggatttggcctcgtcgccctactggcggccggtctcatggcttgaacgcatatattgatcagctgccgcgcgcacatacgagcttttatattgttaactactatgctgtagttattatcacgggtgaatacatgtattcttttttagagcgagaatgtgatagttacttgtatctatcacgtctatatgtaatctgcaggc

SEQ ID NO: 79 - DNA, 767 bp, Aegilops tauschii
atcgatccacgcacatacacgtacgcagctgagcttgctcgacctagctcgatcaatggcctcaaccggagtttcgcgtaggtcctccatcatggcgtcccggctgagcgcgtctgcagaggccatgcgcgcgagcgagggggggaagcagcgacacgccgtgctggcgcggcgggtggagtacgacgaggagtctctggccggtgaaccccaatacgacgtgttcatcaaccaccgcggcgtggacacgaagcggacggtggcgcgcctgctctacgaccgcctcgcgcagagcggcatccgcggcttcctggacaacatgtcgatgcggccgggcgaccggctcagggagacgatcagcgccggaatcagcgaatgcagcgtcgccgttgccatcttctccccgagctacttcgactcggagtactgcctctgggagctcgccacgctcgtagagtcacgcaagaccatcatccccatcttctacaacatcaagccctccgacctggtgctccccgaggccctcgccgcctccgacgactacctcccgcaagacgtcgagcgctacaagtacgcgctccgcgaggccaagaacaccgtcggcctcacctacgactcggccacaggggacatagccgagctggtgtcagcggcagccgacgcggtgctgtaccacatggaaaaaatggtgagagtgcagaggagggaaacgatcgtttcaaggctctaattttgaatggaaaatcaacggctactattcagcgaag

SEQ ID NO: 80 - DNA, 2857 bp, Aegilops tauschii
tgctttgacccatttcgtgtccggcgatcgatcttaaccttggtctactgcgccgacgaggggagagcttctttctacggtcatcgcgccgatggagctgctggggagatcgctcttgcaggcaggctctgctagcaccgcggcgccgcgcggcggccgggagcgcgcgggcggcgggctctgcttcgcgagcctgggcgggaggccgtcgaggaggacggtgaggtcgaaggcgcccgtgggcgccctggccgagcgggtcgtcctcaccccggcgccggcggagagggtggcccggccggaggcgcacccgcagagcgtggcggcgagggccgtggtcaccgtgcgccggaagcgcaaggtggaggtcaaggagcaggtcgccgagcagatggatgcctacgccgacagggtcggccggagcgtccttctcgagctcatcagcacggagacggacccgagaaagggaggccccaagaagagcaggaagtcgaggctggtggggtggttcgagaagcgggacgtcaaggcggagctggtggtgtacacggcggagttcaccgtcgacgcggccttcggcgagccgggcgcggtcaccgtgctcaaccgccaccagcgcgagttcttcatcgagagcatcctggtggagggcttcccgtccggcccggcgcacttcacctgcaactcgtgggtccagcccacccgcgtcgaccccgccccgcgggtcttcttcaccaacaagccctacctgccgtccaagacgccgccggggctgagggagctccggcgacgggagctcaaggagctgcgcggcagcggcaccggcgtgcgcaagatcaccgaccgggcctacgactacgacgtgtacaacgacctgggcaacccggacaagggcgccgggttcgagcgccccgtcctcggcggcgacaagctcccgtacccgcggcggatgcggacggcccggccaagcaccgtcacagacgagggcgcggagagcagggtggagtacccggagcccatctacgtgtcgcgggacgaggagttcgaggagggcaagaacgagatgctgtccgagggcgccatcaaggcgctgctccacaacttcatgccgctgctggtgagctccgtctcgccggatagccgcgacttcgccggcttccacgacgtggacaacctcttcaaggagggcctccgcctcaagcaggccctgcacgaccagctcttccagaagatccccttcgtgcgcaagatccaggagaacagcgagggcctcctccgctacgacacccccgacatcatcaagaaggacaagttcgcgtggctgcgcgacgacgagttcgcgaggcaggcgctggctggcatcaaccccgtcaacatcgagcggcttcaggtgttcccgccggtgagcaggctcgacccggccgtctacggcccgccggagtcggccatcacggaggagcacatcatcgggaacctggacggcatgtcggtgcagcaggcgctggaggagaacaagctctacatgctggactaccacgacatcttcatgcctttcctggaccggatcaactcgctggacggccgcaaggcctacgggacgcgcacgctcttcttcctcacggccgggggcacgctgaagcctatcgccatcgagctgtgcctgccgcccatgaccgacgactgcaagcgcgccaagcgggtgttcacgccccccgccgacgccaccagtatctggctgtggcagctcgccaaggcccatgtctgctccaacgacgccggcgtccaccagctcatcaaccactggctgaggacgcacgcgtgcatggagcccttcatcatcgcggcgcaccggcagatgagcgccatgcaccccatctttaagctgctcaagccgcacatgcggtacacgctcaagatcaacgcgctggcgcggcagatcctcatcaacggagacggcgtcatcgagtccgggttcacccctggccgctactgcatggagatgagctccttcgcctacgacaacctctggcggctcgatcaggaaggcctccccgccgacctcatcagaagaggcatggccgtggaggacgcgagccagccgcacgggctccggttgctcatcgaggactacccctacgccaccgacgggctgctcctctggtcggccatcgcgcggtggtgcgaggcctacgtggcggcctactacccgtccgacgaggccgtgcaggacgactacgagctgcagtcgtggtacacggaggccgtgcaggtggggcacccggacaagtgcgacgcgccgtggtggccgcgcctcacgacggccggcgacctcgcgtccctgctcaccacgctggtgtggctgtgctcggcgcagcacgcggcgctcaacttcggccagtacccgctcggcggctacatccccaaccggccgccgctcatgcgccggctggtgccggccgagggcgacccggagtacgagcacctcgtcgccgacccgcaccggttctacctgtcggcgctgcccagcctcacgcagacgacgacgttcatgacggtcatcgacacgctgtccacgcactccgccgacgagcagtacctcggggagcggcccaacgaggagtggacggcggacccggcggcgctggctgctgcgcgcgagttcgcctcggaggtgcgccgcgccgaggaggagatcgagcggcgcaacgccgaccccgcccggcgcaaccgctgtggcgccggcgtgctgccgtacgaactcatggcgccgtcgtccgggccgggcatcacctgccgaggcgtcccgaacagcgtcaccatctagcccgcaaagagtaaattcaagggaccgtggtag

SEQ ID NO: 81 - DNA, 545 bp, Aegilops tauschii
ggttgcaagaaagctaaggttgacgatatggccgccgtgaggaggatgaggcccgctctgctggtgatcgtggcggcgctcatgctgctggcggtgctcggcgaggcgcggccgctgggtggcgccgactgggcggccgccggagggaccccgctgccggccgcgggcggcgcgtcgaccgtggtccaggcgctccggcggctgtacatgcagcagctgggcagcgggccgggcccctcgtgcggcaccaacagcccaaacgtccactgcccgtagatggccgaggtcgagcgccgcagctcggccggcgtacgtcctctcgggttcgaagttccaacgcgtgttttttgggaccccaagaggtagactctggtgatcgagactaggattggatttgttgcttggtttgttggtgatttttgcccacgcgtacgtgtacgctggttggcactttgtacatacatacagaagaaaagatacacatatagtacgcaggattttgtttgaatagaacgtaggtaagctgaacaagcatcagcaataca

SEQ ID NO: 82 - DNA, 1530 bp, Aegilops tauschii
gagtcacgacggaccaaatcttttcttatccccaccgaagccaccagcgccatgccgtcgcgatcgccgtccatggtgcgcgtggtgtcgtcgtcgacggtgaagccgccgccgcggccgcgcgagcgcatcccgctcacctcctgggacgcctccatgttctcctccaactacatccagaagggcctccttttccacaggcccacctcatgctccccggtcaacgtcgccgaccacctcgccgcggcactcggcgacgcgctcgcccactactaccccatcgccggccgcttcgccacggagcagcacaaggatgacgccgggaacatcgtggggtgctcggtccacgtcgactgcgacggccagggcgtggaggtcgtccacgccgtggccgacggggtgaccatggcggacgtgctcccccgcgacgccgacgtgccgcgcggcgtgctggcgcagttcttccggctcaccgacgccgtcaactacggcggccaggagcagccgctgttcgccgtccagatcaccgacctcgccgacggcgtcttcgtcggcttcgcctacaaccacgcgctctccgacggcaccgccttctgggacttcgtcaactactgggccgccctcgcgcgcgccagcctcggccttgaggcggtgcccccggcgccgaagccctcgttcgagcgctggtcgaccgacggcggcgcggcggggccggccgtgctgccgtgcgccgacgtgtcggagctcatcgagcgggcgcccccgctgcagctgcgcgagcggatgctgcacttctccgcagagtcccttgcggcgctcaaggagcgcgcgcgggagaagctcctggccgccggcgacacggcgggcgcggccgcactgaccaagttccaggcgctctcctcgctcctctggcgctgcatcacccgcgcccggcgcctctcgccggagcaggagacgacgtgccgcgccgccatcaacaaccgcgggcgcctccggccgcagctcccgcaggagtacttcggcaacaccatctacgccatcggcaccgagtccacgcgcgccgcggacctcctcgagcgcgggcacgggtgggcggcggcggccgtggggcgggccgtggcggcgcacacggacgcgtccatcagggcgcgcgtggcggcgtggaccgccaggcccatggtgtacacgcaccgcttcttcgaccccacgggcaccatgatgggcagctccccgcgcttcgacatgtacggctgcgacttcgggtgggggagccccgtggcggcgcgcagcggcgtggccaacaagttcgacggcaagacctcgctctaccccggccgcgagggcggcggcagcgtcgaggcggagctcacgctgtcgcccgagaacatggcggccctcgaggaggacgacgagttctgggccgccgtgaccccagacgcgcccgtgccggcgccggcgccggagaagaaagccacttgaatcttccattccatgcatgttacccccgtacctctgctcttcttcctgtag

SEQ ID NO: 83 - DNA, 3499 bp, Aegilops tauschii
gccaagaagaagcataggcataggcggctcgcgcatgaggagaggcacacctttcgtctaggattcgattcgtccatgattattcaggagggcaagccatgtctcccctgctcctccggttcctctgcctactcctcctcgcaggtgaggcggcgctgacaggcgcgcagagcggcggcgacaaggaggtgctggtggagctcaagcgcttcctggttgccaacaacaggttcaaccgcggcgactacgacgggtggcaggagtcggacccgtcgccgtgccagtggaagggcgtcggctgcgacaggggcggccgcgtcgcgtctctgaacctggcgggctcgaccatctccggccaggtgttcggcaacttctcgcggctctcggcgctcacgtcgctcgacctctccggcaactccatcaacggcccgctcccggccgccgacctcaaccaatgccgcggcctcctgcacctcaacctctcccacaacctcatcaccggtccgctcaacctctccgggctgaccaggctacagacgctcgacgtgtcggggaaccggctcgagggcggcgtcgccgtcaacttcccggcgatatgcgccgacctcaacttgctcgacctgtccaccaacaatctcacgggcaacatcaccggcctgttcgatggctgcgtcaggctcgacaaggtcgacctcagctccaacaacttcaccggcgagctatggcctggaatcgcgaaattcagggcattcagcgccgccgagaacaacctcaccaggagcgtcccgtggagcacgtttcctgacggctgcaggctccagtccttggacctctccgataaccagctggtcgggggcttcccggattccgtcgccaattgcacgaatttgacgtacatgtcgctgtgggggaataatttcactgggattatacctgccggaatcgggaagctcgccgtcctcgagacgttgattcttgggaacaacaagttcgatcggaagataccgccggagctgacgaactgcgggagacttcagttcttggacatgagcaccaacaactttggaggcgacgtgcaacagattttcggcaactttacgagcttgaagtatcttgtgcttcatcacaacaattacaccggcggcatcgtggcctccggcgtgctccggctaccgctgctcgccaggctcgacctcagcttcaaccagttcaccggcgaactccctccagaggtggccaacatgaagagcctcaagtacctgatgctcgccgagaacaacttctccggcaccataccgccggtgtacggccgtctcgccgagctccaggcgctagacctgtctaacaacacgctcacaggtgggatcccagcgagcataggaaacctcacgtcgctcctatggctgatgctcgccgggaaccagctctccggagagataccacctgaaatcggcaactgcaccagcttgctctggctgaacctggccgacaaccggttgactggcaagattccaccggagatggcagagatagggaggaatcccggcccgaccttcgccaagaaccggaatgatacgagcgtgctcgccggctccggcgagtgccaggccatgaaacggtggatcccggcgagctatcccccgttcagcttcgtctactccgtcatgacccgggagaactgccgcagcatatgggaccgcatcctcaagggctacggaatcgtcccaatttgcaccaactcgtcgtcgccggcgaggtccaacacggtctccgggtacgtgcagctgtcagggaacctgctttccggcgagataccgtcacagatcggcgcaatgcggagcctcagcttgctccacctcgacggcaaccgtctcacggggcagctgccaccggagatcggccggctcccgctcgtcatgctgaacgtctcgaggaacaacctctcgggcccgattccgtcggagatcggcgacattctgtgcatcgagaggatggacctgtccttcaacaacctctccggcgagctcccggcgagcctgttcaagctcaccgagctatcaatgttcaacgtgtcgtacaacccactcctctccggcaatgtctccaccaccggccagttcggcaccttcgacgagcagtctttcctcggcaacccgctcatttcgttgcatcagggtggagctgccggtaagcagcaaccaccaccggaagctgccgacgctcctgcagttcggacgcgcagcataccgagaaccatcggggtctggctgcttttctccctcgtcatcgccttcatcgccgccaccgtcgtgttcgcgatcaccagcctacgcgcccggttcccggtggaccaggagccggagctggacgcattctcgtgcgagcaccccaagggcaagtgcgcgttcggaatgtcctcctcgccgccgtccgggtcgtcgtcggccacggggtgctcctcctcgacggagggagtgaaggtgttccggctggacaagacggccttcacctaccgcgacatcgtggcggccacgggcaacttctccgacgaccgggtgatcgggcacggcggctccggcgtggtgtaccgcggcgtgctccccgacggccgcgccgtggcggtgaagaagctctccaggccgcgcgacggcgtggacggcgacggcgagcgcgagttccgcgccgagatggaggtgctcgccgaccggatggggttcacgtggccgcacccgaacctcgtcacgctctacgggtggtgcctctccggcggcgccaagatactggtctacgagcgcctcgacggcgggagcctggaggcgctgatctgcgacacgggcgcgttcgggtgggcggcgcggctggacgcggcggtgggcgtggcgcgggcgctggcgttcctgcaccacgagtgcgtgcccgccgtggtgcaccgcgacgtgaaggccagcaacgtgctcctggacggcgacgggcgcgccaaggtgacggacttcgggctggccagggtggtccgccccggcgacacccacgtgagcacgatggtggccggcacggtcggttacgtggcgccggagtacgcacagacgtggcgcgccacgacgaaaggcgacgtgtacagctacggcgtgctcctcatggagctcgccacgggccggcgcgcggtcgacggcggcgaggaatgcctcgtcgactgggcccggcgcaccgcgaaggagggccggaagcagcaaacggaggatcaacagacgaccgccacggtgttctgggagctgctcgagctgggcatgcggtgcacggccgacgcgccgcacgagcggccggacatgccggtcatcctcgccgcgctgctggacatggccggcgacgcgggctgtgcatactgcatgagctcaggacacagcgacggcgagcaaacaagttctctgacataggtgttgaaggttacaaaaacaaatttattctttgtgtacaaaaatgctgttgtttagttcagctgggc

SEQ ID NO: 84 - DNA, 2726 bp, Aegilops tauschii
ggatcccggagatggctccctcgcctatccccctcctcctcctcctcctcctcgccgtcgcggccctctgccccctcgccgccgcgcagcagcgcaacgtccagacccgcttcccctccacgcgcaccccggcagtcgccgccccgccgccgccgatcgtgcccccgtcgccgtcccccaccggcccggccatcctgcccccgcagtccgcctcctcgtcctcctcctcctccacgaagcgcagcgacatcgccgtggccgtggtgagcacggcgctgagcagcttcgcgctctgcggcctcgccttcttcctcttcctccgccacggcaagaagaaggagctgacgcacgtcggcggcaacggtcactccaaccggccccaggacgccgcgctcgccggcaagctgccggagagggcgccgaagcggccgccccgcggcggcatggtggacgagaacgggctcgacgcgatatactggcgggagttcgagaaggagggcgagggcggcggcaggggcaggaagcccgcggggggctggcgcccgccgcagccgccgccccggcagagccgcgcggagaggtggccggaggcgcaggcgtcgccggccccatccccgccgcggccgaggaagggcaagatagatcaggaaccgctcatacccaggggctccctggattcctcatccgccgtgttcgacgagtcgccgcgcccgcccagcgccagctccagctcgtccttctccgtcgctgcccccgaggcctacgcgcggccgccgccgccggcgatcgccgtcccccgcccgtccccgccaccagcccctgctgccccaccaagcgcgtcggcatcggcatcggcatccctggcgcggccgccaggaagaggaagcccgccaccgccgccaccaccaatggccaccacgtcgccaccgcctaaaggcccgccgccgccaccagcgccgaagggcccaccacccccgccagcacccaaaggcccacctcctccaccagcacccagaggcccgcctccgccaccgccacccggaggaaagaagggagggccgccgccaccaccacctcccggtggcaagaagggagggccgcccccgccgcctgcctgggcgtcgtcctcgaggccaccggcggccccgggcgggccgtccggcgcggacgacctggcgaagctgaagccgctgcattgggacaaggtcaacgtggcggccaccgaccactccatggtgtgggacaagctcaccggcggctcattcaacttggacgaaggcaccatcgaggcgctgttcggcaccgcggcggtgaaccgcaagacgaaatccgcggacgccaaggactcctcgagcggcctcgggcgctcgacctcggaggagcagatattcctgattgagccacgcaagtcgcacaacatctccatcatcctccggtccctcaccgtggggcgggacgagatcatcgacgcgctgcgtgatggcaacaccgagctcggcacggacgtcctcgagaagctgtcccggctcagcatctccaaggaggaagaggccaccatcctgaagttctctgggaaccccgacagacttgcccccgcagaggccttccttcttcgactcctgctcgacgtgcccaacccgtttgcccgtgtcaatgcgctgctattcaaggtgaactacggttctgagattgctgtgctcaagcaatcgctccagactttggagatggcgagccaggagctgaggacgaaggggctcttctttaaactgcttgaggcggtgctaaaggcgggcaaccggatgaatgccggcacggcgcgggggaacgcgcaggccttcaacctcacagcactgcgcaagctcaacgacgtgaagagcaccgatggaggcaccacactgctccactttgtcatcgaggaggttgtgcgcgcagaggggaaacgccttgccgtcaaccgcaactacaccatccgccgctctggtagcctcgccaagagcagcgtcgatggcggaatttcagcagctggctccgctggccaggggccatcacgcgaggacaggcagaatgagtacttgaacctaggattgcccattgttggaggtctcagcagtgagtttgccaatgtgaagaaggctgcaactgtggactacgatgtgactgccaatgaatgcacaatcttaggcaaccgactcgcgggcatcaagaagctcctggagacctgcggggacgatggattctcaagagggttgagaggctttgtcaatgctgcggagcaagagatgaaggcactgagtggagtgcaggagaaggtgcttgatctggttcagcggacgacggagtactaccatgcaggtgctaccaaggacaggaacgcgcatcccctccagttgttcgtcattgtgagggatttcctggggatggtggaccaggcatgtgtggacatcaagagaagactgcagcagcaaaagaagccaacacccccgtcatcacagccaacaacggcggcggctgctaaggggccagctgaagccgctaagggggcacctgatggtgctaaggcggtagctggtggcgcggcggcagcaccaccggctcaaaaaccaccaccagaagaagcagatagcaaaaggaagagggtcatgccaagattcccaaacttgccagcgcactttatgaaggacggcgcagactctgattcaagtagtgatgaggaatagtaggaattc

SEQ ID NO: 85 - DNA, 1469 bp, Aegilops tauschii
tgtacatgaacctgacgttgagtctaggcgtcaatggtggcgccgctgcggccaagaagcgcaaggtgatggacggcgtcggcgacgttggcgtcctcggcgccggtgacggcggtgaccgcgccactgtcatgaggctcctccaggccagagatcgcatggtgaaggttgagcttgatcacgacgacggggacgtgagtgaccgcggagcctcgccgctgatgcgcttgctcctctcgtcggcggccgccggggaggtcggcgacatgcacgcagcggccgtggccttgcaggaggtctaccggcacgcgtccttccgcggcggcgaccccgcccagcgggtcgcatcctacttcgcggacgcgctggcgtcgaggctcctgctgccgccgccggcgaaggcgaagacgacgacgacgactcgcgaagagcagttcctggcgttcaccatgttctaccaggcgtccccgttctaccagttcgcgcacttcacggcgaaccaggccatcgtggaggcgttcgaggccggcggccggcgccgcctccacgtcgtggacttcgacgtctcgttcggcttccagtggccgtccctgatgcagtccctttccgacgccgccaccacaagctcctctctatcctcccaggacgacagcggcgactgctgcgacgagccggtgtccctgcgcatcaccgggttcggcgcgagcgccgacaagctgcgggacacggaggcccgcctcgcccgcttcgcggacggctgccccaacctacggttcgagttcgagggcgtcgtcaacaacgtcaacaacgggccggaggagggccgccatgagcgcatcacgaccgaccccgccgcgacggtggtcgtcaacctggtgttcccggccgcacagaacgtgaggcagagctcatgggatccgcgcagcgcatcggctcacatccggtctctgaacccgtccttggtcttcctgatcgacaaggtcgacgaaggcaacggcggcgttaaaggcgccggaagatgcggaagcgcgagcctgctcccgcggttcgcggccaacctccggtactacgcggccgtgttcgagtccctgcacgagtgcctcccggccgacagcgctgagaggatcgccatcgagagggaccacctcggcgtggagatcagcgacgcaatggcctctctggaccgtcggcgccacgacggcgatcgcgcggcggacaaggtgagtcgcggttggaaggagaggctggagagcgcggggttcgaagacgcgaggctgagctcgaggacggtgagccaggcgaagctgctgctcaagatgaagagcggcgggtgcggcggcggcgggttccgcgtcatggaggccggcgacggcaaggccatggcgctggggtggcgagacagggccctcatcacggccagcgcgtggcggccgtgccggccatcggtcggcaagaacgagccctgatag

SEQ ID NO: 86 - DNA, 1870 bp, Aegilops tauschii
gctagcttaaccttaatatcggtggccattttttgttcgatttcactccatcggggttttagcaagagcagctagctagcttgatatcggtgcagcaatggacgccatggagagaggacagagctcgccgcggctgccaaagatccggggctcaaagatcgacgaggaaagcctcagggtgccgctgatagagagcaagaaggccggcagccgggcgccggcggtggtcctcgggttcgagtgcctcgagagcacggccttcaacggcgtcgccaccaacctggtgctgtacctggagagcgtcctgcacggcagcggcctcgccagcgcctccaacgtcaccacctggatcggcaccagcttcctcacgcccgtcctcggcgccatcctcgccgacaccttctggggcaactacaacaccatcctcgtctccctcgtcgtctaccttctcggtatgatgctcatcaccttctccgcgttgctgccgaccaccgagctgtgcgggctgggctcgtcgtgccacccgatgttcggcgcgcacaccgtcgccttctccggcctctacctcgtggcgttcggcagcggcggcgtgcgggccgcgctgctgccgttcggggcggagcagttcgacgacgacaacgccgtggaccgggagcggaagatggcattcttcagctggttctacatctgcgtcgacttcggcatgatcgtgtccgggctcttcctcgtgtggatccagcagaacgtcagctggggcctcggcttcggcatcgccacggcctgcatcgcgctcgccttcgtcggcttcgtgcttttcacgcccatgtacaagcgtagcatgcccaccggcagcccgttcaagagcctgtgccaggtcgtggtcgccgcgtgcaggaaggtcaccctccgcgtccccgccgacgccgccgtcctctacgaggtcagcgacaagatcgaccagccaaggatcgcgcacaccaaagagttcacgttcctcgacaaggcggccgtggtcgcggactcggacctggaggaggtgacgaacgtcgacgccgcggcggcggccgcgggctcgtggaggctgtgcacggtgacgcaggtggaggagctcaagatcctgatgcggctgctaccgatctgggcgacgagcatcgtgctgtcggcggcgtacgcgcagctcaacaccacgttcgtgcagcagggcagcgccatggacatgcgggtcatgtcgttcaccatcccggccgcgtccatggtgtccttcgaggtgatctgcgtcctggcgtgggtgctcatctacggctcggtgatcgtgccggcgctcaggagactgtccccggcgagcggcgagccgtcgcagctgcggcggatgggcgccgggcggctgctcatggcgttcgcgatggccgtggcggcgctggtggagatgaggagactggaggccgccgggagcggggagtccatcagcatcgggtggcagatgccgcagtacttcgtgctggccggcggggaggtgttctgctacatcgcgcagctggagttcttctacagcgaggcgccggagtcgatgaagagcatgtgcacgtccttcgcgctgctcaccgtggcgctgggcagctacgcgagctcgctgatctacgccgtcgtggacgcgctcacggccaccggcggccggcccgggtggatatcggacgacctcaacgagggccacctcgactacttcttctggaccatggcggcgctgtgcacgctcaacttcgtcgtgtacagcgccttcgccaggaactaccaggtgaagacggtcgtgtcgtgatcgtgatcgtgatcgttccttactcgtcggcgtacataaggagagcatcagatttcg

SEQ ID NO: 87 - DNA, 1166 bp, Aegilops tauschii
gacgcagcaaaggtgtctcccattccaagctgcctaccacacacacactagctgcgagcagtaccatcactggccaaaacgtgaccccgctccagtcaacttcctcgtcgccaccacacgaccgcacctctcccatggcgtcctcctcgccgccgcacgtcgtggaggacgtgcccccgttcctgcagctcctcagcgacggcacggtgatccgcttcacggacggctacccgctcccgatcccgtcgccgccgcccggccagcccgtcgtcgactggaaggacgtcgtgtatgacgccagccacggcctcaagctccgcatctacaggccggcggcggcctcctcctccgggaacaagctcccggtgatcgtctacttccacggcggcgggtacagcatcggcagcttcgacatgcccaacttccacgcgtgctgcgtccgcctcgccggcgagctcccggctgtggtgctctctgcagactaccgcctcgcccccgagcaccggttccccgcgggcctcgacgacgcggcgaacgttgtgtcctgggtgcgcggccaggcagcggctgttggagacaacgccgacccatggctctcggagacggcggacttcgaccgggtgttcgtcgccggggactcggccggcgggggcgtcgtccaccacacggccgtccgcctcgcgtcgggccggctcggccccctcgagcccgttcgcgtcgccgggtgcgcgatgctctgcccgatgttcggcggggaggagaggacggcgtcggaggcggagttcccgccgggcccgttcctgtcgctgccggcggtcgaccaggcgtggcgcctggtgctgccgcctgggtccacgagggaccacccgctggccaacccgttcggcccggacagcccggcccttgacggcgccgcgctgcctccgatgctcgtggtggccgccgcgcacgacctgctgcgcgaccgcgccgcggactatgccgcgaggctcaaggccatggggaagccggtggagctcgtggagttcgaggggcagcaccacgggttcttcgccgtcgagccgtacggcgacgccggcagtgaggtggtccggctcgtcaaacggtttgtctacggtaacggcggcgcctccgactaaattggagatcgagcaaagctgttctag

SEQ ID NO: 88 - DNA, 2789 bp, Aegilops tauschii
ggatccctaccatggccgaagagaaggcagtcggcgcgcccgcgctcgacaccaacatcgagactggcggcttcgatgagaagcgaggacaagctcccgctacccacaaccctaaggctcccgtcgccgaggatgaggagcccgatgaggacatggatgccctgatcgaggacctcgagtccgaggacggccacgagatcgacgacgacgaggaggccacccccggcggtggacgtgtcgtccccgaggaccagctccagactgactctcgtgttggtttgactgaggctgaggttatcgcacgtcgcaagaaatggggtctcaacgccatgaaagaagagcaagagaacatgattctcaagttcctcatgttcttcgttggccctattcagttcgttatggaagctgccgctgttcttgctgctggtcttgaagactggattgatttcggtgtcatttgcgctcttctccttcttaacgcatgtgttggcttcattcaggagtaccaagctggttccattgtcgaggagctcaagaaaactcttgctctcaaggctgttgtcctccgtgatggcactctcaaggagatcgaggcccctgaagtcgttcctggtgacattttacaggtcgaagaaggcacgattatcccggctgatggccgtttcgtcactgagggctgcttctgccaggttgatcagtccgccatcactggagagtctctcgccgtcgacaagcaccatggtgacaactgttacgcttcttccgctgtcaagcgtggtgaggccttcgttatcgttactgccactggtgacaacaccttcgtcggtcgtgccgctgctctcgtctctcagtctgctggtggcactggtcacttcactgaggttctgaacggaattggaacaattttgctcgttctcgtcgtcgccaccctgctaattgtttgggtcagctctttctacagatccaatggcattgttgatatcctccgtttcacacttgctattactatcgtcggtgtccctgtcggtcttcccgctgtcgtcactaccactatggccgtcggtgccgcctacctcgccaagaagcaggccatcgtccagaagctttccgccattgagtcccttgctggtgttgagattctctgctctgacaagaccggtactctgactaagaacaagctctctctcgctgagcctttctgtgttgctggcgttgagcccgatgacctgatgcttactgcttgtttggctgcttcccgcaagaagaagggtattgatgccatcgacaaggctttcctcaaggctctcaagttctacccccgcgccaagggtgttctgtccaagtacaaggttctcgacttccacccctttgaccccgtctccaagaaggtccaggctgttgtcgagtcccctcaaggcgagcgtatcatctgtgtcaagggtgccccactttttgttctcaagaccgtcgaggaggaccaccccatccctgaggaagtcgattcggcgtacaaaaactgtgtggctgagtttgctacccgtggcttccgatctcttggtgttgctcgcaagcgaggtgagggtgcttgggagattctcggaatcatgccttgctctgaccctccccgtcacgatactgcccgcaccatcaacgaggccaagcgccttggtctctccatcaagatgcttactggtgatgccgtcggtattgctcgtgagacttctcgtcagctcggtctcggtaccaacgtttacaacgctgagcgtcttggccttggcggtggtggtgacatgcctggttctgaggtctacgatttcgtcgaggctgccgatggtttcgctgaggttttcccccagcacaagtacaacgttgtcgagatcctccagcagcgtggttaccttgttgccatgactggtgatggtgtcaacgatgctccctctctgaagaaggctgataccggtattgctgttgagggtgcttccgatgctgcccgctctgcttccgacattgttttccttgctcccggtcttggtgctatcattgatgctttgaaaacttcacgccaaattttccatcgtatgtacgcctacgttgtttaccgtattgcgctgtctctccacatggagatcttccttggtctctggatcgccatcctcaacaagagcttgaacattgagcttgtcgttttcattgctatcttcgccgatattgctactcttgccattgcttacgacaacgctcccttctcccagacacccgtcaagtggaacctccctaagctctggggtatgtccgtccttctcggtgttgtcctggctgttggtacctggattgctcttactaccatgtacgccaactctgaggatggtggtatcgtccagaacttcggtaagatcgacgaggttctcttccttgagatctctctcactgagaactggctcatcttcatcacccgtgccaacggccccttctggtcttccatcccctcttggcagctgtctggtgccattctgatcgtcgatatccttgccaccctcttctgtatcttcggttggttcgttggtggccagaccagcatcgtcgctgtcgtccgtatctggattttctctttcggtgtcttctgtgtcatgggtggtctctactacttcatgcagggcagcactggatttgacaacctgatgcacggcaagtcccctaagcagaaccagaagcagcgatcccttgaggatttcgttgtctctcttcagcgtgtctcgacccagcacgagaagtctcagtaataggaattc

SEQ ID NO: 89 - DNA, 1395 bp, Aegilops tauschii
ctgggtagctgagcggataagctgcaccggccatgggaaacttttgtgtgtgcatgggcggctccgccaagtgcgccagcgcctccactcccttccaatcaaaggtgaacccgaggagcagcacctccaactccaactcgaaggcgtcgcgccggagcagctccggcccggacaagccgccgcagccggcggaggcgccgacggcggcgggggaggcgcaggcggtgccgccggcgtcgctcaagtcgttcagcatggcggacctgcgggcggccaccaagaacttcggctccacgtcctacctcggggagggcgggttcgggtgcgtgtacaaggggtggatcgacgagaccacgctcgcccccgccaggcccggcgccaccaacgccatgatggtggccatcaagaagctcaagaaggagagcttccagggccacagggagtggctcaccgaggtcacctacctcggcgacctccaccacgacaacctcgtcaagctcgtcggctactgctccgactccgacagcaacaagctgctggtctacgagtacatgccccgcggcagcctcgagaaccacctgttccggcggggcagccagccgccgctgccgtggtccacgcgcgtgtccgtcgccgtcgacgtcgcccgcggcctcgccttcctccactcccgcgacgtcatcttccgggacctcaagtcctccaacgtgctgctcggccccgaccaccgcgccaagctctccgacttcggcctcgcccgggccggccccaccggcggcaagacccacgtctccacccgcgtcgtcggcacgcgcgggtacgccgcgccggagtacgtcgccacgggccacctctcggccaagagcgacgtctacggcttcggggtggtgctcctggagctcatgaccgggcggcgcgcgctcgacgaggcccgcggggtggcgtcggagctgctggtggactgggcgatgccgatgctgcagggggagcggcgcaaggtgatacgggtcatggacaccaggctcggcgggcagtaccccaagaggcaggcgcaggacatggccgcgctcgcgctccgctgcctccagaacgaccctaagagccgcccctccatggccgacgacgtcctaccctccctcgagctcctgctgcagccaagcgccgccaagtccttctcctcctcctcgacgacgacgacgtcgagatcgccggccgcgtcggcggcgctggtgcacagaggccaccgtcgaaacaaagcctagctagctagctaggagactcggttcatttaattactgtgttcaattagtgtgttcgtctgtgcagtagaatagaatttgtagattggaaattggacatcttttttctctctcgtttcagccgtttggaatattg

SEQ ID NO: 90 - DNA, 1316 bp, Aegilops tauschii
tctcaacagcacctccctaatcgcctcctctcctccttccatccaggccaaaagccctttgcttttcgccttcccctcccctcctcctccgtgccggagttcgccggcggtggtgcctttgccccgcctgccttgggttttagggggattcttgaggggttttaggtaggccgtgtctggggcgctggcaaatgcgagtggagttttagggtgagtgttttcctttcctcgatgtggcccatggaggaggagtttttcatggcggtgaagaggacggagcacgtcgaggtgacgtcccgttcggtggcggcgtcggccagggggaaggagggggttggtggcgtcgagcagcccaagatggtgagggtgttctgcgacgacttcgacgccaccgattcctcgagcgatgaggagggcggcgagcgccggcgcgtgaagcgctacgtccaggagatccggctgcagcccgcggtccaggttaaggtggaggagtcggcgccggtggccaaggccgcgtcggcgacggcgacgacgaggcccagggtgatggttcccgtcaggaagaggaaggccgaggccggcggcgagcggcggttccgcggcgtccggcgccgcccctggggcaagtacgccgcggagatccgcgacccgtggcgacgcgtccgcgtgtggctgggcacctttgacaccgccgaggaggccgccaaggtctacgactcggccgccatcaagctgcgcggccccgacgccaccgtcaacttccagcagtccgaggacggggaggacatggaggtccccgccgaggtcgccgaacgccttccgcagccaccggcgggctccaagaacgcctcctcctcggccacctcctacgactcgtgcgaggagtcccatgtcgcggccgcgtccccgacatccgtcctgcgctccttccctcagtccaccctgggcgccgccgtcgacgacgagtcctccaagaagccgtcctcgtcttccagcaccgccgagaccgacgagtcgagcggcgtcttcggctgctcgttctccggcgacgacttcgccggcgagctggccccgctctacaccgacttcgacctcctctccgacttcgcggagcagccgatggacttcctgtccaacctcccggagccggccttcgcattctccagcgactgctcgtcgtcggcctacaacccgtgtccgccctccccggcggcgttgcagcaggcggacgccttcttcgaggacattaccgacttgtttcaaatcgatcccctccccgtcatctagggaacaactgtaaaacaccggattaggcg

SEQ ID NO: 91 - DNA, 758 bp, Setaria italica
gagagatggggcgcgctccgtgctgcgagaagatgggcctgaagagggggccctggacgccggaggaggacaggatcctggtggcgcacatcgagcgccacggccacagcaactggcgcgcgctgcccaagcaggcgggcctcctgcgctgcggcaagagctgccgcctccgatggatcaactacctccgcccggacatcaagcgcggcaacttcacccgggaggaggaggacgccatcatccacctccacaccgtgctcggcaacagatggtcggcaattgctgccaggctgccggggaggacggacaacgagatcaagaacgtctggcacacgtacctcaagaagcgcctcgagcccaagccagccacccagcaggcgcccaggcgcaagtccaagaagcagcagcagcagcagcctgcggagatcgtgatgctcgacggcccggccagcgccgtgccggtgtcgtcgccggagcagtcgctctccacgtccaccaccagcagcactgactactcggcggcctcgtcggtggagaacaacgcggacagcagcttcacctcggaggaggactaccagatcgaggacagcttctggtcggagacgctggcgatgacggtggacagctccgattctttcgggatggaaagggaggacgcctgcgttgaggcggcgccgtcggccaacgatgacatggacttctggctcaagctgttcatgcaggccagcgacatgcagaatctgtcccagatctagtag

SEQ ID NO: 92 - DNA, 1166 bp, Setaria italica
gacgtgatcgatcgccacgacggtttccaacgcgatcacctacgtacttagctgctgcacgaccagacggccggccgtcacacaggaagaagacagcgtgcttttgagtatatggacgcggcggcggcggcggcggagatctaccggctgccggaggagtgcgtggcgtacgccatctcgctgacgacgcccggcgacgcgtgccactcgtccgcggtgtcgccggcgttccggaccgccgcggactccgacgccgtctgggcacggttcctgccgcccgaccacgccgccgtcctggcgcgcgccgacgagcccgtggagtgcgagtccaagaaggagctcttctcccgactctgcgacacccccgtcctcctcgacggcgccaccatgagctttgggctggagagacggagcggggcgaaatgcttcatgctctcggcgagggcgctcagcattgcctggggagacgatccgacttgctggatatggaccgctagccttccgggatccaggtttcctgaggtcgccgagctcgtcgacgtgtgctggctggagatcagcgggaagctcagcctctcgctgctctccccgggcacaacctacgccgcctacctcgtcttcgccatcgccgacgactcgtacggcctggagtgccacgtcggcatgctgccacccaaggccacagtcaccgtcgtctccgggaccagcggcaagccggcggcgacgtcgaccgagcacgccatctgcctgcagcacatgcagggggaggaggaggtcgccgtgcaccggcggaagcagcagtacatgcggctccgcaagggctacggccgcaagatggtgacgagggaggccgaccccgacatcaggtgcccgcgccggaggggcgacgggtgggtggaggtcgagctgggcgagttcgccgtggccaccggcgacggcgaggacggcggcgtggtggaggtgaggctcgaggaggtggatagccggaggtggaagaggggcctcatcgtgcaaggcatcgagatcaggcccaagcacgcttgctagctgccgccatatagccgaacgcctgcgttgattcttttttatcaacagttagccatcggattaatttttaatctaggaaaaaatcattaagaattaccgatgaattaggtccagagagg

SEQ ID NO: 93 - DNA, 2514 bp, Setaria italica
tcatctttaggaggagatacagagagagataataatgtcggccttaacagcagctgctgcacccacggtcacgacgttcctccgagcacgcactgctaggacatgggttcaacctgccctgccccaacgctccccgcaccggccgtgtggtaaaaattctctcgtcatgcatgagcgcattttggcaatagcaaatgggaaaggcacgggtgcagtgacgacttgcgaaccatctgaacgtctaaaggatgaaccaagaaatgtgtcagaaaaaattgatgccattagagcaaagcttaagtccataagtgatggcaatatcaatgtctcggcctacgacacggcgtgggtagctcttgtgaagaggctcgatggaggtggcggcccgcagttccccaccagtattgactggatcaccaaaaatcagctgccggatggctcatggggcgacgacactttcttcatggttcacgataggattatcaacaccctagcctgcattgtggcccttaaatcgtggaacattcaccattaccagtgccaaagaggtctgtcatttattcatggaaatctatggagattaactgaggaagatgcggaatggatgccagttggctttgagataaccttgccaacactactagagatggccaaggatcttggcctcgacttgccctatgatgagcccgcgctccaagaaatatattccagaagagagctaaagctatccaagattcctatagatgcacttcatgccgggccaacaactttgcttcttagcatagaaggaatgccaggtctagactgggaaaggcttttaacgctccagtgtcccgatggctcctttatgtcatcacctgcccccacagcttatgctcttatgcaaactggggacaggaagtgccttcaattccttgaagaaattgtcgataacttcaaggagggagtgccctttacatatcctgtcgatatctttgagcgcttatgggtggttgatcggttggagcgactaggcatttcgaggtacttcacaagtgaaatccaagagtgcttggattatgtctacaggcacttgactcaaaaaggcttggctgctacaagggattgtccggttaatgacatcgatgacacagccatgggttttcgtctactgcggttgcatggctactatgtctctccaagtatgttcaagcatttcgagaaggatggagagtttgtctgctaccacggacagacaaacaaatcaatcacggcgatgtacaacacataccgtgccgcacaggtctccttccccggcgagagcgagcttgagcgggccgacgtctactgccgcgggttcctggaagagaagcgagcctccggcaattttggcgacaaatgggtcatccccaaggacttagctggcgaggtcggctacgcactggacttcccctggagagcaagcctgccccggatcgaagcaaggatgtatctggagcagtacggtggcagtgccgatgtgtggatcgggaaggtcctctataggatgcccctagtcagtaacgaactgttcctcgagaccgcaagggaagattttcgcagtttccagaaactctgccgactcgaatggaatggcctcagaaagtggtatgacaggaacaagcttgcagcgttcggcgtggagccaaagtgcgtgttgagagcctacttccaagccgcagccagcatcttcgagcccgaccgagcagcggagcgtctcgcatgggcgcgcacggcggtgatcgccgaggctgtttctttgcacttgcgaggcaaagcttctgatgttagcacaagggttcacggcgcaattagtgagctcgagaaccatggccgtgatgcactaactagggtaaatgaggatccaaagaaagccctcctgggtgcaattggtgaacttatcgaccaatcttcgtctgagaatgcttctcactgtcttcgtgaagcttggaagcagtggcttaggtcatggaccgcaaaggagggatttgaatcatgtggagggaatacagcattgttgatagttcgtacagtagagattgcttccggaaggtatagtttgaaggagcatgatgtgaaccgttcggagtatacccaacttgagaggctcacgtcttccatctgcagcaaactgacttctagagttcctgttcagaatggaggattaaagaaatctgagaattcagtcagtcaagtggatttggagatgaaggagctggctcaatctgttcttcagagctgcgactctatcgacagggtgaccaggcagacatttctccatgtggcgaagagctactactatgcttcttattgctcaactgaaacaattgatagtcacatctccaaggtcctattcgaggatgtcgtttcggaatagcacccagttccagtaaatgaagatgtcatatgaatcctctgataaaaaatctcttgttcatttgaatactacaagacaagagacttatacttgtattacatacttgtaccgctacagcc

SEQ ID NO: 94 - DNA, 1247 bp, Setaria italica
caaccatgggaagggctcccgctccggccaacgtccacgagatctgccgcgcacggcgtgccgacggccccgcggccgtgctcgccatcggcaccgccaacccgggcaactgcgtgctccaggaagacttccccgacttctacttccgcgccaccaagagcgagcacctcactggcctcaaagaaaagttcaagagagtttgccagaaactgggcgtgcagaggcgctacctgcaccacaccgaggagctcctgagcgcgcacccggagttcctcgaccacatcttctcgccgtccctcgacgagcggctggacatcgttaagaccgcggtgccggagctcgccgcggaggcctcccggaaggccatcgccgagtggggccgcccggccgccgacatcacgcacctcgtcgtcaccaccaactccggcgcgcacatcccgggcgtcgacttccagctggtcccgctcctgggcctccgcccgaccgtgcgccgcaccatgctctacctcaacggctgcttcgctggcgccgccgcgctgcgcgtcgccaaggacctcgccgagaacaaccgcggcgcgcgcgtgctcgtcgtctgcgccgagctcaccgtcctgatgttcaccaggcccgctgaggggcccttccagttccagacgctcatcaaccagggcctgttcggcgacggcgcgggggccgtcatcgtcggcgccgaccccgtggcgacccccgccgagcgaccgctgttcgagatcgtgtccgccgcgcagaacatcataccggagtccgaggacgccgtctccatgcacctcacgaaaggcggcttcggcggcaacatctccgccaggcaggtccccacgctcatcggggacaacatcgagcgctgcctcctggacgcgttcgagccgctcggcattggcgccggatggaacgacctgttctgggatgtgcacccgggctcgtcggcgatcctggaccagatcgacgccgtgctccagctcaagcccgagaagatggcggcgagcagacgcgtcctgagcgactacgggaacatgttcggcgtcacggtgatcttcgtgcttgacgagctgcggcgccggatggagaagggggaagaggagggggcgccggagtggggggtcatggtggcgttcggacccgggctcaccgttgaaacgatggtgctgcaccggtgcgtggcgcaggccacaggcgccacagcagaggagaaactgactgtggcttgatag

SEQ ID NO: 95 - DNA, 1894 bp, Setaria italica
cgctcgtttctcactcgctccctcccttcggctcatcgtccatccatcagtgatcagcccctcacgtctcgatcaagaccaccaccggccgtgccgatggtgatgatgccggcgtcgccggcgtcgccgcgcgcccggcggtccgtggtggcggagctggagggcgggctgctccggtgcgcggacaccttcccctacttcatgctcgtggcgttcgaggcgtccggcctgccgcggttcgcggcgctgctggcgctgtggcccctgctgcggctgctggagctggccggccggggcggcctggcgctgcgcgccgcggcgctcgtggccaccgccggggtgccgcgggccgaggtggaggccgtgtcccgcggcgtgctgcccaagttcatggccgacgacgtcgaccccgccgcgtgggcggccttcgggtcctgcgagggcaggcgcgtcgtcgtcgccacgcggttgccccgcgtcatggtggagcggttcgccaaggagcacctcggcgcgcacgaggtggtgggctgcgagctcgagtacagccgcctcaggcggtgcacggggctcctcaggggcggcggcgacgaggccgtcgcgggccgcgtccgcacgctgttcgccggcggcaaccggccggacctcggcatcggccggtcagagatggcgcgctccttcttgccattctgcaaggagcagctcaagccaccgttcgccgctgggggcgccgcgacgacggacgccccgccgttccggccggtcatcttccacgacggccgcctagtgtgccgtcccacgccgttcatgtccctcgtcatcctcctctggctgcccctcggcgcgctggtcgccttcgttcgcatcgccgtcggcctcatggtgcccatctggaccatcccccacatcgcgcccatcttcggcggcgccatcatcacgcacggccgcgcgcctgcccccgtccgcgccgcccgcgacgacgacggtggcggctcgccgtcgggcgtgctcttcgtgtgcacgcaccgcacgctcatggaccccgtggtccttgccaccgtgctcgggcgccgcgtggccgccgtgacctactccatctcccggctctcggaggtcctgtccccgatcccgactgtgcggctgacccgcgaccgggacgtggacgcggcgcggatgcgcgccgagctggcccggggcgacgtggccgtgtgccccgagggcaccacgtgccgggagcccttcctgctccgcttctcggcgctgttcgcggagctcagcgaccggatcgtgcccgtggcgatgaactaccgggtggggctcttccacccgacgacggcgcgcgggtggaaggccatggaccccatcttcttcttcatgaacccgaggcccgtgtacgaggtgacgttcctgaaccagctcccggcggaggcgacgtgcgcggcggggaagagccccgtggacgtggccaactacgtgcagcggatactcgccgccacgctggggttcgagtgcaccagcctcacgcgcaaggacaagtatagggtgctcgccggcaacgacggcatcgtcaacgccgccaagccggcggcgcccgggaaggcggcgtggcagggccggatcaaggaggtgctcgggttcctgctccactaaccacactagctgcagagagagacgccacggagctctggtcaaatctccgctcaccaatttgattgagttgtacttatacatgtacctagtcacgtaaagaatctactcatagtagaatacagttttagttttttcttacacaaaataatgtatttttcttttcattttactttaatctgtaaatggtttggcaaattttactggttgtaatcaaagatcagcgttgctccctcatcaaacagtt

SEQ ID NO: 96 - DNA, 1085 bp, Setaria italica
ggaacatgagggacatgggggagaagaggagacatggaggacatcatgtccatggtgttgggtttggagttggacatgccgagcacgacgagaagcacagggagccgaagaagctggacatgagcggcatgtccatggacaccatcccgcatctcagcatgcctcttggcaacatcaccaccttggatctctccaacaacaacctacagaggattccggagtccataatcgcgaggcttctgaacgtggtggtgctggacgtgcggtccaaccagctcaagtcgctgcccaactccatcggctgcctctcaaagctcaaggtcctcaacgtctccggcaacctcctccaggacctgcccgccaccatcgaggagtgccgcgctctggaggagctcaacgccaacttcaaccagctgacgcggctgccggacacgctcgggttcgagctccacagcctccgccgcctctccgtcaactccaacaagctcgcctacctcccctcgtccaccgaccacatgacggcgctccggtcgctggacgcccgcctcaactgcctccgctccctccccgacgggctcgagaacctgggcagcctcgagaccctcaacgtgagccagaacttccagtacctgcgcgagctcccctacgggatcggcctccttgtctcgctccgggagctggatgtcagctacaactccatctccgcgctcccggactccatgggatgcctcaccaagctcgcccggttcagcgccgtcgggaacccgctggtgtgtccccccatggacgtcgtcgagcagagcctcgacgccatgcgcgcatacctcagcgcgcggatgaacgggacggacaaggacaggaggaagaagaggagctgggtgcccaagctcgtcaagtacggcaccttcacggcggggatgatgacgcccggccgcgccaccaaggtgcacggcaacgccgagggactcctcatgtcggattaccggtcgctcaacggcggcggcatcgcgtcgccggggttcctcagcatgctgtcgccccgccggatcttctcgccgcggaggaactcgaccaagcattaatag

SEQ ID NO: 97 - DNA, 788 bp, Setaria italica
aagccatggcttcccgtgccttcgctgcgctgctcaccgtggtagcatttgtaggctttgcttcagttccccgtgctctggcaactgatccgacccagctccaagacttctgcgttgctgataacaacaaccaagtgttggtgaatggggtggtgtgcaagaacgcaaaggtggtgacggcgaacgacttcttcttccacataatgccccagacccctaacgcgcagggatcgggggttgcggcggtggcggtggacaagctcccgggtctgaacacgctgggcatctcgctggcgcgcatcgacttcgtccccggcgggcagaacccgccgcacacgcacccgcggggttccgagatcctgaccgtgatccagggcaccctgctcgtggggttcgtgacctccaaccagctgctgaacaacacgctcttcaccaagcagctggtggagggggacgtgttcgtgttcccgcaggggctcatccacttccagctcaacaacggcaagagccccgccgtggcgatcgcggcgctgagcagccagaaccccgggaccatcaccatcgccaacgccgtgttcgggtccaagccgcccatctcggacttgatcctcgccaaggcgttcatgctcgagaaggacaccgtcgactgggtccagcaggcgttcggcgcggccgcggtcggcggcggcggcggcatgccgggcggcggcggatatcccggcggtggctaccccggcggcaacggaaccggcggcgggtaccccggcgggccagggtacccgtaatag

SEQ ID NO: 98 - DNA, 2143 bp, Setaria italica
acgcacaccagccacagcatgatcggatggagcatccgcagcagcacgtggtccaggtcgggcgtccgccctcgcgtggctcgtcttcagacgatgccgcacgcttggtcggcatgtgccctgctctctatcgcgctgccaaccgagggcgcacggaggaggtcatggcgctgcttctgcaacaacacgccgccggagctgcggccaaagatcgtcaagacactggcattattcagcatggacagtgtgacatactcgaagtgagcgcggagggtaacaccgtcattcacgtggctgcagagcaagggcaccacgagttgatccaggagctctacgccaggttcaataacatcaagggcctcctctctcaccagaactcagcgctggacacgccgttgcactgcgcgtcgagggcggggcacgtcaggacagtggccatcctcatccagcttgcccaggactactgcggcgagagcatcctgggatgcaagaacaaggccggcgacacggccctgcacatggcggcgaggcacggccatggcgcggcgacggaagtcctggtctcggtggcgcccgagctggcggccgaactgaacaacgccggcgtgtcgccgctgtacttggcggtaatgagcgggtcggtgcaagcccttagggccattatcgcgtgcagggacgcgtcggctgtcgggccgagcttgcagaagcagaacgctctgcacgctgccgtcttcaagagctcagtaatggttgacctgctcctggaatggagaccggctctggcggaacaagtcgacggcagcggcagcagcccgctccacttcgcgtcgtccgacggagacagcgacgtcgtgcgcgcgatcctgcgagcggcgccgccgagaacggtgtacaagaaggactccggtggcctctcggccctcttcgtcgcggctcggatgggccaccaccgcgtcgtcaatgagattctggagtggtgccccgacgccgcggagctccgcgacgacaatggcgggaccttcgtgcacgccgcggccaaggagaagagcgactcgttcgcaaaggagaagcaccgccactcggtcgtatctctcgcaatcgagaaccccatgctgcgcggcctcctggacgtgcaggacaaggacgggaacacgccgctccacctcgcggtggccgccggcgcgccgcgcgtcgtggatgaactgctacggaagggcaaggtgcgcgccgatattctgaacaacgacgggcgcacggcattggacctcgccgccggatcgacaagtttcttcacgacggtaaaactggtggtgatgctggtcggattcggtgcacagctccggccgcaaaggcaggaccatctgaagctgtggagcggccacgacagcatagcgaaggatatagagagaacatcggacagcctcgcggtggtggccgtgctcatcgccaccgccgcgctcgccgccgggttcaacgtgcccggtgggtacggcgagaaaacgggcgaggcgaacctcgaggacagactcgtctttaagggcttcctggtcctggacatttccgcggtggcagcgtccgttgtcgcggtgatcctgctcgtctacgggaaggcgtcgcgctccgctggctcgtggaagagcttcgccgcggcgctgcagtgcatgtgggcgtcgctcatctgcctcatgctggcgttctacgctgtgctggatgctgtgacgaccacgaaggcggtctatcgctacgggtttccggtgatcttcgcgtgcatcgttgtcttgagtatcttcatcatgtcgcggatcgaaccggtgaggacgtcgctcacggtctggagattcatgtgtcaccgtgcgaagtcgtcgcgccacacaggctggagattcatgtgccagcagcgttgtcacttgaaaggatggcatgctgtccagaggcagtttccgctcgccggtgcttacgtgctcaacttgtgtctgtttacagctacatatgttctaatagggattgtaggttttgtaggcatctcttggttagagcagctccagcgtatgttttaagagggtgctccaaataaagcatcagtatcactttttctaggcgccgaaccccggagggcacggtgtcaggaagcaccaacttagca

SEQ ID NO: 99 - DNA, 1781 bp, Setaria italica
ggatccctgctatggggaagatctccatggcggcatccatcctctggctggcccttgtcgccctggccgtcgtcggcgaggcggccatcgtcgagcacacctttgttgtgcatgagatgaacatgacccacctgtgcaactcgaccaaggtctacgtggtcaacggtcagctccccggcccacagctggacgtcgtcgacggcgacacggtggtcgtccacctcgtcaacgagctcccacacggcgtcaccatccactggcacggcgtccggcagctccggagctgctgggccgacggcgccggctacgtcaccgagtgccccgtcgcccccggcggcaaccgcacctaccgcttcgacgtctccggccaggtgggcacgctgtggtggcacgcccacgtgacctgcctccgcgccagcgtccatggcgccatcgtcgtccgccccaaggacggcaggtacccgttcccgaccccggcgagggacgtgcccatcgtcatcggcgagtggtggacgctagacctcgtcgagctcgaccgccggaatctcgacggcaacttcgaggacgacccgctgtcggcgaccctcaacgggaagctcggcgatctcagcaactgctccggcgtaccggaggagagcttcgtgctcgacgtcgagcccggcaagacctacctgcttcggttcatcaacacggcgctcttctccgagtacttcttcaaggtcgccggccacacgttcacggtggtcggcgccgacgccaactacctgacgccgttccggacggacatggtgaccatctcccctggcgagaccatggacgtgctcatggtcgccgacgcgccgccgggactctaccacatgaccgccgtcgccaaccagccgccaccgccggacctgcagatccgcgcgctgacctcccgcggcctggtgcgctacgccggcgtgcgcgccgacaacggcggcgcccccgtgccggcgcccctcatgcccggccagcacgacaccatgccgtcctactacttccgcggcaacttcacggggctcgcgttcccgtcgcgccaccgcgttccggcgcacgtcgacgagcgcctcttcgtcacgctagggctcggctccatctgccgcggcggcaagaaggactgcaagctccgccggagcaacgagaccatcacggtggcgaccatgaacaacgtctccttccaccaccagacggcggcgtcgctgctcgagcgccactacgacggcaccggcgagggcctgtacacggaggacttcccggaccggccgccgcggccgtacaactacaccaacatggacctgatcccggtcgggccgctggaggaggtgctcgagccgacgaccaaggcgatcagggtccggcggttcaagtacaactcgtcggtggagatcgtgttccagagcacggcgctgctgcagagcgaccccaaccccatgcacctccatggacacgacttcttcgtgctcgcgcaggggctcggcaacttcgaccccaagaaggacgtcaagaagttcaactaccacaacccgcagatcaggaacaccgtgcacgtgccaagggtaggctggaccgcaattcgcttcatcgcagacaatccagggatgtggtatttgcattgccactttgagttccacatcgtcatgggcatggcgacggcgttcatcgtggaggatgggccgacgcctgagacgagcctgccaccaccgccagcggacttcaagagatgcggcaccaatggtttcagtaagccttagtaggaattc

SEQ ID NO: 100 - DNA, 1861 bp, Panicum virgatum
gaggccattctcatcgcattgcatttcgttatacgtacgtggtagcatcatactatatatcgggataatgttaatgaacgagcaggcgaccggattaccacgtgtcaccaacccatgcaccaaaaagtccccaccccagaacaccggcgtggggcagacgagatctcgagccggagaacgcgcgcacacactcacgctgaaaaagaaggtcgcatttacgttttaagaaacggccgtccgagtcagcacagcacggcggaagccagcgaaggaacgttcggttccgctgctgcggctggtgagccttagcccttaagcttctcgccggccggccccctccaccctgctataaaagtcgtagctacccgcgcagccgtcaaccccgatcgacgtacttgatcgacatcggcacgcccccggtctccgacgcgatcacctactacgtacttggatatatggacgcgccggcggcggcgacgggtggcgcggagatctaccggctgccggaggagtgcgtggcgtacgccatcccgctggcgacgcccggcgacgcgtgccactcgcccgcggtgtcgccggcgttccgggccgccgcggactccgacgccgtctgggaccggttcctgccgcccgaccacgccgccgtgctggcgcgcgccgacgagcccgtcgagtgtgagtccaagaaggagctcttctcgcggctctgcgacagccccgtcctcctcgacggcgccaccatgagctttgggctggagagacggagcggggcgaaatgcttcatgatgtcggcgagggcgctgagcattgtgtggggagatgacccgacgtgctgggtatggagcgctagccttccgggatccaggtttccggaggtcgccgagctcgtcgacgtgtgctggctggagatcagcgggaagctgagcctctcgctgctctccccggggacaacctacgcggcctacctcgtcttcgccatcgccgacgactcctacggccttgagtgccacgtcgccatgctgccacccaaggccacagtcacggtcgtctccgggagcagcagcaagaagccgacgacctctaccgagcacgccatctgcctgcagcacatgcagggcgaggaggaggccgccatgcaccggcggaagcagcagtacatgcgcctccgcaagggctacggccgcaagatggtgacgagggaggccgacccggacatcaggtgcccgcggcggaggggcgacgggtgggcggaggtcgagctgggcgagttcgccgtggccggcgacggcgaggacgatggggtggtggaggtgaggctggaggaggtggatagccggcggtggaagaggggactcatcgtgcaaggcattgagataaggccaattcccgactctgacgccgtctggtcccgcttccagccccgcgatctcccgccgctcgccgatggggagctctccggccccgcgccgccgtccgagaaaggccaattcctccgcctctgcaatcgtcgcgttctgctcgccgatgacctcatgagcatgtggttggacagggagaccggcgccaagtgctacatgatctcggcgagggcgctgcacatctcctgtggaggcacgccggagtactggcgttggacccgtctccccgaatccaggttgaggttcaccgaaattgctaaccttcggaatgtttggtggctcgaaatacggggcaggatacacagcaaaatgctctctcaagactctacttatgcagcttacattgtgttcaaaacttatcgcgatggtggttggattatccaccccacggaggcatcaatcacctctagtgcaggaagcaaatcaactcgcaaagtctgtct

SEQ ID NO: 101 - DNA, 2214 bp, Panicum virgatum
acgctagtgaccctgaagaatctaaggaggcctttgaccgcgcgattagagaatgggtactgtagcatcaatgtagcaaatcatcgattaattaccgtcattagattcgtcacgaaaagttacacccatctctaaaatttttttgcaaatagacttcattcagtccttcatgcggaaaagattctcttctaacgttaggattctagcgcgcatccaaacgggccctataaaagtcgtagtggcggcggctatgtacccggccagcgcagccgtcacccccgacgtgatcgatcatatcgccacgagcacctacgtacaattggatatatggaagcggcggcggtggcggcgggcggctcggagatctaccggctgccggaggagtgcgtggcgtacgccatctcgctgacgacgcccggcgacgcgtgccactcgtccgcggtgtcgccggcgttccgggccgccgccgactccgactccgactccgactccgactccgacgccgacgccgtctgggaccgcttcctgccgcccgaccacgccgccgtgctggcgcgcgccgacgagcccgtccagtgcgagtccaagaaggacctcttctcgcggctctgcgacagccccgtcctcctcgacggcgccaccatgagctttgggctggagagacggagcggggcgaaatgcttgatgctgtcggctagggcgctgagcattgtgtggggagatgatccgacgtgctgggtatggaccgctagccttccgggatccagcaggtttccggaggtcgccgagctcgtcgacgtgtgctggctggagatcagcgggaagctgagcctgtcgctgctctccccggggacaacctacgccgcctacctcgtcttcgccatcgccgacgactcctacggcctcgagtgccacgtcggcatgctgccacccaaggccacagtcaccgtcgtcgtctccgggtccgggagcagcagcagcaagaagccgacgacggcgggggttgcgatgacggcgacgaccaagacgtccaccgagcacgccatctgcctgcagcacatgcagggcgaggaggaggccgccatgcaccggcggaagcagcagtacatgcggctccgcaagggctacggccgcaagatgatgctcacgagggaggccgacccggacatcaggtgcccgcggcggaggggcgacgggtgggcggaggtcgagctgggcgagttcgccgtggccggcgacggcgaggtcgccgacgatggggtggtggaggtgaggctggaggaggtggatagccggcgctggaagagggggctcattgtgcaaggcattgagataaggcccaaacacgccgcttcctagcgctatagagccggctagctgctagaggatttaattgtttttaatctaggggagaattaattattaagaagtggcgatgaattaattaggtccggtccagacagtaacagtcgatcgactctcgaccagattcttttctggactgacgcaacagcttaaaaaatcgagctgctgatcaagaatggtgtgtcgttgcgtcgtcagtgcttgcatgcagactactgcgtcgtcgtacgtgctgctgcaaagcgcttacgggacacgcatgcatgcagaacggcttgttaatgacattgcatgcatgcatggcttatatagctagtttaataattatatatagagagatgatcaactcagggcgacagccgaatagcagatcctgctgtggtacgtggtccagttggtgatccaagggccaaaatgagattaattattgcaaatataatgtactagtatttgttgtaatgttaattattccacacatattttaacgtggttgttcgttgttttgatcactctgtaactgctggtgaatgtcgtcaatttatcgatttctagtaaattattattgtccggtgaagcatctgctggcatcgtcgaatgattgtgattaagagacgaaccggtcgtcgagcgaggttgaaacacctgattcctgttgccgccggccgcggtatgtttaggaagagtttttttttttgaatcagtttaggcagagttttagttttgcagtagtgcgcccggcaactacgtcttgtgttcgctttgaacgtgttttgattgggcaaagcctcctgatttctgttgtgtggtgtggggcttcgctcttacttggtcaggtccaccgatccaaga

SEQ ID NO: 102 - DNA, 3407 bp, Hordeum vulgare
gcggctcccggcgctcacgtcgctcgacctctccgacaactccatcaccggcgcgctccccgccgccgacctcaaccaatgccgcggcctcctgcacctcaacctctcccacaacctcatcaccgggccgctcgtcctctccgggctcaccaggctccgggtgctcgacgtgtcggggaaccggctggacggcgccgtcgccgtcaacttcccggcccccccccccccccccccccccccccccccccccggacggcgccgtcgccgtcaacttcccggcgatatgcgccgacctcaccctgctcgacctgtccaccaacaatctcacgggcagcgtcaccggcctgttggacggctgcgccaggctcgacaaggtcgacctcagctccaacaacttcaccggcgagctctggccgggaatcgcgagattcagggaattcagcgccgccgagaacaacctcaccgggagcgtcccatggagcacgtttcctgatggctgcaggctccaatccttggacctctccgcgaaccagctggtcgggggcttcccggattccatcgccaattgcacgaatttgacctacatgtcgctgtgggggaataatttcaccgggaagatacctgccggaatcgggaagctcgccgtcctcgagacgttgattcttggaaaaaacaagttcgatcggcagataccgccggacctgacgaactgcgggaggcttcagttcttggacatcagtagcaacatgtttggaggcgacgtgcaacagattttcggcaactttacgagcttgaagtatcttgtgcttcatcacaatgaatacaccggcggcatcgtggcctccggcgtcctccggctaccgctgctcgctaggctcgacctcagcttcaaccagttcacgggccaactccctccacaggtggccgacatgaagagcctcaagtacctgatgctcgcagagaacaacttctccggcacgataccgccggagtacggacggctcgccgagctccaggctctggacctgtctaacaacacgctctcaggtgtgattccggcgacaatagggaacctcacgtcgctcctatggctgatgctcgccgggaaccagctctccggccagataccacctgaaatcggcaactgcactagcttgctctggctgaacctggccgacaacctgttgactggcaggattccaccggagatggcagagatagggaggaatcccggcccaaccttcgccaagaaccggaatgatacgagcgtgctcgccggctccggcgagtgccaggccatgaaacggtggatcccggcgagctatcctccgttcagcttcgtatactccgtcatgactagggagagctgccgcaccatatgggaccgcatgctcaagggctacggaatcgtcccaatctgcaccaactcgtcgtcgccggtgaggtccaacacggtctccgggtacgtgcagctgtcagggaacttgctctccggacagataccgtcagagatcggtgcaatgcggaacctcagcttgctccacctcgacggcaaccgtctcacggggcagctgccggcggagatcggccgacttccgctcgtcatgctgaacgtctcgaggaacaacctctcgggcccgattccgtcggagatcggcgacattctgtgcatcgagaggatggacctgtccttcaacaacctctccggcgagctcccggcgagcctgttcaagctcaccgagctgtctatgttcaacgtgtcatacaacccactcctctccggcaatgtctccaccaccggccagttcggcaccttcgacgagcagtccttcctcggcaatccgctcatttcattgcatcagggtggagctgccggtaagcagcaaccaccacgaccggaagctgccgatgctcctggagttaggacaggcggcataccaagaaccatcgtcatgtggctgcttttctccctcgtcatcgccttcatcgccggcaccgtcgtgttcgcgatcaccagcctacgcgcccggttcccggtggaccaggagccggagccggactcgttctcctgcgagcactccaagggcaagtacgcgttcggactgtcctcgtcgccgccgtccgggtcgtcgtcggccacggggtgctcctcctcgacggagggggtgaaggtgttccggctggacaagacggcgttcacctaccgcgacatcgtggctgccacgggcaacttctccgacgaccgggtgatcgggcgcggcggctccggcgtggtgtaccgcggcgtgctccccgacggccgcgccgtggcggtgaagaagctctcgaggccgcgcgacggcgtggacggcgacagcgagcgcgagttccgcgccgagatggaggtgctggccgaccggatggggttcacgtggccgcacccgaacctggtgacgctctacgggtggtgcctctccggcggcgccaagatactggtctacgagcggctcgacggcggcagcctggaggcgctgatctgcgacacggcggcgttcgggcgggcggcgcggctggacgcggccgtgggcgtggcgcgggcgctggcgttcctgcaccacgagtgcgtgcccgccgtggtgcaccgcgacgtgaaggccagcaacgtgctcctggacggcgaggggcgcgccaaggtgacggacttcgggctggccagggtggtccgccccggcgacacccacgtgagcacgatggtggccggcacggtcgggtacgtggcgccggagtacgcgcagacgtggcgcgccacgaccaagggcgacgtgtacagctacggcgtgctcctcatggagctcgccacgggccggcgcgccgtagacggcggcgaggagtgcctggtcgactggacccggcgcaccgcgaaggagggccggaagcagcaaacggaggatcaaaagacggccggcggcacggtgtcctgggagctgctggcgctgggcatgcggtgcacggccgacgcgcctcacgagcggccggacatgccggacgtgctcgccgcgttgctcgacatcgctggtgccgcgaacggcgacgcgggctgtgcgtactgcaggagctcggagcacagcggcggcgagcaaacaagttctgtgagataggtgtccattcaaggttacaggagacaaaattcattacaggaaacaaaattcattccttcgtgtacaaaaatgcggttgcttagttgagcctgacgtccattggaaccagggcagggcgcatgtacgtaacgtaggtaggagcaaagacaagaagcaaagtttttggtagcgcacaatgcagatacagttttggcttggtgtagtggcaaagcaacttgatcgcgtgcgtgcgtgcgtgcgcgcgcaacaacctgctggttttgtttggct

SEQ ID NO: 103 - DNA, 975 bp, Sorghum bicolor
caacaccccacatcacaacacaagtacacaacgcaagaaaagtcgatcgaatccaactccaaccttgggttttgcttgcacacgtcgacgacaccagctcctggtctccgagtccgagagcagaggcggcggcggctgtctggacctctggtcaacccagcttcgcttcatggccatggaggtccagggcaccaggcggccgccgcaggacgccggcgtgaaggtcaagttcatcgagacgcagttcatcagctccgacgccgccagcttcaaggccgtcgtgcagcgcctcaccggcaagtcccccgcccccgcctcgtcgcagacggcggctcatcaggcgccggcggcaccgcacccgcaaaggccgcgcccgtgccggccggccttcgttggcgccgggcagcagcagcagcaggctgccgggtggacgatggatcaacaggctactgccggctacctggcgatgatgccggcgccgaagcaagagccgctcgcggcggcgtcgaggctggaggacatgaacgagctctgcgacttcgcagacctgttctacaccaccaccgccgcgagcgcgcgccgcgacgtcggcggcagcgccttcccttactgaaacgacggagtgtggtgtgtgcgttgcgttcgccttgatgcatgtttgttttgagaatgagtcacaactcacaagcgcggatgcttgcagttgcagtttgccattgccaatttgccatgtcacagtcgcagtgagttttgggcacattaatgatccaggagtgcaaggagagatggattgtctgtcaaccgctgtactgttaagctatatatgtcatgcagctcccatactgtattgttaattcaagagttgtgaaatgctggcatgtcaaatttgtaatgtgctaaaaacagaccatatggtgcaatatgcatgcatagattttttttccgtacatataacatatccagaggttatcaaat

SEQ ID NO: 104 - DNA, 2415 bp, Sorghum bicolor
gacgagcgtagtgattcctatatctaaataagaggagagcatatgaaaaatatataaccgattcttttgttgccacaggtagattatggtataaattcttaacaattatcactcacctggattgcctgccgctgccgcctcccgcagacagcggggcccacctgatcacctactcccgctcccgctcccgcaagagatcatcggatgcggatccatatcaaccacagttgacagcagctccagccgccatgaccatgaccatgccatccccgtcgccgctgcgcgtgctgtccaggcgcaccgtcacgccgccgccccgcccgcgccaccgaatcccgctcaccacctgggacgtctccatgctctccgccgactacatccagaagggcctcctctactccagaccgccattccgtctgctcgaccacctcgaggccgcgctcgcccaggcactcgtctcctattaccccgtcgccggccgcttcgccacggaccagcaccgcgacgccgacggcaacgtcgttggctgctccgtctccatcgactgcgacggccagggcgtcgacgtcatccacgccgtcgccgacggcgtctccatcgccgacgtcatccctgccgacgccgacgtcccgcgcctcgtgcgttctttcttccccctcgacggcgccgtcaaccacgacggccaccacctacctctcttcgtcgtccaggtcaccgacctcaccgacggtgtcttcctcgccttcgtctacaaccacgtgctctccgatggcactgccttctggcacttcctcaacgcctgggcgggcattgcgcgcggccgcagcctctctgtctcccctcctccgcccttgttggagcgctggtcgcccgaggccgacgggctgacgccgcggccgcccccaccgccaccggtcgtgcttccctatcccgacctcacggggttcatcgagaggctttccccgccgccgctgcgcgagcggatgctgcacttctcggcggagtccctggaggcgctcaaggaccgggcgcggcaggagctcctggcggccggcgacgtggctggcgcggccgccgtgaccaaattccaggctctgtcctcgctggtgtggcgctgcttcacccgcgcgcggcgcctgccgccccaccaaacaaccttttgccgagccgccatcaacaaccgcacgcgcctccgcccgcagctgccggccgagtacttcggcaacaccatctacgccatctccacggaggcggtgagcgcgggggatctgctggcgcgcggccacgggtgggcgacggcggccgtggggcgcgcggtggcggcgcacacggacgccgacatccgggcgcgcgtggcggcgtggatggccaagcccgtcgtgtacacgctcaggtacttcgaccccaacggcgtcatgatgggcagctcgccgcggttcgaaatgtacggctgcgacttcggctgggggccgccgctggcaccgcgcagcggcagggccaacaagttcgacgggaaggcgtcgctgtacccggggcgggagggcggcggcagcatcgacgcggaggtggtgctgacgccggagcacatggcgctgctggagcaggacgacgagttctgggcggccgtttcgccggacaaaccttgactgcccatggccgatcaatgtcagacagacagacagacagacagacagacaaacagcaaaaggatgttgatgcgtttggttaaggattaatcctctgataaacgaatcgaaataaatatgagagagagagagggcaggccggggtactctttccagcgaaaatgtttgttgagggaaatgaacgaaatggatggatgttgatgcgcactgcagaaagattgcatcgcgcggcaagcttttgattgtgcttctgatttctgaagatgatgctgcccctggtgtttgaaattgaatgcaacctaccagatgtgtgttgacagtggcaggtgatcttctgctgagtgcctcattgacaggtataggataacctgcttgaaatcaaaggagacatggaacgtctgtccattgcctcatcaattctgaaaggccttcagacttccagtagaagtttttactctattttagcagtgaccaatgtaaaccaaaaaaaaaaaagtatagtctgtttagcagagaggatcgctggtaaaagatttgcacactcagaataattgtttttacttagcaagtaaccctttaagcttataaatgaagatgtgtttggcaaaaactcttcagaagtactgtttttaatttaagtttaaaggaatgacaaatagtacagattctcaatgaaaactgagatatttccacaaagttatgaatgtcaagatcaatgcctggggctaggaacttttattccaaatagtggctcccaaattctctacgg

SEQ ID NO: 105 - DNA, 1665 bp, Triticum aestivum
ccaaatcttttcttatccccaacccaccaccaacaccatgccgtcacggtcgccgtccatggtgcgcgtcgtgtcgtctccacggtgaagccgccgccgcgcccgcgcgagcgcatcccgctcacctcctgggacgcctccatgctctcctccaactacatccagaagggcctcctcttccacaggcccacctcatgctccccggtcaacgccgccgaccacctcgccgccgcgctcggcgacgcgctcgtccactactaccccatcgccggccgcttcgccacggagcagcacagggacgaccgcaccggcgccgtcgtcggctgctccgtccacgtcgactgcgacggccagggcgtggaggtcgtccgcgccgtggccgacggggtgaccatggcggacgtcatcccgcccgacgccgacgtgccgcgcggcgtgctggcgcagttcttccagctcaccgacgccgtcaactacggcggccaggagcagccgctgttcgccgtccaggtcaccgacctcgccgacggcgtcttcgtcggcttcgcctacaaccacgcgctctccgacggcaccgccttctgggacttcgtcaactactgggccgccctcgcgcgcgccaggctcggcctcgcccccgcgccaccggcggcgaagccctcgctcgagcgctggtcgcccgacggcggcccggcggggccggccgtgctgccgtgcgccgacgtgtcagagctcatcgagcgggcgccccggctgcagctgcgcgagcggatgctgcacttctcggccgactcgctggcagcgctcaaggagcgcgcgcgagaggagctcctggccgccggcgacacggcgggcgcggccgcactaaccaagttccaggcgctctcctcgctcctctggcgctgcatcacccgcgcgcggcggatggcaccggagcaggagacgacgtgccgcgccgccatcaacaaccgcgcgcgcctccggccgcagctcccgcaggactacttcggcaacaccatctacgccatcgggaccgaggcaacgcgcgccgcggacgttctcaaccgcgggcacgggtgggcggcggcggccgtggggcgggccgtggcggcgcacacggacgcgtccatcagggcgcgcgtggcggcgtggaccgccaggcccatggtgtacacgcaccgcttcttcgaccccacgggcaccatgatgggcagctcgccgcggttcgacatgtacggctgcgacttcgggtggggcagccccgtggcggcgcgcagcggcatggccaacaagttcgacggcaagacgtcgctctaccccggccgcgagggcggcggcagcatcgacgccgagctcacgctgtcgcccgagaacatggcggccctcgaggaggacgacgagttctgggccgccgtgaccccggacgcgcccgtgccggcgccggcgccggagaagaaggccacttgaatcatcgtccatcgatgtcaacaccgtacctctgctcttcttgattctggttggtgccgatcaccaaaatatgctggccgattttcattttgttcgtgtgattgattaacccaatagcaatatgcattgtctaattcttggctttgaatgacaacaagtgaaagatgttggatttgtgaaaagaaatttgctctgatt

SEQ ID NO: 106 - DNA, 1689 bp, Triticum aestivum
tcttccacctccgtaccgtgactttgttgctccgtttggatcaatcggccggagctctgcatcacctagccggggagcagagcggataagctaagcttcggcggccatggggaacttttgtgtgtgcatgggcggctccgccaagtgcgccagcgcctccactcccttccaatcaaaggtgaacccgaggagcagcacctccaactccaactccaaggcgtcgcgccggagcagctccggcccggagaagccgccgcagccggcggaggcgccgacggcggcgggggaggcgcaggcggtgccgccggcgtcgctcaagtcgttcagcatggcggacctgcgggcggccaccaagaacttcggctccacgtcctacctgggggagggcgggttcgggtgcgtgtacaaggggtggatcgacgagaccacgctcgcccccgccaggcccggcgccaccaacgccatgatggtggccatcaagaagctcaagaaggagagcttccagggccaccgggagtggctcaccgaggtcacctacctcggcgacctccaccacgacaacctcgtcaagctcgtcggctactgctccgactccgacagcaacaagctgctggtgtacgagtacatgccccgcggcagcctcgagaaccacctgttccggcggggcagccagccgccgctgccgtggtccacgcgcttgtccgtcgccgtcgacgtcgcccgcggcctcgccttcctccactcccgcgacgtcatcttccgggacctcaagtcctccaacgtgctcctcggccccgaccaccgcgccaagctctccgacttcggcctcgcccgggccggccccaccggcggcaagacccacgtctccacccgcgtcgtcggcacgcgcgggtacgccgcgccggagtacgtcgccacgggccacctctcggccaagagcgacgtctacggcttcggggtggtgctcctggagctcatgaccgggcggcgcgcgctggacgaggcccgcggcgtggcgtcggagctgctggtggactgggcgatgccgatgctgcagggggagcggcgcaaggtgatacgggtcatggacaccaggctcggcgggcagtaccccaagaggcaggcgcaggacatggccgcgctcgcgctccgctgcctccagaacgaccctaagagccgcccctccatggccgacgacgtcctaccctccctcgagctcctgctgcagccaagcgccgccaagtccttctcctcctcctcgacgacgacgacgtcgagatcgccggccgcgtcggcggcgctggtgcacagaggccaccgtcgaaacaaagcctagctagctagctaggagactcggttcatttaattactgtgttcaattagtgtgttcgtctgtgcagtagaatagaatttgtagattggaaattggacatcttttctctctctcgtttcagccgtttggaatattggaagcatgagcgtacgtacatttgggtacgggtcaagattttctttcctcccttctgttgggaattttttttgtcaagttattaggagtttattagaagtagctccggactgcacagagattggacggcgaccatccattgtctcagtgtagccgtgtacacatcactggcttgcaaattgcataattttcgccatgctggcagcatcaacgttttcagg

SEQ ID NO: 107 - DNA, 1671 bp, Hordeum vulgare
aagtcatcgtattcgtatgcgccaaccggacgaacctctccggtcgcttccccggttccccctatatcccttcttcctcctcgtctcccacctccgtatactgtgacctccttgctccgtacgtctggatcagctagccggagctccgcaccagctagccggccggccatggggaacttctgcgtgtgcatgggcggctccgccaagtgcgccagcgcctccacccccttcgaatcaaaggtgaacccgaggagcagcacctccaactccaactccaactccaaggcgtcgcgccggggtagctccggcccggagaagccgcaggtggcggaggtgcaggcggcggcggcgggggaggaggtggcggaggtgccggcgtcgctcaagtcgttcagcatggcggacctgcgggcggccaccaagaacttcggatccacgtcctacctcggggagggcgggttcgggtgcgtgtacaaggggtggatcgacgaggccacgctcgcccccgccaggcccggcgccaccaacgccatgatggtggccatcaagaagctcaagaaggagagcttccagggccaccgggagtggctcaccgaggtcacctacctcggcgacctccaccacgacaacctcgtcaagctcgtcggctactgctccgactcggacagcaacaagctgctggtgtacgagtacatgccccgcggcagcctcgagaaccacctgttccggcggggcagccagccgccgctgccctggtccacgcgcgtcgccgtcgccgtcgacgtcgcccgcggcatcgccttcctccactcccgcgacgtcatcttccgggacctcaagtcctccaacgtgctcctcggccccgaccaccgcgccaagctctccgacttcggcctcgccagggccggccccaccggcggcaagtcccacgtctccacccgcgtcgtcggcacccgcggctacgccgcgcccgagtacgtcgccaccggccacctctccgccaagagcgacgtctacggcttcggggtcgtgctgctggagctcatgacggggcgccgcgcgctcgacgagtcccgcggcctggcgtcggagctgctggtggactgggcgatgccgatgctccaaggggagcggcgcaaggtgatacgggtcatggacaccaggctcggcgggcagtaccccaagaggcaggcgcaggacatggccgccctcgcgctccgatgcctccagaacgaccccaagagccgcccttccatggccgacgacgtcctgccctccctccagctgctcctccagccaaccaccgccgccaagtcctcctcctcctcctcctccttgacgacgacgtcctccagatcgccggccacgaccatgacgacgccggtgcaaagaggccaccgtcgtcaccatcgctagctagccagctgggaagagactatgttcatttaattattgtgttcaattagtgtgttcatctgtgcagcaatagaatagaatttctagattggaaattggacatctttttctttctcgtttccgccgtttggaatatttttctttttcgaaatggccgttggccgtttggaatattggacacacgaacatatgttggaatttttttgttaagagcttgtaaaacaatcttatgagagagagaaagtagtatattgg

SEQ ID NO: 108 - DNA, 1460 bp, Panicum virgatum
tcgccctgtcgcgctcgcgccccctcttcggggaagcttcctgctttgaccacgtttgggttcagggttctcgccctttcttttttcctatcagagcgcgaccccgctcgctgtcgcctcaagcctcacctagtcatctccgggagagtataaataaccccgtcccgtccggccctcccccagtccaccacgcagcaaccacccttactccgacgacgagagccacacagcgacgagctccctcggctgctaggtcgcctccgcctccgcctccgcctccgcctcgcaagcactcgaacgcgcactcggacgttaacggcggccggccggcggggggagagagagatggggcgcgccccgtgctgcgagaggatggggctgaagagggggccgtggacgccggaggaggacaggatcctggtggcgcacatcgagcggcacggccacagcaactggcgcgcgctgcccaagcaggcgggcctgctgcgctgcggcaagagctgccgcctccgctggatcaactacctgcgcccggacatcaagcgcggcaacttcacccgcgaggaggaggacgccatcatccacctccaccacatgctcggcaacaggtggtcggcgatcgctgccaggctgccggggaggacggacaacgagatcaagaacgtctggcacacgcacctcaagaagcgcctcgagcccaagccagcgagccagcagcaggcggcggcgcccaagcgcaagcccaccaagaagaagcagcagcagcagcctgatgcggaggtcgtggtgctcgacggcccgaccagcatcaccgcgcccgtgtcgccggagcagtcgtcgctctacacgtcgaccaccacctcctccgccgactgctcggcggcgtcgtcgctggacaacaacgcggacagcttcacctcggaggaggactaccggatcgaggacagcttctggtccgagacgctggcgatggcggtggacagctccggtgactattcttccgggatggagagggaggacgcccccgccgcgccggcggccaacgacgacatggacttctggctcaagctgttcatgcaggccagcgacatgcagaataacctgctccagatttaggcggcgtgctagctagatgcatgctccatcgatctgctgatcatatatattctttgcctcacaattctttgaatctttgttctgctccgtttcggtgggtatgtacatccgactgaaagcttgggaaacgaaaagcaattgctttgaatctttgatcatggcggtgttcacttgtgcgcattattattttgttgattttttcggtcaccacaaaaactgcccaaatccatcttatctgaacggacatggcttggctcaatttaataagccaagctttataaacttgctcttacacggttacacaccgtacctctcgattttcgctgtcgaccagagtgtaaccg

SEQ ID NO: 109 - DNA, 1369 bp, Panicum virgatum
agcaaccacccgcactccgacgagagccaaaatctccgagcgagctcccacagcgacgagctccctctggcctctgctgctaggtcgcctccgcctccgcctcgcaaggacccggcaaggtagccagcgagcaatcgaacgcgcactcggacgttaagcgagagatggggcgcgctccgtgctgcgagaggatggggctcaagagggggccctggacgccggaggaggacaggatcctggtggcgcacatcgagcgccacggccacagcaactggcgcgcgctgcccaagcaggcgggcctgctgcgctgcggcaagagctgccgcctgcgctggatcaactacctgcgcccggacatcaagcgcggcaacttcacccgcgaggaggaggacgccatcatccacctccaccacatgctcggcaacaggtggtcggcgatcgctgccaggctgccggggaggacggacaacgagatcaagaacgtgtggcacacgcacctcaagaagcgcctcgagcccaagccagcaagccagcagcaggcggcgcccaagcgcaagcccaccaagaagcagcagcagcagcagcaccagcagcctgatgtggaggttgtggtgctcgacggtccgaccagcacggtgcccgtgtcgccggagcagtcgctctccacgtccaccaccacctccaccgactgctcggcggcctcgtcgctggacaacaacgcggacagcttcaccttggaggaggactaccatatcgaggacagcttctggtccgagacgctggcgatggcgatggacagctccggcgactattattcttccgggatggagagggaggacgcccccgccgcgccgccggccaacgacgacgagatggacttctggctcaagctgttcatgcaggccagcgccatgcagaataatctgccccagatttaggcggcgtgctagctagatggtccccttgagatctgctgatcatattctttgcctcacaattctttgaatctttgtcctgctccgtttcggtggtgtacatccgactgaaagcttgggaagcgaaaagcaattgcttgatcatggcggtgttcacttgtgcgcattattattttgttgattatttcggtcacccggccgttggctacgtgaccacaaaaactgcccaaattcatcttatctctaactgacatagcttggttatatgccaagcttattattaaacttgctgttacacccctctcgattttcgctgtcgaccagagtgtagccgcgccgcctacgagtcacccagctgtccagcagccgtcgccgggagcctggccgacaggccgccccggccctgcactgcactgcacatccatccatccccc

SEQ ID NO: 110 - DNA, 1170 bp, Zea mays
cagcacagcagcaagctccctcagctcggtcttctcggcaggacccggcaagcaaagccaaagcccagctctttctcggccgggagatcgagacatggggcgcgctccgtgctgcgagaagatggggctcaagaggggcccgtggacgcccgaggaggacaggatcctggtggcgcacatcgagcgccacggccacagcaactggcgcgcgctgcccaagcaggcgggccttccccgctgcggcaagagctgccgcctccgctggatcaactacctgcgccccgacatcaagcgcggcaacttcacccgcgaggaggaggacgcagtcatccaactccaccaaatgctcggcaacagatggtcggcaatcgctgccaggctgccggggaggacggacaacgagatcaagaacgtctggcacactcacctcaagaagcgactggagcctaagacagccacgcaggcgcccaagcgaaagcccaagaagcagcagcagccagaggcggtgacgctcgcagcgcctgtctcgccggagcagtcagtctccacgtcgaccaccagcaccaccactgactactcggcggcctcgtcgtcgttggagaacgcggatagcttcacctcggaggaggaggactaccagattgacgacagcttctggtccgagacgctggcgatggcggtcgacagttccgactccgggatggaggaggcagagggcgccttcggcgcgtcgccgccggcgccgtcgaccaacgacgacgtggacttttggctcaagctgttcatgcaggccagcgacatgcagaattcgccccagatttatgcatgaacctagacggttctctctcgatcggctgatgatgttcttggcctcagaattctttcaatccttttgttctgctccgtttcggtggacgtatatctgactgaaaacttgtgcagcggaaagcgattgtgcttcatcatggcggtgttcactttttgcgcattatatactacgattttagttgagttttctgtcacctgtgctttccgccgctagctgcttatcagggaccagggtccctgctacatgaccgatgtccatgtccatgatgtcagcgtcaatggaagtttcgtgagagttttatagcagaaagagatgaagagatagaagataaaagtttgaag

SEQ ID NO: 111 - DNA, 1670 bp, Triticum aestivum
caaagagcggcaccgaatccaatctaatccggttgaagactttctcgccgagctgggccgatcgacggacatggagatggacatggaggggggctcgcagccgcagccgcagggcgcctcgctctcgccggcgccgttcctgatcaagacgtacgagatggtggaggacccggcgaccagccgcgtggtgtcgtggggccccggcggcgccagcttcgtggtgtggaacccgcccgacttctcccgggacctgctgcccaagtacttcaagcacaacaacttctccagcttcatccggcagctcaacacctacggttttcggaagatcgacccggagcgatgggagttcgcgaacgacgacttcatcaggggccacatgcacctcctcaagaacatccaccggcgcaagccggtgcacagccactcaccgcagaaccaggtgaacgggccgctggctgagtcggagaggcgcgagtacgaggaggagatcagcaggctcaagcacgagaacagcgtgctcgtggcagagctccagaggcaggcacagcagcagtgcgggctcagctggctgatgcagtcgctggaggaccggctgatggcgatggagcggcggcaggcggacgtcgtcgcctccgtgcgcgacaccctgcagaggagacggggcggcgttcatccagggcaggagaccatgatgctggaactggagccgacggaccatttcagcaagaagaggagggttccgacgatcggtttcttcgtcgaggagcccgccgaggagcagcgggtgccgcatctgcgggcgatgggtggtgagacgccgggcatggtcatggtgaacgccgagccttttgagaagatggagctggccctggtctccatggagaaactcgtccagagggcaggcgactatgcgtcctctgaagacatgtacaacgccgccgccgctgcacccagcaccgatgatccggctcatgcagatctgcaggcagcaccagtaaatcttcagccgtcttcaccggagctagcggagtctccgggttacgctgtccagagtccaatgctactattcccagaaattcacgaggacaagcacaagacgatggccgaagttgacatgagctccgaggccagcaccacagacacttcacaggacgagacgaccgccgaggccgaggccgagaccggagttccccatgaaccggccgtggcgaacgatctgttctgggagcggtttctcacggacacgcccaagccgctagccgtcgaggaaagccatggacccgaggacgatgtgaagaccggcctagactgctactggttcggtcaccggaacaacgttgatcagatcaccgagcagatggggcacctcgcttctgctcagaagacctgatggctggcctaccatttccgctcgtgtatagcccatctgtaaattatagtttagcctagcctgtctcacatgccctcagactctacaagcatctccctttcagatatagtattgtacagtatatagctcctcgtcacacactctgtacatttgtaaattagtcgcagatatacaattttgaagtccggtgccctgacttgttgtgtgtatgcttcttcctggtgacccgagtaatagcattaacaaacttgtattgcggctgcctaatcatatgcttcgg

SEQ ID NO: 112 - DNA, 1721 bp, Secale cereale
tctttgccgcagaacaagttggttgcatcgacgacaagtcgctgtttttgccaacttggtgagggagaattttccaccgcacgcggcttgattcatgtgaacaaagagcagcaccgaatccaatccagttgaagactttctcgccgagctgggccgatcgacgggcatggacatggagatggaagggggctcgcagccgcagccgcagggcgcctcgctctcgccggcgccgttcctgatcaagacgtacgagatggtggaggacccggcgacgaaccgcgtggtgtcgtggggccccggcggcggcagcttcgtggtgtggaacccgccggacttctcccgggacctgctgcccaagtacttcaagcacaacaacttctccagcttcatccggcagctcaacacctacggtttccggaagatcgacccggagcgatgggagttcgccaacgaggagttcatcagggggcacatgcacctcctcaagaacatccaccggcgcaagccggtgcacagccactcgccgcagagccaggtgaacgggccgctggcggagtccgagaggcgcgagtacgaggacgagatcagccggctcaagcacgagaacagcctgctcgtggcagagctccagaggcaggcacagcagcagtgcgggctcggctggctgatgcagtcgctggaggaaaggctggtggcgatggagcagcggcaggtggacgtcgtggcctccgtgcgcgacgtccagcagaggagacggggcggcgttcacccagggcaggagaccatgctggagctggagccgacagaccatttcagcaagaagaggaggatcccgaagatcggcttcttcgtcgaggagcccgccgcggcggccgaggagcagcgggtgccgcatctgccggcgatgggtggtgagacgccgggcatggtcatggtgaacgccgagccttttgagaagatggagctggccctggtctccatggagaagctcgtccagagggcgggcaattatacatcctctgaagacatgtacaacgccgccgctgctgctgctgttgcacccagcaccgatgatccggctcatgcaggtctgcaggcagcaccagtggaagccggggtaaatcttgagccatcttcaccggagctagcaaagtctccgggttacgctgtccagagcccaatgctactattcccagaaattcatggagacaagcacaagacgacggccgaagtcgatgtgagctccgaggccagcagcacagacacttcgcaggacgagacggctgccgaggccgagaagaccggagttccccatgaaccggccgtggcaaacgatgtattctgggagcggtttctcacggacacgccgaagccgctagccgtcgaggaaggcaatgaatcaaaggacgatttgaagatgggcctagactgctactggttcggtcaccggaacaatgttgctcagatcaccgagaagatggggcacctcgcttctgctcagcagacctgatggccggcttaccatttccgctcatgtatagcccacctgtaaattatactactagtttagccggcatctccctttcagatatatttgtatatagctcctcgtcacgcacactgtacatttgtaaattattagtcgcgaagatacaattttgtagtccagaaaaaaaaaaaaactagaagactgcaacgacgacacaagggagtaagggggg

SEQ ID NO: 113 - DNA, 1295 bp, Aegilops tauschii
ccaactttggacccattctaagaggattcacctatataacacaccaacgttgcgttgccacaagaatggaacagctcaggatatctctcatcaacaacacgatggcgtcaccttctccgtcttccacagtgatccagatgcctccaagtccacacaccaacggcgggacagcgggcttggctccggccacgcccgaggacgccggcgatgtgccacccccagcgcccgcagcagctgctgtggaccagcacagcccgaccgacaaggtcatgtcgagcgccgcgaacctcgcgcagctgctaccgacgggcacggtgctggcgtaccaggcgctgtccccgtccttcaccaaccacggcaagtgcttctcctccaaccagtggctcaccgcggcgctggtgatcatcctcaccatctcgtgcatcctcttcaccttcaccgacagtgtacttggccgcgaccagaagctctactacggcatcgccacgccgcgcggtttcaacgtgttcaacttctcggacgaagaggagaggcagcagtggactcccgctgagttccgcaggctccgcatccggccgctggacttcgtgcgcgccatcttcacggccctggtgttcctcaccgtagctttcagcgacgtggggctgcagaactgcttcttccccaacgctggcatggacacccaggagcttctcaagaacctgcctctgggcattgcgtttttgtccagttttgtgttcatgatcttccccacaaaaaggaagggcatcggctacagcgacaccacccctcgccaaaagctcacttgatgttaatatcagttgtttctgaacagttagatagattagagtataccgtaaatcaccatatatagttactgtaactttgatgtttaggtcacttgttttttaagttaaaatgtagtgtaatcgcggtataggaggagatctggtataggactagtattacttattacatttctttggtaaatacttgtgtattgtttaatttattcatgccaaatttattgaaaccatttggtgggcagatgcccttgttcgctgcagatgttatgtttatctttcaattagagagaaaaggcatgtatgtaccttcttgcataaaaagaataattgacgaagtttgctgaaagtctacctaaactcctaattaccgaagcctgaagtatttgaatttaccaaaattattccaaatttgcggggaaagcgggtgctctgcccatttcaacatatggacatagaaaaaaggagtacaaaaatattacatggaaccag

SEQ ID NO: 114 - DNA, 1212 bp, Triticum aestivum
cttaggacatttctaatcgaccacaccatggcatcatcttctccatcttccaccgtgatccagatgcctccaagtcaacacaccaacggcgggacagccggccttgccccggccacgcctaaggacgccggcgacatcccgaccaccgcacccgcaacagctgccgggccagcagccaccgcgacggacaaggtcatgtcgagcgccgcgaacctggcgcagctgctgccgacgggcacggtgctggcgtaccaggcgctgtccccgtccttcaccaaccacggcaagtgcttctcctccaaccagtggctcaccgcggcgctggtcatcgtcctcaccatctcgtgcgtcctcttctccttcaccgacagcgtcctcggccgcgaccagaagctctactatggcatcgccacgccacgcggtttcaacgtcttcaacttctcggacgaagaggagaagctgcagtggactcccgctgagttccggaggctccgcatccggccgctggacttcatgcgcgccgtcttcacggccctggtgttcctcaccgtggctttcagcgacgtggggctgcagaactgcttcttccccaacgctggcatgaacacccaggagcttctcaagaacctgccattgggcatcgcgtttctgtccagttttgtgttcatgatcttccccacaaaaaggaagggcatcggctacagcgacactactcctcgccaaaagctcacttgatgtttagatcgatcttgtttttaaacagttagatggattagattataacgtaaatcaccatatatagtactataactttattgtttagatcacttattttttaacttaaaatgtagtgtaatcgccgtatataggagtagtatcacttgtgattacatttttttgtggaaatacttgtgtattgcttaatttattcatgcaaaatttaatgaaaccatttgtgtgggcagatgcccttgttcgctgcagttgtaatgtttatcttttaattagagagaaaaggcatgtatgtaccttcttgcataaaaagaataattgatgaactttgctgaaagtctacctaaactcctaaatatcgaaacctgaactatttgaatttaccaaaatcattccaaatttgcagggaaggcgggtgctctgcccatttcaacattgggacatagaaaaaaggagtacaaaaatattacatggaaccag

SEQ ID NO: 115 - DNA, 783 bp, Secale cereale
ctctaatcgaccacacgatggcatcattttctccatcttccatcgtgatccagatgcctctaagtccaaacaccaacggccagccgacggctccggcgacgcccaaggatgccagcgacgtcccaactacggcgccagcagcagccagcgccgcggacaaggtcatgtcgagcgccgcgaacctcgcgcagctcctgccgacgggcacggtgctggcgtaccaggcgttgtccccgtccttcacaaaccacggcaagtgcttctcctccaaccagtggctcaccgcggcactggtcgtcgtcctcaccgtctcctgcgtcctcttctccttcaccgacagcgtcctcggccgcgaccagaagctctactacggcatcgccacgccgcgcggtttcaacgtcttcaacttctcggacgaagaggagcggctgcagtggactgacgctgagtttcggaggctccgcatccggccgctggacttcatgcgtgccgtcttcacggccctggtgttcctcaccgtggctttcagcgacgtggggctgcagaactgcttcttccctggtgctggcaggaacaccgaggagcttttgaagaacctgccgttgggcatcgcttttctgtccagttttgtgttcatgatcttccccacaaaaaggaagggcatcggctacagcgacaacactcctcgcgcaaagctcacttgatgtttagatcgatcttgtttttgattaattagatagattagattataccgtaaattgccgtttatagtgactatatgtt

SEQ ID NO: 116 - DNA, 880 bp, Secale cereale
tcctccatcgtgatccagatgcctctaagtccgaacaccaacggccagccgattgctccggccacgcccaaggacgtcggcgacgtcccaactacggcgccagcagcagccagcgccgcggacaaggtcatgtcgagcgccgcgaacctcgcgcagctcctgccgacgggcacggtgctagcgtaccaggcgttgtccccgtccttcaccaaccacggcaagtgcttctcctccaaccagtggctcaccgcggcgctggttgtcgtcctcaccatctcgtgcgtcctcttctccttcaccgatagcgtcctcggccgcgaccagaagctctactacggcatcgccacgccacgcggtttcaacgtgttcaacttctctgacgaggaggagaagctacaatggactcccgccgagttccggaggctccgcatccggccgctggacttcatgcgtgccgtcttcacggcccttgtgttcctcaccgtggcgttcagcgacgtggggctgcagaactgcttcttccctggcgccggcaggaacaccgaggagctttttaagaacctgccgttgggcatcgcttttctgtccagttttgtgttcatgatcttccccacaaaaaggaagggcatcggctacagcgacagcactcctcgcgcaaagctcacttgatgtttagatcgatcttgtttctgattagttagatagattagattattatgagtagtttttacggtgcatcatactacctgaaataatgggtagtatagagttgatccaacggttaatattggtctgctcggtaattttgttatgtgcagattggtaatttcctatatggacagatttattccctattgttttaatgtataatcatatatac

SEQ ID NO: 117 - DNA, 856 bp, Secale cereale
tcctccatcgtgatccagatgcctctaagtcccaacaacaacggccagccgacggctccggccacgcccaaggacgccggcgacgtcccaactacggcaccagcagcagccagcgcggcggacaaggtcatgtcgagcgccgcgaacctcgcgcagctcctgccgacgggcacggtgctggcataccaggcgctgtccccgtccttcaccaatcacggcaagtgcttctcctccaaccagtggctcaccgcggcgctggtcgtcgtcctcaccatctcgtgcgtcctcttctccttcaccgacagcgtccttggccatgaccagaagctctactacggcatcgccacgccgcgcggtttcaacgtgttcaacttttcggacgatgaggagaagctgcagtggactcctgcagagttccggaggctccgcatccggctgctggactttgtgcgcgccatctttacggccctggtgttcctcaccgtggctttcagcgatgtagggctgcagaactgcttcttccctggtgccggcaggaacaccgaggagctgctgaaaaacctgccgttgggcatcgcttttctgtccagttttgtgttcatgatcttccctactaagaggaagggcatcggctacagcgacaccactcctcgccaaaagctcacttgatgttaatattagttgtttctgaacagttggatggattttagtataatcacgatatatactattacagcttgaggatagattatgaacagttagatagttttcagtagattataatgtttagatcacttgttttaactgttaatcgcggtatataggagttgtttttgcttacttttgttttctgtaa

SEQ ID NO: 118 - DNA, 991 bp, Secale cereale
cgtgatccagatgcctctaagtccaaacaccaacggccagccgatggctccagccacgcccaaggacgccggcgacgtcccaactacggcgccagcaacagccagcgcgacggacaaggtcatgtcgagcgccgcgaacctcgcgcagctcctgccgacgggcacggtgctggcgtaccaggcgttgtccccgtccttcaccaatcacggcaagtgcttctcctccaaccagtggctcaccgcggcgctggtcgtcgtcctcgccatctcctgcgtcctcttctccttcaccgacagcgtcctcggccgcgaccagaagctctactacggcatcgccacgccacgcggtttcaacgtgttcaacttctctgacgatgaggagaagctgcagtggactcctgcagagttccggaggctccgcatccggccgctggacttcatgcgcgccgtcttcacggccctggtgttcctcaccgtggctttcagcgacgtggggctgcagaactgcttcttccctcggtgctggcaggaacaccgaggagctttttaagaacctgccattgggcatcgcgtttctgtccagttttgtgttcatgatcttccccacaaaaaggaagggcatcggctacagcgacaccactcctcgtgcaaagctcacttgatgtttagatcgatcttgtttctgattagttagactgattagattataaatcgtcgtttatagtgactatatgtttgatgtttaaatcacttgtttttaatttaaaatctagtgtaatcgttgtatataggagtagtattcctatgactacatttttttggaaatacttgtgtattgtttaatttattcattaatgaaaccatttgtgtgtcgagctgcagttgtaatgtttgtcttgtaattagagagaaaaggcttgtatgtaccttcttgtataaaaagaataattgatgaactctgctgaaagtctatttaaacacctaaaaagtc

SEQ ID NO: 119 - DNA, 831 bp, Secale cereale
ccatcctccatcgtgatccagatgcctctaagtccaaacactaacggccagccgacggctccggcgacgcccaaggatgccagcgacgtcccaactacggcgccaccagcagccagcgcggcggacaaggtcatgtcgagcgccgctaacctcgcgcagctcctgccgacgggcacggtgctggcgtaccaggcgctgtccccgtccttcaccaaccacggcaagtgcttctcctccaaccggtggctcaccgcggcgctggtcgtcgtcctcaccatctcgtgtgtcctcttctccttcaccgatagcgtcctcggccgcgaccagaagctctactacggcatcgccacgccgcgtggtttcaacgtgttcaacttctcggacgatgaggagaagctgcagtggactcccgctgagttccggaggctccgcatccggccgctagacttcatgcgcgccgtcttcacggccctggtgttcctcaccgtggctttcagcgacgtgggcctgcagaactgcttcttccccaatgctggcatgaacaccgaggagctgttgaagaacctgccattgggcatcgcatttctttccagctttgtgttcatgatcttccccacaaaaaggagggcatcggctacagcgtcaccactcctcgtgcaaagctcacttgatgcgtagatcaatcttgtttttgattagttagactgattagattataaatcgtcgtttatagtgactatatgttttatgttaaatcacttgttttttaatttaaattctagttttaatcgttgtatataggagtagtattcctatgactactattttttt

SEQ ID NO: 120 - DNA, 1007 bp, Triticum aestivum
acgaatggaacaacttaggatattcctagtcgaccgcacaatggcgtctcctccatcttccaccgtgatcgagatgcctcaatctccacacggcaacgccggcgtgccgatggctccaacgacgcccaaggacgccggcgacgtcccgaccatggcatccgcagcaactgcaggactagcacccacggcgacggacaaggtcatgtcgagcgcagcgaacctcgcacagctcctaccgaccggcacggtgctggcgtaccaagcgctgtccccatccttcaccaaccatggcaagtgcttctcctccaaccggtggctcaccgcggcgctggttatcgtcctcaccatctcgtgcgtcctcttcaccttcaccgacagcgtactcggccgcgaccaaaagctctactatggcatcgccacgccgcgcggcttcaacatcttcaacttctcggacgaagaggagaagctgcagtggactcccgctgagttccggaggctccgcatccggccgttcgatttcatccgcgcagtcttcacggccctggtgttcctcaccgtggctttcagcgacgtggggctgcagaactgcttcttccccaacgctggcatgaacacccaggagcttctcaagaacctgcctctgggcatcgcgtttctgtccagttttgtgttcatgatcttccccacaaaaaggaagggcatcggctacagcgacaccactcctcgccaaaagctcacttgatgtttagaccaatcttgtttctaacagttagaaagattagattataacgtaaatcaccgtatatagtattgtaagtttgatgtttagatcacttgttttttaacataaaacgtagtgtaatcgcggtatctaggagtagtattatttatgattacattttttgggaaatacttgtgtattgtttaatttaatcatgcaaaatttaatgaaaccatttctgtgggcagatgcccttgttcggtgcagttgtaatgtttatctttta

SEQ ID NO: 121 - DNA, 857 bp, Triticum aestivum
accacacaatggcgtctcctcctccatcatccaccgtgatccagatgcctccaagtccacaaaccaacggccagccgacggccgggacagtcccggccatgcctaatgatgccggtgacgtgaccatagcacctgcagcagctgccggaccagcatccaaggcaacggacaaggtcatgtcgagcgccgcgaacctcgcgcagctcctgccgacgggcacaatgctcgcgtaccaggctctatccccgtcctttaccaaccacggcaagtgcgaggcctccaaccagtggctcaccgccgcgctggtcatcatcctcgccgccctgtgcatcctcttctccttcaccgacagtgtcctcggccgcgaccagaagctctactacggcgtcgccacaccacgcggcttcaacgtgttcaatttctccgacgaagaggagaagctgaagtggactccagctgagttccggaggctccgcatcaggccactggactttttgcacgccatcttcacagcgctggtctttctcaccgtggcgttcagcgacgtggggctacaaaattgcttcttccccaacgccggcaggaacaccgcagagctgctcaagaacctgccgttgggcatcgcatttctgtcgagttttgtgttcatggtcttccccacaaagaggaagggcatcggttacaccgacaccactcctcgcaagaagctcacttgatgtttagatgatcatatcaccttttttttggacaattagattacaacgtaatcacgatatattttaacttgtgattactttatttttgagaaatatttgtgtattgtttagtttgttatgccatggccgatggaaccatcc

SEQ ID NO: 122 - DNA, 738 bp, Secale cereale
tacacagttgcctacacacattgccaaaacccagcgtccaagtcgtacacacttgttgcaaagaggaggaggattagaagaaagctaaggttgacgacatggccgtcgcgaggaggatgaggctcgctctggcggtgatcgtggcggcgctcgtgctgctggcggcgctgggcgaggcacggccgctgagcggcgccgactgggcggccgcgggagggaccccgctgccggccgcgggcggcgcgtcgaccgtggtccaggcgctccggcggctgtacatgcagcagctgggcgggccgggcccctcgtgcggcaccaacagcccaaacgtccactgcccgccgtagagatggccgaggccgaacgccgcaactcggccgtaggcagcatgagtggtttgaagttccaacgtgttttggcgaccccaagtggtaggctctggtgatcgaccgtaggattggattatttgcttggtttgttggtgatttttgcccacgcgtacgtgtacgctgggcggcacttttgtacatacatacagaagaaaagatacgcatatagtacgtaggattttgtatgaataaaacataggcaagctgaacaagcatcagcgatacatttgtatttacattacatatgtaaacctttgtttatgaattgaattgatactctacctctaacttaccccaaaaaaaaaaaaaaactaacgtaagactagtcgaacgacgacacaagggagag

SEQ ID NO: 123 - DNA, 685 bp, Triticum aestivum
aagttgcctacacacattgccaaaacccagcgtccaagtcgtacacacttgttgcaaagaggaggagggttagaagaaagctaaggttgacgacatggccgtcgtgcggaggatgaggctcgctctgccggtgatcgtggcggcgctcgtgctgctggcggtgctcggcgaggcgcggccgctggggggcgcggactgggcggccgccggagggaccccgctgccggccgtggtccaggcgctccgccggctgtacatgcagcagctgggcgggccgggcccgtcgtgcggcaccaacagcccaaacgtccactgcccgccgtagatggccgaggccgagcgccgcagctcggccggcgtgcgtacgtcctctcgtgtttgaagttccaacgtgtttttggcgaccccggtggtagattctggtgatcgactgtaggattggattcgttgcttggtttgttggtgatttttgcccacgcgtacgtctacgctagttggcactttgtacatactacatacaaaaggaaatacacacatatattacgtaggattctgtctgaataaaactgtaaaacataggcaagctgcagaagcatcagcaatacatttgtatttaaattacatatgtaaacctttgtttatgatttttctttttgagaatcaacctttgtttatgaattgaatt

SEQ ID NO: 124 - DNA, 712 bp, Hordeum vulgare
atagcccatatctacctcgtatagcacacagagttccctaccctacacacattgccaaaacccagcgtccaagtcgtacacacttgctgcaaagaaagaagaaacctaaggttgacgaggacatggccgtcgcgaggaggacgatgaggctcgctctgccgctgatcctggcggcgctcatgctgctggcggtgctcggtgaggcgcggccgctgggcggcgccgactgggccgccgccggagggaccccgctgccggccgtggtgcaggcgctccggcggctgtacatgcagcagctgggcggcccgggcccctcgtgcgggaccaacagcccaaacgtccactgcccgtagacggtcgaggccggccgaacgccgcagctcggccatcgcgccggcggccggttcctcccgtggttcgaagttccgacgtgtgtttttggcgaaccggggtggtacgtagactccggtgatcggctgtaggattggattcgttgattggtttggtttcttggcgatttttgcacacgcgtacgtgtacgcagggtggcaatttgtacatacatatacgcacaagaaaagatacacgcatagtacgtaggattctgtctgaataaaacataggcaggctgcaaaagcatgtcagcaatacgtttgtacttacgttacatatgtaaacctttgtttatgaattgaattgatacgctacttcc

SEQ ID NO: 125 - DNA, 1613 bp, Triticum aestivum
catgaacctgacgttgagtctaggcgtcaatggtggcggcgccgcggccaagaagcgcaaggtgatggacggcgtcggcgacgtgggcgtcctcggcgccggtgacggcggtgaccgagccactgtcatgaggctcctccaggccagagatcgcatggtgaaggttgagcttgatcacgacgacggggacgtgagtgaccgcggagcctcgccgctgatgcgcttgctcctctcgtcggcggccgccggggaggtcggcgacacgcacgcagcggccatggccctgcaggaggtctaccggcagcgtccttccgcggaggcgaccccgcccagcgggtcgcagcctacttcgcggacgcgctggcgtcgaggctcctgctgccgccgccggcgaaggcgaagacgacgacgacgacgactcgcgaagagcagttcctggcgttcaccatgttctaccaggcgtccccgttctaccagttcgcgcacttcacggcgaatcaggccatcgtggaggcgttcgaggccggcggccggcgccgcctccacgtcgtggacttcgacgtctcgttcggcttccagtggccgtccctgatgcagtccctttccgacgccgccaccacaagctcctccgaatcctcccaggacgacagcggcgactgctgcgacgagccggtgtccctgcgcatcaccggttcggcgcgagcgccgacaagctgcgggacacggaggcccgcctcgcccgcttcgcggacggctgccccaacctacggttcgagttcgagggcgtcgtcaacaacgggccggaggagggccgccatgagcgcataacgaccgaccccgccgcgacggtggtcgtcaacctggtgttcccggccgcacagaacgtgaggcagagctcatgggatccgcgcagcgcatcggctcacatccggtctctgaacccgtccttggtcttcctgatcgacaaggtcgacgaaggcagcggcggcggcaaaggcgccggaagatgcggaagcgcgagcctgctcccgcggttcgcggccaacctccggtactacgcggccgtgttcgagtcgctgcacgagtgcctcccggccgacagcgccgagaggatcgccatcgagagggaccacctcggcgtggagatcagcgacgcaatggcctctctggaccgtcggcgccacgacggcgatcgcgcggcggaccagatgagtcgcggttggaaggagaggctggagagcgcggggttcgaagacgcgaggctgagctcgaggacggtgagccaggcgaagctgctgctcaagatgaagagcggcgggtgcggcggcggcgggttccgcgtcatggaggccggcgacggcaaggccatggcgctggggtggcgagacagggccctcatcacggccagcgcgtggcggccgtgccggcgatcggtcggcaagaacgagccctgaaacacgcgcccattcattcattcggtacatagatatcgtgatagaccgtgtgctcatccgattcttcttggtttcctcattggttccttattagagagagagagcttgattcttagtttcttttctcttgatttcttgagtgatatatacatgtatact

SEQ ID NO: 126 - DNA, 1971 bp, Hordeum vulgare
ccaagggcagcgcgcccgggaaccagccaaaacgggaggagcatattggcggccatttcatttcttgcaaacaaagctagtagtacacgcggaacatctagattccctttggtcgcttacataatatatatatatgtatatatgtatatatatatatacccctccccgtcgccgtgacccattccccgcctccctccctcccggccgctacgtacgtctcgcgcctcgccgatctccattaatcgccgcgcgcgcgcgctagcttctgagcttcttggacagacaatcgatcgatcgagagtctggagagatcaattgggtgcttgggtgtacatgaacctgacgttgagtctaggcgtcaatggtggcggcgccgcggccaagaagcgcaaggtgatggacggcgtcggcgacgtgggcgtcctcggcgccgctgacggctgtgatcgcgccactgtcatgaggctcctccaggccagagatcgcatggtgaaggttgagcttgaccacgacgtcgacggggatgtgagtggctgcggagcctcgccgctgatgcgcttgctcctctcgtcggcggtcgccggggaggtcggcgacacgcacgccgcggccgtcgccctgcaggaggtctaccggcacgcgtccttccgcggcggcgaccctgtccagcgggtcgccgcctacttcgcggacgcgctggcgtcgaggctcctgctgtcgccgcagccggcgcaagcgacgactcgccaagagcagttcctggccttcaccatgttctaccaggcgtccccgctgtaccagttcgcgcacttcacggcgaaccaggccatcatggaggcgttcgaggccggcggcacgcggcgcctccacgtcgtggacttcgacgtctccttcggcttccagtggccgtccctgatccagtccctttccgacgccgccgccaccagctcctccctgtcctcccacgacgacagcggcgactcctgcgacgagccggtgtccctccgcatcaccgggttcggcgccagcgccgacgagctgcgggacacggaggcccgtctcgcccggttcgcggacggctgccccaacctacggttcgagttcgagggcgtcctcaacagcgggccggaggacgacggccgccatgaccgcatcaagaccgaccccgccgcgacggtggtcgtcaacctggtgttcccggccgcacagaacgcgagggcgggctcatgggacccgcgcagcgcattggctcacatctggtctctgagcccgtccctggtgttcctgatcgacaaggttgacgaaggcgccggaagatgcggcggaagcgcgagcctgctcccgcggttcgcggccaacctccggtactacgcggcggtgttcgagtcgctgcacgagtgcctcccggccgacagcgctgagaggatcgccatcgagaaggaccacctcggcgtggagatcagcgacgcaatggccactctggaccgtcggcgccacgacggcgatcgggcggcggaccagaaccagaccagccgcggttggaaggagaggctggagagcgcggggttcgaggacgcgaggctgagctcgaggacggtgagccaggcgaagctgctgctcaagatgaagagcggcgggtgcggcggcggcgggttccgcgtcatggaggccggcgacggcaaggccatggcgctggggtggcgggacagggctctcgtcacggccagtgcgtggcgaccgtgccggcgatcggtcggcaagaacgagccgtgaaacatgcgtccattcattcattcagtacatagatcgtgatagactctttgttttcatgcgattattcttggttccttgttgggaaagagagagaagtttgattcttagtttcttttctctagatgtcttgagtgatatatatacatgtatacttatacaagttaaaagaggttatatacagttgatgtatcacattca

SEQ ID NO: 127 - DNA, 2371 bp, Triticum aestivum
ggaaggttcaaatctcccagcactacttggtcttgaaggaaagtgagaggcaaaagcagaggagtgactttgcccgtagcccgccgccggccatggcctcctacgacaaggccatggagtcgtacaagaaggccgtcaccacggcggcctccctcgcggcgtccgcgatgctggtgcggggcgtcgtcaacgagctggtgccctacgaggtgcgtgacctgctcttctccggcatgggctaccttcgctcgcacatgtcctcccagcacaccatcatcatagaggagaccgaggggtgggccaacaaccagctctacgacgccgcgcgggcgtacctggcgacgcggatcaacaccgacatgcagcgcctccgggtcagccgcgtcgacgagaccaagagcatgatgttcagcatggaggagggcgaagagatggccgatgtccatgagggcaccgagttcaagtggcgccttgtctgccgggacaactccagcgccagcagcagcaacaccaacggccgtggcggcagcggcaatttcaagcttgaggtccggtccttcgagatgagcttccacaggaagcacaaggacaaagcacttacctcctacctccctcacatcctcgccgtggccaagaaaatcaaagagcagaacaggacgctcaagatctacatgaacgaaggtgagtcatggtttgccattgatctccaccacccatcaaccttcagcacgcttgccatggatcacaagctcaagcagtcagtcatggatgatctcgagaggtttgtcaagagaaaggaatactacaagaagatcggcaaggcatggaaacgagggtacctgctgtatggcccacctgggactggcaagtcaagcatgattgcagcaatggccaattacctcaaatttgatgtatatgatcttgagctcactgaggtcaactggaactcaacacttcggaggttgctcatcgggatgaccaaccggtcaattcttgtcattgaggacatcgactgcactgtcgagctgcaacagcgggaggaaggtcaggagggcaccaaatccaacccttcagaggacaaggtgacactatccgggctactcaacttcgttgatgggctttggtcaacaagtggggaggagaggataattatcttcacaacaaactacaaagaaaggctcgatcctgcgcttctgcgccctggcaggatggacatgcacattcacatggggtactgctgcccagagtcgttccgaatcttggcctccaactaccactctatagatcaccatgccacatacccggagatagaagaattgatcaaggaggtcatggtgactccagcagaggtcgcagaggtgctcatgaggaatgaagagacggacgtcgcactcaaaggtcttatccagttcctcaagagaaagaaagatggcgctggcaaaccggaaaatgtggaccaggtggcgaaggaggaagaacaagagaaggagatgatgacgaaaagtgatgtcccagataatgaagatcagcaagatgggagcaaagaatgatgtgtatacagtgtgaatatcatacaattagtgccaggaacttcgagcaacaatgtatcattttgctataataagagatcaattttggtaacaataaaataatctggtattgtgaacagttatactatttgagtgcatataaacccagttatgaactcagtattggtagttatttcaatgcagaaatactgttcaatataagcagtcaacaaggttgaaataatcaattttgtcaagactcaaacctaatgtttttagaggaaacttagcatgtctggcttctaataacacttctccaaatcagtcttcagtacaagtgttcacaccattttcttctcgtaggtcatactcgacaattagaccaagattgtcaacaaacttgtgatacacctggcaccctgcacactgaagaaaaactgttcctctttcatagcccaccctgtttatcaaacgttttgtccttgcatcacatttattacatgtaaactgaacaagcaagcttcttctaggaagctttatatcaaaactagcttcctccgaggcatccggatcaacgtcgccggagcacgcacagacatagagtcccctacgaagatatgaaaccctcaggctaggagcgggagtcctgagcttgggattggaggaggtgaggcaagcgcgggacgggggtgagcgaccggcgaaggagctccccctccccgggaacgacagcgccgccgagcagccgtaccccgtggccgtcgtcgccatcggccggtggctactgggttgaggaatcctctcctctcccgttcctcctcctgctgtgcaatggagagatc

SEQ ID NO: 128 - DNA, 2361 bp, Triticum aestivum
agggcaccatcactgcttggaaggttcaaatctcccagcactacttggtcttgaaggaaagtgagaggcgaaagcagaggagtgactttgcccctagcccgccgccggccatggcctcctacgacaaggccatggagtcgtacaagaaggccgtcaccacggcggcctccctcgcggcgtccgcgatgctggtgcggggcgtcgtcaacgagctggtgccgtacgaggtgcgtgacctgctcttctccggcatgggctaccttcgctcgcacatgtcgtcccagcacaccatcatcatagaggagaccgaggggtgggccaacaaccagctctacgacgccgcccgggcgtaccttgcgacgcggatcaacaccgacatgcagcgcctccgggtcagccgcgtcgacgagaccaagagcatgatgttcagcatggaggagggcgaagagatggccgatgtccatgagggcaccgagttcaagtggcgccttgtctgccgggacaactccagcgccagcagcagcaacgccaacggccgtggcggcagcggcaatttcaagcttgaggtccggtccttcgagatgagcttccacaggaagcacaaggacaaagcacttacctcctacctccctcacatcctcgccgtggccaagaaaatcaaagagcagaacaggacgctcaagatctacatgaacgaaggtgagtcatggtttgccattgatctccaccacccatcaaccttcagcacgcttgccatggatcacaagctcaagcagtcagtcatggatgatctcgagaggtttgtcaagagaaaggaatactacaagaagatcggcaaggcgtggaaacgagggtacctgctgtatggcccacctgggactggcaagtcaagcatgattgcagcaatggccaattacctcaaatttgatgtatatgatcttgagctcactgaggtcaactggaactcaacacttcggaggttgctcatcgggatgaccaaccggtcaattcttgtcattgaggacatcgactgcactgtcgagctgcaacagcgggaggaaggtcaggagggcaccaaatccaacccttcagaggacaaggtgacactatccgggctactcaacttcgttgatgggctttggtcaacaagtggggaggagaggataattatcttcacaacaaattacaaagaaaggctcgatcctgcgcttctgcgccctggcaggatggacatgcacattcacatggggtactgctgcccagagtcgtttcgaatcttggcctccaactaccactctatagatcaccatgccacatacccggagatcgaagaattgatcaaggaggtcatggtgactccagcagaggtcgcagaggtgctcatgaggaatgaagagacggacgtcgcacttgaaggtcttatccagttcctcaagagaaagaaagatggcgctggcaaacaggaaaatgtggaccaggtagcaaaggaggaagaacaagagaaagagatgatgacaaaaagtgatgttccagacaatcaagatcagcaagatgggagcaaagaatgatgtgtatacagtgcgaatatcgtacaattagtgccaggaacttcgggcaacaatgtatcattttgctataataagagatcaattttggtaacaataagataatctggtattgtgaacagttatactatttgagtgcatataaacccagttatgaaatgagtattggtagctatttcaatgcagaaatactgttcaatataagcagtctacaaggttcaaataatcaatgttgtcaagactcaaacctaatgtttttagaggaaacttagcatgtctggcttctaataacacattccaaatcagtcttcagtacaagtgttcaccccattttcttctcgtaggtcatactcgacaattagaccaagattgtcaacaaacttgtgatacacctggcaccctgcgcactgaagaaaaactgttcctctttcataggccaccctgtttatcaaacgttttgtccttgcatcacatttattacatgtaaactgaacaagcaagcttcttctaggcagctttatatcaaaactagcttccgccggtgatgccgccgaggcgtacggatcaacgtcgccggagcacgcacagacatacagtcgcctacgacgatatgaaacccgcaggctaggagcgggagtcctgagcttgggattggaggaggtgaggtaagcgcgggacaggggtgagcgatcggcgaaggggctcccactccccgggaacgacagcgccgccgagcagccgtaccccgtggccgtcgtcgccatcggccggtggctactgggttgaggaatcctct

SEQ ID NO: 129 - DNA, 2217 bp, Triticum aestivum
acgaacaggaaattcacccgtttgtgtatgcattcttttacagcgcctgacagcaccaaaacaaaagcatgtgctttcactaccgtgggccctggaaacaaatatgctcatgattctcaagcacatactacatcattggtttatcgacaacgcattcgagtatcaacaggaatactagtactagtactcctactcaacagcaggcatgaagagacaaccatctcctcaaacgcaaagtgggggtccagcaggtagtcggttcggcttcgaggccatttctggcgttgtttagcacggccacccaaggaacatggccgtgccattagaaaaaaccccaccaagtagtgtgatgccatttttctactttggccaaggcctcctttctggacaacgcaccactcagaccaatactacagtattatttagcttgactgactcacccgtcatccaaccacttccacgcaaaccaagccagctataaaaccgcgcgccagctaaacgcccccattcaacaccgaccagcaccatcactgcttggaaggttcaaatctcccagcactacttggtcttgaaggaaagtgagaggcgaaagcagaggagtgactttgcccctagcccgccgccggccatggcctcctacgacaaggccatggagtcgtacaagaaggccgtcaccacggcggcctccctcgcggcgtccgcgatgctggtgcggggcgtcgtcaacgagctggtgccgtacgaggtgcgtgacctgctcttctccggcatgggctaccttcgctcgcacatgtcgtcccagcacaccatcatcatagaggagaccgaggggtgggccaacaaccagctctacgacgccgcgcgggcgtacctggcgacgcggatcaacaccgacatgcagcgcctccgggtcagccgcgtcgacgagaccaagagcatgatgttcagcatggaggagggcgaagagatggccgatgtccatgagggcaccgagttcaagtggcgccttgtctgccgggacaactccagcgccagcagcagcaacaccaacggccgtggcggcagcggcaatttcaagcttaaggtccggtccttcgagatgagcttccacaggaagcacaaggacaaagcacttacctcctacctccctcacatcctcgccgtggccaagaaaatcaaagagcagaacaggacgctcaagatctacatgaacgaaggtgagtcatggtttgccattgatctccaccacccatcaaccttcagcacgcttgccatggatcacaagctcaagcagtcagtcatggatgatctcgagaggtttgtcaagagaaaggaatactacaagaagatcggcaaggcatggaaacgagggtacctgctgtatggcccacctgggactggcaagtcaagcatgattgcagcaatggccaattacctcaaatttgatgtatatgatcttgagctcactgaggtcaactggaactcaacacttcggaggttgctcatcgggatgaccaaccggtcaattcttgtcattgaggacatcgactgcactgtcgagctgcaacagcgggaggaaggtcaggagggcaccaaatccaacccttcagaggacaaggtgacactatccgggctactcaacttcgttgatgggctttggtcaacaagtggggaggagaggataattatcttcacaacaaattacaaagaaaggctcgatcctgcgcttctgcgccctggcaggatggacatgcacattcacatggggtactgctgcccagagtcgtttcgaatcttggcctccaactaccactctatagatcaccatgccacatacccggagatcgaagaattgatcaaggaggtcatggtgactccagcagaggtcgcagaggtgctcatgaggaatgaagagacggacgtcgcactcaaaggtcttatccagttcctcaagagaaagaaagatggtgctggcaaaccggaaaatgtggaccaggtagcgaaggaggaagaacaagagaaagagatgatggcacaaagtgatgttccagacaatcaagatcagcaagatgggagcaaagaatgatgtgtatttagtgcgaatatcatacaattagtgccagaaacttcgagcaacaatgtatcattttgctataataagagatcaattttggtaacaataaaataatctggtattgtgcacagttatactatttg

SEQ ID NO: 130 - DNA, 2553 bp, Hordeum vulgare
ggaatctcgcgtatgccgggcatggaaacgtgacggggacacaagaccaaaaggaaacacgtcggttgtggctgcagaaatttcctatggaaactcgaagccaactgccgacagctacaagtggcatactattcatcacgcaaacttggccgtcaagcctatgaagacagttgtaaacttgctttaccatgcgcacggttccaaaaaagcataaaaaacgtcattatgcgtgtgcaaccattccttggcagcatgttaatcatacatgtgtccctcgtgttgtacaccttcaacaaatttgaacagattacccaatactgtagcaataaaaaagcaaattcaaacaggaaatttgaactgctaaaatgacatatactgtagtatggtagagtacctgacagcaccaaaacaaaagcatgtgttttcactaccgtaccggaggccttggaaacaaatatgctcatgattctcaggcacatacgtactacatcatttggtttatcgacaatgcattcgagtatcaacaggtatactagtactagtactcaacagcaggcataaagagacctcaaactcaaagtgggggtccagaagttagtcggttctgcttgctttaagctttttcaatacccaaccatggacatttctggcgtttgttttgcacggccacccaaggaacatggccgtgccattgagaaaaaaaaccatcaagtagtgcgatgccatttttctactttggccaaggcctcctttctggacaacgcactaccaatcagaccagtattatatagcttgactgactcacccgtcacccaaccatttcgacgcaaaccaaaccagctataaaaccccacgccagctaaacgcccccattcaacaccgaccagcaccatcacttggaaggttcaaatctcccagcactacttggtcgtgaaggaaagtgagaggcgaaagcagaggaggcctgtagccatggcctcctacgacaaggccatggagtcgtacaagaaggccgtcaccacggcggcctccctcgcggcgtccgcgatgctggtgcggggcgtcgtcaatgagctggtgccgtacgaggtgcgtgacctgctcttctccggcatgggctaccttcgctcgcacatgtcctcccagcacaccatcatcatagaggagaccgaggggtgggccaacaaccagctctacgacgccgcgcgggcgtacctggcgacgcggatcaacaccgacatgcagcgcctccgggtcagccgcgtcgatgagaccaagagcatgatgttcagcatggaggagggcgaagagatggcagatgtccacgagggcaccgagttcaagtggcgccttgtctgccgggacaactccagcgccagcagcagcaacggcaacggccgtggcggcagcggcaatttcaagcttgaggtccggtccttcgagatgagcttccacagaaagcacaaggacaaagcccttacctcctacctccctcacatcctcgccgtggccaagaaagtcaaggagcagaacaggacgctcaagatctacatgaacgaaggtgagtcgtggtttgccattgatctccaccacccatcaaccttcagcaccctcgccatggatcacaagctcaagcagtcagtcatggatgatctcgagaggtttgtcaaaagaaaggaatactacaaaaagatcggcaaggcgtggaaacgagggtacctgctgtatggcccacctgggactggcaagtcaagcatgattgcagcaatggccaattacctcaaatttgatgtatatgatcttgagctcactgaggtcaactggaactcaacacttcggaggttgctcattgggatgaccaaccggtcaattcttgtcattgaggacattgactgcactgtcgagctgcaacagcgggaggaaggtcaggagggcaccaaatccaacccttcagaggacaaggtgacactatccgggctactcaatttcgttgacgggctttggtcaacaagtggagaggagaggataattatcttcacaacaaactacaaagaaaggctcgaccctgcgcttctgcgccctggcaggatggacatgcacattcacatggggtactgctgcccagagtcgtttcgaatcttggcctccaactaccactctatagatcaccatgccacataccaggagatagaagaaatgatcaaagaggtcatggtgactccagcagaggtcgcggaggtgctcatgaggaatgaagagacagacatcgcacttgaaggtcttatccagttcctcaagagaaagaaagatggcgctggcaaaatggaaaatgtggaccaggtggcgaaggaggaagaacaagagaaagagatgatgacgaaaagtgatgtcctagacaatgaagatcagcaagatgggagcaaagaatgatgcgtatacagtgtgagtatcatataattagtgccagaaacttccagcaacaatgtatcgttttgctataataagagatcaattttttggtaacaatataaatatctggtattgtgaacagtt

SEQ ID NO: 131 - DNA, 2277 bp, Secale cereale
cgcttggaaggttcaaatctcccggcactacttggtcgtgaaggaaagtgagaggtgaaagcagaggagtgacttcgcctgcagccatggcctcctacgacaaggccatggagtcgtacaagaaggccgtcaccacggcagcctccctcgcggcgtccgcgatgctggtgcgaggcgtcgtcaacgagctggtgccgtacgaggtgcgtgacctgctcttctccggcatgggctaccttcgctcgcacatgtcctctcagcacaccatcatcatagaggagacggaggggtgggccaacaaccagctctacgacgccgcccgggcgtacctggcgacacggatcaacaccgacatgcagcgcctccgggtcagccgcgtcgacgagaccaagagcatcatgttcagcatggaggagggcgaagagatggccgatgtccatgagggcaccgagttcaagtggcgccttgtctgccgggacaactccagcgccagcagcagcaacggcaacggccgtggcggcagcagcaatttcaagcttgaggtccggtccttcgagatgagcttccacaggaagcacaaggacaaagcccttacctcctacctccctcacatcctcgccatggccaagaaaatcaaagagcagaacaggacgctcaagatctacatgaacgaaggtgagtcatggtttgccattgatctccaccacccatcaaccttcagcacgcttgccatggatcacaagctcaaggagtcagtcatggatgatctcgagaggtttgtcaagagaaaggaatactacaagaagatcggcaaggcgtggaaacgagggtacctgctctatggcccacctgggactggcaagtcaagcatgattgcagcaatggccaattacctcaaatttgatgtatatgatcttgagctcactgaggtcaactggaactcaacacttcggaggttgctcatcgggatgaccaaccggtcaattcttgtcattgaggacatcgattgcactgtcgagctgcaacagcgggatgaaggtcaggagggcaccaaatccaacccttcagaggacaaggtcacactatccgggctactcaacttcgttgatgggctttggtcaacaagtggggaggagaggataattatcttcacgacaaactacaaagaaaggcttgatcctgcacttctgcgccctggcaggatggacatgcacattcacatggggtactgctgcccagagtcgtttcgaatcttggcctccaactaccactctatagatcaccatgccacatacccggagatagaagaaatgatcaaggaggtcatggtgactccggcagaggtcgcagaggtgctcatgaggaatgaagagacggacgtcgcactccaaggtcttatccagttcctcaagcgaaagaaagatggcgctggcaaaccggaaaatgtggaccagctagcgaaggaggaagaacaagagaaagagatgatgacgaaaagtgatgttccagacaatcaagatcagcaagatgggagcaaagaatgatgtgtatacagtgtgaagatcatacaattagtgccaggaacttcgagcaacaatgtatcattttgctataataagagatcaattttggtaacaataagataatctggtattgtgaacagttatactatttgagtgcatataaacccagttatgaaatgagtgttggtagctatttcaatgcagaaatactgttcaatataagcagtctacaaggttcaaataatcaattttgtcaagactcaaacctaatgtttttagaggaaacttgatgtctggcttctaataacacattccaaatcagtcttcagtacaagtgttcaccccattttcttctcgtaggtcaaactcgacaattagaccaagattgtcaacaaacttgtgatacacctggcaccctgcgcactgaagaaaaactgttcctctttcataggctaccctgtttatcaaacgttttgtccttgcatcacatttattacatgtaaactgaacaagcaagtttcttctaggcagctttatatcaaaactagcttccgccggtgatgccgccgaggcgtacggatcaacgtcgccggagtacgcacagacatacagtcgcctacgacgatacgaaaccctcaggctaggagctggagtcctgagcttgggattggaggacgtgaggtaagcgccagacaggggcgagcgacctgcggaggggctccccctccgcgggaacgacagcgccgccgagcag

SEQ ID NO: 132 - DNA, 1768 bp, Brachypodium distachyon
caacaccgaccaggacaattcacttggaagttgaaatctctcaacacttggtggtgaagcaaattaaagcgagagaccaaaaaagaaaagaaagcagagggggtgcggtgagccaggcgggagaagctttgccttacagtacagccgccggcaactggcggccatggcgtcctacgacaaggccatggagtcgtacaagaaggccatcaccacggcggcgtccctggcggcgtcagcgatgctggtgcggggcgtcgtcaacgagctggtaccctacgaggtgcgcaacctgctcttctccggcatgggctacctccgctcccacatgtcctcccagcacaccatcatcatagaggagacagagggctgggccaacaaccagctctacgacgccgcacgggcgtacctggcaacgcggatcaacaccgacatgcagcgcctccgggtcagccgcgtcgacgagaccaagagcatgatgttcagcatggaggaaggcgaggagatggcggacgtccacgagggcaccgagttcaagtggcgcctcgtctgccgggacaactccagcgccagcagcagcaacggcaacggcaatggccgcagcggcaatttcaagctcgaggtccggtccttcgagatgagcttccacaggaagcacaaggagaaagccctcaactcctaccttcctcacatcctggccatggccaagaagatcaaggagcaggacaggacgctcaagatctacatgaacgaaggcgagtcatggttcgccatcgatctccaccacccgtccaccttcagcacgcttgccatggatcacaagatgaagcagtcggtcatggatgatctcgagcggtttgtcaagaggaaagagtactacaagaagatcggcaaggcatggaaacgagggtacctgctgtacggcccgcctgggaccggcaagtccagcatgattgcagcaatggccaattacctcaagtttgatgtgtatgatctcgagctgactgaggtcaactggaactccaccctgaggaggttgctcatcgggatgaccaaccggtcaatccttgtcattgaggacatcgactgcactgtcgagctgcaacaacgggaggaaggtcaggagggcaccaaatccaacccttcagaggacaaggtgacactatctgggctactcaactttgtcgacgggctttggtcaacaagtggggaggagagaataatcatcttcacgacaaactacaaggagaggctcgaccctgcgcttctgcgccctggccggatggacatgcacatccacatggggtactgctgcccggagtcatttagaatcctcgcctccaattaccactccatagatcaccacgccacgtacccagagatagaagagttgatcaaggaggtcatggtgactccagcagaggttgcagaagtgctcatgaggaatgaggagactgacatcgcacttgaaggtcttatccagtttctcaagagaaagagggatggtaccaaggacggcaaagcagaaaatgctggccaggtggccaaggaggaagaacaagaggaagagaaattgacgaaaagtgatgtcccagacaatcaaaatcagcaagatgaaagcaaagaatgatgtgtatacacagtgtgatatcgaaagattagtgcctccaacaaaaatgtatcgttttgctataataagagatcatttttggaacaataagctagtctggtgttgtgaattgtgatacttcatgagtgcatacaagttcag

SEQ ID NO: 133 - DNA, 2154 bp, Avena sativa
aacaccgaccagcacgatcttgccaggttgaaatttctaaacacttggccctgaaggaaagtgtgtgagagagaaagcagaggagtgagagccgggagaagctcctcgccgccggccatggcgtcctacgacaaggccatggagtcgtacaagaaggccgtcaccacggcagcgtccctcgcggcgtccgccatgctggtgcggggcgtcgtcaacgagctggtgccatacgaggtgcgcgacctgctcttctccggcatgggctaccttcgctcgcacatgtcctcccagcacaccatcatcattgaggagacagagggctggaccaacaaccagctctatgacgccgctcgcgcctacctcgccacgcggatcaacacagacatgcagcgcctccgggtcagccgcgtggacgagaccaagagcatgatgttcagcatggaggagggcgaagagatggcagatgtccatgaaggcaccgagttcaagtggcgccttgtctgccgggacaactccagcgccagcagcagcaacggcaacggccgcggcggcaacggcaatttcaagcttgaggtccgttccttcgagatgagcttccacaggaagcacaaggagaaagccctcacctcctaccttcctcacatcctcgccatggccaagaaaatcaaggatcagaacaggacactcaagatctacatgaacgaaggtgagtcgtggtttgccattgatctccaccacccatcaaccttcagcacgcttgctatggatcacaagctcaagcaagcagtcatggatgatctcgagaggtttgtcaagagaaaggaatactacaagaagatcggcaaggcatggaaacgagggtacctgctctatggcccgcctggcactgggaaatccagcatgattgcagcaatggccaattacctcaagtttgatgtatatgatcttgagctgaccgaggtcaactggaactccacgctacggaggttgctcatcggaatgaccaaccggtcaattcttgtcattgaggacatcgactgtactgtcgagctgcaacaacgggatgaaggtcaagagggtaccaaatctaacccttcagaggacaaggtgacactttctgggctactcaacttcgtcgacgggctttggtcaacaagtggggaggagagaataattatcttcacaacaaactacaaggagaggctcgatcctgcgcttctgcggcctggcaggatggacatgcacatccacatggggtattgctgcccggagtcgttcagaatcctggcctccaactaccactctatagatcaccatgccacatacttagagatagaagagttgatcaaggaggtcatggtgactccagcggaggtagcagaggtgctcatgaggaatgaagagacagacattgcacttgaaggtcttatccaattcctcaagagaaagaaggatagcgccaaggatggtaaagcagaaaatgtggaccaggcagtgaacgaggaagaacaagagaaagagatgaccacgaaaattgatctcccagacaatcaaaatcatcaagatgagagcaaagaatgatacagtgtgcatatcatacaattagtgccagaaacgcccggcaaaaaatgtatcattttgctataataagatatcatttttggagcaataagttattccggttttgtgaactgtgatatgggttcatataagcccggttatgaactgattatctgtagcaatttcaatgcataaatactgttcaatataagcagtctacaaagttcaaataatcaatgttctcaagactcaaacctaatgtttttagaggaaacttgcaggacttcgcttctaataacacaacacaattcagtcttcagcacaagtgttcacgtcattttcttcttgtaggtcatactcaacaattagaccaagattgtcaacaaactggtgatacacctggcaccctgcgcactgaagaaaaactgttcctctttcataggccaccctgtttatcaaacgctttgtccttgcatcacatttattacatgtaaactcaacgagcaagcttctcctaggaaggtttatatcaaaagatgcttccgccggtgacgcagccgaggcgtccgggacaacctcttgggagcacgcaga

SEQ ID NO: 134 - DNA, 1491 bp, Brachypodium distachyon
tacagccgccggcaacaggcggccatggcgtcctacgacaaggccatggagtcgtacaagaaggccatcaccacggcggcctccctggaggcatcagcgatgctcgtgtggggcgtcgtcaacgagctggtaccctacgaggtgcgcaacctgctcttctccggcatgggctacctccgctcccacatgtcctcccagcacaccatcatcatagaggagaccgagggctgggccaacaaccagctctacgacgccgcacgggcgtacctggcgacgcggatcaacactgacatgcagcgcctccgggtcagccgtgtcgacgagaccaagagcatgatgttcagcatggaggaaggcgaggagatggcagacgtccacgagggcaccgagttcaagtggcgactcgtctgccgggacaactccagcgccagcagcagcaacggcaacggcaatggccgcagcggcaatttcaagctcgaggtccggtccttcgagatgagcttccacaggaagcacaaggagaaagccctcacctcctaccttcctcacatcctggccatggccaagaagatcaaggagcaggacaggacgctcaagatctacatgaacaaaggcgagtcatggttcgccatcgatctccaccacccgtccaccttcagcacgcttgccatggatcacaagatgaagcagtcggtcatggatgatctcgagcggtttgtcaagaggaaagagtactacaagaagatcggcaaggcatggaaacgagggtacctgctgtacggcctgcctggaaccggcaagtccagcatgattgcagcaatggccaattacctcaagtttgatgtgtatgatctcgagctgactgaggtcaactggaaatccaccctgaggaggttgctcatcgggatgaccaaccgatcaatccttgtcactgaggacatcgactgcactgttgagctgcaacaacgggaggaaggtcaggagggcaccaaatccaatccttcagaggacaaggtgacactatctgggctactaaactttgtcgacgggctttggtcaacaagtgggaaggagagaataatcatcttcacaacaaactacaaggagaggctcgaccctgcgcttctgcgccctggccgaatggacatgcacatccacatggggtactgctgcccggagtcatttagaatcctcgcctccaattaccactccatagatcaccacgccacgtacccagagatagaagagttgatcaaggaggtcatggtgactccagcagaggttgcagaagtgctcatgaggaatgaggagactgacatcgcacttgaaggtcttatccagtttctcaagagaaagagggatggtaccaaggacggcaaagcagaaaatgctgctggccagatggccaaggaggaagaacaagaggaagagaagatgacgaaaagtgatgtcccagacaatcaaaatcatcaagatgaaagcaaagaatga

SEQ ID NO: 135 - DNA, 1711 bp, Oryza sativa
aaacacttcgtctggaaggaaagaaggttttcagagacgtaccagagccaacagcagcagtaggctcgccggacggccagccagccatggcgtcctacgacaaggccatcgagtcgtacaagagggccgtcaccacggcggcgtccctggcggcgtcggcgatgctggtgcgcggcgtcgtgaacgagctggtgccgtacgaggtgcgggacctgctcttctccggcgtcgggtacctgcggtcgcgcatgtcgtcccagcacatggtcatcatcgaggagaccgagggctggaccaacaaccagctctacgacgccgtcaggacgtacctcgccaccaggatcaacaccgacatgcagcgcctccgggtcagccgcgtcgacgagaccaagagcatgatgttcagcatggaggagggcgaggagatggccgacgtccatgagggctccgagttcaggtggcgcctcgtctgccgcgacaactccagcagcagcaacggcaacggcaacggccgtggcgggaacggcaactaccggctcgaggtccggtccttcgagatgagcttccacaagaagcacaaggacaaggccctcaactcttacctccctcacatcctggccactgcaaagaagatcaaggatcaggacaggacgctgaagatctacatgaacgaaggtgagtcgtggttcgccatcgacctccaccacccctcgaccttcaccacgctcgccatggatcacaagcagaagcagtcagttatggatgatcttgagaggttcatcaagcgaaaggaatactacaagaagattggcaaagcatggaaacgggggtaccttctgtatggcccacctggaactggcaagtccagcttgattgcagccatggccaattacctcaagttcgacgtatatgatctcgagctgactgaggtcaactggaactcaacccttcgacggttgctcatcgggatgaccaacaggtcaatcctagttatagaagatatcgactgcactctagagctacaacaacgggaggaaggtcaagagagttccaaatccaatccttcagaggacaaggtaacactatctgggctactcaacttcgtggatgggctttggtcaacaagtggggaggagagaataattgtcttcacgacaaactacaaggagaggctcgaccctgcgcttctgcgtcctggcaggatggacatgcatgtccatatgggttactgctgcccagagtcatttagaattctggcctctaactaccactccattgataaccatgccacatacccagagatagaagagttgatcaaggaggtcatggtgacaccagcagaggtagctgaggtgctcatgaggaatgatgacactgatgttgcccttgaaggccttattcagttcctcaagagaaagaaagatgttggcaaggaaggcaaagctgaaaatgtggagcaggtggtgaaggcagaagaaacagagaaagggatgatgaagaaaaatgatgtcccagagaatcaagatccccaagatgcaagcaaataatgatgcttaaacagtgtgcatagcatataattagtgcatcaaattctgtcagatgtatcgttttgactactagtaaaagatcatttttggaataataatgtactctagggaaatgagcttgtgatactatttctattatcacaaaatacatagtaaggtttcat

SEQ ID NO: 136 - DNA, 1733 bp, Panicum virgatum
cgccgggtggtgggtcggccatggcgacctacgacaaggccatcgagtcgtacaagaaggcggtgaccacggcggcgtcgctggcggcgtcggcgatgctggtgcgaggcgtggtgaacgagctgctgccgtacgaggtgcgggaactgctcacctccgggctgggctacctgcggtcgcgcatgtcgtcgcagcacacggtggtgatcgaggagaccgagggctgggccgccaaccagctctacgacgccgcgcgggcctacctcgccacgcggatcaataccgacatgcagcgcctccgcgtcagccgcgtcgacgagggcaagagcctcatgttcagcatggaggagggcgaggagatggccgacctccacgaaggcgccgagttcaggtggcgcctcgtctgccgggacaacctgggcgccggcgccggcaacggcaacggcggccgcggcggcaacggcagctaccgcgtcgaggtgcgctccttcgagatgagcttccacaagaagcacaaggagaaggccatcacctcctacctcccgcacatcctcgccacggccaagaagatcaaggagcaggacaggacgctcaagatctacatgaacgagggcgagtcctggttcgccatcgacctccaccacccgtccaccttcagcacgctcgccatggaccgcaagatgaagcaggcggtcatggatgacctcgagaggtttgtcaagaggaaggagtactacaagaggattggcaaggcgtggaaacgggggtacctcctgtatggcccgcctgggaccggcaagtccagcctcattgcagccatggccaactacctcaagttcgatgtctatgatctcgagctcactgaggtgaactggaactcaacacttcgacgactgctcatcgggatgaccaacaggtcaatcctagtcatcgaggacattgactgctctatcgatctgcaacagcgggacgaaggtcaggatggtaccaaatccaatccttcagaggacaaggtgacactatctggactactcaacttcgtcgatggcctttggtcaacaagtggggaggagagaatcattatcttcacgacaaactacaaggaacgacttgatccagcgcttcttcgccctggcaggatggacatgcacatccacatggggtactgctgccccgagtctttcagaatcctggcctccaactaccactccatcagtgaccatgacacgtaccctgagatagaagagttgatcagggaggtaaaggtgactccagcagaggttgcagaagtgcttatgaggaacgacgacactgacatcgcactcgagggccttatccagttcctcaagggaaagaagagtgatgccaaggatagcaaagatgagaatgtggaccatgtggccaaagagggtgccaaagagatgacaaaacaagacctctcaggcgatcaaaatctgaacgatgcaggcaaagaatgatgccaaagtagtgtgcatatcatatgttagtaccagaaaaatcagccaaaaatgtatgttttggtattaataagagatcatttttggaactagagaatactctggtactatagtactttattttcttctttaaatcagataccacattgtaaagtacatatgggcccaggttaactcacatgagtatatgcagcaattcaatcttaatatgaatgtgtctacagtatccaaatagtcaatattgttgaaatctac

SEQ ID NO: 137 - DNA, 1824 bp, Setaria italica
gcccataaaaactcagccccgaccccttctccacgcccattgttcttgttcattcacttcacacccccctctgtcgtccagcacacacaaccagcgcgcgcggcgccgccgaccctgaattcaaccaatcattcaatcctctcccggccggcatttcgagctccgatcggtcgaccgccggcggccggccatggcgacctacgacaaggcgatcgagtcgtacaagaaggcggtgacgacggcggcgtcgctggcggcgtcggcgatgctggtgcgcggcgtggtgaacgagctggtcccctacgaggtgcgggacctcctcttctccggcctcggctacctgcggtcgcgcatgtcgtcgcagcacacggtggtgatcgaggagacggaggggtgggccaccaaccagctctacgacgccgcgcgcacgtacctcgccacgcggatcaacaccgacatgcagcgcctccgcgtcagccgcgtcgacgaagggaagagcctcatgttcagcatggaggagggcgaggagatggccgacctccacgacggcgccgagttcaggtggcgcctcgtctgccgcgacaaccctggcgccggcgcgggcaacggcaacggagggcgcagcgggaacggcggctaccgcgtcgaggtgcgctccttcgagatgagcttccacaagaagcacaaggagaaggccatcgcgtcctacctcccgtatatcctcgccacggccaagaagatcaaggagcaggacaggacgctcaagatctacatgaacgaaggtgagtcctggtttgccatcgacctccaccacccgtccaccttcaccacgctcgccatggaccacaagatgaagcagtcggtcatggatgacctcgagaggtttgtcaagaggaaggagtactacaagaggattggcaaggcgtggaaacgggggtacctcctgtatggcccgcctgggaccggcaagtccagcctgattgcagccatggccaactacctcaagttcgacgtctatgatctcgagctgacggaggtgaattggaattcaacgcttcggaggttgctcatcgggatgaccaaccggtcaatccttgtcatagaggatatcgactgctccattgatctgcaacagcgggcagacgaaggtcaggatggtaccaaatccagtccttcagaggacaaggtgacactatctgggctactcaactttgtcgatggcctttggtcaaccagtggggaggagagaatcattatcttcacaacaaactacaaggagcggcttgatccggcacttcttcgccctggcaggatggacatgcacatccacatggggtactgctgcccagagtcgttcagaatcctggcctccaactaccacgccatcagcgaccatgacagataccctgagatagaagagttgatcaaagaggtgatggtgactccagcagaggtggcagaggtgcttatgaggaacgatgacaccgatatcgcacttgagggccttatccagttcctcaaggcaaagaggagcgatgccaaggatagcaaaggtgagaatgtggtccatgaggccaaagaggacaggaaagaaatgatgacggaacaagacatctcaggcgatcaaaatctgaacgatgcaggcaaagaatgatgcccatgtagtgtgcatatcatatattagtaccagaaaatatcagccaaaaatgtattgttttgatattaataagagatcatttttggaactagagaatactctggtgtcatgatactttatttccttcataaaatcagataccacattgtaaagtacatgtaggccca

SEQ ID NO: 138 - DNA, 2753 bp, Aegilops tauschii
gcgaggtatagccgcacccgcggaaatgcgggcgaggataaacttaagtgggccgcgtgcccatacataatcgggcctcctttgtacagccttccagtcactccgtcggatggctccattgcacagcaggaggaggaacgggagaggagaggattcctcaacccagtagccaccggccgatggcgacgacggccacggggtacggctggtcggcgggggcggcggtcccccgggggggggggggcgtccccgggggggtccagtagcccccggccgatggcgacgacggccacggggtacggctgctcggcggcgctgtcgttcccggggagggggagctccttcgccggtcgctcacccccgtcccgcgcttgcctcacctcctccaatcccaagctcaggactcccgctcctagcctgagggtttcatatcttcgtaggggactctatgtctgtgcgtgctccggcgacgttgatccggatgcctcggaggaagctagttttgatataaagcttcctagaagaagcttgcttgttcagtttacatgtaataaatgtgatgcaaggacaaaacgtttgataaacagggtgggctatgaaagaggaacagtttttcttcagtgtgcagggtgccaggtgtatcacaagtttgttgacaatcttggtctaattgtcgagtatgacctacgagaagaaaatggtgtgaacacttgtactgaagactgatttggagaagtgttattagaagccagacatgctaagtttcctctaaaaacattaggtttgagtcttgacaaaattgattatttcaaccttgttgactgcttatattgaacagtatttctgcattgaaataactaccaatactgagttcataactgggtttatatgcactcaaatagtataactgttcacaataccagattattttattgttaccaaaattgatctcttattatagcaaaatgatacattgttgctcgaagttcctggcactaattgtatgatattcacactgtatacacatcattctttgctcccatcttgctgatcttcattatctgggacatcacttttcgtcatcatctccttctcttgttcttcctccttcgccacctggtccacattttccggtttgccagcgccatctttctttctcttgaggaactggataagacctttgagtgcgacgtccgtctcttcattcctcatgagcacctctgcgacctctgctggagtcaccatgacctccttgatcaattcttctatctccgggtatgtggcatggtgatctatagagtggtagttggaggccaagattcggaacgactctgggcagcagtaccccatgtgaatgtgcatgtccatcctgccagggcgcagaagcgcaggatcgagcctttctttgtagtttgttgtgaagataattatcctctcctccccacttgttgaccaaagcccatcaacgaagttgagtagcccggatagtgtcacctgttggagatagcacataggacatcagaatggaaagaaaactaaggaactaagcaatgcaagggaaatatcattccaagtatctatctaaccttgtcctctgaagggttggatttggtgccctcctgaccttcctcccgctgttgcagctcgacagtgcagtcgatgtcctcaatgacaagaattgaccggttggtcatcccgatgagcaacctccgaagtgttgagttccagttgacctcagtgagctcaagatcatatacatcaaatttgaggtaattggccattgctgcaatcatgcttgacttgccagtcccaggtgggccatacagcagatcttgagcgtcctgttctgctctttgattttcttggccacggcgaggatgtgagggaggtaggaggtaagtgctttgtccttgtgcttcctgtggaagctcatctcgaaggaccggacctcaagcttgaaattgccgctgccgccacggccgttggtgttgctgctgctggcgctggggttgtcccggcagacaaggcgccacttgaactcggtgccctcatggacatcggccatctcttcgccctcctccatgctgaacatcatgctcttggtttcgtcgacgcggctgacccggaggcgctgcatgtcggtgttgatccgcgtcgccaggtacgcccgcgcggcgtcgtagagctggttgttggcccacccctcggtctcctctatgatgatggtgtgctgggaggacatgtgcgagcgaaggtagcccatgccggagaagagcaggtcacgcacctcgtagggcaccagctcgttgacgacgccccgcaccagcatcgcggacgccgcgagggaggccgccgtggtgacggccttcttgtacgactccatggccttgtcgtaggaggccatggccggcggcgggctacgggcaaagtcactcctctgcttttgcctctcactttccttcaagaccaagtagtgctgggagatttgaaccttccaagcagtgatggtgctggtcggtgttgaatgggggcgtttagctggcgcgcggttttatagctggcttggtttgcgtcgaagtggttgggtgacgggcgagtcagtcaagctaaataacattggtctgagtggtgcgttgtccagaaaggaggccttggccaaagtagaaaaatggcatcacactacttggtggggttttttctaatggcacggccatgttccttgggtggccgtgctaaacaacgccagaaatggc

SEQ ID NO: 139 - DNA, 2095 bp, Sorghum bicolor
ccgcaccgagcacaagatcctcccggcggcatttccagcaagacaactgtttgtgtggaacttgagcgagagagaaagagagggtgatctgagcagccatcgacgagcgagcgagagctacacggttgtgttgtgcgcggtcaccggccgggcagccagccagccagccatggcgacctacgacaaggcgatggagtcgtacaagaaggcggtgacgacggtggcgtcgctggcggcgtcggcgatgctggtgcgcggcgtggtgaacgagctggtcccctacgaggtgcgggagttcctcttctccggcctgggctacctccggtcgcgcatgtcgtcgcagcacacggtggtgatcgaggagacggaagggtgggcgagcaaccagctgtacgacgcggcgcgcacgtacctggcgacgcggatcaacaccgacatgcagcgcctccgcgtgagccgcgtcgacgagggcaagagcctcatgttcagcatggaggaaggcgaggagatggccgacgtccacgccggcgccgagttcaggtggcgcctcgtctgccgcgacggcggcggcgccggcgccggcaacggcggccacgcccacgcccacgcccgcggcggcggcggcggcggcagctaccgcttcgaggtccgctccttcgagatgagcttccacaggcggcacaaggacaaggccatcgcctcctacctcccgcacatcctcgccgaggccaagaagatcaaggaccaggacaggacgctcaagatctacatgaacgaaggcgagtcctggttcgccatcgacctccaccacccttccaccttcaccacgctcgccatggaccgcgacatgaagcgctccgtcatggacgacctcgagaggttcgtcaggaggaaagagtactacaagaggatcggcaaggcctggaagcgagggtacctgctccacggcccgcctgggaccggcaagtccagcctcattgccgccatggccaactacctcaagttcgacgtctacgatctcgagctcacagaggtgaactggaattccacgctgaggaggctgctcatcgggatgaccaacaggtccatcctcgtcatcgaggacatcgactgctccgtcgatctgcagcagcgtgcagaggaaggtcaggatggtggtacaaaatccagtcctcctccttcagaggacaaggtgacattatctgggctactcaacttcgtggatggtctgtggtcaacaagtggggaggagaggatcatcatcttcacgacgaactacaaggagcggctcgacccggcgctgcttcggccaggcaggatggacatgcacatccacatgggttactgctgcccggagtcattcagaatcctggcctccaactaccactccatcactgaccacgacacataccctgagatagaagcactgatcaaggaggcgatggtgactccagcagaggtcgcggaggtgctcatgaggaacgacgacaccgacatcgcgctccagggccttattcggttcctcaagggaaagaagggtgatgccaagaacagccaaggcgaaaacgtggagcacgtgaccaaagaggaggagaaagagatgatgccgacaaaaaaagatgacccagtcgatcaaaatctcaatgatgcaggcaagcaatgatgccaaagtagtgtgcatatcaaatgttgtagtgccagaataacctgctgaaaatgtatcgttttggtattaataagaggtcttttttttcgagctgcagagtactctggtattatgatcctttgtctccttcatataaaatcatatgtatcacactgtatgtaaagtacatataggccctgttgcattcagatgagtatatgcagcagctttaacgtgccattctacacataataaacaatcaatgttgtcaaaacctacagactacagggcgttttgcataccgacactgcttcccacaacagatcaatcttcagaattggtgctcaccacattttctccttgtagctcattttcttctcgtagatcatactcaacaactagaccaagattatcaacaaacttgtggtacacctggcaccctgcacactg

SEQ ID NO: 140 - DNA, 1339 bp, Triticum aestivum
gcacattagtatcttagcaccttgctaaaccctgaagcttagagaactcgaagcgccataaatttaatggctagcccgacgaagctcgacatggccggccatggcgacgaggtgacgaggaacaagaaggtggtgctgaggaggtacgtgacaggctacccgacggcggaggacatggaggtggtcgtcacctccgacgtccggctgcgggtgccggaggggtcggcggccgccgtggtggtcaagaacctgtacctgtcctgcgacccgtggatgcgcggccgcatgaccaagcatgacgacggcgacgccgtgccggccgaggacttcgtgcttggagaggccttggtcaatttcaccgtcggcgaggtggtcgactcgacgcacccggagttcgacgccggtgacctcgtatggggcatgagtgcatgggaggagtacaccctcatcacccaaacggagggcctgttcaagatcaaccaccccgagctgccactctcacactacacaggtgttcttggcttggcagggctcactgcatatgctggacttttcgaggttggcaagccaaagcaaggtgaaactgtttttgtgtcggcagcatctggcgccgtcggtcaggttgtcggacagctcgccaagatcgcaggatgctatgtggttggaagtgccggctccgatgagaaggtgaatctcttgaagagcaagatgggcttcgacgacgcgttcaactacaagtcggagggggacgacctcggcgcggcgctcgggcggcgcctcccgggcggcatcaacgtctacttcgacaacgtgggcggcgcgacgctggacgcggcgctgctgcggatgcggccgggcggccgggtggtggcgtgcgggatgatctcacagtacaatctgtcggagcaccagggggtgcgcaacctgtggtgcatcatcccaaagcgcgtccgggtggagggcttctcctgcatggactaccaccacctgtatcccaggttcgaggaggaaatggccggctatatcaaggcagggaaggtgaccgtcgtggaggacgtcgtccgagggattgagagggcgcctgaggctctgctgggcctgttttctgggagaaatgttggcaagctgctggttgctcttgcatgagtcatgagtgtgagtccatggaataatgacttctttatgtgttttattgaataagattgtagctgcaggcttataattatgataatgtaattgtaagccataaaaaattatacacttctgctttggtacccccactaaatacatcaagggaggatgctctttcgtaataaaacgcatgatgacctttattaaa

SEQ ID NO: 141 - DNA, 2034 bp, Triticum aestivum
atcggtgcagcaatggacgccatggaaagaggacagggctcgccgcggctgccaaagagccggggctcaaagatcgacgaagaaagcctcagggtgccgctgatagagagcaagaaaaccggcagccgggcgccggcggtggtcctcgggttcgagtgcctcgagagcacggccttcaacggcgtcgccaccaacctggtgctctacctggagagcgtcctgcacggcagcggcctcgccagcgcctccaacgtcaccacgtggatcggcaccagcttcctcacgcccgtcctcggcgccatcctcgccgacaccttctggggcaactacaccaccatcctcgtctccctcgtcgtctaccttctgggtatgatgctcatcaccttctctgcgttactgccgaccaccgagctgtgcgggctgggctcgtcgtgccacccgatgttcggcgcgcacaccgtcgccttctccggcctctacctcgtggcgttcggcagcggcggcgtgcgggcggcgctgctgccgttcggcgcggagcagttcgacgacgacaacgccgtggaccgggagcggaagatggcattcttcagctggttctacatctgcgtcgacttcggcatgatcgtgtccgggctcttcctcgtgtggatccagcagaacgtcagctggggcctcggcttcggcatcgccacggcctgcatcgcgctcgccttcgtcggcttcgtgcttttcacgcccatgtacaagcgtagcatgccgaccggcagcccgttcaagagcctgtgccaggtcgtggtcgccgcgtgcaggaaggtcaccctccgcgtccccgccgaggccgccgtcctctacgaggtcagcgacaagatcgaccagcccaggatcgcgcacaccaaagagttcacgttcctcgacaaggcggccgtggtcgcggactcggacctggaggaggtgacgaacgtcgacgccgcggcggcggccacgggctcgtggaggctgtgcacggtgacgcaggtggaggagctcaagatcctgatgcggctgctgccgatctgggcgacgagcatcgtgctgtccgcggcgtacgcgcagcttaacaccacgttcgtgcagcagggcagcgccatggacatgcgggtcatgtcgttcaccatcccggccgcgtccatggtgtcattcgaggtgatctgcgtcctggcgtgggtgctcatctacggctcggtgatcgtaccggcactcaggagactgtccccggcgagcggcgagccgtcgcagctgcggcggatgggcgccgggcggctgctcatggcgttcgcgatggccgtggcggcgctagtggagatgaggaggcttgaggccgccgggagcggggagtccatcagcatcgggtggcagatgccgcagtacttcgtgctggccggcgcggaggtgttctgctacatcgcgcagctggagttcttctacagcgaggcgccggagtcgatgaagagcatgtgcacgtccttcgcgctactcaccgtggcgctgggcagctacgcaagctcgctgatctacgccgtggtgaacgcgctgacggccaccggcggccggcccgggtggatatcggacgacctcaacgaggggcacctcgattacttcttctggaccatggcggcgctgtgcacgctcaacttcgtcgtgtacagcgccttcgccaggaactaccaggtgaagacggtcgtgtcgtgatcgtgatcgttccttactcgtcggcgtacataaagagagcatcagatttcgcattgcaacgcgcagtgcggtggtacaaaagatttgttttgttcttgtttcagaattcaaaaggttctttctttaggtagaacgttataaaagaatttagaactagtttggtatgatgcaattacggcaacacgcaacagaacctgggtctgtgatactgtgtagttgtcttcgttttggtgtaaacggtcactttggtgctacaacttgtggcatacaatgaactggtgcaacaacttggctcggacgtgcaaa

SEQ ID NO: 142 - DNA, 2061 bp, Hordeum vulgare
ggctcccacccgagccactcaaaaaagccacaaggcttctcacttcatcaaggcatacctagcttatcgtcggtgcagcaatggacgccatggaaagaggccagggctcgccgcggctgccaaagagccggggctcgaaggtcgacgaggaaagcctcaagacgccgctgatagagagcaagaagaccggcagccgggcgccggcggtggtgctcgggttcgagtgcctcgagagcacggccttcaacggcattgccaccaacctggtgctctacctggagagcgtcctgcacggcagcggcctggccagcgcctccaacgtcaccacgtggatcggcaccagcttcctcacgcccgtcctcggcgccatcctcgccgacaccttctggggcaactacaacaccatcctcgtctccctcgtcgtctaccttctcggtatgatgctcatcaccttctctgcgctcctgccgaccaccgatctgtgcgggctgggctcgtcgtgccatccgatgttcggcgcgcacaccgtcgccttctccggcctctacctcgtggcgttcggcagcggcggcgtgcgggcggccctgttgccgttcggggcggagcagttcgacgacgacaacgccgtggaccgggagcggaagatggcattcttcagctggttctacatctgcgtcgacttcggcatgatcgtgtccgggctcttcctcgtgtggatccagcagaacgtcagctggggcctcggcttcggcatcgccacggcctgcatcgcgctcgccttcgtcggcttcgtccttttcacgcccatgtacaagcgcagcatgccgaccggtagcccgttcaagagcctgtgccaggtcgtggtcgccgcgtgcaggaaggtcaccctgcgcgtccccgccgacgccgccgtcctctacgaggtcagcgacaagatcgaccagcccaggatcgcgcacaccaaggagttcacgttcctcgacaaggcggccgtggtcgcggactcggacctggaggaggtgaccaacgtcgacgccgcggcggcggccgcgggctcgtggaggctctgcacggtgacgcaggtggaggagctcaagatcctgatgcggctgctgccgatctgggcgacgagcatcgtgctgtcggcggcgtacgcgcagctcaacaccacgttcgtacagcagggcagcgccatggacatgcgggtcatgtcgttcaccatcccggccgcgtccatggtgtccttcgaggtgatctgcgtcctggcgtgggtgctcctctacggctcggtgatcgtgccggcactcaggagactgtccccggcgagcgacgagccgtcgcagctgcggcggatgggcgccgggcggctgctcatggcgttcgcgatggccgtggcggcgctggtggagatgaggaggctggaggccgccgggagcggggagtccatcagcatcgggtggcagatgccgcagtacttcgtgctcgccggcggggaggtgttctgctacatcgcgcagctggagttcttctacaccgaggcgccggagtcgatgaagagcatgtgcacgtccttctcgctgctcaccgtggcgctgggcagctacgcgagctcgatgatctacgccgtcgtgaacgcgctcacggccaccggcgggcggcccgggtggatatcggacgacctcaacgaagggcacctcgactacttcttctggtccatggcggcgctgtgcacgctcaacttcgtcgtgtacagcgccttcgccaggaactaccaggtgaagacggtcgtgtcgtgatcgtgatcgttccttgctcgtcggcgtacataaggagggcatcggatttcgcattgcaacacgcagtgcggtggtacaaaagattgttttgtttcttgtttcagaattcaaaaagttctttctttaggtagcgcgttataaaagaattttaaatctagtttggtatggtgcaattacgggaacaagcaacaacaattgggtttgtgatactgtgtactattagttgtcttcgttttgtttgtagatgttttagtagttttttttt

SEQ ID NO: 143 - DNA, 2135 bp, Brachypodium distachyon
ttccgatctcagacccgagactcccacaagagccaaagccaaaggcgcctagctcccgggagttccacgaaaattgctgcaatggacgccatggaaagaggccagagctcgccgcggctgcctaagagccgaggttcaaagatcgacgaagaaagcctcaaggtgccgctgatcgaggcgaagaagaagaccggcagcagagcgccggcggtggttctcgggttcgagtgcctggagagcacggcgttcaacggcattgccacgaacctggtgctgtacctggagcgcgtcctgcacggcagcagcctcggcagtgcgtccaacgtcacgacctggatcggcacgagctacctgacgcccgtcttcggcgccatgctcgccgacaccttctggggcaactacaacaccatcctcgtctccctcgtcgtctaccttctcggcatgatgctggtcacgttctcggcgttcctgccgacgacggcgctctgcggggtggggtcgtcgtgccacccggtgctgggctcgcacaccgtggccttcgcggggctctacctcgtggcgttcggcagcggcggcgtccgggccgcgctgctgccgttcggcgcggagcagttcgacgacgacaacgcggtggaccgggagcggaagatgtccttcttcagctggttctacatcgccgtcgacttcggcatgatcgtgtcgggtctcttcctcgtgtgggtgcagcagaacgtctcctggggcctgggtttcggcatcgccacggcctgcatcgcgctcgccttcgccgggttcgtgctcgccacgcccatgttcaagcgccggatgccgtccggcacgccgctcaagagcctgtgccaggtcgtggtcgccgcgtccaggaaggtcgccctgcgcgtggttccctcggaggccgcgaacctctacgaggtgagcgacaagatcgagcacgagcagcccaggatcgcgcacacggacgagttcacgttcctcgacagggcggccatgatcgtggcgtcggacctggcagaggtgaccgcgaacgacgccggcgcgggcgcgggttcttcctcgtcgtcctggaggctctgcacggtgacgcaggtggaggagctcaagatcctgatgcggctgctgccgatctgggcgacgagcatcgtgctgtcggcggcgtacgcgcagctgcagaccacgttcgtgcagcaggggaacgccatggacacgcgggtcatgtccttcagcctccccgccgcgtccatggtgtccttcgaggtgatctgcgtcctggcatgggtgctcatctacgacttcgtgatcctgccggcgctccggagcttctcccccgcgagcggcgagccgtcgcagctgcagcggatgggcgccggccggctgctcatggcggtggccatggccgccgccgccctgctcgagatgaagcgtctggacgccgcggcagggggcgggtccgtgagcatcgcgtggcagatgccgcagtacttcgtgctcgcgggcggcgaggtgttctgctacatcgcgcagctggagttcttctacaacgaggcgccggagtcgatgaagagcatgtgcacgtcgttcgcgctgctcaccgtggcgctgggaagctacatgagctcgctcatctacggcgtcatcaacatgctcacggccacggacgggcggcccggatggattccggacaacctcgacgagggacacctcgactacttcttctgggtcatggccgcgctctgcacgctcaacttcgtcgtctacagcgccttcgccaggaactaccaggtcaagacggtcgtgtcgtgatcgttccttgctccttggctcggcgtacatacaaaacgcatcagaattcacattgcacacgcagttcgtgttgcacagtttttttgttttgttttttcagttttggaggggaatttccaaaaagtttttttatttgtttgttttgagacggcatggtcgtacaaaacattttagaactagctagctttagtccacagaaaacaacggtatggaaatactggtatttgtgtgctccagtaatttgtttgggtacggctgagaccgtctaatatacagtacatccatatacagtactcgtatgttgtgtactccagaaa

SEQ ID NO: 144 - DNA, 2254 bp, Oryza sativa
atctctcgtgctcagctcgcagccaaaaaccccaaggcgctctcacgacggcaggagctagcttagctgcagaaaaagcaggtgacgttgaattctgatttctgaacgagttgcagcagcatagcgacaatggacgccggcgacgccatggagagaggccagcagcggctgccagagagctggaacccgaaactccaggacgacgtcagcctgacggtgccactcatccaggacaagaagagcgggagcaaagcgccggcggtggtgctaggattcgagtgcttggagagcacagcgttcaacggcattgccacgaacctggtggtgtacctggagaccgtcctgcacggcagcagcctcgcgagcgcgtccaatgtcacgacgtggttcggcacgagctacctcacgccggtgttcggcgccatcatcgccgacacgttcttcggcaactacaacaccatcctcgtctccctcgtgttctacctcctgggcatggtgctggtcaccttctcggcgttcctgccgaccaccgcgctgtgcgccgtggcgggctcgacgtcgtgccagcagcctgtgtttggcgcgcagaccatcgccttcgtggggctctacctcgtggcgttcggcagcggcggcgtgcgcgcggcgctgctgccgttcggcgcggagcagttcgacgacgacaacgcggtggaccgggagcggaagatgtccttcttcagctggttctacatgtgcgtcgacttcgggatgatcgtgtcgggcctattcatcgtgtggatccagcagaacgtgagctggggactcggcttcggcatcgccacggtttgcgtcgcgatcgcgttcggcggcttcgtgctcgccacgcccatgtacaagcgcagcatgcccaccggcacgccgctcaagagcctcgcccaggtggtggtcgccgcgtgccggaaggtcagcctccgtgtccccgccgacgccgccctcctctacgaggtccatgacaagatcgatcagcccaagatcacgcacaccgacgagttcagctttcttgacaaggcggcggtgatcgtgcagtccgacctggaagaggactcgaacgacgcctcggcggcggccgcgggctcgtggaggctatgcacggtgacgcaggtggaggagctcaagatcctgatgcggctgctgccgatatgggcgacgagcatcgtgctgtcggcggcgtacgcgcagctgaacaccacgttcgtgcagcagggcgccgcgatgaacatgcggatcatgtcgttcaccatccccgccgcgtcgatggtgtccttcgaggtgttctgcgtcctggcatgggtgctcgtctacggctcggtgatcgtgccgctcctcaggagcttctccccggccaacggcgagccgtcgcagctgcggcgcatgggcgccggccgtctgctcatcgcggtcgccatggccatcgccgcgctggtggagatggtgcgcctcgacgcggcggcgcgcggcgagtccctgagcatcgcgtggcagatgccgcagtacttcatgctggccggcggtgaggtgttctgctacatcgcgcagctggagttcttctacagcgaggcgccggagtccatgaagagcatctgcacgtcgctggcgctgctcaccgtggcgctgggaagctacatgagctccttcatctacgccgtcgtgaacgcgttcaccgccgtggacggccggcccgggtggatttcggacaacctcaacgagggacacctggactacttcttctgggtcatgtcggcgctgtgcacgctcaacttcgtcgtgtacagcgcgttcgcgcggaactacaaggtgaagacggtcgtgtcatgatcgctcgcccacacgtccgcgcgtacataggcaaaacaaggtagcgttaggaacggggtgcgtccaggaaatacacgggacacgtccggtgcacctgcgaaacggtttttgtatcgcagcgaccaatatcttctggctgctgctgatcgacgccatcgtgttccttgttgtttattgtttctttctttttgtcggttttactggaaaggaaatacggatgggcaacaggacatccatgaactttatttatgctgtggtcctgaaagaaaaaacagaaggaaatgcaatgtggaaacatggtgtgaccgtgtgagtgataccgcacatttcatggtagtactctgcaacagttatggccgttggtgatcaaatctctatgggccgtttgtaaatctcg

SEQ ID NO: 145 - DNA, 1926 bp, Oryza sativa
cggacgtgtcccgtgtatttcctggacgcaccccgttcctaacgctaccttgttttgcctatgtacgcgcggacgtgtgggcgagcgatcatgacacgaccgtcttcaccttgtagttccgcgcgaacgcgctgtacacgacgaagttgagcgtgcacagcgccgacatgacccagaagaagtagtccaggtgtccctcgttgaggttgtccgaaatccacccgggccggccgtccacggcggtgaacgcgttcacgacggcgtagatgaaggagctcatgtagcttcccagcgccacggtgagcagcgccagcgacgtgcagatgctcttcatggactccggcgcctcgctgtagaagaactccagctgcgcgatgtagcagaacacctcaccgccggccagcatgaagtactgcggcatctgccacgcgatgctcagggactcgccgcgcgccgccgcgtcgaggcgcaccatctccaccagcgcggcgatggccatggcgaccgcgatgagcagacggccggcgcccatgcgccgcagctgcgacggctcgccgttggccggggagaagctcctgaggagcggcacgatcaccgagccgtagacgagcacccatgccaggacgcagaacacctcgaaggacaccatcgacgcggcggggatggtgaacgacatgatccgcatgttcatcgcggcgccctgctgcacgaacgtggtgttcagctgcgcgtacgccgccgacagcacgatgctcgtcgcccatatcggcagcagccgcatcaggatcttgagctcctccacctgcgtcaccgtgcatagcctccacgagcccgcggccgccgccgaggcgtcgttcgagtcctcttccaggtcggactgcacgatcaccgccgccttgtcaagaaagctgaactcgtcggtgtgcgtgatcttgggctgatcgatcttgtcatggacctcgtagaggagggcggcgtcggcggggacacggaggctgaccttccggcacgcggcgaccaccacctgggcgaggctcttgagcggcgtgccggtgggcatgctgcgcttgtacatgggcgtggcgagcacgaagccgccgaacgcgatcgcgacgcaaaccgtggcgatgccgaagccgagtccccagctcacgttctgctggatccacacgatgaataggcccgacacgatcatcccgaagtcgacgcacatgtagaaccagctgaagaaggacatcttccgctcccggtccaccgcgttgtcgtcgtcgaactgctccgcgccgaacggcagcagcgccgcgcgcacgccgccgctgccgaacgccacgaggtagagccccacgaaggcgatggtctgcgcgccaaacacaggctgctggcacgacgtcgagcccgccacggcgcacagcgcggtggtcggcaggaacgccgagaaggtgaccagcaccatgcccaggaggtagaacacgagggagacgaggatggtgttgtagttgccgaagaacgtgtcggcgatgatggcgccgaacaccggcgtgaggtagctcgtgccgaaccacgtcgtgacattggacgcgctcgcgaggctgctgccgtgcaggacggtctccaggtacaccaccaggttcgtggcaatgccgttgaacgctgtgctctccaagcactcgaatcctagcaccaccgccggcgctttgctcccgctcttcttgtcctggatgagtggcaccgtcaggctgacgtcgtcctggagtttcgggttccagctctgcagatcaagttcaaagtttggggagaacatgtcagtttacatttttttttatttcttgtatatctgaacaagccatcaaagtttttgcggcgttgttgtagacgtcagcgattgtacttgaaaatcgtaaagggataaaggaagcagctttgtac

SEQ ID NO: 146 - DNA, 2050 bp, Secale cereale
atcggtgcagcaatggacgccatggaaagaggccagggctcgccgcggctgccaaagagccggagtccgaaggtggacgaagaaagcctcaaggtgccgctgatagagagcaagaagaccggcagccgggcgccggcggtggtcctcgggttcgagtgtctcgagagcacggccttcaacggcgtcgccaccaacctggtgctctacctggagagcgtcctgcacggcagcggcctcgccagcgcctccaacgtcaccacctggatcggcaccagcttcctcacgcccgtcctcggcgccatcctcgccgacaccttctggggcaactacaacaccatcctcgtctccctcgtcgtctaccttctgggtatgatgctcatcaccttctctgcgttgctgccgaccaccgagctgtgcgggctgggctcgtcgtgccacccgatgttcggcgcgcacaccgtcgccttctccggcctctacctcgtggcgttcggcagcggcggcgtgagggccgcgctgctgccgttcggggcggagcagttcgacgacgacaacgccgtggaccgggagcggaagatggcattcttcagctggttctacatctgcgtcgacttcggcatgatcgtgtccgggctcttcctcgtgtggatccagcagaacgtcagctggggcctcggcttcggcatcgccacggcctgcatcgcgctcgccttcgtcggcttcgtgcttttcactcccatgtacaagcgcagcatgccgaccggcagcccgttcaagagcctctgccaggtagtggtcgccgcgtgcaggaaggtcaccctccgcgtccccgccgacgccgccgtgctctacgaggtcagcgacaagatcgaccagcccaggatcgcgcacaccaaggagttcacgttcctcgacaaggcggccgtggtcgcggactcggacctggaggaggtaacgaacgccgacgccgccgcggcggccgcgggctcgtggaggctgtgcacggtgacgcaggtggaggagctcaagatcctgatgaggctgctgccgatctgggcacgagcatcgtgctgtcggcggcgtacgcgcagctcaacaccacgttcgtgcagcagggcagcgccatggacatgcgggtcatgtcgttcaccatcccggccgcgtccatggtgtccttcgaggtgatctgcgtcctggcgtgggtgctcctctacggctcggtgatcgtgccggcactcaggagactgtccccggcgagcggcgagccgtcgcagctgcggcggatgggcgccgggcggctgctcatggcgttcgcgatggccgtggcggcgctggtggagatgaggaggctggaggccgccgggagcggggagtccatcagcatcgggtggcagatgccgcagtacttcgtgctggccggcggggaggtgttctgctacatcgcgcagctggagttcttctacagcgaggcgccggagtcgatgaagagcatgtgcacgtccttcgcgctgctcaccgtggcgctgggcagctacgcgagctcgctgatctacgccgtggtggacgcgctgacggccaccggcggccggcccgggtggatatcggacgacctcaacgaggggcacctcgactacttcttctggaccatggcggcgctgtgcacgctcaacttcgtcgtgtacagcgccttcgccaggaactaccaggtgaagacggtcgtgtcgtgatcgtcatcgttcctgacccgacggcgtacataaagagagcatcagatttcgcattgcaacgcgcagtgcggtggtacagaagatttgttttgttcttgtttcagaattcaaaaaagttcttttttttgtgagtacaaaaagttctttctttaggtagcacgttataaaaagaagttagaactagcttggtatgatgcaattacggcaattgtcttcgttttgtttgtaagacgttttagcagttcaaattaaactgcaaaaacatcttttattagtgtttgcagttaaaattaaactgcaaaaacatcttttattagtgtttg

SEQ ID NO: 147 - DNA, 2247 bp, Secale cereale
cttgatatcggtgctgcaatggacgccatggagagaggccagggctcgccgcgcctgccaaagagccggagtccgaaggtcgacgaagaaagcctcaaggtgccgctgatagagagcaagaagaccggcagccgggcgccggcggtggtcctcgggttcgagtgtctcgagagcacggccttcaacggtgtcgccaccaacctggtgctctacctggagagcgtcctgcacggcagcggcctcgccagcgcctccaacgtcaccacctggatcggcaccagcttcctcacgcccgtcctcggcgccatcctcgccgacaccttctggggcaactacaacaccatcctcgtctccctcgtcgtctaccttctgggtatgatgctcatcaccttctctgcgttgctgccgaccaccgagctgtgcgggctgggctcgtcgtgccacccgatgttcggtgcgcacaccgtcgccttctccggcctctacctcgtggcgttcggcagcggcggcgtgcgggccgcgctgctgccgttcggggcggagcagttcgacgacgacaacgccgtggaccgggagcggaagatggcattcttcagctggttctacatctgcgtcgacttcggcatgatcgtgtccgggctcttcctcgtgtggatccagcagaacgtcagctggggcctcggcttcggcatcgccacggcctgcatcgcgctcgccttcgtcggcttcgtgcttttcacgcccatgtacaagcgcagcatgccgaccggcagcccgttcaagagcctctgccaggtcgtggtcgccgcgtgcaggaaggtcaccctccgcgtccccgccgacgccgccgtcctctacgaggtcagcgacaagatcgaccagcccaggatcgcgcacaccaaagagttcacgttcctcgacaaggcggccgtgctcgtggactcggacctggaggaggtggcgaacgtcgacgcggcggcggcggccgtgggctcgtggaggctgtgcacggtgacgcaggtggaggagctcaagatcctgatgcggctgctgccgatctgggccacgagcatcgtgctgtcggcggcgtacgcgcagctcaacaccacgttcgtgcagcagggcagcgccatggacatgcgggtcatgtcgttcaccatcccggccgcgtccatggtgtccttcgaggtgatctgcgtcctggcgtgggtgctcctctacggctcggtgatcgtgccggcactcaggagactgtccccggcgagcggcgagccgtcgcagctgcggcggatgggcgccgggcggctgctcatggcgttcgcgatggccgtggcggcgctggtggagatgaggaggctggaggccgccgggagcggggagtccatcagcatcgggtggcagatgccgcagtacttcgtgctggccggcggggaggtgttctgctacatcgcgcagctggagttcttctacagcgaggcgccggagtcgatgaagagcatgtgcacgtccttcgcgctgctcaccgtggcgctgggcagctacgcgagctcgctcatctacgccgtcgtggacgcgctcacggcgacaggcggccggcccgggtggatatcggacgacctcaacgaggggcacctcgattacttcttctggaccatggcggcgctgtgcacgctcaacttcgtcgtgtacagcgccttcgccaggaactaccaggtgaagacggtcgtgtcgtgatcgtcatcgttcctgacccgacggcgtacataaagagagcatcagatttcgcattgcaacgcgcagtgcggtggtacagaagatttgttttgttcttgtttcagaattcaaaaaagttctttttttttgtgagtacaaaaagttctttctttaggtagcacgttataaaagaagttagaactagtttggtatgatgcaattacggcaacacgcgacagcaattgggtttgtgatactgtgtagttgtcttcgttttgtttgtaagacgttttagcagttcaaattaaactgcaaaaacatctttcattagtgtttgtagttaaaattaaactgacaaaaaaaacatttcacattaatgtacagaggtagtatttctttttccagttagctgaagcaaggattggcaagaggccatccatatactgtacgttgtactaggtctcggcctctcggggttggttcgggcaccgataatgtggggtacaaatacaaatgcagatacaattggtctga

SEQ ID NO: 148 - DNA, 2214 bp, Setaria italica
atcccagctcggcagctccatagactcaggctctctcgcctctcccgcgccgcaggcccgccgaaggcgcgcgatcccgggcggcgccgaggaaagcgagagcacggcttcctttccggggagatttcgacgtagattgcagcggaaatggacgccggcgacgccatggagagaggccagcagcgctcgccgcggctgccagagagccggagcccaaagatccaggacgaaagcctcacggtgccactcattcaagacaagaaaactggaagcaaagcgccagctgttgttctaggatttgagtgcttggagagcacagcgttcaatggcattggcacgaacctggtggtgtacctggagagcgtcctgcacggcagcaatctcgccagtgcgtccaatgtcacctcctggatcgggaccagctacctgacccccgtcttcggcgccatcgtcgcggacacgttctggggcaactacaacaccatcctcgtctccctcgtcatctaccttcttggcatgatgctcgtcaccttctcggcgttcctgccgatcaccgagctctgcggggtcggctcgtcgtgccaccccgtgctgggcgcgcggaacatggccttcctcggcctctacctcgtggcgttcggcagcggcggcgtgcgcgcggcgctgctgccgttcggcgcggagcagttcgacgacgacaacgccgtggaccgggagcgcaagatatccttcttcagctggttctacatctgcgtggacttcggcatgatcgtctcgggcgtgttcatcgtgtgggtccagcagaacgtcagctggggcctgggattcggcatcgccacggcctgcatcgcgctcgccttcggcggcttcgtcctcgccacgcccatgtacaagcgcaccacgcccaccggctcgccgctcaagagcctgggccaggtcgtggtcgccgcgttcaggaaggcctgcctccgcgtcccctccgacgccggcctcctctacgaggtccacgacaagatcgaccagcccaagatcgcgcacaccgacgagttcgcgttcctcgacaaggcggccgtggtcgccgactcggacctggaggaggtgacggacgccgacgccgcggggtcgtcgtcgtggaggctgtgcacggtgacgcaggtggaggagctcaagatcctgctgcggctgatgccgatctgggcgacgagcatcgtgctgtcggcggcgtacgcgcagctgaacaccacgttcgtgcagcagggcggcgccatggacatgcgggtggcgtccttcaccatcccggccgcgtcgatggtgtccttcgaggtgctctgcgtcctggcctgggtgctcatctacggctccgccatcgtgccggcgctccgggccgtctccccgtcccgcggcgagccgtcgcagctgcagcggatgggcgccgggcggctgctcatggcgtgcgcgatggccgtggcggcgctggtggagacgaagcgcctggccgccgcgggccgcggcgaggccgtgagcatcctgtggcagatgccgcagtacttcgtgctggccggcgcggaggtgttctgctacatcgcgcagctggagttcttctacaacgaggcccccgacacgatgaagagcatgtgcacgtcgctggcgctgctcaccgtcgcgctgggcagctacatgagctcgctcatctacgccgtcgtggacgcgctcaccgcgaccggcggccggcccgggtggatcgcgaacaacctcaacgaggggcacctagactacttcttctggaccatggcggcgctgtgcacgctcaacttcgtcgtgtacagcgccttcgcaaggaactacaaggtcaagacggtcgtgtcgtgatccggatggagcgcgcgctcaggctctgcttcgtcgcgcacaaggtcaagacggtggaatttgcagtgggtgttgcgcaatggcgcgtttgtgcacaaagattttagagattgctaggaatgcgtaggtgcataggcaacggcattatttgtgcgctccattgtgttacgtacgtggtagcgacgggccggggtttttattgattttttttgggttcaatttcttttattttctgtagtgtaagttgaaacatggatcggcaacaggacatccgtgcatcatatgatatatgcctcgggaaaaaaatgcagcaatactgcgcatttgccaacgaatcaatgaccg

SEQ ID NO: 149 - DNA, 2145 bp, Sorghum bicolor
agactcgcttctccgcaaacgatcgaccagcgaagccgcacgctccgctccaggaggttgcgaggaaaaaaaaaaagcaggatctaggaagctcgcagttgcagcggcagcagatggacgccggcgacgccatggagaagggccagccagagaggggaagcccaaagattcaggatgaaagtctcacggtgccactcattcaagacaagaaaaccggaagcaaagcaccagcagtggttctagcattcgagtgcttggaaagcacagcgttcaatggcattggcacgaacctagtggtgtacctggagaccgtgctgcacggtagcaatctagccagcgcgtccagtgtcacctcgtggttcgggaccagctacctgacgccgatcttcggcgccatcgtcgcggacacgttctggggcaactacaacaccatcctcgtctccctcctcgtctaccttcttggcatgatgttggtcaccttctcggcgttcctgccgaccaccgagctctgtggagttgggtcgtcgtgccaccccgtgctgggctcgcagaacgtcgcgttcctcggcctctacctcgtggccttcggcagcggcggcgtgcgcgcggcgctgctgccgttcggcgcggagcagttcgacgacgacaacgccgtggaccgggagcgcaagatgtccttcttcagctggttctacatctgcgtcgacttcggcatgatcatctcgggcgtcttcatcgtgtggatccagcagaacatcagctgggggctcggcttcggcatcgccaccgcctgcgtcgcgctcgccttcggcggcttcgtgctcgccacgcccatgtacaagcgccggatgccgacgggaacgccgctcaagagcctgggccaggtcgtcgtcgccgcgttcaggaaggtcagcctccgcgtccccgcggacgccggcctcctctacgaggtccacgacatgatcgagcagcccaagatcgcgcacaccgacgagttcgggttcctcgacaaggcggcggtggtcgcggagtcggacgacccggaggaggtgacgaacgacgccgcggcggcggccgcggggtcgtcgtcgtggaggctctgcacggtgacgcaggtggaggagctcaagatcctgctgcgcctgctcccgatatgggcgaccagcatcgtgctgtcggcggcgtacgcgcagctcaacaccacgttcgtgcagcagggcggcgtgatggacatgcgggtgatgtcgtcgctcaccgtcccggcggcgtccatggtgtccttcgaggtgctctgcgtcctggcgtgggtgctcatctacgacgccgtgatcctgccggcgctccgggccatctcccccgcgcgcggggagccgtcgcagctgcagcggatgggcgccgggcggctgctcatggcgtgcgcgatggccgtggcggcgctggtggagatgaggcgcctcgacgccgctggccgcggcgagtccatcagcatcgcgtggcagatgccgcagtacttcgtgctggccggcggggaggtgttctgctacatcgcgcagctggagttcttctacgacgaggcgccggagacgatgaagagcatgtgcacgtccttcgcgctgctcaccgtcgcgctggggagctacatgagctcgctcatctacgccgtcgtggacgcgctcaccgccaccggcggcggcgggcggcccggctggatctcggacaacctcgacgagggccacctcgactacttcttctggaccatggcggcgctgtgcacgctcaacttcgtcgtgtacagtgggttcgccaggaactacaaggtcaagacggtcgtgtcgtgaatcgtgatccggccagcgtacaaaaatgtgggtcaatttcgttgcgcaatgctggcacagaagattaattttagggattgctaggagggcgtaggtgcgtcaaaccattatttcgtgtgctccatggtgttagcctgttaggcttacgtggtagcgacggggtccttgattttttttgtgttccttttatttttgttggttgcccgtaagctgaaacatgaatgtgcaacagaacatatccatggccacatgttattattattatgcccaaaaaaaagtgcagtgttggttgctactcgtcccacaa

SEQ ID NO: 150 - DNA, 2271 bp, Zea mays
atggcaatatgctgctttgaattgatctcgcccgagtacagagagagtgtcacgccgctggggacgtcagggtccgtgacgcccgccgcttttaccagctccatctccctgtcgcgtgcgtgccgctcgagggtggccggtggccgcgtatatataaagctgcgctgcttgcgctctcgttcattcattcccatcccaggctcaggtctccgagcacggcacacgaccagtgaagccgcccgctccgcggcttgcgagcaaaaagcaggagctggtagcttcttgtagctcgtggccggtagcttcttttaacagctgcagcggcaaatggacgccggcgacgccatggaaaagggccagcgctcgtcatcgcggctgccagagaggggggctccaaagattcaggaggaaagcctcacggtgccactcattcagaacaagaaaaccgggagcaaagcaccggcggtggttctaggattcgagtgcctggagagcacggcgttcaatggcatcggcacgaacctggtggtgtacctagagaccgtcctgcacggcagcaatgtagccagtgcgtccagcgtcacctcgtggttcggcaccagctacctgaccccgatcttcgccgccatcgtcgcggacacgttttggggcaactacaacaccatcctcgtctcgctcctcgtctaccttcttggcatgatgctcgtcaccttctcggcgttcctgccggccaccgagctctgcggagtcgggccctggtgccaccccatgctcggctcgcggaacgtggcgttattcctcggcctctacctcgtggccttcggcagcggcggcgtgcgcgcggcgctgctgccgttcggcgcggaccagttcgacgacgacaacgccgtggaccgggagcgcaggatgtccttcttcagctggtactacatctgcgtcgacttcggcatgatcgtctcgggcgtcttcatcgtgtgggtccagcagaacgtcagctggggcctcggcttcggcatcgccaccgcctgcatcgccctcgccttcggcggattcgtgctcgccacgcccatgtacaagcgccggatgcccaccggcacgccgctcaagagcctgggccaggtcgtggtcgccgcgctcaggaaggccagcctccgcgtccccgcggacgccagcctcctctacgaggtccacgacaagatcgacgagcagcccaggatcacgcacaccgacgagttcgggttcctcgacaaggcggcggtggtcgtggagacggacctggacctggaggaggtgacgaacgacgccgacgccgcggggtcgtcgtggaggctctgcacggtgacgcaggtggaggagctcaagatcctgctgcgcctgctcccgatatgggcgaccagcatcgtgctgtcggcggcgtacgcgcagctgaacaccacgttcgtgcagcagggcggcgtgatggacatgcgggtgatgtcgctcaccgtcccggccgcgtccatggtgtccttcgaggtgctgtgcgtcctggcgtgggtgctcatctacggctccgcggtcgtgccggcgctccgggccatctcccccgcccgcggcgagccgtcgcagctgcagcggatgggcgccgggcggctgctcatggcgtgcgccatggccgtggcggcgctggtggagacgaagcgcctcgacgccgcgggccgcggcgagtccgtcagcatcgcgtggcagatgccgcagtacttcgtgctggccggcggggaggtgttctgctacatcgcgcagctggagttcttctacaacgaggcgccggagacgatgaagaccatgtgcacgtccttcgcgctgctcaccgtcgcgctggggagctacatgagctcgctcatctacgccgtcgtggacgcgttcacggcgaccggcggccggcccggctggatctctgacaacctcaacgagggccacctcgactacttcttctggaccatggcggcgctgtgcacgctcaactttgttgtgtacagtgggtttgccaggaactacaaggtcaagacggttgtgtcatgatcctgccaccgccagcgtacacgaaaagggtccagttagtcatgcagtggccagtgggtgttgttagattttagggtttgctactgctagggggcgtagatcagggttaacaaaaccggtattaaaccggcgcccgggaatgatttcccagcggttttgttttcaaatttcattctaaattaaaaaatttgatattttataaaaacggaa

SEQ ID NO: 151 - DNA, 1744 bp, Triticum aestivum
caaaccaacaggacgccgcacgtcccccgcacgcacccagccgagcccagcgagagcagaaactccattccccattccttcttcatcaccctcccccctctccgcccccaaaaaatctcaacagcacctccctaatcgcctcctctcctccttccgtccaggccaaaagccctttgcttttcgccttcccctccccacctcctccgcgccggagttcgccggcggtggtgcctttgccccgcctgccttgggttttacggggattcttgaggggttttaggtaggccgcgtctggggcgcaggcaaatgcgagtggagttttagggtgagtgttttcctttcctcgatgtggcccatggaggaggagtttttcatggcggtgaagaggacggagcacgtcgaggtgacgtcccgttcggtggcgccgtcggccaggggggaggaggggtttggtggcggcgagcagcccaagatggtgagggtcttctgcgacgacttcgacgccaccgattcctccagcgatgaggaggagggcgagcggcggcgcgtgaagcgctacgccaggagatccggctgcaggccgcggtccaggtgaaggtggaggagtcggcgccggtggccaaggccgcgtcggcgacggcgacgacgaggcccagggtgatggttcccgtgaggaagaggaaggccgaggccggcggcgagcggcggttccgcggcgtccggcgccgtccttggggtaagtacgccgcggagatccgcgacccgtggcgacgcgtccgcgtgtggcttggcacttttgacaccgccgaggaggccgccaaggtctacgactcggccgccatcaagctgcgcggccccgacgccaccgtcaacttccagcagtccgaggacggggaggacatggaggtccccaccgaggtcgcggagcgccttccgcagccaccggcgggctccaagaacggctcctcctcggccacctcctacgactcgtgcgaggagtcccacgtcgcggccgcgtccccgacatccgtcctgcgctccttccctcagtccaccctgggcgccgccgtcgacgacgagtcctccaagaagccgtcgtcgtcttccagcaccgccgagaccgacgagtcgagcggcgtcttcggctgctcgttctccggcgacgacttcgccggcgagctggccccgctctacaccgacttcgacctcctctccgacttcgcggagccgccgatggacttcctgtccaacctcccggagccggccttcgcattctccagcgactgctcgtcgtcggcctacaacccgtgcccgccgtccccggcggcgttgcagcaggcggacgagttcttcgaagacatcaccgacttgtttcaaatcgatcccctccccgtcatctagcgaaacaactgtaaaacaaacaccgaattaggcgcctaattcggtcaaattttgtttgcattcgttattttttcttcttttttttctttttgtctttctagagagagaggagagagtatgatgttatgattcgcctgtgtagctgcctgccgccaaacaatccccggaagagggaagcctcgaaggggtttagatgagagtgaaagaatgggatggctgttattagtctctttgttcatcgctggttttgtcaccagcgctgaagccaagttatcagtaattagcaatagtatcatcgtgttatgagtttgaaacatttccgtatatatttttatgtgaatga

SEQ ID NO: 152 - DNA, 933 bp, Triticum aestivum
caaccggcctcgctaggcgcttgcttctatataaagggcatggcagcagacacaacagcaacccaaaccccgctaagcatcagcattcagcagcacctcccttctacctcctctgctttgcattcctccttccggtttcaaccgcaatcaatggctgccatgaagatcaccctccttgccgtggccgccttattaggcaccgcgtcagcggtaacctacaacgtcggcgagcagggcggttggaccctcaacaccgactacagcagctgggtgtccggcaagaagttcaacgtgggtgatgagatcgtcttcaagtactcgtccgccgcgcacgatgtggtcgaggtcagcaaggccggctacgactcctgcagcatcgacggcgccatcaacaccttcaaatctggcaacgacgtcatccccctcagcgccaccggcacccgctacttcatctgcggcatcactggccactgcagccccaccgccgcggccagcatgaaggtcatgatcgacgtcgcctcgggctcctcttcgccttcctcacccatgccagccgcaggtcctggcgcgagcaactctcccccggcgccaccctcctccgccgctacctccgtcggtgccacagcaggatttggcctcgtcgccctactggcggctggtctcatggcttgaacgcatatattgatcagctgccacgcgcacatatgagcttatatattgttaactactgctgtagtcattatcacgggtgaatacatgtattcttttttagagtgagaatgtgatagttacttgtatctatcacgtctatatgtaatctgcagaccttcatgtcttttatataatcattctagagcattattttatactaaaaaaaaaaaaaaaactcgagactacacctcggccgcgaccacgctaatcactagtgaattc

SEQ ID NO: 153 - DNA, 1018 bp, Aegilops tauschii
caaaatccaatatccaaatgccattccaccaacccatctcgctgggcgcttggttgtatataaagcgcgcggcagcacaagcacagcagcaaccccagcccccgctaagcatcagccttctacctcctctgctttgcattcctccttccggttccagccgcaatcaatggctgccatgaagatcaccctcctcgccgtggccgcgatggccgtcttactaggcaccgcgtcagcggtaacctacaacgtcggcgatcagggcggttggacccttagcaccgactacagcagctgggtgtccggcaagaagttcaacgtgggtgatgacatcgtcttcaagtactcgaccccggcgcacaacttggtcgaggtcagcaaggccggctacgactcctgcagcaccgacggcgccatcaacaccttggcctcgggcaacgacgtcatcaccctcaacgccaccggcacccgatacttcatctgtggcgtccctagccattgcagccccaccgccgccgccagcatgaaggtcgtgatcgacgtcgcctcgggctcctcctcgccgtcgtcacccatgccagctgcaggtcctggcgcgagcaactctcccccggcgccgccctccaacgccgctacctccgtcggtgccacagcaggatttggcctcgtcgccctactggcggccggtctcatggcttgaacgcatatattgatcagctgccgcgcgcacatacgagcttttatattgttaactactatactgtagttattatcacgggtgaatacatgtattcttttttagagcgagaatgtgatagttacttgtatctatcacgtctatatgtaatctgcaggccttcatgtctttttatataatgattctagattattattttataagggtgcgtcagtgcatgcgtagcagtaccaatagtcttctaactaaaaagaaagaatcaatagtcctgtcaattttatccaaccatcgacccaaaataataggtacaccttcagaagcgag

SEQ ID NO: 154 - DNA, 833 bp, Secale cereale
cctcccttccatctcctctgctttgcgttcatccttccagctccaagcgcaatcaatggctgccatgaagatcaccctccttgccgtggccgcaatctcggcgctcttactaggcaccgcgtcggcggtgacctacaccgtcggcgagccgggcggttcgtggacactcggcaccgactacagcaagtgggtggccgacaagaagttcaacgtgggtgatgagatcgtcttcaagtactcgaccccggcgcacgacgtggtcgaggtcagcaaggccggctacgactcctgcagcatcgacggcgccatcaacaccttaagcaccggcaacgacgtcatcgccctcaacgctgccggcacccggtacttcatctgtggcgtccctagccactgcagccccaccgccgccgcgagcatgaaggtcgtgatcgacgtcgcctcgggctcctcctctccgtcgtcacccatgccagctgcaggtcctggcgcgagcaactctcccccggcgccgcccacctccgccgctacctccgtcggggccacagcaggatttggcctggtcgccctactggcggccggtctcatggcttgaacacatatattgatcagctgccgtccacacatatgagcttatatattgttgttattatcacgggtgaatacatgtattcttttttagagcgagaatgtgatagttacttgtatctatcacggttatatgtaatctgcaggccttcatgtcttctatataatgattctcgaggattattttataagggtgctagcagtaccaattgtcttctaactaaaaagaaagtatcaatagtcctttt

SEQ ID NO: 155 - DNA, 1681 bp, Secale cereale
cacgcaacaaggactcgaccgacatcgaggctcgagctaaccttcaccacttgcagcaatctctctctctttctttctctctctcgccgatcaaacttgatcaacgtcgaccgggcaactacacccagctgcaaggtgcacgcaagctagctcgacagttagcaatggaggttaaggtgttgggctccaggctcgtcaagcccgcccgcaatgccggcgccgcgccggcgcaacccaccgagtacatccctctgtccgtcttcgacaaggtgacgttcaacatgcagatggccatcatctacgcctttgccgcgccggcgccatccacggccgccatcgagaacgggcctcgccacggtcctcgcccagtaccgcgccttcgcgggccagctcggcgaggcgcccgaccacacgctgtcagtcatactcaacgaccgtggcgcgcgcctggttgaggcgaccgtggacgccgacctcgtcgacatggcgccctcgaagcccacgccggagctgctcaagctgcacccagacctggaggcggagcacgaggaggttgtgctgctgcagctgacacggttccggtgcggctcgctcgccgtagggttcacgtccaaccacgtcgtcgccgacggccacgccaccagcaactttctcgtggcctgggggcgcgccactagagggctccccatgggactcccgccgctgcaccaccacaaggacctcttcaagccacggtcgtcgcctcgcgtggagcacgaccaccgcaaccgagaatactacctgccgtcgccctccgacgtggtcggtcaccacggcgatgccgccgacaacattgtcatccacaaggcgcacttcaccaaggacttcatcgccggtctgcgcgctaaggcgtcagaagggcgcggccggccgttcagccggttcgagaccatcctcgctcacctttggcgcaccatgacccgcgcgcgcgacctgagccccgaggaaacctccaagatccggctgtccgtggacgggcggcaccggctgggccagccggcggagtacttcggcaacatggtcctttgggcgttcccgcgcgccaccgtggatgacctcctgaaccgaccgctgaagcacgccgcgcaggtgatccacgacgaggtggcgagggtggacggcgcctacttccaatctttcgtcgacttcgcgagctccggcgccgccgagaaggaggggctcgcgcggagcgccgtgtgcaaggacgcgcagtgcccggacgtggaggtggacagctggctgacgttcccgttctacgagctggacttcggcacggggagccccagctacttcatgccggcctacttccccacggaggggatgcttttcctcgcgccgtccaacttcagcgacggcagcgtcgatgccttcgtacccctattccaagagaacctccaagccttcaaagaatgctgctactccatggattagtcgaagaaatagcgagtgagaatacattagttcatttattattgagaggggttgttcttcatttgtacagtatttgtttggctctattgttttgtatataagagcatggttaaataactacaaccagtctgcttggttatatggagttgactagtcatctatacgccaagtcttaatagccggcaaagtataagtaagttaaagaattaag

SEQ ID NO: 156 - DNA, 1570 bp, Secale cereale
cacgtacaagctcgatctcttgttgccaacttttgatctttctcgccacagagaaactacttctccggtctaagctcagtacacagcaatggaggtcaaggtgctgagctccaggctcgtcaagcctgcctacagtgccggcgaagcgccggtgccggccaccgagtacattccactatccatcttcgacaaggtgacgttcgagatgcagatggccatcatctacgccttcgcgccgcccgcgcccaccacggcctccatcgagaagggccttgccatggtcctcgcgcagtaccgcgccttcgccgggcagctcggcgtgtcccccgacggcacgccgtcagtcatcctcaacgaccgtggcgcgcgcctggttgaggcgtccgtggacgccgacctcgtcgacatggcgccctcgaagcccacgccagagctgctgaagctgcatccggacctggaggtggagcacctggaggtcgtgctgctgcagctgacacgattccggtgcggctcgctcgctgtagggtttacgtccaaccacgtcgtcgccgacggccacgccaccagcaacttccttgtggcctgggggcgcgccacgagagggctccccatgggcctcccgccagtgcaccaccacaaggacctcttcaagccacggtcgtcgcctcgcgtggagcacgaccaccgtaacagggagtactacctgccgtcgcgcaccgacgtggttggtcaccacggcgatgacgccgacaacatcgtcatccacaaggcgcagttcaccaaggacttcatcgctggtctgcgcgccaaggcgtccgaggggcgcggccggccgttcagccggttcgaaaccatcctcgctcacctgtggcgcaccatgacgcgcgcgagagacctgagccccgaggagacctccaagatccggctgtccgtggacgggcggcaccggctgggccagccggcggagtacttcggcaacatggtcctgtgggcgttcccgcgctccacggtgggtgaccttctgaaccggccgctgaagcacgcggctccaggtgatccatgacgaggttggcgaaggtggacggcgcatacttccagtcgttcgtagacttcgcaagctccggcgccgccgagaaagaggggctggctcggagcgccgtgtgcaaggacgcgcagtgcccagacgtggaggtggatagctggctgacgttcccgttctacgagctggacttcggcacggggagcccaagctacttcatgccggcctacttccccacggaggggatgctcttcctggcgccgtccaacttcggcgacggcagcgtcgatgccttcgtacccctattccaagagaacctccaggcgttcaaagaatgctgctattccatggagtaggtgggccaactgttaatttgtcgaaaaaacagtgaggcatacattagttcattcgttgagagggttgcagaaaaaaataatgtcttttctttttctctttgagaattgaatagtgctaccgggtgtacacagatgttatctaccctaattcttttttaataataataaagcggct

SEQ ID NO: 157 - DNA, 1514 bp, Triticum aestivum
cagtacacagcaatggaggtcaaggtgttgagctccaggctcgtcaagcctgcctacactgccggcgaagcgccgatgccggccaccgagtacattccgctgtccatcttcgacagggtgacgttcgagatgcagatggccatcatctacgccttcgcgccgcccgcgcccgccacggcctccatcgagaagggccttgccacggtcctcgcccagtaccgcgccttcgccgggcagctcggcgagtcccccgacggcacgccgtccgtcatcctcaacgaccgtggcgcgcgcctaattgaggcgtccgtggacgccgacctcgtcgacatggcgccctcgaagcccacgcctgagctgctgaagctgcatcctgacctggaggcggtgcaccaggaggtcgtgctgctgcagctcacgcggttccgttgtggctccctcgctgtcgggttcacctccaaccacgtcgtcgccgacgccacgccaccagcaacttcctcgtggcctgggggcgcgccacgagagggctcccaatgggccttccgcccgtgcaccaccacaaggaccttttcaagccacggtcgtcgcctcgcgtggagcacgaccaccgtaacagggagtactacctgccgtcgcccaccgacgtggtcggtcaccacgccgacgccgccgacaacatcgtcatccacaaggcgcacttcaccaaggacttcatcgctggtctccgcgccaaggcgtcagaagggcgcggccggccgttcagccggttcgagaccatcctcgcccacctgtggcgcaccatgacgcgcgcgcgcgacctgggccccgaggagacctccaagatccggctgtccgtggacggccggcaccgcctcggccagccggcggagtacttcggcaacatggtcctgtgggcgttcccgcgctccacggtgggcgacctcctgaaccggccgctgaagcacgccgcccaggtgatccacgacgaggtggcgagggtggacggtgcctacttccaatcttttgtcgacttcgccagctccggcgccgccgagaaggaggggctcgcgcggagcgccgtctgcaaggacgcgcactgcccggacgtggaggtggacagctggctgacgttcccattctacgagctggacttcggtacggggagcccgagctacttcatgccggcctacttccccacggaggggatgcttttcctcgcgccgtccaacttcggcgacggcagcgtcgatgccttcgtacccctattccaagagaacctccaggcgttcaaagaatgctgctactccatggaatagtaggtggccaaacttgaattagtccaaggaacagggagtgaggcatacattagttcatttattgagagtgtggcataaaaaatatgtgttctcttttttgtttttgagaattttattgtgctactgtatatacacagatgttgttgtgtacagttagcacgaattttcggagcaaacaaattacattatacaccaata

SEQ ID NO: 158 - DNA, 1551 bp, Hordeum vulgare
caggagtacacaagacggctaagcaataagcaaagcctccacgtacaaggaaagctctcggttgcaaacttttgatcattctcgctgatcaaacttcattagcgacagagaaactagtgctccgatacacagcagcaatacaatggagatcaaggtgttgagctccaagctcgtcaagcctgcctacagtgccggcgatgcgccgatgccggccaccgagtacattcctctgtccatcttcgacagggtgacgttcgagatgcagatggccatcatctacgcctacgcgccgcccgcgccctccaccgcctctatcgagaagggccttgccacggtcctcgctcagtaccgcggcttcgccgggcagctcggcgagtcccccgacggcacgccgtccgtcatcctcaacgaccgtggcgcgcgcctatttgaggcgtccgtggacgccgacctcgtcgacatggcgccctcgaagcccacgccggagctgctcaagctgcatcctgacttggaggcggagcaccgggaggtggtgttgctgcagttgacacggttccggtgcggctcgctcgccgtcgggttcacgtccaaccacgtcgtcgccgacggccatgccaccagcaacttcctcgtggcctgggggcgcgccacaagagggctccccatgggcctcccgccagtgcaccaccacaaggagctcttcaagccgcgctcctcgcctcgcgtggagcacgaccaccgcaaccgggaatactacctgccgtcgcccacagacgtcgtcggtcaccacggcgacgccgccgacaacatcgtcatccacaaggcgcaattcaccaaggacttcatcgccggtctgcgcgccaaggcgtccgaggggcgcggccggccgttcagccggttcgagaccatcctcgcccacctctggcgcaccatgacgcgcgcgcgcgacctgagccccgaagagacctccaagatccggttgtccgtggacggtcggcaccggctcggccagccggcggagtacttcggcaacatggtgctctgggcgttcccgcgcgccacggtcggcgacctcctgaaccggccgctgaagcacgccgcccaggtgatccacgacgaggtggcgagggtggacgccgcctacttccaatctttcgtcgacttcgcgagctccggcgccgccgagaaggaggggctcgcgcggagcgccgtgtgcaaggacgcgcattgcccggacgtggaggtggacagctggctgacgttcccgttctacgagctggacttcggcacggggagcccgagctacttcatgccggccttcttccccacggaggggatgctcttcctcgcgccgtccaacctcggcgacggcagcgtcgatgccttcgtgcccctattccaagagaaccttcaggcgttcaaagaatgttgctactccatggagtaggtggcaatactccatgaggcatacattagttcattgatttattgaatgtgacagacaaaaatcgtttcttcttcttctttttgagaattgtatagtgctactat

SEQ ID NO: 159 - DNA, 1624 bp, Secale cereale
cacgtacaagctcgatctcttgttgccaacttttgatctttctcgccacagagaaactacttctccggtctaagctcagtacacagcaatggaggtcaaggtgctaagctccaggctcgtcaagcctgcctacagtgccggcgaagcgccggtgccggccacggagtacattccactatccatcttcgacaaggtgacgttcgagatgcagatggccatcatctacgccttcgcgccgcccgcgcccaccaccgcctccatcgagaagggccttgccacggtcctcgcccagtaccgcgccttcgccgggcagctcggcgagtcccctgacggcacgccgtcagtcatcctcaacgaccgtggcgcgcgcctcattgaggcggccgtggacgccgacctcgtcgacatggcgccctcgaagcccacgccagagctgctgaagctgcatccggacctggaggcagagcacctggaggtcgtgctgctgcagctgacacgattccggtgcggctcgctcgctgtagggttcacgtccaaccacgtcgtcgccgacggccatgccaccagcaactttctcgtggcctgggggcgcgccacaagagggctcgccatgggcctccctccagtgcacccccacgcggacctcttcaagccacggtcgtcgcctcgcgtggagcacgaccaccgtaacagggagtactacctgccatcgcgcaccgacgtggtcggtcaccacggcgatgccgccgacaacatcgtcatccacaaggcgcacttcaccaaggacttcatcgccggtctgcgcgccaaggcgtccgaggggcgcggccggccgttcagcaggttcgaaaccatcctcgctcacctctggcgcaccatgacgcgcgcgagagacctcagccccgaagagacctccaagatccggctgtccgtggacggccggcaccggctcggccagccggcggagtacttcggcaacatggtgctttgggcgttcccgcgcgccaatgtgggtgacctcctcaaccggccgctgaagcacgcggcgcaggtgatccacgacgaggtggcgagggtggacggcgcctacttccaatctttcgtcgacttcgcgagctccggcgccgccgagaaggaggggctggctcggagcgccgtgtgcaaggacgcgcactgcccggacgtggaggtggacagctggctgacgttcccgttctacgagctggacttcggcacggggagcccgagctacttcatgccggcctacttccccacggaggggatgctcttcctcgcgccttcctacctcggcgacggcagcgtcgatgccttcgtccccgtcttcgagcacaatctccaggcgttcaaagaatgctgccactccatggagtaggtggacaaacggagaatcggtagaatgataactgagggtcagcagagaaaagaatgttgatgacgtgcaaagcacatttctttcttttctttttcatttgagaattgtatagtgctactgtagtactgcatgtacacaaaggttctgatgtaccagtaacatggatttttttagggctgtctatgtcacatctagatgtgagatgttatctcacatctaactctactaaac

SEQ ID NO: 160 - DNA, 2911 bp, Aegilops tauschii
ctactacaaaagtactcctcgagtattttgttttaaaggcatctccaatgctgacccgtaaatcagacaccgtattcgtctatggacaaagggaccagtccaaaacgatagccactatacgcccgctagtaaagggcagtttgaaatttaaatatgtctgctccatagcatgtcggatcacatcctcggccaataacaacaaaaaaaaagtaagtatgcttagttttacatgcctgatcattgaagaatatcagtccggcagtccatgcgaaaaattaggtttttgctttaccgagcctccacgctcaatctaccagcatagccgtataggccgcctccacctccttctctgccacctcgatctccttgctccgccttctccagctcatccttctgtcgctgaaacatcttgaaaaggatgacttcgccaaatccgccaccttcaaggtgagcaccttcgcgtccttcaaagtcgctgcgatttccaccttcttctatttgagcatggcctttttctcttcgagcttgaacttcttcttggtcgccttcatcaacaagtcaaacctctccgccaccttcgtcttcggcagggtctcctccgggtccatgcgtcggcggggagggaagaaaagagtgggggataagggcaggaatttgatggagagcgtcaggatggaagcagagagtgagagattttgccacgaaaacagttcggccagctacaaaagcgcgggccgactacttcgaggaccgatggggcttggcgttggatggcttgcggtgtctagacagctgcggccggacggatactaatggtttgaggggttggtgttggagaggccctaactcaaacatccatatggggttagccagtattttctcgtggacacaccatgaggggaaaacaataaataacatgagttgtattattgcctctggacttcatattggtctgttttgtaaagcacgcaaaggagtgaaatagagggtacggtttagacttgtgacatttgcatgttctaggtaacagccggtcactagtcaaacacatgcatggtttacaggcgggccaggtccaagtctcaagtctcaactacacaaattaacaagtggtactagactcaagtagtttgatttcacctaccggccggctaccgtttcccccgagcgtgttcgagactccaataccgtcctataaattgtacaaccagcagcaggacaaccaccaaatcatacacacaacacaagagtacaagaccgcaaagcctccacgtacaagctcgatctcttgttgcctacttttgatctttcccgccacagagaaactacttcttcggtataagctcagtacgcagcaatgaaggtcaaggtgttgagctccaggctcgtcaagcctgcctatactgccggcgaagcgccggtgccggccaccgagtacattccactatccatcttcgacaaggtgacgttcgagatgcagatggccatcatctacgccttcgcgccgcccgcgcccaccacggcctccatcgagaagggccttgccctggtcctcgcccagtaccgcgcctttgccgggcagctcggtgagtcccccgacggcacgccgtccgtcatcctcaacgaccgtggcgcgcgcttgattgaggcgtccgtggacgcggacctcgtcgacatggcgccctcgaagcccacgcctgagctgctcaagctgcatcctgacctggaggcggagcaccaggaggttgtgctgctgcagctgacacggttccggtgtggctcgctcgcggtagggttcacgtccaaccacgttgtcgccgacggccacgccaccagcaactttctcgtggcctgggggcgcgccactagagggctccccatgggcctgcctcccgtacaccaccagaaggacctcttcaagccacgatcgtcgcctcgcgtggagcacgagcaccgtaacagggagtactacctaccgtcgcccaccgacgtggtcggtcaccacggcgacgccgccgacaacatcgtcatccacaaggcgcacttcaccaaggacttcatcgccggtctgcgcgccaaggcgtccgaggggcgcggccgcccgttcagccggttcgaaaccatcctcgcccacctgtggcgcaccatgactcgcgcacgcgacctgagccccgaagagacctccaagatccggctgtccgtggacgggcggcaccggctccgggcgggcgggcgggggtgcgtgcgctgggcgtccccgcgctccgcggtgggtgacctcctgaaccggccgctgaagcacgcggcgcaggtgatccacgacgaggtggcgagggtggacggcgcctacttccaatctttcgtcgacttcgccagctccggcgccgccgagaaggagggcctggcgcggagcgccgtctgcaaggacgcgcattgcccggacgtggaggtggacagctggctgacgttcccgttctacgagctggacttcggcacggggagcccgagctacttcatgccggcctacttccccacggaggggatgctcttcctggcgccgtccaacttcggcgacggcagcgtcgatgccttcgtacccttattccaagagaacctccaagcgttcaaagaatgttgctactccatggaataggtggcctaactgagaatcggtagattgataactgaggatcagcagagaaaagaatgttgagtacgtgcaaagcacatttttctttcttttttcatttgaggattgtatagtgctactgtagtactgcatgtacacaaaggttctgatgtacctaatcttattgatggtatgttagtacgttataaattgaacaaatgttcattttggacactgaagtattgtctccgacttgaacactaaacaatggaagtatgaaac

SEQ ID NO: 161 - DNA, 1721 bp, Brachypodium distachyon
gtacagcacaaagaccacaagcaaagcaagaggccaagcaacaagggttcgacgcacgaccccacgagccagagcgcgagcctaattcggtctcttgttgcaatctgctccttaattctccccaatcaatcaagcttctgattaactcaagagcaacgacaacgtacgtgcacctcctccgacgatcctagctgcaatggaggttaaggtgctgagctccaagctggtgaagcccgccgcctgcaacaatggcggcgccacggagacagagtacatccctctgtccatcttcgacagggtgacattccagatgcagatggccatcatctacgccttcgcgccgcccgcgccgtccacagccgccatcgagaagggcctcgccctcgtgctgggccagtaccgggccttcgcgggccagctcggcgagtcccccgacggcagcccggccgtgatcctcaacgaccggggcgcgcggctcgtggaggcgtccgtggacgcggacctcgtggacatggcgcccgccaagcccacgcccgagctgctgaagctgcacccggacctggaaggggagcagcccctcgaggaggtggtgctgctgcagctcacccggttccgctgcggctccctcgccgtcgggttcacctccaaccacgtggtcgcggacggccacgccaccagcaacttcctcgtggcgtggggccgcgccaccagagggctccccatgggcccgccccctgtgcaccattaccacgggctcttcaagccgcgctcctcgcctcgcgtggagcacgaccaccgccgcagggagtaccacctgccgtcgcccaacgacgtcgtgggccaccacggcgacgccgccgacaacatcgtgatccacaaggcccacttcaccaaggacttcatcgcggggctccgggccgacgcgtcagtgggccggggccggcccttcagccggttcgagaccatcctggcccacctgtggcgcgccatgacgcgagcccggggcctcggtcccgaagagtcctcggcgatccggctgtcggtggacgggcggcaccggctggggaagccggccgagtacttcggcaacatggtgctctgggcgttcccgcggtccacggtgggcgacctcctgaaccgtcccctgaagcacgcagcgcaggtgatccacgacgaggtggccagggtggacggcgcctacttccagtccttcgtcgacttcgcgtgctccggcgccgtccagaaggagaagctcgcgcccagcgccgtgctcaaggacgcgcattgccctgacgtggaggtggatagctggctcacgttcccgttctatgagctcgacttcggcacggggagccccagctacttcatgccctcctacttccccacggaagggatgctcttcctcgcgccgtcctacatcggcgacggcagcgtcgacgccttcgtgcccgtcttccaacacaaccttcaagcgttcaaagaatgctgttactccgtggagtaggtggcgagctagtagtgcaagttaagtaaggagtgatggcgagctagtagtgcaagttaagtaaggagtgagccaaaacataatacttcagcaatgtgtttaattacgtgcaaattaaactgttttgagactggtacagtagtgctacagagacatcagacatgtacacgaacgatgtaacgttcagagtaataagaattttttgattaattttttc

SEQ ID NO: 162 - DNA, 1735 bp, Brachypodium distachyon
acagcacaaaaggcccccaagcaaccagcctagctatcgctacctctcttgcttgcttgctgcaaaccattagtactatacctctttgattcacggcacacagcagcgagagtacaccttaagacgtgcgtactccgatccaagctcgtgtgcttgcaaagttccacagcaatggaggttaagattttgagctcgaagctggtaaagcctgcgtgcagtccccatggcggcgacaccacagaaacagagtacatccctctgtccatcttcgacagggtgacattccagatgcagatggccatcatctacgccttcgcgccgcccgcgccgtccaccgccgccatcgagaagggccttgccgccgtcctgggccagtaccgggccttcgcgggccagctcggcgagtcacccgacggcagcccggccgtgatcctcaacgaccggggcgcgcggctcgtggaggcgtcggtggacgcggacctcgtggacatggcgcccgccaagcccacgcctgagctgctgaagctgcacccggacctcgaaggcgagcagccgctcgaggaggtggtgctgctgcagctcacccggttccgctgcggctcccttgccgtcggcttcacctctaaccacgtggtcgccgacggccacgccaccagcaacttcctcgtggcgtggggccgcgccaccagaggactccccatgggcccgccccccgtgcaccattaccacgggctcttcaagccgcgctcctcgcctcgcgtggagcacgaccaccgccgcagggagtactacctgccgtcgctcaacgacgtcgtgggccaccacggggacgccgccgacagcatcgtgatccacaaggcccacttcaccaaggacttcatcgcggggctccgggccaaggtgtcggagggccggggccggccgttcagccggttcgaggccatcctggcccacctgtggcgcaccatgacgcgcgcgcgcgggctcggccccgaagagacctcggcgatccggctgtccgtggacgggcggcaccggctggggaaacccgcagagtacttcggcaacatggtgctctgggcgttcccgcggtccacggtgggcgacctcctgagccggcccctgaagcacgcagcgcaggtgatccacgacgaggtggccagggtggacggcgcctacttccagtccttcgtcgacttcgcgtgctccggcgccgtccagaaggagaagctcgcgcccagcgccgtgctcaaggacgcgcattgccctgacgtggaggtggacagctggctcacgttcccgttctacgagctggacttcgggacggggagccccagctacttcatgccgtcctacttccccacggaagggatgctcttcctggcgccgtcctacatcggcgacggcagcgtcgacgccttcgtgcccgtcttccagcacaacctccaggcgttcaaagaatgctgctactccatggagtagtaggtgcaggttcagatggcgcgcgaactaggaatcgatcggccggagagaaacagtaggctgcaacgttaattaatcaagacggcggcgggagtactagtacgaactatgtgccaagccaacgcggcgcggttgttggatgtcggggtcggtttggttgaggggtggtcgagcctttctttttttctctctcttgttgtgacgcagtttgtatatggcgtcaatcgatttgattatttgaggtgtatacttg

SEQ ID NO: 163 - DNA, 2243 bp, Oryza sativa
gtacatccaaagcaaagcaaagcaaagcaaagcatcaagctcacacctcgagagtacgagctcgagcttagccaagcaatcaagcttacttgccttcttcttcttcttcttccttgagttgattgattgctactagctcagacagcaatggaggtcaaggtattgagcagcaagctcgtcaagcccgcctacaatggcggtgtcgccgcggcccccgacgtggagtatattcctttgtcgatcttcgacaaggtgacgtacaagatgcagatggcgatcatctacgcgttcccgccgccggcgccgtcgacggcggccatcgagaaggggctcgcggcggtgctcgcgcagtaccgcgcgttcgcggggcagctcggggagtcgcccgacggcgaggcggcggtggtgctgaacgaccgcggcgcgcggctggtggaggcggcggtggacgccgacctcgtggacatggcgccggcgaagcccacgccggagctgctccggctgcacccggacctggagggggagctccaggaggtggtgctgctccagctgacgcggttcaggtgcggctccctcgccgtcgggttcacctccaaccacgtcgtcgccgacggccacgccaccagcaacttcctcgtggcgtgggggcgcgccaccagggggctccccatgggcgccccgcccgtgcaccaccacgccgccctcttcaagccccgcccctcgccgcacgtcgagcacgaccaccgcaacagagagtactacctccccgccgccggcgacgacagccacggccacggcgacggcggcgcggcggacaacatcgtgatccacaaggcgcacttcaccaaggacttcatcgccggcctccgcgcggcggcgtcggaggggcgcggccggccgttcagccggttcgagaccatcctcgcccacctatggcgcactatgacgcgcgcccgcgggctcagccccgacgaggcctccaccatccgcctctccgtcgacggccgccaccgcctcggcgcgccggcggagtacttcggcaacctcgtcctctgggcgttcccgcgcgccaccgtcggcgacctcctcacccggccgctcaagcacgccgcgcaggtgatccacgacgaggtggcgcgcgtcgacggcgcctacttccgctccttcctcgacttcgccctctccggcgccggcggcgacaaggaggggctcgcgccgagcgccgtgctcaaggacgtgctgtgcccgaacgccgaggtggacagctggctcaccttcccgttctacgagctcgacttcggcaccggcagcccgacctacttcatgccgtcgtactttccgacggaggggatgctgttcctggtgccgtcgtacctcggcgacggcagcgtcgacgccttcgtccccgtcttcaaccacaacctcgaggcattcaaggagtgctgctactccatggagtaaaattcaaaatcaaaatcaaaatcaaatcatttattcgttattattattgattatggagtaataataataagttaaatttttattattattccattgtcttaaaagcaaattatggattaatgatatatatagaagaagagagggaaattcaagatttaggtagtgaattaaccatttcttttcaccattttgtacgtatgcatgtgcatgggtacgtacaaaaagaaaggaaaaggttacaggctgggtacttagtacgtgccaaattggtgccaacgcggggggtggttagatgtcgaggttatcaatttggtgaggggtggttattaggttgaagcgcacgttaattaatcaaattaattataaggcgtttgcttgtttgtttacgaattacgacaacgtatacagtacgaggagtactatattttcttctactgttttttttttctggcttggattcatttagcttggatcaggggcgtttccatgtttcaccaagttttggatgatatctgtgtaacacactgtatgtaaaccggtctagtatagtatttgtttaagaggtgaatggaaatgttgcttggaattcggctataaatacaagaaataattttgttcttgttttttctgtgtgttgacgtgatcaatgcggtggtcagttctggtgaccaaataccatacaaccgtcgccgtcaactagttcggacagacatgccgctgcacacctaacacaagcaagctgcatccaaatccgaaccaatcctgttgtcgacgtgcaccag

SEQ ID NO: 164 - DNA, 1616 bp, Secale cereale
ggagctccgcctcgtacgccgatccaagctcgacctagctagctagcaatggaggtgaaggtgctgagctccaggctggtcaagcccgcctacaaggccggcgctccagccacggagtacatccctctctccatcttcgacacggtcacgtaccagatccagatggccatcatctacgccttcgcgccgcccgcgccgtccaccgccgccatcgagaagggcctcgcggccgtgctggctcactaccgtgccttcgccgggcagcttggccagtcccccgacggcgcgccggccgtggtcctgaatgatcgtggcgcgcgcctcgtggaggcgtccgtggacgccaacctcgtcgacatggcgccggccaagcccacgccggcgctgctgaagctgcacccggacctggacgcggagcaccaggaggtggtggtgctgcagctcacgcggttccgctgcggctccctcgccgtcgggttcacgtccaagcacgtcgtcgccgacggccacgccaccagtaacttcctcgtcgcctgggggcgcgccaccagggggctgcccatgggcctcccgccggtgcaccaccagaagggcctcttcaagccgcggtccccgccagctcgcctggagcacgaccaccgcagcagggagtaccaccggccatcgcccaccgcagccgccggtggccatcatcacggagtcgacggcgccgaaagcaacattatcatccacaaggcgcacttcaccaaggacttcatagcggggctccgcgccagggcctccgaggggcgcgggcggccgttcagccggttcgagaccatcctcgcgcacctctggcgcaccatgacgcgcgcgcgcgacctgagccccggcgaggccacgtcgatccggatatcggtggacgggcggcaccggctgggcaggccggcggagtacttcggcaacctggtgctgtgggcgttcccgcgcaccacggtgggcgacctgctgggccggccgctgaagcacgcggcgcagacgatccacgaggaggtggcgagggtggacggcgcctacttccagtccttcgtcgacttcgcgtgctccggcgcggcggagaaggaggggctcgccccgagcgccgtgctcaaggacgtggtgtgcccggacgtggaggtggacagctggctcaccttcccgttctacgagctggacttcggcacggggagcccgagctacttcatgccgtcctacttccccacggaggggatgctgttcctggcgccgtcctacctcggcgacggcagcgtggacgccttcgtccccgtgttccggcacaacctccaggccttcaaggaatgctgctactccatggagtagatcgagtcatgcatcaatggtgggatggatcggtgcaacgaacaagaaagaacgttactgtacgtgcgagagagatggaacagaactgcatgccgaagcggcgcggttgttgggtcgggtgggtgaggggtggtcgaattttattttatttttagctgtgagtgacgacgcactttatggtggcggcctcagacacattgatcgatcgattggttatttgtgccctatacttgaagttaataaataataatgttgat

SEQ ID NO: 165 - DNA, 2083 bp, Zea mays
agcacggttggttgttagaatccttggaacagtcaaacacaaaagttaataacgatggagaagcgcggcggccggttcaaagtttacgcgaggaagccaatcactcccaccaaccatttcttagcccccgcgcgcttcgtacgtactcctatataaaccgcacggcacgagtgcatcagaacgtacaccccaaggcgccaaagcaaagcaaggaaaaggaaagcaacaaggaggactcacgcagtacgcgcgagacctcgagctcaagtccttgcttatctttcttgctgcaaatagcttgaagtcgatccgcgaaaggacgaccgcaccagctagcattcgttaccttcatcagcttcgacagcaatggaggttaaggtgctgagctccaagctcgtcaagcccgcttacaatgccggtgcgggcccagcgccggcggtcagtgcggatgagtacacccccctgaccatcttcgacgtggtcacgtacaagatgcagatggccatcatctacgccttcccgccgccggccccatcgacggcggccatcgagaacggcctggccgcggtgctggccgagtaccgcgcattcgcggggcagctgggcgtggccccagacggcacgcccgcggtgctgctcaacgaccgcggcgcgcgcctcgtggaggcggccgtggacgcggacctcgtggacatggcgcccgccaagcccaccccggagctgctccggctgcacccggacctggaggaggaggagctccaggaggtggtgctcctgcagctgacccggttccggtgcggctcactcgccgtcgggttcacgtccaaccacgtcgtggccgacggccacgccaccagcaacttcctcgtggcgtgggggcgcgccaccaggggcctcccgacgggcctgccccccgtgccccgccaggcggggctcttcaagccgcgcccttcgccccgcgtcgacttcgaccaccgcagcagggagtggtacctgccgtcgcccgccgagaccgagaagcagcacggccacggccgcgagggcgcggcggcggcggagagcatcgtgatccagaaggcgcatttcaccaaggacttcatcgcgcggctccgcgccaaggcatcggaaggccgcggccgcccgttcagccggttcgagaccgtcctggcccacctgtggcgcgccatgacgcgcgcccgcgggctgagccccgacgagacctcgcagatccggctgtccgtggacgggcgccaccgcctcggcctccccgccgagtacttcggcaacctggtcctctgggcgttcccgaccgccacggtggcggacctgctggggcggccgctgaagcacgcggcgcaggtgatccacgacgaggtggcgagcgtcgacggcagctacttcaggtcgttcatcgacttcgcgacgtccggcgccgcggagagggaggggctggcgcccagcgccgtctgcaaggacgtcctgtgcccgaacgtggaggtggacagctggctcaccttcccgttctacgagctggacttcggcacgggcagcccgacctacttcatgccgtcctacttccccacggaggggatgctgttcctcgtgccgtcctacatcggcgatggcagcgtcgacgcattcgtgcccgtcttccagcaaaacctcgaggcgttcaaggagtgctgctacgccatggactaggatcgggctgcaggcgtcgtagcggaggcaggaggggaagggaatgcttgcatatcccgatcgcccgtaggttgaaccgtcggatcaaggacgtgtctaattaagcgagtgtttcattgagttttgggagattaaatttatgattcaatttaattatgaggttaatcaataataatgacaataatcagtctgttcatttttaatccgtaccggcttctactactttacctgatttaatccgaaaccaacagtctgtgtgttaacccctgactctctgtctgctatccatgcatccggcaggattccaccaccatatacaaatagttcttttcagcttaatcactggctgattgtatgtgtagaccaatattccgtaaaccac

SEQ ID NO: 166 - DNA, 631 bp, Triticum aestivum
acacaacaagaatctctccgttcgttccacaaagcagcagcaaggaatcgttggtgccggactgcccgatcgaatcatccgtcagaggatccatggccatggagaggttcttcacggcgctcgtcttctgcgaggcgccgctggacggctacggcacatcggtgctcaccgccggcgcgatggacaggccggtctctgccggcggcagcgcgacgaagccggcggtggctaacaagacggactctcagaaggagcagggactcttcaacggcaagccgacggcgcagcggcgccctgcgttcgagctcgcgttcgacggtgtcaactgcttcgacaccgtcgtcatgcactgagcatgtcgctttctcgattcttatatgtatagaacttgggtcagctagactgttttgacacgtaagtggacttgtgatgatttgttcattccattgtagacagtagtgcataagcttcatcaataaagatgatatgaatttaaagttaatataaatataatcagattacgggtaatgcggatcaaagtatatgtagatccttccgtcagcgtgctgtactgctgtctaacggtctttgccacgcgtttttcgcaggaacaatgcaaccgagaggttgg

SEQ ID NO: 167 - DNA, 1056 bp, Hordeum vulgare
ataacacaccaacgttgcgttgccacacgaatggaacaccttacgatatctctaatcgatcacacaatggcatcatcttctccttcaaccatgatccagatgcctccaactccacacaccaacggcagccagccgacggctccgaccacgccaaaggacgccggcgacttcccgaccatggggcacggagcagctgctggacgagcacccacggcgacggacaaggtcatgtcgagcgccgcgaacctcgcgcagctcctgccgacgggcacggtgctggcttaccaggcgctatccccatccttcaccaaccacggcaagtgcttgtcctccaaccagtggctcaccgcggcgctggtcgtcgtcctcaccatctcgtgcatcctcttctccttcaccgatagcgtactcggccgcgacaaaaagctctactatggcatcgccacgccgcgcggtttcaacgtcttcaacttctcggacgaagaggagaagctgcagtggactcccgatgagttccggaggctccgcatccggccactggatttcatgcgcgccgtcttcacggccctggtgttcctcaccgtggcgttcagcgatgtgggcctgcagaactgcttcttccccaacgccggcaggaacaccgaggagctgctcaagaacctgccattgggcatcgcgtttctatccagttttgtgttcatgatcttccccacaaaaaggaagggcatcggctacactgacaccactcctcccagaaagctcacttgatgttcagatcaatcttgtttctaaaccgttgattgattagattatacgtacatcaatgtatttagtactataattacatgatgtttagatcgattagattgattgattagattatacgtatatcacttgttcttaagttaaaatgtagtgtaatcagtaatcatggtatataggagtagtaatacttatgattacattttttggaaatatttgtatgtcgtttaatttattaatgcaaaatttaatgaaaccatttgtttgggcagatgcccttggtcgctgcagtga

SEQ ID NO: 168 - DNA, 1056 bp, Aegilops tauschii
ggattcgcctatataacacactgacgatgcgttgccacacgaatggaacagcttaggatattcctagtcgagcgcacaatggcgtctcccccatcttccaccgtgatccagatgcctccaacaccacacaacaacggcgaaccgacgctggccccggccacgccaaaggacgccggtgacgtgccgaccacggcgcccgcagcagctgccggaccagcacccacggcgacggacaaggtgatgtcgagtgcggcgaacctcgcgcagctcctgccgacgggcacagtgctggcgtaccaggcgctgtccccgtctttcaccaaccacggcaagtgcttctcctccaaccagtggctcaccgcagcgctggtcatcgtcctcgccgtcctgtgcgtcctcttctcctttaccgacagcgtcctcggccgcgacaaaaagctctactatggcatcgccacgctgcgaggtttcaacgtcttcaacttctcggacgaagaggagaagctgcaatggactcccgccgagttccggaggctccgcatccggccgctggacttcgtgcgcgccgtcttcacggccctggtgttcctcaccgtggccttcagcgacgtggggctgcagaactgcttcttccccaacactggcatgaacacccaggagcttttcaagaacctgcctctgggcatcgcgtttctgtccagttttgtgttcatgatcttccccacaaaacggaagggcatcggctacagcgacaccactcctcgacaaaagctcacttgatgttaatatcagttgtttctgaacagttagatagattaagagtataccgtaaatcgacgtatatagttactgtaactttgttgtttagatcacttgttttttaagttaaaatgtagtgtaatcagggtataggagtagtatgacttattacattttttgggggaaatacttgtgtattgtttaatttattcatgcaaaatttaatgaaaccatttgtgtgggcagatgcccttgttcggtgcagttgtaatgtttatcttttatttagagagaaaa

SEQ ID NO: 169 - DNA, 584 bp, Triticum aestivum
gttggaagtagctagccatgaagagcagcacgctgatggtgatcatggtcctccaggccactctggtcatggggatctttatcctcccggacatgtgcaacggagatgtgcatgcaacgtccgtgggtgagggcaaggccatcgacctcaacctgggcaagctaaggtgctgcatcaactgcaactcctcctcgggcctctacacatgcgatgacgtcgtgaagatatgcgaccctgtctgcaagcgatgcgccgttgtgaagaagaaccttgtcaaggagttcaggtgcaccgacaccttcctcggtctgtgcgaaaatccgtgcaagaaccactgaagatgaaagtagctaataagcagcacgctagctgctactgtgatttgatatgtgctacggtgcacagtagacatgtatgccaggattgggattggatgattttcgatccatgttatacgcggaacagtaagtcgttgtttacgtgtttattgacacaataaaatcggtgttagatattggtggttatatcatggcaatctccacaattttgattctagatattggtggaatagttcctataggctt

SEQ ID NO: 170 - DNA, 856 bp, Aegilops tauschii
ccctgaacacgtacaactaatctaaagttttgaccgaaacaaacttgtggtcagtcaactgaccaaattttattttcagtcaactgacctctagccagtcccataggataagcagacacaactaaggaacttgcaaaacaatgtatgtttgatatgcagacaatatttcatactccgacttgtgaccgattaatactagctctctaaaataatgtaaaatatcctcacgggagaaaagatgcttgttgccgtcgcaagaaatgatcaacctaacacgtcaaatatcttgtgattcggtgcatcaataaatttccacaacatcgtgactcaagcctataggaactattccaccaatatctagaatcaaaattgtggagattgccatgatataaccaccaatatctaacaccgattttattgtgtcaataaacacgtaaacaacgacttactgttccgcgtataacatggatcgaaaatcatccaatcccaatcctggcatacatgcctactgtgcaccgtagcacatatcaaatcacagtagcagctagcgtgccgcttattagctactttcatcttcagtggttcttgcacggattttcgcacagaccgaggaaggtgtcggtgcacctgaactccttgacaaggttcttcttcacgacggcgcatcgcttgcagacagggtcgcatatcttcacgacgtcttcgcatgtgtagaggcccgaggaggagttgcagttgctgcagcaccttagcttgcccaggttgaggtcgatggccttgccctcacccacggacgttgcatgcacatctccgttgcacatgtccgggaggataaagatccccatgaccagagtgg

SEQ ID NO: 171 - DNA, 2128 bp, Triticum aestivum
ggagcaagaagagagtgagggcaaggcaagatggccgggggcggcgagggcgcggcgggcgggacgggggagatgcggtcgctggcgctcacgcccacctggtccgtcgccaccgtgctcaccctcctcgtcgccgcctcgctcatcgtcgagcgctccatccaccgcctcagcaactggttgaagaagactcaccggaacccgctccacaaggcaatggagaagatgaaagaagaaatgatgttgctcggcttcatatccctgcttttagcggcgacgtcgaggatgatctccggtatctgcatcgactccaagtactacaacagcaggttctccccgtgcaacaaagaagaggctgagcagtcattgagcaccgagcacgacctgactcgcaagcgcaaccacataatcgatgccattctgcatcgttctctcaggaggaaccttaaggcgcagtcccatcaggtggagagctgccacgagggcttcgagtcgtttgtttcacatgagggtctggagcagctccaccgcttcatatttgtcatggcggtaacccatgtgacctacagttgcttgacgatgttgctagctatactcaaggtccatacatggagaaaatgggaagatgaagcatttagagataatcacgaatctttttcccagattgcgtatgcatcagcaactagaaggcaaccaccagcacttaccaaatcctcttcattcagattttggagtcaaaataatgcggtcatgtgggtgttttgcttccttgctcaatttggtcaatctgttgttcgagctgactaccttatccttcgcaagggtttcataatgaaccacaatcttgcaccaacgtacgacttccacacttacatgatacgctcaatggaagaggagtttgagaagattgttggagtgagtggagtgctgtggggcttcgttgttgctttcatgctatttaatgttgatggatctaacctgtacttttggatagccatcctccctgttgctcttgttcttctagtcggtgcgaaactgcagcatataatagcgattttaacatcagagggtgcaaagctgactgcatttggaccaaggataaagccacgcgatgatctcttttggttcaagaaaccaaagtttctcctgtggctgattcactttgttctcttccagaatgcattcgagctggcctctttcttctggttctggtggcaatttggttatgagtcatgcttcatcaaaaaccacctactggtttactgccgccttgtattggggtttgccggacagtttctctgcagttacagtacgttgcctgtttatgcgcttgtcacgcagatgggatcaaagtacaaggctgccctgatccccaacaggatcagagaaaccatgcacgggtggggcaaggacacaaggaagaagaggaagaagcggcgcggcgacgattccaccatccgcacagagaccagcaccgtgtgctccctcgactacgaggacgaagacgacgacggccatggccattccgatgatgccacgacacccaggttgccgccatacctgaagatcgagctacggccaatgcggggcggcggtggcattcctacaccaggcatgccgagccaccagcttccgaccggcggcagcaactggacccccggcggcagctctcagcacgcgctgctccagcgacagggctcggcctcagcctccgcgccgtcgtcaccgccaccgagcagccatgaccgcggcgtcgtaaggtcagcgtcgatgccggggatcgctgccgtggcaacgatagcctcgacgataggccttagcaccccgccgactcggctcagcgatgatgcccatgcataggaggacactggacttattttgtgttactgtaggatgatgatggctgatgacgactgaggagagataatgataggatcatatcatagatgagagaaagatatactacttcattttgtggtcatataagaaaagatggtgtatagtgttacatacatggtcatatatactagtgcgtgtcatcagaacttagagacgacggtttggtttaaaggaatttcaaaggaatttatagaggaaagttaatcccagcgtcagcattgatcttcac

SEQ ID NO: 172 - DNA, 2845 bp, Hordeum vulgare
ccccacccccgaatcttcttccacccccgcatcatcccatttgtttagtttaactccaatgagcagctaatgattcattccatccccatgcgaccgagcgagcgagatgagaagactagagaagaagaaagattagtgtagtaagtacaataggtgacagttgagatcccctttcaatctgctggcaccttcttcttcttctccttcctgtggagcattttgttgtttctccacctcccttctgcttcttcttccccccgcactcacccttgatgccagccgttgccgtcatcctcctgcctcggcccgtccgtcgaccagctcccttcctagccaagctctgagccgagcttccgaaggaaatcgatccgctcctgctcctgctctgcattccgtctccaccgttggtcttcttcttcttctcctcctgccgtccgcggcgccattggggagaagcgagcgacagcctaaatataggccgcgtggtcgccacgaccgagacagcaagaacaaggtgggcatcgtattgctgctcctcctccaagatccctatcccctttctcgctcccggagctccccgtcggaggccggccggcgacgcgatgcgccgcgtagccgttgcgccccggcccctccctgactggtgagcactgagcaatgcggcggcgcgcgccgggtctggcagaggaataggaggcgtccgtctgcctgtctctccggtgtcggtgttggtcttgggtacgtacgctcgcgcggtacagaagaaggtgggagcaagatggccggcggcgagggcgccggcgcggggggcgggacgggggagatgcggtcgctggcgctgacccccacctggtccgtcgccaccgtgctcaccctcctcgtcgccgcctccctcatcgtcgagcgctccatccaccgcctcagcaactggctgaagaagactcaccggaacccgctctacaaggcaatggagaagatgaaagaagaaatgatgctgctcggcttcatatccctgcttttagcggcgacgtcgaggatcatctccggtatctgcatcgacaccaagtactacaacagcaggttctccccgtgcaccaaagaggaggtcgaggagtcattgagcgccgagcacgccctgacccgcaagcgcaaccacgtaatcgatgctatcctgcatcgttctctcaggaggaaccttaaggctcagtaccatcaagttcaggcttgccacgagggcttcgagtcgtttgtttcgcatgagggtctggagcagctccaccgcttcatatttgtcatggcagtaacccatgttacctacagttgcttgacgatgttgctagccatactcaaggtccatacatggagaaaatgggaagatgaagcatttagagataaccatgaatctttttcccagattgcgtatgcatcagcaactagaaggcaaccaccagcacttaccaaatcctcttcattcagattttggagtcaaaataatgctgtcatgtgggtgttttgcttcctcgcacaatttggtcaatctgttgttcgagctgactaccttatcctccgcaagggtttcataatgaaccacaatcttccaccaacatacgacttccacacttacatgatacgttcaatggaagaggagtttgagaagattgttggagtgagtggagtactgtggggctttgttgttgctttcatgctatttaatgttgatggatctaacctgtacttttggatagccatcctccctgttgctcttgttcttctagtcggtgcgaaactgcagcatataatagcgattttaacatcagagggtgcaaagctgactgcatttggaccaaggataaagccacgcgatgatctcttttggttcaagaaaccaaagtttctcctgtggctgattcattttgttctcttccagaatgcattcgagctggcttctttcttctggttctggtggcaatttggttatgattcatgcttcatcaaaaaccacctactggtttactgccgccttgtattggggtttgctggacagtttctctgcagttacagtacgttgcctgtttatgcgcttgtcacacagatgggatcaaagtacaaggctgccctgatccccaacaggatcagagaaaccatgcacgggtggggcaaggccacgaggaagaagaggaagaagcggcgcggtgacgattccaccatccgcacggagaccagcactgtgtgctccctcgactacgaggacgaggatgacgatggccatggtcattccgatgatgccacgacaccgaggttgccgccatacctcaagatcgagctgcggccaatgcggggcggcggcggcattccgagaccgggcatgctgagccaccatattccgaccggtggcagcaactggacccccggcggcagctcccagcacgcgttgctccagcgacagggctcagcctcagcctctgcgccgtcatcacctccacctagcagccatgaccgcggtgtcgtaaggtcggcgtcgatgccggggatcgcttccgtggcaacgatagcctcgacgataggccttaccaccccgccgtctcgtctgagcgatgccaattcataggacactagactttgtgttacttatacgatgatgacgacgatgactgatgagagataatgctaggatcatatcatagatgagagaaatatatacttcattttgtggtcatataagatggtgtatatagagacatatagtgttacatgatcaattatagtagtgcgtgtcatcagaacttagagactgtttggtttaaaggaatttcaaaggactttatagaggaaagttaatccagcg

SEQ ID NO: 173 - DNA, 3909 bp, Brachypodium distachyon
gctgctgggctctgcttcacagaaatggaccaagaattgtgctacaatcataagaggtaagcattactcaccttcaaagtctaagtgccaaaccagttacctcttttgattgctaaagcgggaaacaagtagatatatactaggaaatgatatgtcaagatgaccagcggagagatcagtgctctgcttcttcttttttagagttgcaacgtgggcttcttttcttgaattgctgtcgaaaccaagaactgttgtgtcaaaatcctgcgcccaaaagaggctcctcagaaccaacgttttgtttacagcaatcatgtactagtacaatgtgtattactccctccgtcgactcaaatttgtttaaaaatgaacgtatctatatattaaaatatgtctagatacatgtaatatttcagcacttaatacgggacggagcagtactaagtgtaaaggtcagtcaaaagtttcgtcttgatgaaacaaaattgaagcagccaagctttcttacaaaatggaattccgaattccaaaggtagccagccaagcttttgtttcacttgtcacggacaccaaatcccggcaaaattcctggagcgcacgtacaactaggccgcccacggcgtgggaagcacaaaccaaaaataaagaagttttttttttctttcttaggtaaaaagttttttaaaaatatttaaggcgcgcatccccgtctccaacggccacaccggacgcacgtacaggcagctatcagtcggcactaggcacatgcagcgacgctgacactacgggcccacgacgtgcggccccaccggccagccaacggaagctagagacaggcacgttcgcgtcaccctctacgtagctccgtgtaatagagtcatgtgctcgcccgcctcggcctctctccttgcttccctcgtgctagtgtcagaggtttgtacttgcaggagccagcctcgaatcttcttgcagcgtgctaagtgccgccatttgtttttgtttatgccaatgagcagcaaatcatggaggggagagagaatgagagatcagagatgagaagaagaagattagaagctgacagttctgcttgatttttggctcctccgaggcgagatcccctttctgctggcaccagcttccatctcctgttcgtattcgtcttcctcctctggcatctctctgttgtttcttccagcgctcttcgtcttcttcctcctccggccctgttgacgccaaggactgttgctatcatttcctgcttccattgatacccttcctgctgctccccaaaggaagaggaaacacagtgtccaggaaaacacagtgctcttcttctccaatctgtcgcaaggtgcgtcccagctccatacgagctgcagcctgcagaggaatcgagtggctaaatatagcaaggctgctccataaggctaatcgaagtggaggacaaagaggggaacattcagcattttcttggtattctccaagagatcccctctctctgatctcccaagtgaagaaggtcaacaggctgatggcggcgctaatggcgacgcaatgtagcgcgtagcgtcttttcgccccaccacccagccccaggtcctccaagaagaagaagaaggaggaggagctcttgaatcccgtctcctgcgcacgcgtttctgcagtctcttggttggctccttgttgattgatttgctgcgctgcgctgttgcaatgcggccggttcttggggaggaataggagtataggactgtctctctcttgacgcttgagtggacagatggccggcggcgagggcgcggcggcggcggcgggggaggcgggggagatgcggtcgctggcgctcacgccgacgtggtcggtggccaccgtgctcacgctcctcgtcgccggctcgctcgtcatcgagcgctccatccaccgcctcagcaattggttgaagaagactcaccgaaatccgcttcacaaagcaatggagaagatgaaagaagaaatgatgttgcttggcttcatatctctgctcctggcagctacgtcgagaatcatctctggtatctgcatcgattccaagtactacaacagtaagttctccccatgcaccaaagaagaggttgaagaatctatgagtgccgagcacacccttgctgagggcattctgcaccattctctcaggaggaaccttaaagctcagtaccatcatgttcaagcttgtcccgagggctacgaatcatttgtttctcatgaaggtttggagcagctgcatcggtttatatttgtcatggcagtaacccatgtgacatacagttgtttgacgatgttgctagctatactcaaggtccatacatggagaaaatgggaagatgaagcatttagggacaatcatgaatcattttcccagattgcctatgtatcagcaactagaaggcaaccaccagcacttaccaaatcctattcatttcgtttttggagccaaaataatgcagtcatgtgggtgttttgcttcatcgcacaatttggtcaatctgttgttcgagctgactatcttatcctccgcaagggtttcataatgaaccacaatctaccaccaacatatgacttccacaattacatgatacgctcaatggaagaggagtttgagaagattgttggagtgagtggagtgctgtggggctttgttgttgctttcatgttattcaatgttgatggatctaacctgtacttttggatagccattcttcctgttactcttgttcttctagtcggtgcaaaactgcagcatgtcatagcaactttaacatccgagggtgcaaggatgacttcatttggaccaagaataaagccacgcgatgatctcttttggttcaagaaaccaaagtttctcctgtggctgattcattttgtcctcttccagaatgcattcgagctggcttctttcttctggttctggtggcaatttggttatgattcatgcttcatcaaaaaccacctgctagtttactgccgcctcgtattggggtttgccggacagttcctttgcagttacagtacattgcctgtttacgcccttgtcacacagatgggatcaaagtacaaggcagccctgatccccaacaggatcagagaaaccatgcatgggtgggggaaggcggcgaggaaaaggcggcggaagcggaggggcgacgactccaccatccgcaccgagaccagcaccgtctgctccctcgactacgaggacgaagacgatgacgatgatcatgaccacgccacgccatccaggccgccgttgccgtacctgaagatcgagctgcagcccacgcgcagcgctggcggcggtattccgaggccgggcaccacgccggttcaccgccattccatcagcacgctgccctgcagcggcagctcccagcacgcgctgctccagcagcaggcctcatcatcggcgccgtcttcgccacctgcgagcaaccggggccgtggagtgacgaggtcggcgtcgatgccagggatagcttccctgacaacgatgcctgggcctggcggcagcatcggcactccgacttgcttgagcgacgaccatgcttagaacacacttgactttgtgtacaactctaggataatgatgatgatgatgaagaagaatagtgcaatgcctgctttttttataggtgatgagtgcaattgatgctagtataggcatatacatatatacttcgttctgggacatgactttgaggtatacccgtttgtctggctgatggtgtatattgtatacatgatcagttgcaggtgcaagtcttcagaacttactcgctggttggctcagaaaagtcgaccagaattggcttccaatctagataattgtgtttcaggtcaattctttcgattaattcagtactcagtagtttgacg

SEQ ID NO: 174 - DNA, 3784 bp, Panicum virgatum
ccccgccccgccgtcatggccgaggaccacgggtcgtcgcggcacatgtcggcgtcgcagaaggagctgggcgacgaggacgcgcgggtggtgcgcgtgggcgacgccgcgcgcaccaacgagcgcctcgacttcgcgggcaacgccgtgcgcaccgccaagtactcgccgctcaccttcctgccgcggaacctcctcgagcagttccaccgcctcgcctacgtctacttcctcgtcatcgccgtgctcaaccagctgccccagctcgccgtcttcggccgcggggcctccgtcatgccgctcgccttcgtcctcgccgtcaccgccgtcaaggacgcgtacgaggactggcgccgccaccgctccgaccgcgccgagaacggccgcctcgccgccgtactctccccggacgccgccgggggtgcccagttcctcccgaccaagtggaagcacgtccgcgtcggcgacgtcgtgcgggtcgtttccgacgagtcgctccccgcggacatggtcctcctcgccaccggcgagcccaccggcgtggcgtacgtgcagacgctcaaccttgacggcgagtccaacctcaagacccgttacgccaagcaagagaccctctccacgccgcccgagcgcctcgccggcgccgtcatccgctgcgagcgccccaaccggaacatctacggcttccaggccaacctcgagctcgagggggagagccgccggataccgctcggcccgtccaatatcgtgctgcgcggctgcgagctcaagaacacggcctgggccgtcggcgtcgtggtgtacgccggccgggagaccaaggccatgctcaacaacgccggcgcgcccaagaagcgcagccgcctcgagacgcacatgaaccgcgagacgctcttcctctccgccatcctcgtcgtgctctgcacgctcgtcgccgcgctctccggcgtctggctgcacacccacgaggaggagctcgagctcgcgcagttcttccacaagaaggactacctgaaacgcgacgacaacaatgactacgagaactacaattactacggcatagcggcgcagatcgtgttcatcttcctcatggcggtcatcgtgttccagatcatgatacccatctcgctctacatctccatggagctcgtcaggctcggccaggcctacttcatgatccgggacaccaagctgttcgatgagtcctccaacacgaggttccagtgtcgggctctcaacatcaacgaggacctaggccagattaagtgcatattctctgataagaccggcacgctcacgcagaacaagatggagttccggtgcgcgaacattgacggtgtcgattacagtgacattgcacgacagcgacctgctgagggtgatcggatttgggcgccaaagatatcggtgaacaccgatcaggaactggtcaagttgatcagggatgggggtgacacagagcaagggaggcagacccgagagttcttcctcgccctggcaacgtgcaacaccattgtccccatggtaactgatggcccggaccctaagaagaaggtgatcgattaccagggcgagtcaccagatgagcaggcattggtctctgctgctgcggcatatggctttgtgctagttgaacgaacatcaggacacatcgtgatcgatgtgctcggtgagaagcagagatatgatgtccttggtcttcatgagtttgacagtgaccgcaagaggatgtctgttataattggctgccctgataagtcagtcaagctttttgttaaaggcgcagatagttcaatgtttgaggttattgacaaaatgttgaattcagatgttatccaagcaacagagaagcatctccattcttattcatcattaggcctgcgaacgcttgttatcggtatgcgggaacttagccaagaagagtttcaagagtggcaaatggcttatgaaaaggctagcaccgcactactaggaagagggaacctactccgtggtgtggctgccgacatcgagaggaacttgcgcctgttgggagcctctggtattgaggacaagctgcaggatggagtacctgaagcaattgagaaactgagggaagcagggatcaaggtgtgggtgctaacaggcgacaagcaagaaactgccatctccatcggctattcctgcaaacttttgacacgggacatgacacagattgtaatcaatagtcgctcaagggactcatgcagaaggagtctggatgatgcaatcaccatggttaacaaataccaatcattctcgacagatccacagcttagagtgcctcttgctttgattattgatggaaacagcctcgtctacatttttgatacggattgggaagagaagctttttgaaatcgcaattgcttgtgacgtcgtcctatgctgtcgggtagctcccctgcagaaggctggtattgttgatctcataaagaagagaacaagtgacatgacacttgctattggagatggtgcaaatgatgtgtccatgattcaaatggctgacgttggcattggcatcagtgggcaagagggaagacaagctgttatggcctcagattttgccatgggtcaattcagatttttggttcctctgttgttggttcatggccattggaactaccagaggatggcctacatgatcctatataacttttacagaaatgctacttttgtctttgtgctattctggtatgtactttacactggttttaccctgacaacagcaataactgagtggagcagtgtgctatactctgtgatatacaccgctgtccctactattgttgttgccattctagataaggatctcagccgccggacattgctgaaatatgcccagctatatggcccggggcagcgtgaggagaattacaatttgaggctattcatcttcatcatgatggactcagtatggcagagcgttgcatgtttcttcatcccttaccttgcatacaggaaaagtgtaattgacagttccagcctcggagacctctggacactctctgttgtcattcttgtcaacattcacctggcaatggatgtcatcaggtggaactggatcacacatgcagcgatatggggaagcattgctgcgacatggatttgcgtcatgatcttagactccatacctaccttgcctggtttctgggcaatctataaggtgatgggaactgggttattctgggcactgctgcttgcggtaaccgtagtcgggatgattcctcattttgccgcaaaggccttcattgagtatttcatccccagtgacatccaaatcgcgagagaaatggagaagtcacaagatacccatgatgcaacccatccagaagttcagatgagttctgtaagtagagcttagagtagggcattacacagtgatcttttgttcgttcggataggatagctctacacctttcttttgttctttttgttgtgtataggcaattctttcagcagtgtgcaagctttcttgatgcttgctccattgccaactatccaaaggatagcccccttgtacccattgtgtatccacccgccaaattttgttgatttacatgaaaggaaatcgtacaggagttaattgtacaaaacagaaactggtccgcatggcttatgatggtatacactatagcacagtacacattcaagtcaactgtacaaattcagtaaccgtattagcttcgttgcatctttatacgctacgctggtttcagactttcagcaagcacttcatgttagttcagtaatttcgttgaatcaat

SEQ ID NO: 175 - DNA, 5021 bp, Panicum virgatum
ctgatctgcatgccgaattgcagatagatattagatagacctcggtttaactgattcgggcccacccgcaccaagaaaagaagtactactatcaccaatgaccaatccataatccatcctctggcctttttgggtccgaagcttcaagatctccgcccacaaaagcttagccggccttcaccggcgcggcgcccccggtaccaaaccgcccggaacgtagcttttcttgaattgtttagcggccgcgaaagcgaaacccgctcgccggccgtcccgccaccgcacggatgccgccggggccggccgctcccgtatacgacggagttgtcgattttctctgtcgtatcggcagcaagcgggggcagagaagcttctaggaggacacgggcagtcagaggggtggagcgttaccaaatcttcctccgctaatagtctaattcagtaatgggaattctttagattagcgctgcctaatagcttctgcggcagattccttggttcggagaaaaccaacgcgggcagggcgagcggagcacacacgaaagtctacgagctctgtctctctcctcatacggacggtgccgtcgtcctcaccaactcccccctgccagattttaagcgccatggccaaaccatcccggcttccaatttctctctttcttcccgtctctgcgcttcgcttcctccttcctccccggcctgcggaaagcgggccctggttaatccaatctttaatgcgccagtcaccgtagttactcccaggcgtccgccttggccaaccacccgcgcctcctcctcgcttgccttgccttgctttgcctgccaaaacccaactcgtcctctgctcgtgagctcgccgccttcccctcccctccctgttctcgcagcccgaacgcggcgagtgccgctcggccccgatccgccgctccaaaaacccgactttcgcgcgcgcgccgggagcgccatgcccgggaacacgggagcccggggttcggggcgccgcgccgtctgactccgcgccggtcggcagcctcccgcctcccgcccgcgcccctgccccgccgccatggccgaggaccacgggtcgtcgcggcacatgtcggcgtcgcagaaggagctgggcgacgaggacgcgcgggtggtgcgcgtgggcgaccccgcgcgcaccaacgagcgcctcgacttcgcgggcaacgccgtgcgcaccgccaagtactcgccgctcaccttcctgccgcggaacctcttcgagcagttccaccgcctcgcctacgtctacttcctcgtcatcgccgtgctcaaccagctgccccagctcgccgtcttcggccgtggcgcctccgtcatgccgctcgccttcgtcctcctcgtcaccgccgtcaaggacgcgtacgaggactggcggcgccaccgctccgaccgcgccgagaacggccgcctcgccgccgtcctctccccggacgccaccgggggcgcccagttcctcccaaccaagtggaagcacgtccgcgtcggcgacgtcgtgcgggtcgtctccgacgagtcgctccccgcggacatggtcctcctcgccaccagcgagcccaccggcgtggcgtacgtgcagacgctcaaccttgatggcgagtccaacctcaagacccgctacgctaagcaagagaccctgtccacgccgcccgagctgctcgccggcgccgtcatccggtgcgagcgccccaaccggaacatctacggcttccaggccaacctcgagctcgagggggagagccgccagataccactcggcccgtccaacatcgtgctgcgcggctgcgagctcaagaacacgacctgggccgtcggcgtggtggtgtacgcgggccgggagaccaaggccatgctcaacaacgccggcacgcccaagaagcgcagccgcctcgagacgcacatgaaccgcgagacgctcttcctctccgccatcctcgtcgtgctctgcacggtcgtcgccacgctctccggcgtctggctgcgcacccacgaggacgagctcgagctcgcgcagttcttccacaagaaggactacctgaaacgcgacgacaacaatgactacgagaactacaattactacggaatagcggcgcagatcgtgttcatcttcctcatggcggtcatcgtgttccagatcatgatacccatctcgctctacatctccatggagctggtcaggctcggccaggcctacttcatgatccgggactccaagctgttcgacgagtcctccaacacgaggttccagtgtcgggctctcaacatcaacgaggacctaggccagattaagtgcatattctcggataagaccggcacgctcacgcagaacaagatggagttccggtgcgcgagcattgacggtgtcgattatagtgacattgcacggcagcgacctgctgagggtgatcggatttgggcgccaaagatatcggtgaacaccgatcaggaactggtgaagttgatcagggatgggggtgatacagagcaagggaggcagacccgagagttctttctcgccctggcaacgtgcaacaccattgtccccatggtcactgatggcccggaccctaataagaaggtgatcgattaccagggcgagtcaccagatgagcaggcattggtctctgctgctgcagcatatggctttgtgctagttgaacgaacatcaggacacatcatgatcgatgtgctcggtgagaagcagagatatgatgtccttggtcttcatgagtttgacagtgaccgcaagaggatgtctgttataattggctgccctgataagtcagtcaagctttttgtgaaaggcgcagatagttcaatgcttggggtcattgacaaaatgttgaattcagatgttatccaagcaacggagaagcatctccattcttattcatcattaggcctacgaacgcttgttatcggtatgcgggaacttagtcaagaagagtttcaagagtggcaaatggcttatgaaaaggctagcaccgcactactaggaagagggaacctactccgcggtgtggctgccgacatcgagaggaacttgcgcctattgggagcttctggtattgaggacaagctgcaggatggagtacctgaagcaattgagaaactgagggaagcagggatcaagatgtgggtgctaacaggcgacaaacaagaaactgctatctccatcggctattcctgcaaacttttgacaagggacatgacacagattgtaatcaacagtcgctcaagggattcatgcagaaagagtctggatgatgcaatcaccatggttaacaaataccaatcattctcaacagatccacaacttagagtgccccttgctttgattattgatggaaacagcctcgtctacatttttgatacggattgggaagagaagctttttgaaatcgcaattgcttgtgatgtcgtcctatgttgtcgggtagctcccctgcagaaggctggtattgttgatctcataaagaagagaacaagtgacatgactctagctattggagatggtgcaaatgatgtatccatgattcaaatggctgacgttggcattggcatcagtgggcaagagggaaggcaagctgttatggcctcagattttgccatggggcaattcagatttttggttcctctgttgttggttcatggccattggaactaccagaggatggcctacatgatcctatataacttttacagaaatgctatttttgtgtttgtgctattctggtatgtattttacactggttttaccctgacaacagcaataactgagtggagcagcgtgctatactctgtgatatacaccgctgtccctactattgttgttgccattctagataaggatcttagccgccggacattgctgaaatatgcccagctatatggcccagggcagcgcgaggagaattacaatttgaggctattcatcttcatcatgatggactcagtatggcagagcattgcatgtttcttcatcccttaccttgcatacaggaagagtgtaattgacagttccagcctcggagacctctggactctctctgttgtcattcttgtcaacattcacctggcaatagatgtcgtcagatggaactggatcacacatgcagcgatatggggtagcattgctgcgacatggatttgcgtcatgatcctagactccataccaaccctgcctggtttctgggcaatctataaggtgatgggaactgggttgttctgggcactgctgcttgcggtaaccgtagtcgggatgattcctcattttgccgcaaaggcgttcactgagtatttcacccccagtgacattcaaatcgcgagagaaatggagaagtcacaagatacccatgatgcaacccatccagaagttcagatgagttctgtaagtagagcttagagtaggggatacacagtgatctttttgttcattcgaataggatagctctacacctttatttggttctttttgttgtgcataggcaattctttcagcagtgtgcaagctttcttgatgcttgctccattgccaactatcaaatggatagccccccttgtacgcattgtgtatccacccgccaaattttgttgatttacatgaaaggaaatcgtacaggagttaagtgtacaaaatagaaactggtccgcatggcttatgatggtatacactgtagtacagtacacattcaagtcaactgtacagattcagcaaccgtattagctttgttgcatctttatatgctggtttcagagtttcagcaagcactttattttagttcattaatttcgttgaatcagttgtaaaaacattatcacagtggttcatttgaagtttgaacgagtgattggataatactatagacagattgggtacaagtcgaccgggaatctgggaaatttcttcccctgtctctgtcacaagattcagctgatcaacgccacaccgttatctatctaaaatatgaggttgattgagtcgataatccatc

SEQ ID NO: 176 - DNA, 4373 bp, Oryza sativa
gctttggttcgtggttgccaaaacccaactcgtttcctccccttcccatccatctctcccctgtttgtttcttggccctgatcggcctccccgtgttccctccgatccgctggtcaaaatttggtgttgagtggcacggcgggatctccatggccgggaacgcgagcggggattcgccgtggttcttggcttgaggccttggggtgggtcagcggtcgccgcccgcccggtatggccgaggaacacgaccaccatgggtcgtcgcggcacatgtcggcgtcgcagaaggagctcggcgacgaggacgcgcgggtggtgcgcgtcggggacgccgagcgcaccaacgagcagctggagttcgccgggaacgcggtgcggacggccaagtactcgccgctcacgttcctgccgcggaacctgttcgagcagttccaccgcctcgcgtacgtctacttcctcgtcatcgccgtgctcaaccagctcccccagctcgccgtcttcgggcgcggcgcgtcggtcatgccgctcgcgttcgtcctcaccgtcaccgccgtcaaggacgcgtacgaggactggcggcgacaccgctctgaccgcgccgagaacggccgcctcgccgccgtcctcctatcccctggcgcgggcacccacttcgccccgaccaagtggaagcacgtccgcgtcggcgacgtcgtgcgcgtctactccgacgagtccctcccggctgacatggtcctcctcgctaccagcgatcccaccggcgtcgcctacgtgcagacgctcaaccttgatggcgagtccaacctcaagacgcgctacgcaaagcaagaaacgctcaccacgccgccggagcagctcaccggcgccgtcatccgctgcgagcgcccgaaccgcaacatctacgggttccaggccaacctcgagctggagggggagagccgccggataccgctcggcccgtccaacatcgtgctgcgaggctgcgagctcaagaacacgacctgggccatcggcgtggtggtgtacgcggggcgcgagaccaaggcgatgctgaacaacgccggcgcgccgaccaagcgcagccgcctcgagacgcagatgaaccgggagacgctcttcctctccgccatcctcgtcgtgctctgctcgctcgtggcggcgctctcgggcgtgtggctgcgcacccacaaggccgacctcgagctggcccagttcttccacaagaagaactacgtgagcgacgacaagaacgccaactacaactactacggcatcgctgcccagatcgtgttcgtgttcctcatggccgtcatcgtgttccagatcatgatacccatctcgctctacatctccatggagctcgtcaggctcgggcaggcctacttcatgatccgggacacgacgctgtacgacgcgtcctccaactcgaggttccagtgtagggcgctcaacatcaacgaggacctaggccaggtcaagtgcgtcttctccgataagaccggcacgctcactcagaacaagatggagttccggtgcgcgagcgtcggcggcgtcgattacagcgacatcgcacggcagcaacctgttgagggtgatcggatttgggtgcccaagattccggtgaacgtcgacggggagatcgtggagttgctgaggaatgggggagagacagagcaaggaaggtacgcccgggagttcttccttgctcttgcgacgtgcaacaccattgttcccttgattcttgatggcccggacccgaagaagaagatcgtcgactaccagggcgagtccccggacgagcaggcgttggtctccgccgccgccgcgtatggtttcgtgctagttgaacgaacctccgggcacattgtcattgacgtccttggtgagaagcagagatttgatgttcttggacttcatgagtttgacagcgatcgcaagaggatgtctgttatcattggctgtcctgacaaaactgtcaagctgttcgtaaaaggcgcggataattcgatgtttggagtcatcgacaaaacaatgaatcccgatgttgttcgtgcaactgagaagcatctccatgcatattcctcactggggctgcgtacacttgttatcggtgtcagggaacttagccaggaagagtttcaggagtggcaaatggcttatgagaaggctagtactgcattgctaggaagaggaggcctactccgtggtgtggctgccaacatcgaacagaacctgtgcctattgggagcctctggtattgaagacaagctgcaagatggtgtacccgaggcgatcgaaaaactcagggaagctgggattaaggtttgggtactaactggtgacaagcaagaaactgctatctccattggcttttcctgcaagcttttgacaagggagatgacacagattgtaattaacagtaactcaagagagtcatgtagaaagagtcttgatgatgcaatttcaatggttaacaaactccggtcattatcaacggactcacaagctagagtccctctcgctttgatcattgatggtaacagccttgtctacatttttgatacagaacgggaagagaagctttttgaagtggcaatagcttgtgatgttgttctatgttgccgggtagctcccctacagaaggccggtattgtcgatctaataaaaaagcggacaagtgacatgactttggctattggagatggtgcaaatgatgtatccatgattcaaatggctgatgttggtattggcatcagtggacaagaaggaaggcaagctgttatggcatcagattttgccatgggacaattcagatttttggttgacctgttgttggttcatggtcattggaactaccagagaatgggctacatgatcctatataacttctacagaaatgctactttcgtattcgtgcttttttggtacgtacttaacactggtttcaccctgacaacagcaataaccgagtggagcagtgtgttatattctgtgatctatactgctgtcccaactatcgttgttgcgattctcgacaaggatctgagtaggaggacattgttgaaatacccccaactctatggtgcagggcagcgcgaggagagttacaacctaaggctgttcatttttgtcatgctggactccatctggcagagcctcgcagttttctttatcccttaccttgcatacagaaagagtacaatcgacggtgcgagtctgggagacctctggacactagctgttgtcattcttgtgaacattcaccttgcaatcgatgtcatcagatggaactggatcacgcacgcagcaatatggggcagtatagtcgcaacgctgatttgtgtcatggtcatagactccataccgatattgcctggtttctgggcaatatacaaggtgatgggaactggactgttttgggcattgctgctcgcggtaattgtggttggaatgattcctcattttgtcgctaaggccataagggagcatttccttccgaatgatattcagattgcgagagaaatggagaaatctcaagattctcatgatgtcactcatccagaaattcagatgagtacagtggcacgagcttaggttaggggtcacatactttttgttcattcagataggatagctctacacctttctttggttctttttactgtgtgtatactaggcaattctttctgtagtaagcacatttcttgttgcttgctgcctttgtcagctatccaaaggataggtttctttgtacccatgctgtgtatccgcctgccaaattttgttgatttataccaaaaaagaaatcatacaggagtaaactgtacattttcagaaattgcccctgttgattcctaaccagagtaagttctttttgccgggtccagagttagttattggtactggtagtgttaatgatggttgcacgttttcattccgtaaagatttattggttgaggggcaaccgagcagcaaaatacgtaactgatcctgtttatcagccaaaaaaaaaaatctgaaatcaaacctattgaccatcagagttcaacttgacaataaaatcatgcaggctgtttcgccgttctttcgacagtttcagacttcaagtcttcaacgcagcttgtgtattggttcattttagcgaaaaacattcgagagctacctaaaaacaaatgattagcagtctcatacacgcaacaacaaacaaaggaatctttaaaattctcttcggttgttgtcactaggtcagctgaaagtaccatgatgtaaccagctaattgcctcgtcaatccatcagataagttacagacttggcagtatatttagtatacccaagtttgtttgggtttaaccaacgttttctcaaagattct

SEQ ID NO: 177 - DNA, 4996 bp, Brachypodium distachyon
ttatccactaattgaaaatattatttaagccgcctaagattaacagctcagttggcctcattcccttgtcttccccgtcgtctcctcggggcaaagaagcttccaggaggagggagcgcaatcaaacgccctcctaatccaatgtctgcttgtctttgatgacttgaccaaaattagtattgaaaattcagataacacagaatgaacacaagcaacatagagaacacagaagctttcaagtctccctcttctctcatccaaacggtgcctccgtcctcaccaactcccctctgccagattttaagcgtcgcggccaaatcttttctccctttgcttcgtctccttctccgccagaaataaaaattcctctgcagcagcagccccatctttaatgcaacactcgccgtagttacttccagtccctggcatccgcttcaacgccaaccaacccgcccttcttggtttgccaacccgtcttctcctctgctctgctttgcccctctcctctgtttcttcttgaacccagccgggctcgccgcgtccgccggtcaaaaatctgactttgacgcgcgcgcgcgccgggatcttcatgggcgggggttcggggctcttagcctgacgcgcggcaggtccggccggccggtgagcgcccatggccgaggaccacggatcgtcgcggaacatgtcgatgtcgatgtcgcaaaaggagctgggcgacgaggacgcgcgggcagtgcgcgtgggcgacgcggcgcgcacgaacgagcggctcgagttcgccgggaacgccgtgcgcaccgccaagtactcgcccttcaccttcctgccccgcaacctgttcgagcagttccaccgcctcgcatacgtatacttcctcgccatcgccgtcctcaaccagctgccccagctcgccgtcttcggccgcggcgcctccgtcatgcccctcgccttcgtcctcactgtcaccgccgtcaaggacgcctacgaggactggcgccgccaccgcgccgaccgcgccgagaataaccgcctcgccgctgtcctgtccaccgtccccggcgcgggcgccgcagaatatgtcccgaccaagtggaaagacgtccgcgtcggcgacatcgtgcgcgtcgctgccaacgagtcgccccccgcggacatggtgctcctcgccaccagcgacaccacgggcgtcgcctacgtgcagacgctcaaccttgacggtgagtccaacctcaagactcgctatgccaagcaggaaacgcttaccacgcgggtcgagcatctcgcgggcgccgcggtcatccggtgcgagcgcccgaaccgcaacatctacggcttccaggccaacctggagctccaggaggagagccgccggataccgctcggcccgtccaacatcgtgctgcgcggctgcgacctcaagaacacggcctgggccgtcggcgtcgtggtgtacgcggggcgcgagaccaaggcgatgctcaacaacgccggcacgcccaccaagcgcagccgcctcgagacgcacatgaaccgcgagacgctcttcctctccgggatcctcatcgtgctctgctcgctcgtggccgcgctctcgggcgtctggctgcgcacccacgccacgcagctcgagctcgcgcagttcttccacaagaaagactacctcaacagcgacaaggagaacagcaactacaactactacggcatcgcggcgcagatcgtcttcaacttcctcatggcggtcatcgtcttccagatcatgatacctatctcgctctacatctccatggagctcgtcagactcgggcaggcctacttcatgattcgggatgcgaggctgtacgacgcgtcgtcagactcgaggttccagtgcagagctctcaacattaacgaagacctgggccaggttaagtgcatcttctctgataaaaccggcacgctcacgcagaacaagatggagttccggtgtgcaagcatcgacggcgtcgattacagtgacatcacgcggcagcgacctgtcgagggtgatctggcttgggtgccaaaggtgccggttaacgtcgacagagaggtgatggcgctggtgaggaatgtgggtgctaccgagcaagggaggtataccagagagttcttcattgcgctggcaacgtgcaacactattgttcccttgatccttgatggccctgatccgaagaagaaggtgatcgactaccaaggcgaatcaccggatgagcaggcactggtttctgccgccgctgcgtatggttttgtgcttgttgagcgaacctccgggcacatcgtgatcgacgtcctcggtgagaaacagaggtttgatgttcttggtcttcatgagttcgacagcgatcgcaagaggatgtctgttataattggctgtcctgacaagactgtgaaactgtttgtaaaaggtgcagatagttccatgttcggaatcattgacaaaacactgaatccagatgttgttcaggcaactgagaagcatctccattcatattcgtcagtcggcttgcgaacacttgttattggtgtccgggaacttacccagacagagtttctggagtggcaaatggcttatgagagggctagcactgcattactaggaagagggaacctcctacgcagtgtggccgccaacattgaacggaatatgcgcctattaggagcctctggtattgaagacaagctgcaagatggagtgcctgaagcaattgaaaaactgaggcaagctgagattaaggtttgggtcctgacaggtgacaaacaagaaactgccatttccattggctactcctgcaagcttttgacacaggacatgacacagattgtaatcaatagtaactcaagagagtcatgtagaaggagtctagatgatgcaatctccatggttcacaagcttcggtcattatcgacagactctcagtctagagtgcccctagctttgattatcgatggtaacagcctcgtatacatttttgatgacacggaacgggaggagaagctttttgaagtcgcgatagcttgtgatgttgttctatgttgtcgagtggctcccctacagaaggctggcattgttgatttaataaagaagcgaacaagtgacatgactctagctattggagatggagcaaatgatgtatcaatgattcaaatggccgatgttggaattggcatcagtgggcaagagggaaggcaggctgttatggcctcagattttgccatggggcaattcagatttctggtccctctgttgttggttcatggtcactggaactaccagagaatgggctacatgatcctatacaacttttacagaaatgctacttttgtctttgtgcttttctggtatgtactttacactggtttcaccttgacaacagcaataaccgagtggagcagtgtgttatattctgttatatatactgctgtcccaactattgttgtcgccattctcgacaaggatctgagtcggaggacattgctgaaatatccccaactctatggcgcagggcagcgcgaggagaattacaacctaaggctattcatttacattatgatggactcagtctggcagagccttgcggttttcttcatcccttaccttgcatacagaaagagcgcaatcgatagcgctagcctgggggacctgtggacactgtcagttgttattcttgtcaacattcaccttgcaatggatgtcatcagatggacctggatcacacatgcagcaatatggggcagtattgtggcgacatggatttgcgtcatcgtcatagactccataccaatcttgcccggtttctgggcaatctacaaggtgatggggactggattgttttgggcattgctgcttgcggtgattgtggttggaatgatccctcattttgccgcgaaggccatcagggagcatttcatccctaatgacattcagattgcgagggagatggagaagttgaagcattcccatgagctcactcatccagaagttcagatgagcacattcgctcaatcgtagggttaggggtcaacacagtgatctttgttcattctgataggttagccttacaccttttctttggttctttttgcactgtgtatataaaagcaattctttctgcagtgagcatgcttcttcttgcttgctgccttgtcggctatccaaaggataggttcaatcttgtacccatgctgtgtatccacctgaaaattttgttgatttatactgaaagaaagtcatataggagttagctgtagaaattcagaaactgatcctattggttataagagggaacaccagaagtgttaagtttttttcttttctgaaagccagttactgtgttacctagtttaatttttaatggaagaccacagagtcggggtaaattctgcgttgtgtttctagaagagtcgtctgttcaaattcagaatgcctttgtgcctgcttaatcagggtttcagagttcaattcagcacggctttccttactcacacaaatgcagcaactgctccaactgaccctgttggagttttctcaaatactttatgtagagttatagttggatttggtttagcggttatgattagagtttgagtcaagcacctgtaacatggactcccttatatatgaagggataccgcaagatgtaactcagacaactctattataactagtaaggtgcccgtgtgttgccacggaagcaccttacattgttctttaaacatgaagtatatatatatttttagtttgttgcaactcatgggtgttgtgacaatttgcataaaaaagcccttgtcattttcataagatgtgtgacctagagtttatatgggctcagcgccttcgcaaatgattcacgcagaagcctgctcctgctcaacttgtcagatgcatcacattcccaggtaactatcaaataaaacgaaaatagacataattcaaataatataatactcctgtcatatataatggcttattacaagagca

SEQ ID NO: 178 - DNA, 3800 bp, Triticum aestivum
ctgtttgtttcttgaacccaaacccagcttgtgccccggtcaaaatcggactttgggatcgccatgggcggggattcgaggttctcccactgacgcggctggtccggccggtcagcgacagcgcacgccatggccgaggaccatggatcgtcgcggcacatgtcgtccatgtccatgtcgcacaaggagctgggcgacgacgacgcgcgggtggtgcatgtgggcgacgcggagcgcaccaacgagcgcctccagttcgccgggaacgccgtgcgcaccgccaagtactcgccgctcaccttcctgccgcggaacctgttcgagcagttccaccgcctcgcctacgtctatttcctcgtcatcgccgtgctcaaccagctcccccagctcgcggtcttcggccgcggggcctccgtcatgccgctcgccttcgtcctcgcggtgaccgccgtcaaggacgcgtacgaggactggcgtcgccaccgctccgaccgcgccgagaataaccgcatcgccgctgtcctgtctcccggcgtaggcgcccaattcgtccccatcgagtggaagcacgtccgcgtcggcgacgtcgtgcgggtcggtgccaacgagtcgcccccggcggacatggtcctcctcgccaccagcgacaccaccggcgtcgcctacgtgcagacgctcaaccttgacggcgagtccaacctaaagactcgttatgctaagcaagagacgctgacgacgccgctcgagcatctcgccggcgccgtcgtcaggtgcgagcgcccgaaccgcaacatctacggcttccaggccaacctggagctccagggggagggccgccggataccgctgggcccgtccaacatcgtgctgcgcggctgcgacctcaagaacacgtcctgggccgtgggcgtagtggtctacgcggggcgcgagaccaaggcgatgctgaacaacgcgggcacgccgaccaagcgcagccgcctggagacgcacatgaaccgcgagacgctcttcctctccggcatcctcatcgtgctctgctcggccgtggccacgctctcgggcgtgtggctgcgcacccaccagaccgacctggagctcgcgcagttcttccataagaaggactacctcaaggtcggcaaggaggacaacgagaactacaactactacggcatcgcggcgcagatcgtgttcaacttcctcatggcggtcatcgtgttccagatcatgatacccatctcgctctacatctccatggagctggtgaggctcgggcaggcctacttcatgatccgggacgccaagctgtacgacgcgtcgtccgactcgaggttccagtgcagggcgctcaacatcaacgaggacctggggcaggtcaagtgcgtcttctccgataagaccggcacgctgacgcagaacaagatggagttccggtgcgcgagcatcgacggcgtcgattacagcgacgtcgcacggcagcgacctgtcgagggcgagccggcttgggcgccaaagatgccggtgaaggtcgacagagaggtgatggagctggtgaggaatgggggtgctacggagcaagggatgaacgccggagagttctttcttgccctggcaacgtgcaacaccattgttcctttgatcattgatggccctgacccaaagaagaaggtgattgactaccaaggcgagtcgccggacgagcaggcgttggtttctgccgccgcggcgtatggctttgtgctcgttgagcgaagctccgggcacattgtcattgacgtccttggtcagaagcagaggtttgacgtccttggtcttcatgagtttgacagcgaccgcaagaggatgtcagttataattggctgcccggacaagactatcaagctgtttgtaaaaggtgcagatagttccatgtttggaatcatcgacaaaacactgaatccagatgttgtccaggcaactgagaaacatctccattcatattcgtcagtcggcctgcgaacactcgtcatcggtgtccgggaacttagtcagtcagagtttcaggagtggcaaatggcttacgagaaggctagcactgcattattaggcagaggcaatcttctacgcagtgtggccgccaacattgaaaggaacatgcgcctcttaggagcctccggtgtcgaagacaagctgcaagatggagtgcctgaagcaattgaaaaactaagggaagcagggattaaggtttgggttctgacaggtgacaaacaagaaactgccatctccattggctattcctgcaagcttttgacaagggacatgacacagattgtaatcaatagtaattcaagagagtcgtgcagaaaaagtctggatgatgcgatctccatggttaacaaacttcggtcactgtctacagactcccaatctagagttcccctcgctttgatcattgacggaaacagtctcgtctacatttttgacacagaccgggaggagaagctttttgaagtcgcgatagcatgcgatgtcgttctatgttgtcgagtggctcctctacagaaggctgggattgttgatttaataaagaagcgaacaagtgacatgactctagctattggagatggtgcaaatgatgtatccatgatccaaatggccgatgttggcattggcatcagtggtcaagaaggaaggcaagctgtgatggcctcagattttgccatggggcaatttagatttttggtcccactgttgttagttcatggccactggaactaccagaggatgagctacatgatcctatacaatttttacagaaatgctacttttgtctttgtgcttttctggtatgtactttacactggttataccctgtcaacagcaataaatgagtggagcagtgtgttatactctgtggtctatacctctgcgccgactgtcattgtcgccattctcgacaaggatctgagccgaaggacattgctgaaatacccccaactctacggtgcggggcagcgcgaggagagttacaacctaagactattcattttcatcatggtggactccgtttggcagagcgtcgcagttttcttcatcccttacctcgcatacaaaaacagcgcaatcgacagcgccagcctgggagacctgtggacactgtctgttgtcattcttgtcaacattcaccttgccatggatgtcatcagatggacttggatcactcatgcagcaatatggggcagtattgtggcgacatggatttgcgtcatcatcatagactccatacccaccttgcccggtttctgggcaatctacgaggtgatgggaactgcattgttctgggcattgcttcttgcggtgattgtggttggaatgatccctcattttgccgcaaaggccatcagggaacatttcatgcccaatgacatccagattgcgagagagatggagaagtcgcgagattctcgtgatgctaatcatccagaagtccagatgagtacatccactcgagcttaggagtaggggatctttgttcattcgcgtaggctagagttacacctttctctttctgaagaaattacaccttttccttggtctttttgttgtgtgtatataaagcaattctttcggcagtgagcatgcttcttgttgcttgctaccctgtcaactatccaaaggatagatttcttgtagccatgctgtgcatccgcctgcatttttttttgttaatttatatgaaaagaatcgtacaggagttaactgtacatattcagggactgatttattttatgaagattctgaaactgatgatactgatttcc

SEQ ID NO: 179 - DNA, 4040 bp, Secale cereale
tcagggtctcttcctccctcgcccgctcatccaaacggtgcttttgtccccaccaactcccatctgccagattttaagcaaaccatttcaagtcctcatcaagattgcgtagtagtatcttttctctgcttgcttcgtctcttctccctctcccccctgaaataaaaattcctctgcagcagcagctcatctttaatgcaacactcgccatagttactcccaggcatccacttcgacccaaccactgctctgctctgctctgttctgcttcctcccctgtttgtttcttgaacggttgaacccaaacccagctcggtcaaaatcggactttgggatcgccatgggcggggattcgaggttctcccactgacgcggctggtccggccggtcggcacgccatggccgaggaccatggatcgtcgcggcacatgtcgtccatgtccatgtcgcacaaggagctgggcgacgacgacgcgcgggtggtgcatgtgggcgacgccgaccgcaccaacgagcgcctccagttcgccgggaacgccgtgcgcacggccaagtactcgccgctcaccttcctgccgcgcaacctgttcgagcagttccaccgcctcgcctacgtctatttcctcgtcatcgccgtgctcaaccagctcccccagctcgcggtcttcggccgcggggcctccgtcatgccgctcgccttcgtcctcgccgtcaccgccgtcaaggacgcgtacgaggactggcgccgccaccgctccgaccgcgccgagaacaaccgcctcgccgctgtcctgtctcccggcgcgggcgcccaattcgtccccaccgagtggaagcacgtccgcgtcggcgacgtcgtgcgggtcggtgccaacgagtcgcccccggcggacatggtcctcctcgccaccagcgacaccaccggcgtcgcctacgtgcagacgctcaaccttgacggcgagtccaacctaaagactcgctacgctaagcaggagacgctgacgacgccgctcgagcatctcgccggcgccgtcgtcaggtgcgagcgcccgaaccgcaacatctacggcttccatgccaacctggagctcccgggggagagccgccggataccgctgggcccgtccaacatcgtgctgcgcgggtgcgacctcaagaacacgtcctgggccgtgggcgtagtggtctacgcggggcgcgagacaaaggcgatgctcaacaacgcggggacgccgaccaagcgcagccgcctggagacgcacatgaaccgcgagacgctcttcctctccggcatcctcatcgtgctctgctcggtcgtggccacgctctcgggcgtgtggctgcgcacccaccagaccgacctggagctcgcgcagttcttccataagaaggactacctcaaggtcggcaaggagggcaacgagaactacaactactacggcatcgcggcgcagatcgtgttcaacttcctcatggcggtcatcgtgttccagatcatgatacccatctcgctctacatctccatggagctggtgaggctcgggcaggcatacttcatgatccgggacgccaagctctacgacgcgtcgtccgactcgaggttccagtgcagggcgctcaacatcaacgaggacctggggcaggtcaagtgcgtcttctccgataagaccggcacgctgacgcagaacaagatggagttcaggtgcgcaagcatcgacggcgtcgattacagcgacgtcgcacggcagcgacctgtcgagggtgagccggcttgggtgccaaaggtgccggtgaaggtcgacagacaagtgttggagctggtgaggaatgggggtgctacagagcaagcgatgaacgccggagagttctttcttgccctggcaacgtgcaacaccattgttcctttgatccttgatgatggccctgacctcaagaagaaggtgattgactaccaaggcgagtcgccggacgagcaggcattggtttctgccgccgccgcgtatggctttgtgctcgtcgagcgaagctccgggcacattgtcattgacgtccttggtcagaagcagaggtttgatgtccttggtcttcatgagtttgacagcgaccgcaagaggatgtcagttataattggctgcccggacaagactatcaagctgtttgtaaaaggtgcagatagttcaatgtttggaatcatcgacaaaacactgaatccagatgttgtccaggcaactgagaaacatctccattcatattcgtcagtcggcctgcgaacacttgtcatcggcgtgcgggaacttagccagtcagagtttcaggagtggcaaatggcttatgagaaggccagcactgcattattaggcagaggcaatctcctacgcagtgtggccgccaacattgagaggaacatgcgcctgttaggagcctccggtgttgaagacaagctgcaagatggagttccggaagcaattgaaaaactaagagaagcagggattaaggtttgggttctgacaggtgacaaacaagaaactgccatctccattggctattcctgcaagcttctgacaagggacatgacacagattataatcaatagtaattcaagagagtcgtgcaggaaaagtctggatgatgccatctccatggttaacaaacttcgatcactatccacagactctcaatctagagttcccctcgccttgatcattgacggtaacagtctggtctacatttttgacacagaccgggaggagaagctttttgaagttgccatagcatgcgatgtcgttctatgttgtcgagtggctcccctacagaaggctgggattgttgatttaataaagaagcgaacaagtgacatgactctagctattggagatggtgcaaatgatgtatccatgatccaaatggctgatgttggcattggcatcagtggtcaagaaggaaggcaagctgtgatggcctcagattttgccatggggcaatttagatttttggtcccattgttgttagttcatggccactggaactaccagagaatgagctacatgatcctatacaacttttacagaaatgctacttttgtctttgtgctcttctggtatgtactttacactggttataccctgtcaacagcaataaatgagtggagcagtgtgttatactctgtggtctatacctctgcaccgactgtcattgtcgccattctcgacaaggatctgagtcgaaggacattgctgaaatatccccaactctacggtgcggggcagcgcgaggagagttacaacctaagactattcattttcatcatggtagactcggtttggcagagcgttgcagttttcttcatcccttacctcgcatacaaaaacagcgcaatcgacagcgccagcctgggagacctgtggacattgtctgttgtcattcttgtcaacattcaccttgccatggatgtcatcagatggacttggatcactcatgcagcaatatggggcagtattgtggcgacatggatttgcgtcatcatcatagactccatacccaccttgcccggtttctgggcaatctatgaggtgatgggaactgcattgttttgggcattgcttcttgcggtgattgtggttggaatgattcctcattttgccgcaaaggccattagggaacatttcatgcccaatgacatccagattgcgagagagatggagaagtcgcaagattctggtgatgcttatcatccagaggtccagatgagtacatccactcgagcgtaggagtaggggatctttgttcattcgggtaggctagagttacacctttctctttctgaagaaattacaccttttccttggttctttttgttgtgtgtatataaagcaattctttcggcagtgagcatgcttcttgttgcttgctgccctgtcaactatccaaaggatagatttcttgtagccatgctgtccatccgcctgcattttttttgttaatttatatgaaaggaccgtacaggagttaactgtacatattcagggactgatttattttat

SEQ ID NO: 180 - DNA, 4348 bp, Hordeum vulgare
taacaagcttgtgggaggagggagctttatcaaatgccatcctaataataagaagaaattgaaccgtgaccttttttttttttttggagaaggaaattgaaccgtgacctgatcaaatttctgcttgcctttgatgacttgactaataactaatatcgattgcttgttagactttttttttatttctagactactccattagagagttgggtcatgagacaggagaggagcagcccccaaacccaaacaaacaagagaaacaaagcctagaggtctctccctccctcgctcatccaaacggtgcttttgtcctcaccaactcccctccgccagattttaagcgccacgagcaaaccatttcagcaagatcgcgtatcttttctctgcttgcttccgcttcgtctccctctcctctcctctcctcccctgaaataaaaattcctctgcagcagcagcagcagctcatcttcaatgcaacactcgccatagttactaccacgcatccacttcaacccaaccactgctctgttctgctctgcttccttccttcctcccctgtttgtttcttgaacccaaacccagctcaaaatcggaccttggcgagcgtccccatgggcggggattccaggctctcccactgacgcggctggtccggccggtcagcgcgcgccatggccgaggaccatggatcgtcgcggcacatgtcgtccatgtccatgtcgcacaaggagctgggagacgacgacgcgcgggtggtgcatgtgggcgacgcggaccgcaccaacgagcgcctcgagttcgccgggaacgccgtgcgcaccgccaagtactcgccgctcaccttcctgccgcggaacctgttcgagcagttccaccgcctcgcctacatctatttcctagtcatcgccgtgctcaaccagctcccccagctcgcggtcttcggccgcggggcctccgtcatgccgctcgccctggtcctcgcggtcaccgccgtcaaggacgcgtacgaggactggcgccgccaccgctccgaccgcgccgagaataaccgcctcgccgctgtcctgtctcccggtgccggcgcccaattcgtacccaccgagtggaagcacgtccgcgtcggagacgtcgtccgggtcggtgccaacgagtcgcccccagcggacatggtcctcctggccaccagcgacaccaccggcgtcgcctacgtgcagacgctcaaccttgacggcgagtccaacctaaagactcgctacgctaagcaagaaaccctcacgacgccgctcgagcatctcgccggcaccgtcgtcaggtgcgagcgcccgaaccgcaacatctacggcttccaggccaacctggagctccagggggagagccgccggataccactcggcccgtccaacatattgctgcgcggctgcgacctcaagaacacgtcctgggccgtgggcgtggtggtctacgcggggcgcgagaccaaggcgatgctgaacaacgcgggcacgccgaccaagcgcagccgcgtcgagacgcagatgaaccgcgagacgctcttcctctccggcatcctcatcgtgctctgctcggctgtggccacgctcacgggcgtctggctgcgcacccaccaggccgacctggagctcgcgcagttctttcataagaaggactacctgaaggtcggcaaggacggcaacgagaactacaactactacggcatcgcggcgcagatcgtgttcaacttcctcatggcggtgatcgtgttccagatcatgatacccatctcgctctacatctccatggagctggtgaggctcgggcaggcatacttcatgatccgggacgccaagctgtacgacgcgtcgaccgactcgaggttccagtgtagggctctcaacatcaacgaggacctggggcaggtcaagtgcgtcttctccgataagaccggcacgctgacgcagaacaagatggagttccggtgcgcaagcatcgatggcgtcgattacagcgacgtcgcacggcagcgacctgtcgagggcgagccggcttgggtgccaaaggtgccggtgaacgtcgacagagaagtgatggagctggtgaggaatgggggtgctacggagcaagggatgaacgccggagagttctttctcgccctggcaacgtgcaacaccattgttcctttgatcgttgatggccctgacccaaagaagaaggtgattgactaccaaggcgagtcgccggacgagcaggcattggtttctgccgccgcggcgtatggctttgtgctcgttgagcgaagctccgggcacattgtcattgatgtccttggtcagaagcagaggtttgatgtccttggtcttcatgagtttgacagcgatcgcaagaggatgtcagttataattggctgcccggacaagactgtcaagctgtttgtaaaaggcgcagatagttccatgtttggaatcatcgacaaaacactgaatccagatgttgtccaggcaactgagaaacacctccattcatattcgtcagtcggcctgcgaacgcttgtcatcggtgtgcgggaacttagccaggcagagtttcaggagtggcaaatggcttacgagaaggctagcactgcattattaggcagaggcaatctcctacgcagtgtggccgccaacattgaaaggaacatgcgcctgctgggagcctccggtgtcgaagacaagctgcaagatggggttcctgaagcaattgagaaactaagggaagcaggcattaaggtttgggtgctgacaggtgacaaacaagaaactgccatctccattggctattcctgcaagcttctgacaagggacatgacacagattgtaatcaatagtaattcaagagagtcatgcagaaaaagtctggatgatgccatctccatggttaacaaacttcggtcgctatcttcagactctcaatctagagttcccctcgctttgatcattgacggtaacagtctcgtctacatttttgacacagaccgggaggagaagctttttgaagtcgcgatagcgtgcgatgttgttctatgttgtcgagtggctcctctacagaaggctgggattgttgatttaataaagaagcgaacaagtgacatgactctagctattggagatggtgcaaatgatgtgtccatgatccaaatggccgatgttggcattggcatcagtggtcaagaaggaaggcaagctgtgatggcctcagattttgccatggggcagtttcgatttttggtcccactgttgttagttcatggccactggaactaccagagaatgagctacatgatcctatacaacttttacagaaatgctacttttgtctttgtgcttttctggtatgtactttacactggttataccctgtcaacagcaataaatgagtggagcagtgtgttatactctgtggtctatacctctgcgccgactgtcattgtcgccattctcgataaggatctgagtcgaaggacattgctgaaatatccccaactctacggtgcggggcagcgcgaggagagttacaatctaagattattcattttcatcatggtagactccgtttggcagagcgttgcagttttcttcatcccttacctcgcatacaaaaacagcgcaatcgacagcggtagcctgggagacctgtggacactgtctgttgtcattcttgtcaacattcaccttgccatggatgtcattagatggacttgggtcactcatgcagcaatatggggcagtattgtggcgacatggatttgcgttatcatcatagactccatacctaccttgcccggtttctgggcaatctataaggtgatgggaactgcattgttctgggcattgcttcttgcggtgattgtggttggaatgatgcctcatttcgctgcaaaggccatcagggaacatttcatgcccaatgacatccagattgcgagagagatggagaagtcgcaagattctcgtgatgtttatcatccagaagtccagatgagtacatccactcgagcgtaggagtaggggatatttgttcattcgagtaggctagagttacacctctctttctgaagaaattacaccttttccttggttctttttgttgtgtgtatataaagcaattcttttggcagtgagcatgcttcttgttgcttgctactctgtcaactatccaaaggatagatttcttgtagccatgccgtgcatccgcctgcatttttttttgttactttatacgaaaagaaccgtacaggagttaattgtacatattcaggaactgatttatattatgaacattctgaaactgatgatactgatttccttgagct

SEQ ID NO: 181 - DNA, 1929 bp, Panicum virgatum
gccatggggaagcaactctccatggcggcatccattctctgcatggccattgtcgccctggccgtcgtcggcgacggcgaggcagccgtcgtcgagcacacttttgttgtccatgagatgaacatgacccacctgtgcaacacgaccaaggtgtacgtggtgaacgggcagctccccgggccgcagctggacgtaaccgacggcgacacggtggtcgtccacctggtgaaccagctgccgcacggcgtcaccatccactggcacggcgtccggcagctgcgcagctgctgggccgacggcgccggctacgtcaccgagtgccccgtccctcccggcggcaaccgcacctaccgattcgacgtcgccggccaggtcggcacgctctggtggcacgcccacgtcacctgcctccgcgcctccatccatggcgccatcgtcgtccgccccaaggacggtcgctacccgttcccgacgccggccaaggacgtgcccatcgtcatcggcgagtggtggcagctcgacctcgtcgagctcgaccgccggaacctcgacggcaacttcgaggacgacccgctctccgccaccatcaacggcaagctcggcgacctcagcaactgctccggcgtgccagaagagagcttcgtgctcgacgtggagcgcggaaagagctacctgctgcggttcatcaacgccgcgctcttctccgagtacttcttcaaggtggccgggcacacgttcacggtggtcggcgccgacgccaactacctgacgccgttccggacggacatggtgaccatcgcccccggcgagaccatcgacgtgctcatgatcgccgatgcgccgccggggcactaccacatgaccgccgtcgccaaccagccgccgccgccggacctgcagatccgcgcgctcagcactcgcggcctcgtccgctacgccggcgtgcgcgccgacaacaacggcctgcccgtgccggctccgctcatgcccggccagtacgacaccttgccgtcatactacttccgcggcaacttcaccgggctcgccttcccggggcgccaccgcgtgccggcgcgcgtcgacgagcgcctcttcgtcacgctcgggctcggctccatctgccgcggcggcaagaaggactgcaagctccgccgcagcaatgagaccatcacggtggccaccatgaacaacgtctccttccaccaccagacggcggcgtcgctgctggagcgctactacgacggcgccggcgagggcgtgtacacggaggacttccccgacaacccgccgcggccgtacaactacaccgacatggacctgatcccagtcgggccgctggaggaggtgctcgagccgacgaccaaggcgatcaggctccggcgattcaagtacaactcgtcggtggagatcgtgttccagagcacggcgctgctgcagagcgaccccaacccgatgcacctccatggatacgacttcttcgtgctcgcgcaggggctcggcaacttcgatcccaagagggacgtcaagaagttcaactactacaacccccagctcaggaacactgtgcatgtgccaagggtaggctgggtagcaattcgcttcgtcacggataatccagggatgtggtacctgcactgccactttgagttccacatcgtcatgggcatggcgacggcgttcatcgtggaggatggcccgacgcctgagacgagcctgcccccgccgccgccggacttccagagatgcggcaccaatggtttcagtaagccttaagttctgattaagatgggtggggaacttttatttttatttattcaacgtaacgaataaagatgaaggcattaccatccttcatcgcattattggttgtaattcttattgcaagagatcgatgtaattttttttatatttacatgtgtatgtcagtgc

SEQ ID NO: 182 - DNA, 2370 bp, Panicum virgatum
atagctataggttgcgtgcaggctttgagtaacaagagtaaaagtcaggtgctaaattttctctccgtggcgttgatcttccccgtccatgtttcgtcttctccaatctggctggccaggtcaacagatgcaaacgccggttcagttcaggtgtttcatctccctattgtcagacaagtactagtacagcaaacagtgctggcgaccggccgggcgtgtatataaaggacacactgacagtctcatcacaagcacctaactaactccgatcctcacaaattcaaacaagtttaaccgagaggtgtgtttgccattttatagcaaaagtagaagcaccgcagttgttgttcatggctgccatggcggcccccgtcctctgcatggcccttgtcatcgccctcgccgccacggtggctcccgtcggcgaggcggcggtcgtcaagcacacctttgttgtgcacgagatgaacgtgacgcacctttgcaacacgaccaagatctacgtggtgaacgggcagttcccgggcccgacgctcgacgtcaccgacggcgacacggtggtcgtccgcgtcgtcaaccggctggaccacggcctgaccatccactggcacggcgtgcggcagctccggagctgctgggccgacggcgccggcttcgtcaccgagtgccccatccctcccggcggcaaccacacctaccgcttcaacctcactggccaggtcggcacgctctggtggcacgcccacgtcacctgcctccgcgccaccatcaacggcgccatcgtcgtccgccccaaggacggccggtacccgttcccgacccccgccggggacgtgcccgtgctcatcggcgagtggtggcagctcgacctcgtcgagctcgaccgccggatggccgacggcaacttcgacgacaacccgctgtcggccaccatcaacggcaagctcggcgacctcagcaactgctccggcgtgccggaggagagcttcgtgctcgacgtggagcgcggcaagagctacctcctgcggatcgtcaacacggcgctcttctccgagtactacttcaaggtggccgggcacaagttcacggtggtcggcgccgacgccaactacctgacgccgttcgagaccgacatggtcaccatcgcgccgggcgaggccatcgacttgctcatgaccgccgacgcgccgccggggcactaccacatgatcgcgctcgccaaccagccgccggagcccgacccgcagatccccctgttcgtctcccgcggcctcgtccgctacgccggcgtgcgcgccgacaacaacggcctccccgtgccggcgccgctcatgcccgaccagcacaacaccatgccgtcctactacttccacggcaacctcacggggctcgcctacccggggcgccaccgcgtgccggcgcacgtcgacgagcgcctcttcgtcacgctggggctcggctccctctgccgcggcggcgggaaggtgtgcaagcgccgccgcagcaacgagaccatcgtggtggccaccatgaacaacgtctccttccaccaccccaccaccacgtcgctgctggagcgctactacgacggcgccggcgagggcgtgtacacggaggacttcccggcgaacccgccgcacccgtacaactacaccaacagggacctgatcccgccggggccgctggaggaggcgctggagccgacggtcaaggcgaccaggctccggcggttccggtacaacacgtcggtggagatcgtgttccagagcacggcgctgctgcagagcgactccaacccgatgcacctccatggatacgacttcttcgtgctcgcgcaggggctcggcaacttcaaccccaagagggatgtcaagaagttcaactaccacaacccgcaactgaggaacaccgtgcaggttccccggaccggatgggccgcggtccgcttcgtcacagacaatccagggatgtggtacttgcattgccactttgagtttcacattgtaatgggcatggcgacggcattcatcgtcgaggatgggccgacaccggagacgagcctccctccaccgccaccggagttcaagagatgcggcgcaaatggtctcactcagccatagagtttttgaaacatcaataaagaaattgagtcaataaaaattattatataacaaataagacgggggtattggcattgtccgccgtattattgcccctcactagtcattcttgtgaacttctcagagatgtaatttttttcatttagtatttaaattgcatgcagaaattaatgagtgtaactctgtcctatataattggaattatgagggatatatatacatgaaagtaagaatttgtttcatcatcttg

SEQ ID NO: 183 - DNA, 1590 bp, Triticum aestivum
tcaacgtcgaccgagcaactacacccagctgcaaggtgcaagcaagctagctagctcgacagttagcaatggaggttaaggtgttgggctccaagctcgtcaagcccgcctacaatgccggcgccgcgccggcaccttccaccgagtacatccctctgtccatcttcgacaaggtgacgttcaacatgcagatggccatcatctacgccttcgccgcgccggcgccatccacggccgccatcgagaatggcctcgccacggtcctcgcccagtaccgagccttcgcgggccagctcggcgaggcgcccgacggcacgccgtccttcatcctcaacgaccgtggcgcgcgcctggttgaggcaaccgtagacgccgagctcatcgacatggcgccagcgaaacccacgccggagctgctcaagctgcaccccgacctggaggcggagcacgaggaggttgtgctgctgcagctcacgcggttccggtgcggctccctcgccgtggggttcacgtccaaccacgtcgtcgccgacggccacgccaccagcaacttcctcatcgcctgggggcgcgccacgagaggcctccccatcggcctccctcccgtgcaccaccacaaggacctcttcaagccacggtcgtcgcctcgcgtggagcacgaccaccgcaacagggagtactacctgccgtcgcccaccgacgtcgtcggtcaccacggcgatgccgccgacaacatcgtcatccataaggcgcacttctccaaggacttcatcgccggtctccgagccaaggcgtcagaagggcgcggccggccgttcagccggttcgagaccatcctcgcccacctctggcgcaccatgacacgcgcgcgcgacctgagccccgaggagaccaccaagatccggctgtccgtggacgggcgacaccggctcggccagccggcggagtacttcggcaacatggtgctttgggctttcccgcgctccaccgtgggtgacctcctgaaccggccgctgaagcacgcggctcaggtgatccatgacgaggtggcgaaggtggatggtgcatacttccagtcgttcgtagacttcgcaagctccggcgccgccgagaaggaggggctggctcggagcgccgtgtgcaaggacgcgcagtgcccggacgtggaggtggatagctggttgacgttcccgttctacgagctggacttcggcacggggagcccaagctacttcatgccggcctacttccccacggaggggatgcttttcctcgtgccgtccaacttcggcgacggcagcgtcgatgccttcgtacccctattccaagagaacctccaggcgttcaaagaatgctgctattccatggagtaggtggcctaactgttaatttgtcgaagaaacagtgaggcatacattagttcattcattgagagggtggcagaaaaaaataatgtcttttctttttctctttgagaattgaatagtgctactgtgtgtacacagatgttatcttgtacaagtacgtaacatgagttttcagattaaaaatttactagcgaaaagacccgtatgttgtaaccggaaaaaa

SEQ ID NO: 184 - DNA, 1643 bp, Secale cereale
cacgcaacaaggactcgatcgacatcgaagctcgagctaaccttggcaacttgcagcaatatctctctctctctttctttctctctcgccgatcaaacttgatcaacgtcgaccgagcaactacacccagctgcaaagtgcacgcaagcaaagctagctcgacagttagcaatggaggttaaggtgttgggctccaggctcgtcaagcccgcccgcaatgccggccccgcgccggcgccatccaccgagtacatccctctgtccgtcttcgacaaggtgacgttcaacatgcagatggccatcatctacgccttcgccgcgccggcgccaaccacggcggccatcgagaacggcctcgccacggtcctcgcccagtaccgcgccttcgccggccagctcggcgagggacccgacggcacgccgtccttcgtcctcaacgaccgtggcgcgcgcctggttgaggccaccgtggacgctgacctcatcgacatggcgccctcgaagcccacgccggagctcctcaagctgcaccccgacctggagggagagcacgaggaagttgtgctcctgcagctcacgcggttccggtgcggctcgctcgccgtcgggttcacgtccaaccacgtcgtcgccgacggccacgccaccagcaacttcctcgtcgcctgggggcgcgccacgagaggcctccccatcggcctccctcccgtgcaccaccacaaggacctcttcaagccacggtcgccacctcgcgtggagcacgaccaccgtaaccgggagtactacctgccgtcgcccaccgacgtggtcggtcaccacggcgatgccgccgacaacatcgtcatccacaaggcgcacttctccaaagacttcatcgccggtctccgcgccaaggcgtccgaagggcgcggccgcccgttcagccggttcgagacaatcttagcccacctgtggcgcaccatgacgcgcgcgcgcgacctgagccccgaggaaacctccaagatccggctgtccgtggacgggcggcaccggctgggccagccggcggagtacttcggcaacatggtcctgtgggcgttcccgcgctccacggtgggtgaccttctgaaccggccgctgaagcacgcggctcaggtgatccatgacgaggtggcgaaggtggacggcgcatacttccagtcgttcgtagacttcgcaagctccggcgccgccgagaaggaggggctggctcggagcgccgtgtgcaaggacgcgcagtgcccagacgtggaggtggatagctggctgacgttcccgttctacgagctggacttcggcacggggagcccaagctacttcatgccggcctacttccccacggaggggatgctcttcctggcgccgtccaacttcggcgacggcagcgtcgatgccttcgtacccctattccaagagaacctccaggcgttcaaagaatgctgctattccatggagtaggtgggccaactgttaatttgtcgaaaaaacagtgaggcatacattagttcattcgttgagagggttgcagaaaaaataatgtcttttctttttctctttgagaattgaatagtgctaccgggtgtacacagatgttatctacccctaatcttttttaataataataa

SEQ ID NO: 185 - DNA, 1429 bp, Secale cereale
gctcgctcctctcgtccgtactgcaaggtgacgttcaacatgcagatggccatcatctacgccttcgccgcgccggcgccaaccacggcggccatcgagaacggcctcgccacggtcctcgcccagtaccgcgccttcgcgggccagctcggtgaggcgcccgacggcacgccgtccttcgtcctcaacgaccgtggcgcgcgcctggttgaggcgaccgtggacgccgacctcatcgacatggcgccctcgaagcccacgccggagctcctcaagctgcaccccgacctggagggagagcacgaggaggttgtgctcctgcagctcacgcggttccggtgcggctcgctcgccgtcgggttcacgtccaaccacgtcgtcgccgacggccacgccaccagcaacttcctcgtcgcctgggggcgcgccacgagaggcctccccatcggcctccctcccgtgcaccaccacaaggacctcttcaagccacggtcgccacctcgcgtggagcacgaccaccgtaaccgggagtactaccttccgtcgcccaccgacgtggttggtcaccacggcgatgccgccgacaacatcgtcatccacaaggcgcacttctccaaggacttcatcgccggtctccgcgccaaggcgtccgaagggcgcggccggccgtttagccggttcgaaaccatcctcgctcacctgtggcgcaccatgacgcgcgcgagagacctcagccccgaggaaacctccaagatccggctgtccgtggacgggcggcaccggctgggccagccggcggagtacttcggcaacatggtgctttgggcgttcccgcgctccacggtgggtgacctcctgaaccggccgctgaagcacgcggctcaggtgatccatgacgaggtggcgaaggttgacggtgcatacttccagtcgttcgtagacttcgcaagctccggcgccgccgagaaggaggggctcgcgcggagcgccgtgtgcaaggacgcgcagtgcccggacgtggaggtggatagctggctgacgttcccgttctacgagctggacttcggcacggggagcccgagctacttcatgccggcctacttccccacggaggggatgcttttcctggcgccgtccaacttcggcgacggcagcgtcgatgccttcgtacccctattccaagagaacctccaggcgttcaaagaatgctgctattccatggagtaggtggccaactgttaatttatcgaaaaaacagtgaggcatacattagttcattcattcagagggtggcagaaaaaataatgtattttccatttctctttgagaattgaatagtgctactgtgtgtacagatgttatctacccctaatcttttcttaataataataaagcggctatcatttctatcgacttaaaaaaaaaaaaa

SEQ ID NO: 186 - DNA, 1897 bp, Setaria italica
acagcccaaaggcaccaagcaagcaacaaggactcgagcgagcagcacgaggtttcgagcaaaggaaagccgcgtacgtcgtcgtacagcaaagcccttgctcagttgctctctcttgttgcgaacgagcatttgcttgcgccaaacggccaaagcttaatctgtccgcgaaagaacgatcgcaccagctagccagagctagcaggcaagcagctcgatcgtcggcagcaatggaggtgaaggtgctgagctccaagctcgtgaggcccgcctacaatgccggcgcggccccgccggcggggggcgagtacatcccactgtccgtcttcgaccgggtgacgtacaagatgcagatggccatcatctacgccttcccgccgccggcaccgtcgacggcggcgatcgagaagggcctcgccacggtgctgtccgagtaccgcgccttcgcggggcagctgggctcggcccccgacggcacccccgcggtgctcctcaacgaccgcggcgcgcgcttcgtggaggcggccgtggacgccgacctcgtggacatggcgcccgccaagcccaccccggagctcctgcgcctgcacccggacctggagggcgaggagctccaggaggtggtgctcctccagctcacccggttccgctgcggctccctcgccgtcggcttcacctccaaccacgtcgccgccgacggccacgccaccagcaacttcctcgtcgcgtggggccgcgccaccagggggctccccacgggcccgtcccccgtgtaccaccaggcggggctcttcaagccccgcgcctcgccgcgcgtcgagcacgaccaccgccgcagggagtaccgccccgccggcggcgagccggaccacggccacggcgagggcgccgagaacatcgtcatccacaaggcgcacttcaccaaggacttcatcgcgtcgctccggggcagggcgtcggagggccgcggccgcccgttcagccggttcgagaccatcctcgcccacctgtggcgcaccatgacgcgcgcccgcggcctgaaccccgacgagacctcgcagatccggctgtccgtggatgggcgccaccggctgggcctccccgccgagtacttcggcaacctggtcctgtgggcgttcccgacggcgacggtggcggacctcctgggccggccgctgaagcacgcggcgcaggtgatccacgacgaggtggcccgcgtggacggcgcatacttccggtcgttcatcgacttcgcgagctccggcgccgtcgagagggaaggcctgatgccgagcgccgtgtgcaaggacgtgctgtgcccggacgtggaggtggacagctggctgacgttcccgttctacgagctagacttcgggacggggagcccgacctacttcatgccgtcctacttccccacggaggggatgctgttcctcgtgccgtcctacatcggcgacggcagcgtcgacgccttcgtccccgtcttccagcacaacctcgaggcgttcaaggagtgctgctacgccatggagtaggaggggattgcagcatgcatgcatgcgacaaattggtcaagagaaaaaaaaacgttagtggttagtaagttccagcgctgcatgcggttggtggaagtcaagtctgcgggggtcgacgattatttgcattggtttggttgcggcgcacgctaaggcgtcgctggttgcaccgtgcgtacgtgaagaggatggagctagtagtcgtggtcgaggtttttttttttgaggcgcttcacttgcatctcgatcggtcggatcagggggcatcttgtttgtttcatcgagttttggagatgtaaattggtggtgatttaattaatgatgctaatggaaattaataatattgatggttcttaataaaa

SEQ ID NO: 187 - DNA, 1426 bp, Aegilops tauschii
gtggcatagtcctcactagttaagtcactaagcaacccctggaggtaactaattaatgggttctatctccgacgacgaggcggcttgcatctacgcgatgcagctggcagcggcagctgtcttgccgatgacgctcaagaacgccatcgagctgggcatgatcgagatcctcgttggcgctggcgggaagatgctttcgccgtctgaggtggccgcccagctgccgtcgacggccaacgcggaagcaccggccatcgtcgaccgcatgctgcggctgctggcatcgcacaacgttgtgtcgtgcgaggtggaggaaggtaaggacggccgcctcgcacgccggtacggcaccgcgccggtgtgcaagtggctcagccccgacgaggacggcgtgtccttggccccgatggtcctcttgaacgacaaggtcatgctggagagctggtaccatttgaaggacactgtccttaacggtggcctgccattcgaaaaagcgtacggaatgacagcgtttgattaccaaggaacggacccgcgctttaatcgcgtcttcaatgaggccatgaagacccactccatgatcatcaccaagaagctcctggagttctacaagggcttcgatggtgtgggcaccctcgtggacgtcggtggcggtgtgggcgccaccatccacaccatcctttgcaggtacccaagcatcgagggggtcaacttcgacctccctcacgtcatctccgaggcaccatcctttgcaggtgtgcaccacataggtggtgacatgttcaagaaggttccctctggggacgcaatcctcatgaagtggatactccacgactggaacgatgagcattgcacgacgctgctgagcaactgctacgatgcactacccgcgcatggcaaggtggtcatagtggaatacatcctgccagtgaagcccgacgaaacggccacagcacagaggtccttcgaagccgacatgattatgctcacacacacacccggcggcaaggagaggtacctgagggagtacgaagagctcgccaggagcgccgggtttgccagcgtcaaggccacctacgtctacagcaacatatgggtcattgagttgaacaaatagaacctgcatgtgtgctagtatgtggagtttccactgctcccttaaatttctcttactctgaatcagcaatatacataataaaggattggctacaagaaaagttgtctcaagagctgtaatttctaaatcaacaaaattacttcttttttgcgatggtcaacaaaattacattgtcaagcctagtttgtgtagctttggggcttaaacgtgcaagtgactagttgcatcgtgaccttgttttatacatgtatggaatgcatatgaatgtaatagattgatatgaatgtgtatagatatttattgctgcgt

SEQ ID NO: 188 - DNA, 1469 bp, Hordeum vulgare
gctctctctcagaagctaccacacacacacgcgcgcgcgcacgcacgcacgctctctctgaagggccgaaggctacctgcccgtgcctcctgtgtgcgccgtctcccccgagctcggcgttcgaacgagaccgggagcttgcgggcttcgcgcacgttgcacacgagcttagcttggttctccggccggccgggtttgcttctttggccgcgcgccgcgcgccgagagtgacatgacgacgagccaggacgtggttgtttcggagatgggcattggggcgggcggggccgccatgccgggctccggcggcgcgggcctcttcgcgtgccgcagcgccgccagcgccggggccatgtccatgcggcagacgtacctcgacctcgccgccgcagccgcgcgctccgccaactgcacgtgggccgagctcgaggtcatgcgcgctgcctcgcccacccgctcccgccccggcgccgacgtcgacgatctcacggcctggatgaggaagcacccgtcggcactagccaagttcgagcaaatcgccagcgcgtccaagggcaagaagatcgtcatgttcttggactacgacggcaccctctcccccatcgtcgccaaccccgacgccgcctacatgagcgacgcgatgagggaggcggtgcgcgacgttgccaagcacttcccgacggcgatcgtgagcgggcggtgccgcgagaaggtgcacaacttcgtcggcctctccgagctgtactacgccggcagccacggcatggacatcaaggggccaagctccaatcctgagtctgtcgtgtgccaacctgcaagagagttcctccccgtgatcgaggaggtgtacaaggtgctcgtggaaaagacgaagtccacacctggagccaaggtggagaacaacaagttctgcctgtccgtccacttcagatgtgtggatgaaaagagatggaacttcttggctgagcaagtcaaggccgtgatgaaggactaccccatgctgaagctcactcaagggaggaaggtcttcgagctccggcccagcattatgtgggacaagggcaaggctctggagttcctgcttgaatcgctaggattcgccagctgcagcgacgtcctgccggtgtacatcggcgacgaccgcaccgacgaggacgccttcaaggtgctgcggaagaggggccaaggcgtgggcatcctggtgtccaagtccgccaaggagaccagcgcgtcctactcgctgcaggacccggcggaggtcatggagttcctgctccggctcgtggagtggaagcggaggtcggcgacgccgcccatggtcaggccgcgggtgtaaccacacccccgccggcaccccaccagctatagcctagtcgtagtagcacagatccaagacgccggtcgggtcgaccaccggtcaatcaaagctcgtcgccatccgtgtcccgtcgtgccaacaccacgtaccc

SEQ ID NO: 189 - DNA, 1173 bp, Secale cereale
gcgccgtctcgccggagcttggcgttggagcgagaccaggagcttgcgggcttcgtggtacgttgcacgagctagctgctggctggtttgacatgacgacgagccaggacgtggttgtttcggagatgggcattggggcgggcggggcggccatgccgggctccggcgccgctggcctctacgcgtgccgcagcgcggccagcgccggggccatgtccatgcgccagacgtacctcgacttcgccgccgcggccgcgcgctccgcgagctgcacctgggtcgagctcgaggccatgcgcgcctcctcgcccccgcgctcccgcgccggcgccgacgtcgacgagctcacggcctggatgaggaagcacccgtcggcgctaggcaagttcgagcaaatcgccagcgcgtccaaggggaagaagatcgtcatgttcttggactacgacggcaccctctcgcccatcgtcgccaaccccgacgccgcctacatgagcgacgcgatgagggaggcggtgcgcgacgttgccaagcacttcccgacggcgatcgtgagcgggcggtgccgcgacaaggtgcacaacttcgtcggcctctccgagctgtactacgccggcagccacggcatggacatcaagggaccaggctccaatccagagtctgtcctgtgccagcctgcaagcgagttcctccccatgatcgatgaggtgtacaaggtgcttgtggaaaagacgaagtccacaccaggagccaaggtggagaacaacaagttctgcctgtccgtccatttcagatgtgtggatgaaaagagatggaatttcctggctgagcaagtcaaggccgtgatcaaggactaccccatgctgaagctcacccaagggaggaaggtcttcgagctccggcccagcatcatgtgggacaagggcaaggctctggagttcttgctcgagtcgctaggattcgccagctgcagcgacgtcctgccggtgtacatcggcgacgaccgcaccgacgaggacgccttcaaggtgctgcggaagaggggccagggcgtggggatcctggtgtccaagtgcgccaaggagacgagtgcgtcctactcgctgcaggacccggcggacggtccagtcggaagttcccgcggcctccgggctcggtggagtggaacgcggagtc

SEQ ID NO: 190 - DNA, 2090 bp, Aegilops tauschii
ggctgcgcatgtgaggaaagcacgaaaaccgccgtggactcggcgcacaggcatggagaagagaacgatcgtcgggcgggcggcgccacacgtaggctccgcatgggatcccacgggcaggccccacgtgcccctaccgcgcccgccgctcgagctataagtacccgcgcttatcccactccggttccacccaccttaagctctgagaagctaccacacacacacgcgcacacccacaccgcgcacgaacgcacgcgcgcgcgcactccctgaaggccagctgcctgtgcctgtgcgccgtctcgccggagcttggcgttggaacgagaccgggagcttgcgggcttcgcgcacgttgcacgagctctcagctggttctccggccgggcttgcttgtttggccgtgcgccgcgcgccgagtgacatgacgacgagccaggacgtggttgtttcggagatgagcattggggcgggcggggcggccatgccgggctccggtgccgcgggcctcttcgcgtgccgcagcgccgccagcgccggggccatgtccatgcggcagacgtaccgcgacctcgccgccgccgccgcgcgctccgcgaactgcacatgggccgagctcgaggccatgcgcgccgcctcgcccacccgctcccgccccggcgccgacgtcgacgagctcacggcctggatgaggaagcacccgtcggcgctaagcaagttcgagcaaatcgccagcgcgtctaaggggaagaagatcgtcatgttcctggactacgacggcaccctctcgcccatcgtcgccaaccccgacgccgcctacatgagcgacgcgatgagggaggcggtgcgcgacgttgcgaagcacttcccgacagcgatcgtgagcgggcggtgccgcgacaaggtgcacaacttcgtcggcctctccgagctgtactacgccggcagccacggcatggacatcaagggaccaggctccaatcccgagtctgtgctgtgccagcccgcaagcgagttcctccccatgatcgacgaggtgtacaaggtgcttgtggaaaagacgaagtccacacctggagccaaggtggagaacaacaagttctgcctgtccgtccacttcagatgtgtggatgaaaagagatggaacttcttggctgagcaggtcaaggccgtgatcaaggactttcccatgctgaagctcacccaagggaggaaggtcttcgagctccggcccagcattatgtgggacaagggcaaggcgctggagttcctgcttgaatcgctaggattcgccagctgcagcgacgtcctgccggtgtacatcggcgacgaccgcaccgacgaggacgccttcaaggtgctgcggaagaggggccagggcgtggggatcctggtgtccaagtgcgccaaggagaccagcgcgtcctactcgctgcaggacccggcggaggtcatggagttcctgctccggctcgtggagtggaagcggaggtcgtcgacggcggcgccgccccagggccgtccggcggaggtcatggagttcctgctccggctcgtggagtggaagcggaggtcgtcgacggcggcgccgcccatggtccggccgcgggtgtaaccccggccggcggcccaccagctagcctagcagcagcacagatccaagacgccggtcgggtcggtcgaccaccggtcaatccagctcgtcgcgatcggtgtcccgtcgtgccaacactaccccacccccaccccaccccaccccgcccaagttttctctgatggttctgtggtagcaatgtactgctgctgctggtctactagtactctactactccactactcccttgttgttttttgtcccacgggctgggaaggcacatgcaaagctacctgccgctcccaaacccggcctgccggccttgacgagaaagaaggttcttcgttattattcacccatgtaactagctaggatcgccctctgttcagtgttcaattgtctctgtaaaatgcagtaatggaatcagttaacagtgattatttcgtactacatcatgtgcatgcatgggtgtcagctagcttgtctaatccgtcgc

SEQ ID NO: 191 - DNA, 1785 bp, Brachypodium distachyon
cccacctccagctctctctcagaagaagaacctaccacaccctctctccccaagtctagcactgcagcacttcgccgtgccgtccaagcgcttgctttggaacgaggcgcagggctttcctgggggtgcttcttggccttgcacgagcttagtttcctgtgggtttagcctgtgacatgacgagccaggacgtggttgtccctgagatgggcattggggccggggccgcgatgccgggctcgggcggcacggcagggctcttcgcgtgccgcagcgccgccgcgggcgtcatgtccatgcggcagacttaccacctcgccgcggcgcgctccgcccccgcgagctgcacctggctcgaggccatgcgcgcctgctccccgccacgctcccgcggcggcgccggcgccgacgtcgacgagctctcggcctggatgaggaagcacccgtcggcgctgggcaagttcgagcagatcgcgggcgcgtgcaaggggaagaaggtcgtcatgttcctcgactacgacggcacgctctcgcccatcgtcgccaaccccgacgccgcctacataaccgacgcgatgagggcggcggtgcgcgacgtggccaagcacttcccgacggcgatcgtcagcggccggtgccgcgacaaggtgcacaacttcgtcggcctctccgagctctactacgccggcagccacggcatggacatcaagggaccgacctccagtcccgagtcggtcctgtgccaacctgcaagcgagttcctccccatgatcgaggaggtgtacaaggtgctggtggaaaagacgaaatccacacctggagccatggtggagaacaacaagttctgcctgtccgtccacttcagatgtgttgatgaaaagagatggaatttcttggccgagcaagtcaaggccgtgatcaaggactaccccatgctgaagctcacgcaaggcagaaaggttttcgagctccggcccagcattatgtgggacaagggcaaggctctggagttcctgctcgaatcgctaggtttcgccgactgcagcgacgtcctgccggtgtacatcggcgacgaccgcaccgacgaggacgccttcaaggtgttgaggaagaggggccaaggcgtggggatcctggtgtccaagtgccccaaggagacgagcgcctcttactcgctccaggacccaacagaggtcatggagttcctgctccggctcgtggagtggaaccggaagtcttcttcttcgccagccatgctccggccaagagtactgtaataaccccaagaacgcgccaccggccagtctaatcaccggtcaatctaaatgctcggcgtccaatcatcatacataccccaccaccaaatttgtttcttctttggttctctggcggccggcctcccgatcggaacggaagtaatcacggaggaaaattaaaggaggccaggcacagaaaccatcccgggaactgctcaagctgcagcctgattaagcgtgtgcagcaaaatgtacttaccactagtctactgctactacgacgtacgtacggctaccccccctttgttgttttttgtcccgtgggctgggaaggcatatgcaaagctacctgccgtcctgtagagcctcgacgagaaagaaggttcgctcaattattcgccaccactgcatgtaactagctagcttaggatcgatgatctatcactgtcccctccttcctcccctgtactgtgcctgctcactgtaaaatgcagtaacggaattaatgttgatcatttcgtgtatcccc

SEQ ID NO: 192 - DNA, 2187 bp, Panicum virgatum
gtggatgcagtcttatgcttatgcacatgttgagagctcctttcccctttgccccttgcatgctacaaaacaaaacaatacggctggggggagcagggccagcatgcaccaaagccgctgcgggcggcggcccggcctaccagctaagcagcacggcgaccaccgtggcccccgcacgccggctccactcgggatcccacgtggcaggcccctacgggcccacccctccgagctataagtacccgcactactctccacacttcgcatccacccatctcaagctctcacaactcacaggtcagaagcaaagcccgcacgctccccccaagtcctgaggcaggctagctagctgtgctcctcccgtccgagtgcctggcgttgggggaaggaaggtgaggcctcgccgtcttcgcggcgcacgagcctgcacctgggccgttggtgaggcgaagcacatgacgaaccaggacgtggtcgtgtcggagatgggcattgcggccggggcggcgctgccgggcccgagcccggcgctcttggcttgccggggcgcggccgccggcgccatgtcccttcggtacctcgacctggccgcggccgccgcgcgctcggccagctgcacctgggccgacgccatgcgcgcctcgtcccccacccgctcccgcgccgccggcgatgtcgacgagttcacggcctggatgaggaagcacccgtcggcgctcggcaagttcgaccagattgccagcgcgtccaaggggaagaagatcgtcatgttcctggactacgacggcacgctctcccccatcgtcgccgaccccgacgaggcctacatgagcgacgcgatgagggcggcggtgcgcgacgtcgcgaagcacttcccgacggcgatcgtgagcgggcgctgccgcgacaaggtgcgcaacttcgtcggcctctcggagctctactacgccggcagccatggcatggacatcaagggaccaagctccaatccggagtcggtcctgtgccaacctgcaagcgagttcctccccgtgatcgacgaggtgtacaaggcgctggtggaaaagacgaagtccacacctggagccaaggtggagaacaacaagttctgcctgtccgtgcacttcagatgtgtagatgaaaagagatggaatgctttggcggagcaagtcaaggccgtcatcaaggactaccccaagctgaagctcactcaagggaggaaggttctggagatccgcccgagcatcatgtgggacaagggcaaggccttggagtttctgctcgaatcgctcggattcgccagctgcagcgacgtcctcccggtgtatatcggtgacgaccgcaccgacgaggatgctttcaaggtgctgaggaagaggggtcagggcatcggcatcctcgtctccaagtgccccaaggagaccaacgcctcctactccctgcaggacccgagcgaggtcatggacttcttgctccggctggtggagtggaagcgcaagtcgccgccgccgccgatgatccggccgcgagtgtagctggctggctcggtgcggcagccggttggcggaccgatcgaatcggtgtccaatcatgcgaacataccccaccaccaatgttccccctctctgacgattcttagcttgtgtggtggcctctgaaacggactcgtggtggttgctgcgttacacgcgtgttcttcgattccctggcggggccacacacacacaactcctcctcgtcactgaaaatgttggagcatgttggtgctgctgtctaatacagtaaccgtgtgtctgcttccccggcaatgtaccactagtagtacccctcccttctcgtgttatttttgtccctcgtctcatccccatgggcttggaaggcatctgcaaagctccctgccgtcctagaagagaagaacctttgcaagaaagagaaggttcccttcaccccatgtaactagcacctactatattctaggcactactgttctttgtacccttctctgctgtgtaaaatgtagtctgtaataaaagtaattaagatccaagtaatggaattattttgcatttctctcgtacaacgatccaggatgcgtgctgtgccgtgcgacttgtttgttctttttgatgatcgcatgacgataaaagttatatgcactgatgcaagcgtgaggtgcggaaaaaggag

SEQ ID NO: 193 - DNA, 1910 bp, Sorghum bicolor
tcctcccacttcgcatccatccacccacccatctcaagcccgcacactcccccaggtcccctaacgctgcgttcgtcccgcccccaagtgcttcgtgttggggggacgagacgatcgagaaagtcgccggctttgcctcccacgagtccgtcgaacctgctgctgcctgggccgctggtgaagcggaagcacacatgacgaaccaggacgtggtcgtgtcggagatgggcattgcggccggggccgcgctgccgggcgcgagcccggccctcctggcctgccggggcgcggccgccggcgccatgtccctgcggtacctcgacctggccgcggcggccgcgcgctcggccagctgcacctgggtcgacgccatgcgcgcctcctcgcccacccgctcccgcgccgccgccgacgtcgacgagttcacggcatggatgaggaagcacccgtcggcgctcgccaagttcgagcagatcgccagcgcgtccaaggggaagaaggtcgtcatgttcctagactacgacggcacgctctcccccatcgtcgccgaccccgacgccgcgtacatgagcgacgcgatgagagcggcggtgcgcgacgtcgcgaagcacttcccgacggcgatcgtgagcgggcgctgccgcgacaaggtgcgcaacttcgtcgacctctcggagctctactacgccggcagccatggcatggacatcaagggaccaagctccaatcccgagtcagttttatgccaacctgcaagcgagttcctccccgtgatcgacgaggtgtacaaggcgctggtggaaaagacgaagtccacgcctggcgccaaggtggagaacaacaagttctgcttgtccgtgcacttcagatgtgttgatgaaaagagatggaatgctttggcagagcaagtcaaggcagtgatcaaggactaccccaagctgaagctcactcaagggaggaaggttctggagatccgtccgagcattatgtgggacaagggcaaggccttggagttcctgctcgaatcgctcggattcgccaactgcagcgacgtcctcccggtgtacatcggtgacgaccgcaccgacgaggatgctttcaaggtgctgaggaagagggggcaaggcatcgggatccttgtgtccaagtgccccaaggagacgaacgcctcctactccctgcaggaccccggcgaggtgatggacttcctgctccgtctggcggaatggaagcggaaatcctcggcgccaccgatgattcggccgcgggtgtagctcagctcaggactcagcagccgggcgatcgactactagtcaatcgatcgaatcggtgtccaatcatgcgaacataccccaccaccaccaaatttttttctcttctcctgtctctccccgtccctccctccctctctctctctctcagctcgctctgacgattcttcgcttgtggtggcctctgaaaccgactcgtggtggttgctgcattacatgttcttcgattccctgaccactgtgtgctgcgccaccgaggaaaaagaggccacacacaaagcacaacgtcactgaaaaaatgttttgagcatgttggcgctactgtcgaatacagtaaccgtgtctactccaaggcaatgtactacctccacattctcgtgttatttttgtccctcgtcgtcgtccccccatgggtctggaaggcatctctgcaaagctacctgccgtcctagaagtagaagaacctttgaaagaaacagagaaggttcatcacttcaccccatgtaactagctagtagctactgttcgtacgtacgtaccctctgtaaaatgtagtgaatgaaagtaagatccaagtaatgcatgaattatatattctctgcaaattattgtttcgtacgtacctcgatcgatcctaca

SEQ ID NO: 194 - DNA, 1896 bp, Setaria italica
caagctctcacaagcaaagcccgcacactccccaagtcctcaggcaggcgaggctagctaggtgtctgtgtgttcgtcccgtcccagtgcttggcgttgggacgagacggtcgaggaggtctcgccggcttcgcgtcgcacgagtctgccgccgccttggccgctggtgaagcgaggcgcatgacgaaccaggacgtggtcgtgtcggagatgggcattgcggccggggcggcgctgccgggcccgaggccggcgctcctggcctgccggggtgcggccgccggcgccatgtcccaccggtacctcgacctggccgcggccgccgcgcgttcggcaagctgcacctgggccgacgccatgcgcgcctcgtccccgacccgctcccgcgccgccgccgatgtcgacgagttcaccgcctggatgaggaagcacccgtcggcgctcggcaagttcgagcagattgccagctcatccaaggggaagaagatcgtcatgttcctggactacgacggcacgctctcccccatcgtcgccgaccccgacgccgcctacatgagcgacgcgatgaggtcggcggtgcgcgacgtcgccaagtacttcccgacggcgatcgtcagcgggcgctgccgcgacaaggtgcggaatttcgtcggcctctcggagctctactacgccggcagccatggcatggacatcaagggaccaagctccaatcccgagtcggtcctgtgccaacctgcaagcgagttcctccccgtgatcgacgaggtgtacaagttgctggtggaaaagacgaagtccacacctggagccaaggtggagaacaacaagttctgcctgtccgtgcacttcagatgtgtagatgaaaagagatggaatgctttggccgagcaagtcaaggccgtgatcaaggactaccccaagctgaagctcactcaagggaggaaggttctggagatccgtccgagcatcatgtgggacaagggcaaggccttggagtttctgctcgaatcgctcggattcgccaactgcagcgacgtcctcccggtgtacatcggtgacgaccgcaccgacgaggacgctttcaaggtgctgaggaagaggggtcaaggcctcggcatcctcgtctccaagtgtcccaaggagacgaacgcctcctactccctgcaggacccgggcgaggtcatggacttcctgctccggctggtggagtggaagcgcaagtcatcgccgccgccgccgccgccgataatgatccggccgcgggtgtagctatctcagcagcagccggtcggtcggcggcgggtcgactagtcaatcgatggaccgatcgaatcggtgtccaatcatgcgaacataccccaccaccaccaaattccgctccccccccctccctctctctaacgattcttagcccttgttgtggcctccgaaacggactcgtggtggttgctgcattacacgcatgttatgttcttcgattccctggccgggggcccccgtgctgcggccgcgccaccgaggaaaaagaggccacacacacaacaacacaaactccctccgccgcctgtgcatgctcccgtcactggaaaatgccggagcatgttgtggtggtgccactgtctaatacagtaaccatgtctactccgattccccggcaatgtaccactagtagtaccccctccccgtgttatttttgtctcccgtcgcctccccatgggtttggaaggcatctgcgaagctacctgccgtcctagaagagaagaacctttgcaagaaagagaaggttcccttcaccccatgtaactagtagctttatatatatattattcttctacctaggcactgttgttctttgtaccatctgtgtaaaatgtagtaaaagtaagatccaag

SEQ ID NO: 195 - DNA, 2442 bp, Zea mays
tatgtattagccgtagtgtttcttgacactatgttcatgcacatgtagacctacacctaccttcgcccatgcccagttgccgttgcatgctacgaaacaaatcaattcggcgagggaggcgggccatcatgcaccaatgcggctgcggcctactaagcagcccggcgaccacccccggcccagacgtcggctccactcgggatactacgtggcaggccctctgggcccacccccgagctataagtacgccgcactcctactactcccaactcgcatcgcatccgcccacatctcaagccctgagaagcccgcacactcccccaggtccctgaggctaactgcgttcgtcccgtccaagtgcttcgtgttgggacgatcgagaaagtcgccgggtttgcctcccacgagcctgccctgctgcctggggccgctggtgaagcggaagcacatgacgaaccaggacgtggtcgtgtcggagatgggcattgcggccgggaccgcgctgccgggctcgagcccggccctcctggcctgccggggcgcggcggccggcgccatgtccctgcggtacctcgacctggcagcggcggcggcgcgctcggccagctgcacctgggtcgaggccatgcgcgcctcctcgcccacccgctcccgcgccgccgccgacgtcgacgagctcacggcctggatgaggaagcacccgtcggcgctcgggaagttcgagcagattgccagcgcgtcccaggggaagaaggtcgtcatgttcctagactacgacggcacgctcgcccccatcgtcgccgacccggacgccgcctacatgagcgacgtgatgagagcggcggtgcgcgacgtcgcgaagcacttcccgacggcgatcgtgagcgggcgctgccgcgacaaggtgcgcagcttcgtcgacctgtcggagctctactacgccggcagccatggcatggacatcgaaggaccaagctccaatcccgagtcagttctgtgccaacctgcgagcgagttcctccccgtgatcgacgaggtgtacaaggcgctggtggagaagacgaagtccacgcctggcgccaaggtggagaacaacaagttctgcctgtccgtgcacttcagatgtgtagatgaaaagagatggaacgcattggccgagcaggtcaaggcagtgatcaaggactaccccaagctaaagctcactcaaggcaggaaggttctggagatccgtccgagcatcatgtgggacaagggcaaggccttggagtttctgctcgaatcgctcggattcgccagctgcagcgacgccctcccggtgtacatcggtgacgaccgcaccgacgaggacgccttcaaggtgctgaggaagaggggccaaggcgtcgggatcctcgtgtccaagtgccccaaggagacgaacgcctcctactcgctgcaggaccccggcgaggtcatggacttcttgctccgcctggtggagtggaagcggaaatccacgacgactcggccgccggtgtagctcttgttcttggtcgactagtcaatcgatggaccgaccgatcgatcgaatgggcgtccaatcatgcgcgaaaacataccccaccactgcaagaccaatttttttttctgtctctctctctccctctctctccactctctctgacgattcttcagcttgtggtggcctccgaaaccgacgactcgtggtggttgctgtgttacatgttcttcgattccctgaccaccgtgtgctgccggcctccgccaccaccgagcgaggaaaaaggaggccggccggccgcacacaaagcacagcgtcactgaaagtgttttgagcatgttggcgctactgtcgaatacagtatcagtaaccggttctactccaaggcagtgtactgtccccccacccccattattctctcctgttgtttttggccctagcttgttccccatgactctggaaggcatcgtcgtctatctgcaaagctacctgacgtccttgaattgaagaacctttgaaagaaacagagaaggttcggtaatttcacttcacccccaattaatataagtatgtaactatagtagctgctgtatgtctaggcactgtttacgcaccctctctgtaagatgtgtactcctggtgaatgaatgtgagatcccaagcaatggaattatattctgcaaattatttcgtgccaaccagtctttacaattccaattcagggaaaagagagaaagagagcaccaattagcaactacaacggattctgagaccattgattaaacaagactgctaaggttttgtttgggtaaagagggattggagtgaattgaagtgtattgaagggattgaaagagaaattagttcatattacacttcgatacgtctcataccacttcaatccacttcaatccgagattgtccaaacaaggggggttttg

SEQ ID NO: 196 - DNA, 1133 bp, Zea mays
cctgggctaggccgctggagaagcgaagcacatgacgaaccagcaggacgtggtcgtgtccgagatgggcattgcggccggagccgcgctgccgggccccagcccggccctccttgcctgccggggagcggccgccggcgcaatgtccctgcggtacctcgacctggcagcggcggccgcgcgctcggccagcggcaccggcacctgggccgacgccatgcgcgcctcctcgcccacccgctcccgcgccgccgacgagttcacggcctgggtgaggaagcacccgtcggcgctggggaagttcgagcagatcgccagcgcgtccaaggggaagaaggtcgtcatgttcctagactacgacggcacgctctcccccatcgtcgccgaccccgacgccgcctacatgagcgacgcgatgagagcggcggtgcgcgacgtagcgaagcacttcccgacgtcgatcgtgagcgggcgctgccgcgacaaggtgcgcaacttcgtcgccctctcggagctctactacgccggcagccatggcatggacatcaagggaccaagctccaatcccgagtcagttctgtgccaaccagcaagcgagttcctcccggtgatggacgaggtgtacaaggcgctggtggaaaagaccaagtccacacctggcgccaaggtggagcacaacaagttctgcctgtccgtgcacttcagatgtgtagatgaaaagagatggaatggtctggcggagcaggtgaaggcggtgaccaaggactatcccaagctgaagctcactcatgggaggaaggttctggagatccgcccgagcatcatgtgggacaagggcaaggcgttggagttcctgctcgaatcgctcggattcgccaaccgcagcgacgtcctcccggtgtacatcggcgacgaccgcaccgacgaggatgctttcaaggtgctgaggaagaggggccaaggcatcgggatcctcgtgtccaagtgccccaaggagacgaacgcctcctactccctgcaggaccccggcgaggtcatggacttcctgctccgtctcgtggaatggaagcggaaatcctcggcggccccgatggttcggccgcgggtgtagctcggcagcccggaggtcgact

SEQ ID NO: 197 - DNA, 2410 bp, Oryza sativa
ctcgcgcctcgcggctcgcgcgggtggactcatgaactcggcctacgctttacactgggctagaaaacaaacgatacggcaggggatgcccccgccgcggcctaccagctaagcaggcgagccccctcacacacgtagaatccacatatggtgacatgggatccacgtggcggccccccacgtgccctatcgctgggcccactcctcgcagctataagtaccccgtcctctcccactccgcctccacccacctctcaaactctcggagaagcgagcacacacactcactccctgtctcctcctcctcctcctcccttgaggctgttcgtctcgacgagtgcttggctttgtgtttgtggtgtgtgatcatgacgaaccaggacgtggtggtttctgagatgggcatcgcggcaggcgcggcgctgccgggaggaccggccggcccggcgggcggcctcttcgcgtgccgcagcgcggccgcgtcgatgaggcagacgtacctcgacctcgccgcggcggcggtggcggcgcgctccgcgagctgcaccagctgggccgacgccatgcgcgcctcctcccccacccgctcgtcccgctccgcctccgacgtcgacgagttcaccgcctgggtgaggaagcacccgtcggcgcttagcaagttcgaggagatcgccgccaagtccagggggaagaagatcgtaatgttcatggactacgacggcacgctctctcccatcgtcgccgaccccgacacggcctacatgagcgacgcgatgagggcggcggtgcgcgaagtcgccaagaccttcccgacggcgatcgtcagcgggcggtgccgcgacaaggttcgcaacttcgtcggcctctccgacctctactacgccggcagccatggcatggacatcaagggaccaagctccaacccggagtctgccctttgccagccagcaagcgagttcctccccatgatcgacgaggtgtacaagacgctggtggaaaagacgaaatctacacctggagccaaggtggagaacaacaagttctgcctgtccgtccacttcagatgtgtagatgaaaagagatggaatgctttgggggagcaggtcaaggccgtgatcaaggaatacccaaagttgaagcttacccaaggaaggaaggttttggagatcaggccgagcattgagtgggacaagggcaaggctctggagttcttgcttgaatcgctgggattcgccaactgcggcgacgtcatgccggtgtacatcggtgacgaccgcaccgacgaggacgccttcaaggtgttgagaaagagaggtcagggcctgggaatcctagtctccaagtgccccaaggacaccaacgcctcctactctctccaggacccaacagaggtgatggagttcttgctcaggctggtggagtggaagcggaagtcgtcgtcgtcgtcgttgatgattcgtccgagagtgtagcggcgacacggtgtagaggccgtaagaaactgaaactaagatggtcaatcatgcgaacatgcgaacataccccaccaacaccacgtactacccccatttttttccgatgatttctgtggttggcctctgcgacggactcgtggtggttacacgctagctgttcgattccgtcccctgtgccgccgaggaaaaggagaccaccaaaaaagaagaaaaaaaaactctcgcttaattagctctcgatcagattccggcatgtttgggcgcgcagcggccggcgccaaagcaagcatggctccaggcatgttggtcactggtggtgttgcagctgcagtctagaacagtaaccatgtctactacccggcaatgtgctactactattactagtagtctactgctgctactgctactacgactacgactactacccttgttattattatttttttggtcccatggacttggaaggcatatgcaaagaaacctgccatcctagacccttaacaaaaagagaaggttctatctccatcgatctgttcatcaccccatgtaaaatgtactactactagctagctagagcaagacttaattcatccgtttgtcgacagttcgtcctcgatctccctctgtaaaatgtaatggagttaattaattaatagcaatggattatttcgcatgtcgtagtacctctccatcgatctgggatgctaactttctttgctctttcgatgatctcatgacgacgaagatatactgtgatgtgagcatgcatgagcaccgggaaacaaaaggaggccaggtggctagctaacaccgtacacatacaacacctcgcgggaagcatgtgaacggcttgctgcaggatctccctgcatgatcacctgcagggttcttgcgtgcagtgacaaactagctagctagctccaacaagatcgcag

SEQ ID NO: 198 - DNA, 2486 bp, Zea mays
gtaggaacgttctagcgggcaccgtatagtgtccatcgccattaaattccgtcgacctcggcgcgcctgctgctagcgcgacgcggccagtcacgcacgcagccgccttcttcgcccacgcagctcttgtgttccatcttccatggacaccgtacccagccagccatcccatcatcatttcacacttgacgcacgccacgcggctgggtatgcggccataaaataggaaccccctgtttgttgcgagttaggtgatcacctcgatctcccgcgcttattttccccgccaccctgctctgctctgcaagcctccctgctaaataatcctaccgctccgcagccgcaggtgcgtgcgtggtggttgacggccgcttacccgcaccggcgccatgcgcgcgcgcggctaggtggtcgaggtcaagccaaacgctgcccaccgcctctgcctcgcatatatcctcgcgcacgttctttgctcgtctcgcactcgcttccttcgacggactcatcgccgatcacaccaggctagctagcccacccacagtcgtagggccaggaccgataggaggagctcggtttttccgaccaggaccgccgccgccacacccgaagaagccgacgatgcagacgacgacgacgacgtcctcggtggtggccgagctggagggcgcgctgctccggagcgcggacacgttcccgtacttcatgctcgtggcgttcgaggcgtccgggctgccgcgcttcgcgctgctgctggcgctgtggccgctgctgcggctgctggagctggcgggccggcgcggcctggcgctgcgcgccgccgcgttcgtggccaccgcgggcgtgccgcgcgccgaggtggaggcagtgtcgcgcgccgtgctgcccaagttcatggccgacgacgtcgaccccgccgcgtgggcggccttcgggagctgcgaggggacgcgcgtcgtcgtcacgcggatgccccgcgtcatggtcgaccgcttcgccagggagcacctaggcgcgcacgcggtcgtcggctgcgacctcgagtacagccggctcaggcggtccacgggtctgctaagaggcgcgagctatgaggacgtcgccacccgtgtgcgcgcgttgttcgccggcgacggctgccggccggcactcgggatcggcgggtcaaagatggcgcgctcattcttgacattctgcgaggagcagctcaggcagccattcccagcgcccaacgagacgaacgccccgccgttccggccggtcatcttccacgacgggcgcctcgtgtgccggcccacgccattcatgtccctcgtcatccttctctggctgccgctcggcgtgctggtcgccttcgtccggatcgccgtcgggctcatggtccccatctggaccgtcccctacatcgcgccggtcttcggcggcgccgtgatcacccacggccgcgcgcctccccccgccaagctcggcggcggctcgccctcgggggtcctcttcgtctgcacgcaccgcacgctcatggaccccgtggtgctggccgccgtgctcggccggcgcgtggcggccgtgacgtactccatctcccgcctctcggaggtcctctccccgatcccgacggtgcgtctgacgcgcgaccgggacgcggacgcggcgcgcatgcgcgcggagctggcccgcggcggcgacgtggcggtgtgccccgagggcaccacgtgccgggagcccttcctgctccgcttctccaagctcttcgcggagctcagcgacagcatcgtgcccgtggcgatgaactaccgcgtggggctgttccacccgacgacggcgcgcgggtggaaggccatggaccccatcttcttcttcatgaacccgcggcccgtgtacgaggtgacgttcctgaaccagctccccgcggagtcgacgtgcgcggcggggaagagccccgtggacgtggccaactacgtgcagcggatactcgccgccacgctcgggttcgagtgcaccaccctcaccaggaaggacaagtacacggtgctcgcgggaaacgacggcgtcgtcaacgccaagccggcctggcagagccgcgtgaaggatgtcctcggcttcctgctccactaaccacattacttgcacggctctggactctgcgctcaaatacttcgctcaccgatttgattgagtttatactttacatttatttatacatgtaagtaagaataaccacacgcaaaagcatgtagtagtaacatacagtagtgtgattattagcctttatttcttcacataataagtactgtatattgtattgttctttgttttacaagtgttttggtgaatttttactgggtgtaatcaaatatattttgtagccatgactaagaaatcttggctgaagagcttgttgccgagtgatggctacaggtagatcaggtttggtaggactttcaaccctgtttttgtttatagcaaagtcgaaagctacaactttg

SEQ ID NO: 199 - DNA, 3145 bp, Secale cereale
caaaaaccttgttcctctgtttctctcaacaacagaaaacagcagcacccacctcagctattattctctcaatacctgctgcatacctatagccgcgttcttcaatacctaagaatcgacattctcttttaacgtcacctaccatggccgaagagaaggcggtcggcgcacccgcgctcgacaccaacatcgagactggcggcttcgatgagaagcgaggacaagctcccgctacccacaaccccaaggctcccgtcgccgaggatgaggagcccgatgaggacatggatgccctgatcgaggacctcgagtccgaggacggccacgagatcgacgacgacgaggaggccacccccggcggtggacgtgtcgtccccgaggaccagctccagactgactctcgtgttggtttgactgaggctgaggttatcgcacgtcgcaagaaatggggtctcaacgccatgaaagaagagcaagagaacatgattctcaagttcctcatgttcttcgttggccctattcagtttgtcatggaagctgccgctgttcttgctgctggtcttgaagactggattgatttcggtgtcatttgcgctcttctccttctcaacgcatgtgttggtttcattcaggagtaccaagctggttccatcgtcgaggagctcaagaaaactcttgctctcaaggctgttgttctccgtgatggcactctcaaggagatcgaggcccctgaagtcgttcccggtgacatcctccaggtcgaagagggaacgatcattcctgctgatggtcgtttcgttaccgagggctgcttctgccaagttgatcagtccgccatcactggagagtctctcgctgtcgacaagcaccatggtgacaactgttacgcttcttccgctgtcaagcgtggtgaggccttcgttatcgttactgccactggtgacaacaccttcgttggtcgtgccgctgctctcgtctctcagtctgctggtggcactggtcacttcactgaggttctgaacggaattggaacaattttgctagttctcgtcgtcgccaccctgctaattgtttgggtcagctctttctacagatccaatggcattgttgacatcctccgtttcacccttgctattactatcgtcggtgtccctgtcggtcttcccgccgtcgtcactaccaccatggccgtcggtgccgcctaccttgccaagaagcaggccatcgtccagaagctttccgccattgagtcccttgctggtgtcgagattctctgctctgacaagactggtactctgaccaagaacaagctctctctcgctgagcctttctgtgttgctggcgttgagcccgatgacctgatgctcactgcttgtttggctgcttcccgcaagaagaagggtattgatgccatcgacaaggctttcctcaaggctctcaagttctacccccgcgccaagggtgttctgtccaagtacaaggttctcgacttccacccctttgaccccgtctccaagaaggtccaggctgttgtcgagtcccctcaaggcgagcgtatcatctgtgtcaagggtgccccactttttgttctcaagaccgtcgaggaggaccaccccatccctgaggaagtcgattcggcgtacaaaaactgtgtggctgagtttgctacccgtggcttccgatctcttggtgttgctcgcaagcgaggtgagggtgcttgggagattctcggaatcatgccctgctctgacccccctcgtcacgacactgcccgaactatcaacgaagccaagcgccttggtctctccatcaagatgcttactggtgacgctgtcggtattgcccgtgagacttctcgtcagctcggcctcggtaccaacgtttacaacgctgagcgccttggtcttggtggtggtggtgacatgcccggttctgaggtttacgatttcgttgaggctgccgatggtttcgctgaggttttcccccagcacaagtacaacgtcgttgagattctccagcagcgtggttaccttgttgccatgactggtgatggtgtcaacgatgctccctctctgaagaaggccgatactggtattgctgtcgagggtgcctccgatgccgcccgatccgcctctgatatcgttttccttgcccccggtctcggagccatcatcgacgccttgaaaacgtcccgtcaaatcttccacagaatgtatgcctacgttgtctaccgtatcgctctttccctgcacatggagatcttccttggtctctggatcgccatcctcaaccgatctctcaacattgagcttgtcgtctttatcgccattttcgccgatattgccacccttgctatcgcctacgacaacgctcccttctcccagactcctgtcaagtggaatcttcccaagctctggggtatgtccgttcttctcggtgttgtcctggctgtcggtacctggatcgctcttacgaccatgctggcgaacagtgaggacggcggaatcgttcagaacttcggtaagatcgatgaggttctcttcctcgagatctctcttactgagaactggctgatcttcatcacccgtgccaacggtcccttctggtcttccatcccctcttggcagctgtctggcgctatcctgatcgtcgatatccttgccaccctcttctgtatcttcggttggttcgttggtggccagactagcattgtcgctgttgtccgtatctggattttctctttcggtgtcttctgtgtcatgggtggtctctactacttcatgcagggcagcaccggcttcgataacctcatgcacggcaagtctcccaagcagaaccagaagcagcgatccctcgaggatttcgttgtctctcttcagcgtgtttcgacccagcacgagaagtctcagtaaacaaagatggtatatacccggagcaccatcgaccggacttttcactttcgctacgtccaaatttgccctttaatactcgcacccgagtactgagactcatggagtggctgaggaatgtttcatacccctagaacgtctattagacacttaataatacaagtaaaataaataaaaaaaaaactacgagactagacacgcgactacacggagtagccccccccccccccgccccc

SEQ ID NO: 200 - DNA, 3233 bp, Triticum aestivum
cgcagaagtacgcgggacgacatctcacttcgacaattcaaaaagaagctctcgccccgactcaaaactttctccttgttttcctctcctcgttcacccacgaatagacttcattcataagcgaccctaacttcgtgcggtgcttagacactttcttccccttttcctctccactctaccttgttcctctgtttctctcacaacaacagaagcggcatcaacctattatttcactatatctgctgccaacctacagccgcactctacacaacctaagaatcgacattctcttttcccatcatctccaacgatggctgaagagaaggcggccggcgctcctgcgctggacaccaacatcgagactggcggcttcgacgagaagcgaggacaagctgctcccccacccacgcccccaaggctcctgtcgccgaagatgaggagcccgacgaggacatggacgccctgatcgaggatctcgagtccgaagatggccacgccttcgacgatgaagaagagactcagcccggaggtggccgtgttgttcctgaagatcagctccaaaccgactcccgagtcggtttgaccgaggccgaagtcctcaaccgacgacgcaaatggggtctcaaccagatgaaagaagagcgtgagaacatgattctcaagttcctgatgttctttgtcggcccaattcagttcgtgatggaagctgctgctgttctcgctgctggtttggaggattggattgactttggcgtcatctgcgcgctgctcctgctcaacgcctgtgtcggtttcattcaagagttccaggcaggctcgatcgttgaagaactaaagaaaacacttgctctcaaggctgtcgtcctccgtgacggtactctcaaggaagttgaggcccccgaggtcgtgcccggtgatattctccaggttgaagagggaaccatcatccctgctgatggtcgtttcgttaccgagggctgcttcgtccaggttgatcagtctgccattactggcgagtctctcgctgtcgacaagcacgctggtgataactgctatgcttcctccgctgtcaagcgaggtgaggctttcgtcatcgttaccgccactggtgacaacaccttcgtcggtcgagctgctgcccttgtctcccagtccgctggaggaactggtcactttacagaggttctcaacggcattggaacaattcttctcgttcttgtcgtcgccacactgcttgttgtatgggtgtcttccttttatcgatcaaatggaattgttgacatcttacgtttcaccttggccatcaccatcgtcggtgtgcctgtcggtcttcctgctgttgttacaaccaccatggctgtcggagctgcctacctcgccaagaagcaggccattgtccagaagctgtccgccattgagtctctggccggtgtcgagattctctgctctgacaagactggtaccctgaccaagaacaagctctctctcgctgagcccttctgtgttgctggcgttgagcccgatgatctcatgcttactgcttgtttggccgcttcccgcaagaagaagggtattgacgccattgacaaggctttcctcaaggctctcaagtactacccccgtgccaagagcgttctgtccaagtacaaggttcttgacttccatccctttgatcccgtctccaagaaggttcaggctgttgttgagtctcctcagggcgagcgcatcatctgtgtcaagggagcccctctctttgtcctcaagactgtcgaagaggaccaccctatccctgaggaaattgatgctgcatacaagaacactgttgccgaattcgctacccgtggtttccgatctctcggtgttgctcgcaagcgaggtgagggtgcttgggagattctcggaattatgccttgctctgaccctccccgtcacgatactgcccgcaccatcaacgaggccaagcgcctcggtctctcaatcaagatgcttactggtgatgccgtcggtattgctcgtgagacttctcgtcagctcggtctcggtaccaacgtttacaacgctgagcgtcttggccttggcggtggtggtgacatgcctggttctgaggtctatgatttcgtcgaggctgccgatggtttcgctgaggttttcccccaacacaagtacaacgttgtcgagatcctccagcagcgtggttaccttgttgccatgactggtgatggtgtcaacgatgctccctctctgaagaaggctgataccggtattgctgttgagggtgcttccgatgctgcccgctctgcttccgacattgttttccttgctcccggtcttggtgctatcattgatgctttgaaaacttcacgccaaattttccatcgtatgtacgcctacgttgtttaccgtattgcgctgtctctccacatggagatcttccttggtctctggatcgccatcctcaacaagagcttgaacattgagcttgtcgttttcattgctatcttcgccgatattgctactcttgccattgcttacgacaacgctcccttctcccagacacccgtcaagtggaacctccctaagctctggggtatgtccgtccttctcggtgttgtcctggctgttggtacctggattgctcttactaccatgtacgccaactctgaggatggtggtatcgtccagaacttcggtaagatcgacgaggttctcttccttgagatctctctcactgagaactggctcatcttcatcacccgtgccaacggccccttctggtcttccatcccctcttggcagctgtctggtgccattctgatcgtcgatatccttgccaccctcttctgtatcttcggttggttcgttggtggtcagaccagcatcgtcgccgtcgtccgtatctggattttctctttcggtgtcttctgtgtcatgggtggtctctactacttcatgcagggcagcactggatttgacaacctgatgcacggcaagtcccctaagcagaaccagaagcagcgatcccttgaggatttcgttgtctctcttcagcgtgtctcgacccagcacgagaagtctcagtaaactagatggtatatacccggaccaccatcgcccggacttttcactttcgctctgtccaaatttgaactgtattactcgcacccgagtattaagactcctggagtggttgaggaaactttcatacccctagagaacgtctactagacacctaa

SEQ ID NO: 201 - DNA, 1471 bp, Hordeum vulgare
ctcgatttagttcactccgttgggtatataaagatggcgacgcagcaaagatgtcccagctagccgcctacacctaccatcactggccaaaacgtgaaccgttccagtcaaacttcctcgtcgccaccacacgaccgcacctctctcatggcgttctcctcgccgccgcacgtcgtggaggacgtgcccccgttcctgcagctcctcagcgacggcacggtgatccgcttcactgacggctaccccctccccatcccgtcgccgccgcccggccagcccgtcgtagactggaaggacgtcgtgtacgacgccagccacagcctcaagctccgcatctacaggccggcggcggcgtcctcctccgggaacaagctcccggtggtcgtctacttccacggcggcgggtacaccatcggcagcttcgacatgccgaacttccacgcgtgctgcgtccgcctcgcgggcgagctcccggctgtggtggtctctgcagactaccgcctcgcccccgagcaccgcttccccgcgggcctcgacgatgcggcgaacgtcgtgtcctgggtgcgcgcccaggctgcagcggtggcggcggcagaggacagtgccgacccctggctctcggagaccgcgaacttcggccaggtgttcgtcgccggggactcggccggcgggggcgtcgtccaccacacggccgtccgcctcgcgtcaggccggatcggccctctcgaccccgtttgcgtcgccgggtgcgcgatgctctgcccgctgttcggcggggaggcaaggacggcgtcggaggcggagttcccgccgggcccgttcctgtccctgccggcggtcgaccaggcctggcgtctggtgctgccggctgggtccacgagggaccacccgctggccaacccgttcggcccggacagcccggtgctcgacggcgtcgcgctgccgccgatgctcgtggtgaccgccgagcacgacctgctgcgcgaccgcgccgcggactatgccgcgaggctcaaggcgatagggaagccgatggaactagtagagttcgaggggcagcaccacgggttctttgccgtcgagccgtacggcgacgcgggcagcgaggtggtgcggctcgtcaaacggtttgtctacggcaacggcggcgcctccgactaaattggagatcgagtaaagcagttcagtttgtatcattgcctcgtggaggacgagtggagtaacattttattttggacactataatatagtatgtgtatgtcaaactcctatacgtattctttttctcgtctcaacatatgcatttgatttgaatttattggcaatttattaaggatttcactacaaagcaaatgccagattttttagcatgaaaaatcgttcggccaagatgacaaattatgtttgcctcgaggatgcaagttttctttaacaaacatggcaaatccttgccatgttattttgctaggaa

SEQ ID NO: 202 - DNA, 1460 bp, Secale cereale
agtaccatcactagccgaaacgtgaaccgctccagtcaaacttcctcgtcgccaccacacgaccgcgtctctcccatggcgtcctcctcgccgccgcacgtcgtggaggacgtgcccccgttcctgcagctgctcagcgacggcacggtgatccgcttcactgacggctacccgctccccatcccgtcgccgccgcccggccagcccgtcgtcgagtggaaggacgtcgtgtacgacgccagccacggcctcaagctccgcatctacaggccgccggcctcctccgacgagaagaagctcccggtgatcgtttacttccacggcggcgggtacaccatcggcagcttcgacatgcccaacttccacgcgtgctgcgtccgcctcgccggcgagcttcccgctgtggtgctctctgcagactaccgcctcgcccccgagcaccggttccccgcgggcctcgacgacgcggcgaacgtcgtgtcctgggtgcgcgcccaggcggcagcggtgtcggcggcagaggactgtgccgacccctggctctcggagacggcggacttcggccgggtgttcgtcgccggggactcagccggcggaggcgtcgttcaccacacggccgtccgcctcgcgtcaggccagctcggccccctcgaccccgtttgcgtcgccggatgcatgatgctctgcccgctgttcggcggggaggagaggacggcgtcggaggcggagttcccgccgggcccgttcctgtcgctgccggcggtcgaccaggtgtggcgcctggtgctgccgccagggtccacgagggaccacccgctggccaacccgttcggcccggagagcccggcgctggacggcgtcgcgctgccgccgatgctcgtggtgaccgccgagcgcgacctgctgcgcgaccgcgccgcggactacgtcgcgaggctcaaggcgatggggaagcccgttgagctcgaggaattcgaggggcagcaccacgggttcttctccgtcgagccgtacggtgacgccgggagcgaggtggtccggcttgtcaaacggtttgtctacggcaacggcggtgcctccggttaatttggggatcgagcaaagcgatgtggatcgtgtgttggagtaacatcttgtttaccatgtcagcgagcatccagaagatgaaataaaaacacgttatgtgtagtagcaaacccagacaagcacccccaaagaagtcgtacctagagcaaaatagtcgaggttgatacaaagagtgtgacttgttctcaatcaactgagaatctcaatcaagtgacataacatgtgagaaagtgaaaaaattaaaatagaaaaatctacgcatatcttaatgtaagatatcactaatatagcatcgaccaagatataactaagtactcgtccattgtagaataaaaaaaaacggtaaagtagacgactacgacacgacgaacggg

SEQ ID NO: 203 - DNA, 1058 bp, Triticum aestivum
cacggcctcaagctccgcatctacaggccggcggcggcctcctcctccgggaacaagctcccggtgatcgtctacttccacggcggcgggtacagcatcggcagcttcgacatgcccaacttccatgcgtgctgcgtccgcctcgccggcgagctcccggctttggtgctctctgcagactaccgcctcgcccccgagcaccggttccccgcgggcctcgacgacgcggcgaacgtcgtgtcctgggtgcgcggccaggcagcggctgttggggacaacgccgacccatggctctcggagacggcggacttcggccgggtgttcatcgccggggactcggccggcgggggcgtcgtccaccacacggccgtccgcctcgcgtcgggccggctaggccccctcgaccccgttcgcgtcgccgggtgcgcgatgctctgcccgatgttcggcggggaggagaggacggcgtcggaggcggagttcccgccgggcccgttcctgtcgctgccggcggtcgaccaggcgtggcgcctggtgctgccgcctgggtccacgagggaccacccgctggccaaccccttcggcccggacagcccggcccttgacggcgtcgcgctgcctccgatgctcgttgtggccgccgcgcgcgacctgctgcgcgaccgctccgtggactatgccgcgaggctcaaggccatggggaagccggtggagctcgtggagttcgaggggcagcaccacgggttcttcgccgtcgagccatacggcgacgccggcagcgaggtggtccggctcgtcaaacggtttgtctacggcaacggcggcgcctccgactaaattggagaccgagcaaagcagttcaatttgtatcgctgcttcgtgaaggacgagtggagtaacattttgttttggacactcgtatgtcatactcctcaaaatacaaagatgccataaacttagacatatattttttctcttctcaacatatgcatttgatttgaatttattgccaatttattaaggatttcgctacaaatcaaatgtcagattttttagca

SEQ ID NO: 204 - DNA, 2066 bp, Hordeum vulgare
tcaacattaattctgtaccagactgaatgaagtggtgcttatatatttaaagagatataatatagtactaagaagccatttcttgagcacaagaattcaaatcatatgatttgcatctaggtcacatttttttgccgttctgcgttgccattggcagatatgtgcaggccatagcaactttgaagtagcaacagcacatagtccaacaattgactagatgctgccacgtagcaagaagaatttttggaatatgccagtagcgtattccccagtcccttctgcttcattctgtcaggccagcaaaatgacacattgcagacgtatgattttgtcttctatttttattgtggtgttttggggggtatgtatgtatgctgtgaagttggtggagaactacacaagagccaatcacctctagctcaattcatgttgcattaggctccaagatcaggacaatttagcatgcatcagccatgaaggtggggtccacacattctcttttctccactgctaatctcttgcccctctgccatgtggtttctatataagacatggtatgaggctacacatcaaggcaattcttatcgtagatagcaactaaaatggagaccatgtcatatccttgttcccctcttctctccctccccacacatgaagagagtaacttcttcatatggtctcctcaagtagctctccacgagaatgccaccatccatgttgatcattccactgatcaacaacatgataatgtgttcttggacactgcagctcaacattatgctaatgattggcagcaacaggatgcttctgatgttggtgtgttcacctattgtggtgagaggattctgggccaggagagtggcaacttggtcgcaatccaggaagagctcatggaggagaacagtttaactgatctccttctcactggcgcagaggcggtcgaggcgggggatccaagatttgccttggcagtgttctcgaggcttgatggcctcctccttggcactcctgaaaatgcagcagccggctcttttgatcgcctggcctaccacttttcccaaggtctgcggtcccggatctccagtgcaagcaccagttgctctccacctgagccactggcgtctgatagaatgtcggtgcaacagattatacaagagctgtcgccatttgccaagtttgcgcacttcactgccaaccaggccattctagacgccaccaagggcgatgcacatgtgcacgtcgtcgacctgaacattggcgagggcatccagtggccatcgctcatgtcagatcttgcccgtcatggtggcatttcattccacctcacggcggtcacagcagacgccgactacagcgatgccgttcaccatgcatctgcgcggtggctctcggagttcgcagagtccttgaacctccccttccaatatagctccctctgtttacacagtgatgaagacctgcatgaattctccaagaacagtaaaggctcggtgatcttctcatgtgacacaacaagcatgccttacaagttgctgagcaagttaccggcactcctacctgcctgtgttgagctgttacagcctaagttaatggtcatcatagaagaggagctggttagaatcggaaaggaggtgtctctatgtaaggcctcctttgtcgacttcttcttcgaggcattgcaccacttcaccacggtgttcgagtcactggcgagctgcttcgctggtggtaaccagggggtgtgcctgagacttgtggagagggagatggtggggccaaggatacaggacttcgtggggcagtatgggtctgtgacagctgaggtcaatgctcctgtggttttggaaaggtatggggcttgtgacctgagtggttgcaatgttgctcaggccaggatgctggttgggttgttcaatagggggtttgagattgtgcacgagaagggcaggcttatgttgtgctggaagtccaggccactgacctctgtgtctgtttgggctccaatcttgaaagaaagaagctcatgacgttctttattttgttgtaagtgtttttttttcgagaaa

SEQ ID NO: 205 - DNA, 2976 bp, Aegilops tauschii
atggagaccatgtcatatccttgttcccctcttctctccctccccacacatgaagagagtaactttttcatgtggtctcctcaagtagctctccacgagaatgccaccatccatgttgatcatcccactgatcagcaacctgataatgtgttcttggacactgcagttcaagattatgctaatgattggcatcaacaagatgcttctgatgttggtgtgttcacctattgtgatgagaggattcagggccaagagagtggcaacttggtcgcgatccaggaagagctcatggaggagaacagtttaactgatctcctcctcactggtgcagaggcggttgaggcgggggatccaagatttgccttggcagtgttctcgaggcttgatggcctcctccttggcagccctgaaaatgcagcagccggctcttttgatcgcctggcctaccactttgcccaaggtctgcggtcccggatctccagtgcaagcaccagttgctctctgccggagccactgccgtctgatagaatgtcggtgcaacatattatacaagagctgtcgccgtttgccaagtttgcgcacttcactgccaaccaggccattctagacgccaccaagggcgatacacatgtgcacatcgtcgacctgaacattggtgagggcatccagtggccatcgctcatgtcagatcttgcccgtcatggtggcatgtcattccacctcacggcggtcacagcagacgccgactacagcgacggcgttcaccatgcatctgcgcggcggctctcggagttcgcggactccttgaaccttcctttccagtacagctctctctgtttacacagtgatgaagacctgcatgaattctccaagaactgtaaaggctcggtgatcctctcatgtgacacaacaggcatgccttacaagttgctgagcaagttaccggcactcctacctgcctgtgttaaactgttacagccaaagttaatggtcatcgtagaagaggagctggttagagtcggaaaggaggcgtctctatgtaaggcctcctttgtcgacttcttcttcgaggcattgcaccactttaccacggtgttcgagtcactggcgagctgcttctttggtggtaaccagggggcgtgcctgagacttgtggagagggagatggtggggccaaggatacaggactttgtggggcagtatgggtctgtgacagttgaggtcactactcctgtggttttggaaagggagggctcgtctcagctcagtacggatgttctgatttcagcagtcgcaggtgatcttgccagccgtttcatctcattcctagctcacatatatgacactcgaacttgtgaggatgatgatcgtagaaggctggaattcgtgttgctaaggatccacactgttgttgaggaagcagaggggtggcacatcacaaatcgaagaatgttcttgcagcttaaggcactcattcaggatcttggcatggaggttctgatttcagctgtggtgggtgatcttgtcagccggttcatctctttcctggcgcaaaattatggcactcaaacatgtgtggaggaggaccgtagaaggctggaactcatcttactaaggatgcacatggttgttgaggaagcagaggggcggcaaatcacaaatcgagggatgttcctgcatctgaagacactcatcgatggtgtgcatctcgggtactacatgcttgacaggctcaagttccaatcccttggagaagagagcgttgaagatgatgaggtgagtaactggagccagtctcttgccgtttctacttttagcgccgccaagcgtcttcgtcttgctgttgctgcttctataatgaagaacgcaccagtagcatttggtactgggagcacgacaaatttgaaaagggttcttgaaagtttagaggccaagactgcagatatgagagagttcgtcgtgctcctcggcagctgccctcgtcttcctcgtcagccatactgtgtgcacctatacatggataagtgcatgtttggtcgccacgttgagaaagagcaactcatcaacttcttgctatgtgatgacagtcatcacgattgcacacatattagcatcctgccgatcatcggcccacacagaatcgggaagaaaactctggtgcagcatgcttgcaaggatgagagggtgtgcaatcatttctcccacatgtttttcttcaaaggagatgatctacggaacggagtatttgcatttaacaaccaggcagcctcagggaagtacttgtttgttgtggatttcatcttcgatgtggatgaggcagcatggacaaacttccaatcatatctgcagaagttgccaggtgctgggatcaaaattgtagtgacaggcagagcagagcaagttgcaaacttggggactgctcaaccgatcaggctgaagagtctgtctcaagaagagtactggtactacttcaaggcacttgccttcggaagcatggatcctgatgatcatccgaaactggcatctttgggcatgcaactagcggcgctcctacagggatcatttcttggtgcaaacatactcggcgagctactaagagctaatccaagcacagaattctggcgcggagtattatcgagcataagagtacttgttcgcgagcacatgtcgtccttcggcacgcacccggaggacctccttggtagaaattttcctgtgaatttcggcagtgcggccttggtgggtggtccggctcagggatacctggtgtatgatcttagggaggctggccctgctcaaagtgagctgccaaaactgacatcgcaagaactactgacaggccgtgatatacctgttgaagacaagtttgaggtgctagtatggagatctcggatcccgccttactgcgactacgttgttacttacgaaaaacagaagaatcatgtggcagtgagaaaacgtcagcgcaaaagttaa

SEQ ID NO: 206 - DNA, 1410 bp, Triticum aestivum
tcaagattatgccaatgattggcatcaacaagatgcttctgatgttggtgtgttcacctattgtgatgagaggattctgggccaagagagtggcaacttggtcgcgatccaggaagagctcatggaggagaacagtttaactgatctccttctcactggtgcagaggcggtcgaggcgggggatccaaggtttgccttggcagtgttctcaaggcttgatgggctcctccttggcagccctgaaaatgcagcagccggctcttttgatcgcctggcctaccactttgcccaaggtctgcggtcccggatctccagtgcaagcaccagttgctcgctgccggagccactgccgtctgatagaatgtcggtgcaacagattatacaagagctgtcgccgtttgccaagtttgcacacttcactgccaaccaggccattctagacgccaccaagggcgatacacatgtaaacgtcgtcgacctgaacattggcgagggcatccagtggccatcactcatgtcagatcttgcccgtcatggtggcatgtcattccacctcacggcagtcacagcagacgccgactacaccaacgatgttcaccatgaatctgcccggcggctctcggagttcgcggactccttgaacctccccttccagtacagctctctctgtttacacagtgatgaagacctgcatgagttcttcaagaacagtaaaggctcggtgatcttctcatgcgacacaacaagcatgccttacaagttgctgagcaagttaccggcactcctacctgcctgtgttaagctgttacagcctaagttaatggtcattgtagaagaggagctggttagaatcggaaaggaggcgtctctatgtaaggcctcctttgtcgacttcttcttcgaggcattgcaccacttcacgacggtgttcgagtcactggcgagctgcttcgctggtggtaaccagggggcttgcctgaggcttgtggagagggagatggtggggccaaggatacaggactttgtggggcagtatgggtctgtgacagttgaggtcactgctcctcaggttttggaaaggtatggggcttgtgacctgagtggttgcaatgttgctcaggccaggatgctggttgggttgttcgatagggggtttgaggttgtgcatgagaagggtaggcttgtgttgtgctggaagtccaggccactgacctctgtgtctgtttgggctccaatcttaaaagaaaggagctcatgaagttctttatttttgttgttgtaagcgttgcagtgaagaattttgaggaaaacgtatttggttagtgagccaccttatttgatttcgatctcagcctttctctcttgctcttgttggcttctcatatatctcctagggtaacttctagtgat

SEQ ID NO: 207 - DNA, 4879 bp, Brachypodium distachyon
tcttcaagccgcctaactcggctcatcgacacgtgtagctctcctatcgtcatgacgtcaccctctccgtcgtctccggcggcggtccgccggagccgtagacggagaagcgcgcctatcagaagaggaacccgatcccgtccatgccccggccctccgtcccctattccgacgcggcgccgagtcagccgccgaccaccaactggcagccgctccctcccgaggtaggtcaccaaggtactcaccaccactcaactgacgcgacccctcctctgagcctggcgtcacacatgctggcgcagggccgcgcgcgcgcacatggaaggcccgcgcgattcccgcctcgaacatctcgatctggcggccggtgcaaagcgcagcgcgtgcaaagcatgtcgatttgcgcgccgcgcgccgcactcccccttaggggaaaaaaacacactattctacatggggattctgttcataccacacgatgacgatgcgcggtgcctggattttgggttctagcaaggggcgcagctctggtcgcgtgcgtcaggtcaacaaaacccatgctaaattgctgattagcatatgctaatcatcatggatctatctgctactagtgcttgctgcttaggtagagcgctttattttttagtggttcgagagtacaccatgtcaggacaggacgatttccaagcatttgcacgcacacccaaggcgttatcgtgcagatgattgtacataagattatgttcacatatggtggtgatgcactgggcctgacagcacctcctagcgtatctctaattttgggtttttgtggtcgccgtgtttaagttggccacattagttaaaaggaaaccatgctaatgagcatatgataatcatggggggttccagcgttctgtcgcattttttgttttgctagtggtgatggggaaggatacaagaagcagggataattgctccaagaaatgatgtcgaatttaatcgattgaactactgaatcttcagcaagaccagggtaagcttgcaaaggaatgcggcctacatgatgtgtcttccacaatatttttccctggcccgagtcgtgagtcatgaggaaccttacccacttgcagcaacttgccaactcctttttttctgcagtcaggcagcttaggttacgcgggaaacatatactgatagacaaggatgatactttaagtgacttgctaactagctggggattaggagaccatcaagctgatgctacagaacagaagagaacaggatatttggacttcccactcaacaatagttcaagagaaaaaatgaatacattatatatagagagatgcagtgcttaccatctatcattatgatgataattagatacccacctgccgtccttaactcatttgatgtcatcgtagagagtatttttcatgagcatggtaagctcccacactgatggttgacaaaatggactatacagctattcctgtcagtctcaactctcaaggtattaattaaagccctctatgacaaaaccttgtgggtgggtgggggcatatgatacttttctcaaaaagggggcatatgatacttaaatacgctaatttttcaaattagcgacttctccttccttctgtgtaaacatgttttgttgtccttgatatatccagtttcgaagggagtagtagtgctaattgatttgaaaagtaccatgctgccaagatcctttttttaataattaattttttttacttcccattgtccactcttacagttgtaatttggtgtccttttctttttctggtcgaatataattcatggtgttaataatgcatgactataatactgagtgaattcacaattttacgcttgatagtgtgcacatggtgccagctttgcttgtcccataatatgaaacacatcctggcaaacttatttacctcaatggaatcatccagaattccagacacttgagagaaagaaaagaatcatacaatgctgaaagctcactagaacacaccatttgtgcatttctacatgaagttgtgaaatagtcagtggaaagctgtacattgctgcactccatccacagcctcctcctgttgctagtttctggaattgatcattttggaatcgccagtagggaaaccagaagaaaagttcagattagtagcaaggggcagcatggaaccaaacaatctatgtggcccacgtctggtctatgtaagttccactttacaacagctttactccttgacacaagcagctttgtcctctttcagttccaccctattgtctacatctcataactccatttgaatctgccaacaagttgtataaccttacaataatgggttgtatgggcacctgattggtgtcaactgtcaaataaagaatcaagtctgggagcaagttggcatgattttattacactggtaattatttgtacatagattagcgtgtccaagttaaccggttttgggctgatcaatgatcataaataaagttgaagtaccgagtagtcgagtactaaagttaaacagtttttctggaccagattgagtgaactgtacttatatttcagaagaaacactaatagaaaaccagttctgacttctgagcaaaagtagaataaaattacaagctgcttctagggctgtatttttttccctaccttcctgcgttttcattggcacatgagtgcaggccatagcaacagcacatgtattttcttatgcacatagtccaatacttgactagatgctgacacgtagcgagaaacattcctggtatataccatcagcgtattctcagttccttctgcttcattttgtcaggccagcaaattgacacactgtacacgtatgcttttgttttttaatttttattttgatgttttggggggactatgtatgtgaagttggtggagacctacacaagagcctttcacctctggtttgatctaagccgcattaggctccaagatcaggacagttttgcatgcataggccatgaaggcagggcccacccattctctattctccactgataatctcttccgtctccgcctcctcattgtgtgtatataagacacaatgtggagagcacgaaccaaggcaatccttacggtagatagcaactacgatggagaccatgtcatatccttgttcccctcttctctccttccctacacatgaagagaataactttgtcctatggtctcctcaagtagccctccatgaggacgccaccatccatgttgatccttccactcatcagctacatgattgtgggttcttggacaccatggctcttgattattctaacgactggcatcgtcaagatgcttctgatgtcggtatgttcatcgattgtgatgagcggattctgggccaggagaacggcggcttgatggcgatccaagaggagctcatggaggagaacagtttaactgatctccttctcactggtgcagaggcagttgaggcgggggattcaagacttgccacggcagtgttctcgaggcttgatggcctcctccttggcatccctgaaaatgcagcagtcggctcttttgatcgcctggcataccactttgcccaaggtctgcggtcccggctctccagtgcaaacaccaggtgccctccgccagagccactgccatctgatagaatgtcagtgcagcagattatacaagagctgtcgcctttcgccaagttcgcgcacttcactgccaaccaggccattctagatgccaccaagggcgactcggatgtgcacgtcgtcgacctgaacatcggcgagggtgtccagtggccatcactcatgtcagaccttgccagccatggtgggaggtcattccacctcacggcgatcataacagatgctgactacagctatgacgttcaccaggcatctgcgcggcggctctcggagtttgccgactccttgaaacttcccttccagtacaactctctccgtatacacagtgatgaagacctgcatgatttctccaaaagctgtaacggcccagtgatcttctcatgcgacacgacaagtatgacttacaagttgctggggaagttacggacaatcctacctggctgtgttaaaatgttaagacctaagttaatggtcatcgttgaagaggagctggttggaatcggaaaggaagcatctgtatgtaacacctccttcgtcgacttcttcttcgaggcactgcaccacttcaccactgtgtccgagtcattggctagctgcttcagtggtggtaatcatgggttgtgcctgagacttgtggagagggacatggtggggccaaggatacaagacttcgtggagcactatgggcctgtgacacttgagccaaatgctcctggggttttggaaaggtatggggcttgtgagatgagcgcttctaatgttgctcaggcaaggatgctggttgggttgttcaatagggggtttggggttgtgcatgagaagggcaggcttgtgttgtgctggaagtccagggcgttgacctctgtgtctgtttgggctccaatctgaaaagaaaggggcttatgatgttctttatttattttttgttgtaagagttcgcaatgacgagttttgaggaaaatttatttggttggtgagacacattatttggttcctatgtcagttttctttcttgatgctcttgtcattatcatatatctcctaggaaaacttacagtgatgaatgaagtcaagtaaccagtggagaataaaatttgctcttgccaatcgtatgagccgtgtggatttttctgcaggagtgcttgagattgatcttgatttttgttttcctcttatgaacaaggtgtgacctgtgcaaatagacagagaggatggcctcgcgaaagaa

SEQ ID NO: 208 - DNA, 1815 bp, Panicum virgatum
cgggcgtaggcttctgttagtagtggtgaactggtgaagcttataaaaccttctgttccgtatggaaaggcgaaagcgtcgctagctgggtcagcgctctctctctcgctctcccttccagcggtcgcctcacctcgccgcctctccgctatatatcagggctctcgctttgttcgagggtccatcagtttcttcctctcctcctcgccaagccggtaccctctcttcagctacctcctgcagcagctgccagccagttcctgaaaagaacagttgatcgatttgctggtagtgggatcagatcgtacagctgcgaagcagagtctcctcaaaaaaaaaatcagaagcggagagctagtagctcatctagcctgcagctgaggaacatgaggaacatggcagagaagaggagacatggaggagggcatcatgtccatggtgttgggtttggagccggagttggacatgccgagcacgacgagaagcgcatggagccaaagaagctggacatgagcggcatgtccatggacaccatcccacatctcagcatgcctcttggcagcatcactaccttggatctctccaacaacaacctacagagtattccggagtccataatcgcgaggcttctgaacgtggtggtgctggacgtgcggtccaaccagctgacatcgctgcccaactccatcggctgcctctccaagctcaaggtcctcaacgtctccggcaacctcctccgcgacctgcccgccaccatcgaggaatgccgggcgctggaggagctgaacgccaacttcaaccagctgacgaagctgccggacacgctggggttcgagctccacggcctccgccgcctctccgtcaactccaacaagctggcctacctgccgtcgtccacctcccacatgacggcgctgcggtcgctggacgcgcggctcaactgcctccgcgcgctgcccgacgggctcgagaacctcggcggcctcgaggccctgaacgtgagccagaacttccagtacctacgggagctcccctacggcatcggcctcctcacctcgctccgggagctggacgtcagctacaactccatcgccgcgctcccggactccatgggctgtctcaccaagctctcccggttcagcgccgcgggcaacccgctggtgtccccgcccatggacgtcgtcgagcagagcctcgacgccatgcgcgcctacctcagcgcgcggatgaacggcaccgacaagcaggacaggaggaagaagaagagctgggtgcccaagctggtcaagtacagcaccttctcggcggggatgatgacgcccggccgcgccaccaaggtgcacggcagcggcgccgagggcctgctcatgtcggactaccggtcgctcgacggcggcggcatcgcctcgccggggttcctcagcatgctgtcgccgcggcggctcttctcgccgcggaggaactcgcccaagcatcattgataaattacttggcatgtgtgcacctgcctgcctgcttgctgcttcgtgtgtgcagatagaacatgcatgctcctcgtattgtagcgtgattaagctgatgctgttgctactgcagatgtagtatatgttttttttttgaagagatacatgcatataaagcgtgtacagagtagtagtgggatagggcattcatgacttgatgtacataagaattaagggtgtccatttctcttttttcttgtttctcggttacttgagcgtaatgcttatggaagcagtattttggagcagttgtagcatttacatgctgaatgacctaagtgttccagttttt

SEQ ID NO: 209 - DNA, 2011 bp, Panicum virgatum
ccagtagcgttgagattcacacatctctccacaatttccctggcatcccacgcggttgaccctgccgagatttaacccggccgccgcccagatgggcgagtgatatgtagagagagagagagagagaggtacgtacggaagtaccgtgggcggcggccgggctcgggtgcgcgcgcgtataggcttgtgttttatttgaaagggcgtagggccaaagcttagaaccttcctgctagctggaggagtacctgcacactgtatcgtgtggaaaggccaaagaaagcgtcgctagctgggtcagctctctcgctttctcgtcccatctcaccgcccctccgctatatatcagagggctctcgctttgttcgagggtcagttccccctcgcctagcccgtaccctctctttagctacctcctgcagcagccgccaacaagttcctgatcgagaagaacacttcggagtagtgttcagagaagcgtagagctagtaggtcatatctagctatctagcagctaaggaacatgaggggcatgggagagaagaggagacatgggggagggcatcatgtccatggtgttgggtttggagccggaggaggagttggacatgccgagcaagacgagaagcgcagggagccgaagaagctggacatgagcggcatgtccctggacagcatcccgcatctcagcatgcctcttggcaacatcactaccttggatctctccaacaacaacctacagagcattccagagtccataatcgcgaggcttctgaacgtggtggtgctggacgtgcgctccaaccagctcacgtcgctgcccaactccatcggctgcctctccaagctcaaggtcctcaacgtctccggcaacctcctccgcgacctgcccgccaccatcgaggaatgccgtgcgctggaggagctgaacgccaacttcaaccagctgacgaagctgccggacacgctggggttcgagctccacggtctccgccgcctctccgtcaactccaacaagctcgcctacctgccgtcgtccacctcccacatgacggcgctccggtcgctggacgcgcggctcaactgcctccgcgcgctgcccgacgggctcgagaacctcggcggcctcgagaccctgaacgtgagccagaacttccagtacctgcgcgagctcccctacggcatcggcctcctcgtctcgctccgggagctggacgtcagctacaactccatcgccgcgctcccggactccatgggctgcctcaccaagctcgcccggttcagcgccgcgggaaacccgctggtgtgcccgcccatggacgtcgtcgagcagagcctcgacgccatgcgcgcctacctcagcgcgcggatgaacggcaccgacaaggacaggaggaggaagaagtgctgggtgcccaagctggtgaagttcaacaccttctccgcggggatgatgacgcccggccgggcgaccaaggtgcacggcaacgccgagggcctcctcatctcggactaccggtcgctcgacggcggcatcgcgtcgccggggttcctcagcatgctgtcgccgcggcggctcttctcgccgcggaggaactcgcccaagcatcattagtagtaagcattacatgtgtgcagtgtgctcttctccgtcacgtatagcctgcctgcctgcctgcttgctttgctgcttcgtgtgtgcagatgacatgctcgctcctcgtattgtagagtgattaagctgatgctgttgctactgctgtactgcagatgtagtatatgttttgaagagatacatgcatataaagtgtgcacagtagtagtgggatagggcattgatgtacataagaattaagggtgcccatttcttcttcttttttctcggttatttgggcacaatgcttacgaaagcagtattttggagcagttgtagcgtttacatactgaatgacctcagtgttaagttttattggtactctccactcggcttatcagccaaatttgaaaatct

SEQ ID NO: 210 - DNA, 1583 bp, Zea mays
agggctctctcgcttggctcaaggctcaccttctccttcctctcgcctagcctgcctcgctcctccgttcaggcaggctttcagctaccgccgcgcggccgcgaccggcggcctcctttagcggctacgtacgacgtatataccgggcaggcgggcaccggccacggccaacgctagctgctgccaggttgctggaaagagcagctaagagagataattcaggagtgggatcgagacgacatgagggacatgggagagaagaggagacacgggcatggacatggacatggacatcttgttgggtttggagctggaggggttgttggacatgccgcagagcatgaggagaagcgcatggagcagaagaagctggacatgagcagcatgtccatggacaccctgccacatctcaccacgcctcttggcaacatcactaccctggatctctccaacaacaacctacagagcattccggagtccataatcgcgaggctcctgaacgtggtggtgctggacgtgcgctccaaccagctcaagtcgctgcccaactccatcggctgcctctcaaagctcaaggtcctcaacgtctccggcaacctgctccaagaactcccggccaccatcgaggaatgccgtgcgctggaggagctgaacgccaacttcaaccagctgacgaggctgccggacacgctgggcttcgagctccacggcctccggcggctgtccgtcaactccaacaagctcgcgtacctgccgtcgtccacctcccacatgacggcgctgcggtcgctggacgcgcgcctcaactgcctccgcgcgctgcccgacgggctggagaacctcggcggcctcgaggcgctcaacgtgagccagaacttccagtacctgcgggagctgccctacggcatcggcctcctcgtctcgctccgggagctggacgtcagctacaactccatcgccgcgctcccggactccatgggctgcctcaccaagctcgccaggttcagcgccgcgggcaacccgctggtgtgcccgcccatggacgtcgtcgagcagagcctcgacgccatgcgcgcctacctcagcgcgcggatgaacggcaccgccaaggccaagaagaagagctgggtgcccaagctggtcaagtacagcaccttctcggcggggatgatgacgcccggccgcaccaaggtgcacgggaacaacaccgacggcctccacatgtcggattaccggtcgctcgacggcggcggcgttgcgtcgtcggcgtttctcagcatgctgtcgccccggcgtctcttctcgccgcggagaaattcggccaagcactagtagcttagcagtggccactggttcggcgggctatacatgtgtgctccctccttattgctggctatttgcttgctgcttcgatgttcatatgacatgcacgtactgtagcgcaagctgaagctaatgatcttgctactgcagttgtatatgctttgaagagaggtatatatgaagtgtgtatagtagcacgtagtgcaatagggcattaatgtacataagaattaagggtgtctttctttccattgtttaca

SEQ ID NO: 211 - DNA, 1820 bp, Sorghum bicolor
ggagtagtacaacctgcactacgcactgtaccgtgtggaaaggccgttgggtcagcttcttgctgtcccttcggttccgttccgttccgttccatcggttgccagctctctctcggctccctcctgctatatatcagagggttacgcttggctcaaaggctcagcttctccttcctcgccaacgcctagcagcctgcctcacgcgcgcccttccgttcagcaaccaccgccggccgaccagttgcctccttcggcagctatacgtaccagccacaggccatagctgctgcaaggtcgttcctggaaattaagagcagttcaacttcagagaggagtggagaggaaaagcttgctccgagacatgagggatatgggagagaagaggagacatgggcatggacatggacatggacatggccacggccatcttgttgggtttggagtcggaggggttggacatgcagagcatgaggagaagcgcatggagcagaagaagctggacatgagcggcatgtgcatggacaccctgccacatctcaccacaccccttggcaacatcactaccttggatctctctaacaacaacctacagagcattccggagtccataatcgcgaggctcctgaacgtggttgtgctggacgtgcggtccaaccagctcaagtcgctgcccaactccatcggctgcctctccaagctcaaggtcctcaacgtctccggcaacctgctccaagaactgccggccaccatcgaggaatgccgcgcgctggaggagctgaacgccaacttcaaccagctgacgaggctgccggacacgctgggcttcgagctccatggcctccggcgtctgtccgtgaactccaacaagctggcgtacctgccgtcgtccacctcccacatgacggcgctgcggtcgctggacgcgcgcctcaactgcctgcgcgcgctgcccgacgggctggagaacctgggcgggctggagacgctgaacgtgagccagaacttccagtacctgcgggagctgccctacggcatcggcctcctcgtctcgctccgggagctggacgtgagctacaactccatcgccgcgctgccggactccatgggctgcctcaccaagctcgccaggttcagcgccgcgggcaacccgctggtgtgcccgcccatggacgtcgtcgagcagagcctcgacgccatgcgcgcctacctcagcgcgcggatgaacggcaccgccaaggccaagaagaagagctgggtgcccaagctcgtcaagtacagcaccttctcggcggggatgatgacgcccggccgcaccaagaacaacagcaccgacggcctccacatgtcggattaccagtcgctccacggcggcggcatcgcgtcgccggggttcctcagcatgctgtcgccacggcgtctcttctcgccgcggagaaattccaccaagcactagctagtagcttaattagtacgtacgtagtggtcactctggtccccggcgacggcgagctatacattatgcatgtgtgctgcctgcctgtttgcttgctgcatgattcgagtgttcatcagatgtgctatgctcgtattgtagcacaagctaaagctactgatcttgctactgcaggtgtatatgctttcaattgaagagaggtatttctgaagtgtgtatagtagtacgtagtgcaaatagtagggcattgatgtacataagaattaagggtgtccttttttttcttttctttttacatgtgcactaatgcttatgttggagtagtcttaatttttgaaggaaatataattgttcatccacagtccaa

SEQ ID NO: 212 - DNA, 1502 bp, Oryza sativa
acaccatacatcccgcgccttcttcctcctcagctttgccgagacctcgttgcctcaagccgtgttgcgtgctgcatgctctgaattgaagaactctcttgagcctgaccaggtatatcagaagtggagaagaagattggaagcatgagggaaatgggagagaagaggaggcgtggacaccttaaccctgctggttttgcaggagggttgcatgatcatgaggagaagaagaacgaggagcataagctagacatgagtggcatgtccatggatgccctcccacacctcaccatgtctcttggtcaagtcaccatcttggatctctctaacaacaatcttgagagcatcccggagtcaataatcgctcggctgctgaacgtggtggtgctggacgtgcggtccaaccagctgaaatcgctgcccaactccatcggctgcctctccaagctcaaggtcctcaacgtctccggcaacctgctcgagtccctccccaacaccatcgaggagtgccgtgcgctggaggagctgcacgccaacttcaacgagctgacgaagctgccggacacgctggggttcgagctgcacagcctccggaagctgtcggtgaactccaacaagctggcgcagctcccctcctcgacgtcgcacatgacggcgctcagggcgctggacgcccggctcaactgcctccgcgcgctccccgacgggctcgagaacctcgccaacctcgaggcgctcaacgtcagccagaacttccagttcctccgggagctcccctacgccgtcggcctcctcgcctcgctccgggagctcgacgtcagctacaactccatcgccgcgctcccggactccatgggctgcctcaccaagctcgccaggttcagcgccgtcggcaacccgctggtgtccccgcccatggacgtcgtggagcagggcctggacgccatgcgcgcctacctcaccgcgaggatgaacggcggcgacggcaagaggaagaagaaggcgtggctgcccaagctggtcaagtacagcaccttcacggcgaggatgacgcccgggcgcaccagggtgcacgagaacacggagggcctcctcatgtcggactaccggtcgctcaacggcatcgcctcgccgaggttcctcaccatgctctcgccgcgccgcctcttctcgccgcggaggaattcgcccaagcattgttgatatggccgatccgatccgcctctgcctactctgtgtactggttgcctgtttgcttcaggggtgtacttcagatgatgtcatgctctcgtacttaattaggatagatatgatgatgctgctgctgctagctgctaccgctgctgcaaggtgtgtatatgttctcatgaagaggtttgtagcttcgcatacagtatatagctctacaatttttgtttgacgtaaaaaatgctgtagtacaatctagagcattgatgtacataacaagggtaattttcttccatgtctgtttgttaagcacc

SEQ ID NO: 213 - DNA, 941 bp, Triticum aestivum
cgcaaccggcctcgcttaggcgcttgcttctatttaaagggcatggcagcagacaccacagcaacccaaaccccgctaagcatcagcattcagcagcaccagccttctacctcctctgctttgcattccgccttccagttccaattccaaccgcaatcaatggctgccatgaagatcgccctccttgccgtggccgcgatggccgtcttgctaggcaccgcgtcagcggtaacctacaacgtcggcgatcagggcggttggaccctcagcaccgactacagcagctgggtgtccggcaagaagttcaacgtgggtgatgagatcgtcttcaagtactcgaccccaacgcacgacgtggtcgaggtcagcaaggccggctacgactcctgcagcatcgacggcgccatcaacaccttggcctccggcaacgacgtcatcaccctcaacgccaccggcacccggtacttcatctgtggcgtccctaaccattgcagccccaccgccgccgccagcatgaaggtcgtgatcaacgtcgcctcgggctcctcctcgccgtcgtcacccatgccagctgcaggtcctggcgcgagcaactctcccccggcgccgccctccaacgccgctacctccgtcggtgccacagcaggatttggcctcgtcgccctactggcggccggtctcatggcttgaacgcatatattgatcagctgccgcgcgcacatacgagcttttatattgttaactactatactgtagttattatcacgggtgaatacatgtattcttttttagagcgagaatgtgatagttacttgtatctatcacgtctatatgtaatctgcaggccttcatgtctttttatataatgattctagactattattttaaaaaaaaaaaaaaaaaaaacctcggccgcgaccacgctaatcactagtgaattc

SEQ ID NO: 214 - DNA, 2236 bp, Triticum aestivum
tctcccctacggatacatcgccgacgacccaagcaagcaagccgccagcagcaacaaaccaacccaacccaatccctgccggccaaactccaaacttccaaagccatgggcacctacaagtgctgcctcgtcttcaagcgccggtaccgctggacggacgcgccgccgccggacgacgtgcgggcgctcttcgccgtgcactccggcggggcagccaccatgggcgccgacggcctgcgccgctacctcgagtcctccgaccccgacgccgccgacgacgccgagggcgaggcggaccgcctgctggaccagatccgcctgcagggacaccagcaccagcgcgccggcccgcgcctcccgcgcctcggccgcggccagctgctcggcctcgacgacttccaccgcttcctcttctccgccgacctcaacccgcccgtccgccggccccaggtccaccacgacatgtcccagcccctctcccactactacgtctacacgggccacaactcgtacctcaccggcaaccagctcagcagcgactgcagcgacgtccccatcatcaaggccctgcagcgcggcgtccgggtcatcgagctcgacatgtggcccaactccgccaaggacgacatcagcatcctccatggcaggactttgaccaccccggtttcgctgctgaaatgcttgaaatccatcaaagaatatgctttcgtcgcgtctccctacccggttatcatcacactcgaagaccaccttacacccgagctgcaggacaaagttgccaagatggtccttgaagtgtttggcaccatactgtactaccctgaagaagaacatcccaaagagctcccttcacctgagtccctcaagggtcgcgtgctcctatcaacaaagcccccaaaggagtaccttgaagccaaggatggtggtgccgcgaaagacggtgatgcggagcagaatcctggcaaaggaactgacgatgatgcggcttggggaacagaagtcccagatttcaagactgaaatccaatctgctaaacaggaagatgatgcctctgagaaccgtagagacggcgatgaggacgacgacgatgaggacgaacagaaaatgcaacagcatctagctccacagtataagcgccttattactataagagcaggaaagccaaaggggggtactacgtctgatgccttgaagtgtgacccgaacaaagttaggcggctcagtttgagcgagcaacagcttgccaaagctgtagttaatcatggcaccgaaatagtgaggtttacacagaggaatctactgaggatatacccaaagggcactcgggttacttcatccaactacaatccatttattggttgggtgcatggtgctcagatggtagccttcaatatgcagggatatggaagagctctttggttaatgcatggattttataaagccaatggtggctgtggctacgtgaagaaaccggatttcttgatgcagtccgagccggaagttttcgatccaaaaaagcctcagcctgttaagaaaaccttgaaggtgaaagtgtacatgggagatggttggcggatggacttcaagcagactcactttgaccaatattctcctccagatttttacgcacgggtcgggatcgccggcgtcccggcggactcggtgatgaagaagaccaaggcggtggaggacaactgggtgccggtgtggggggaggagttctcgttcgacctgacggtgccggagctggcgctgctgcgggtggaggcgcacgagtacgacatgtcggagaaggacgactttgcggggcagacggtgctgccggtgtcggagcttcagcccgggatccgcgcggtggcgctgttcgaccgcaaggggaacaagctccccaacgtcaagctcctcatgcgctttgagtttgtgtgatttggaatggtttggtttggtttgagagatgatggcgtgtcggcggccatggttggtacttggtgctcgtgcattctttgttcatcctgtacatacgtgatgcggtctgtgtgaatacggagtgtacggttgtatatgtgagtcagttgtgtagacacgagaattcatcaaccctgtatttgttgtgagtggcgtaataaggtattttaccatcacgtttgttgtcagtggaaataaggtacgtacgtgattagttttgtgttaactcttttgaaatatttcatagccagaaaagatttgaattcaaggt

SEQ ID NO: 215 - DNA, 2039 bp, Secale cereale
ccaatccaatccaatccagccctcgccggcgagaccgccggcgccatgggcacctacaagtgctgcctcatcttcaagcgccggtaccgctggacggacgcgccgccgccggacgacgtgcgtgccctcttcgccgagcactcgggcggggcggccaccatgggcgccgacggcctgcgccggtacctcgagtcctccgcgggcggcgaccacgacgccgccgacgccgacgccgagggcgaggcggaccgcctgctggaccagatccgcctgcaggggcaccagcagcgcgccggcccgcgcctcccgcgcctggggcgcggccagctgctctccctcgacgacttccaccgcttcctcttctccgccgacctcaacccgcccgtccgccgggcccaggtccaccacgacatgtccgcgcccctctcccactactacatctacacgggccacaactcgtacctcaccggcaaccagctcagcagcgactgcagcgacgtccccatcatcaaggccctgcagcgcggcgtccgggtcatcgagctcgacatgtggcccaactccgccaaggacgacatcagcatcctccatggcaggactttgaccaccccggtttcgctgttgaaatgcttgaggtccatcaaagagtacgctttcgtcgcgtctccctacccggttatcatcacgctcgaagaccaccttacaccggagctgcagggcaaagttgccaagatggtccttgaagtgtttggcggcatactgtactaccctgaagaagaacatcccaaagagctcccttcacctgaattcctcaagggccgtgtgctcctatcgacgaagcccccaaaggagtaccttgaagccaaggatggtggcgccgtgaaagatggtgatgcggagcagaatcctggaaaaggaggaactgacgatgatgcggcttggggaacagaagtcccagatttcaagactgaaatccaatctgctaaagaagatgatgccgcagagcaccataaagatgatgatgaggacgacgatgatgatgaggacgaacagaaaatgcaacagcatctagctccacagtataagcaccttattactataagagcaggaaagccaaaggggggtactacgtctgatgccttgaagtgtgacccgaacaaagttaggcggctcagtttgagcgagcaacaacttgccaaagctgtagttaatcatggcaccgaaatagtgaggtttacacagaggaatctactgaggatatacccaaagggcactcgggttacttcatccaactacaatccatttattggttggttgcatggcgctcagatggtagccttcaatatgcagggatatggaagagctctttggttaatgcatgggttttataaagccaatggtggctgtggctacgttaagaaaccggatttcttgatgcagtctgagccggaagtttttgatccaaaaaagcctcaacctgttaagaaaaccttgaaggtaaaagtgtacatgggcgatggttggcggatggacttcaagcagacacactttgaccagtattctcctccagatttctatgcacgggtcgggatcgccggcgtcccggcggactcggtgatgaagaagaccaaggctgtggaggacaactgggtgccggtgtggggggaagagttcctgttcgacctgacggtgccggagctggccctgctgcgggtggaggcgcacgagtacgacatgtcggagaaggacgactttgcggggcagacggtgctgccggtgtcggagctgcagcccgggatccgcgcggtggcgctcttcgaccgcaaggggaacaagctccccaacgtcaagctcctcatgcgctttgagtttgtctgatttggtttgagagatgtggtgtgttggtactctctgcattctttgttcatcctgtacatatacgatgcgtggtggttctgcctgtgtgaatatggaggtgtaccgttgtactatatgtcagtcagttgtgcagacacgagaattcatcgatcttgtatttg

SEQ ID NO: 216 - DNA, 2069 bp, Lolium multiflorum
cagcccagccaagctaactccggccgtcagccatgggcacgtacaagtgctgcctcatcttcaagcgccggtaccgctggacggacgcgccgccgccggaggacgtgcgctcgctcttcgcgcagcactcgggcgggacggccaccatgggcgccgacggcctgcgccgctacctcgagtccaccggcaccgacccggacttcgacggcgacgccgaggccgagcgcctgctcgaccagatccgccaggcccagcgcgtgcgggtcccgcgcgtggggcgcccgctcctgggcatcgacgacttccaccgcttcctcttctccgacgacctcaacccgccgctccgccgcccgcaggtccaccacgacatggccgcgccgctctcccactactacgtctacacgggccacaactcctacctcaccggcaaccagctcagcagcgactgcagcgacgtgcccatcatcaaggcgctgcagaggggcgtcagggtcatcgagctcgacatgtggcccaactccgccgaggacgacatcaacatcctccatggcaggacattgaccaccccagtttcactcctcaagtgcttgaggtccatcaaagagtatgctttcgtcgcgtcgccttaccctgttatcataacgctcgaagaccaccttccacctgaactccaggacaaagttgccaagatggtcctcgaagtatttggcaacatactctattaccctgaagaagaacatcccaaagaactcccttcaccggaagaactcaagggccgtgtcctcctgtcgacaaagcccccaaaggagtaccttgaagccaaggctggtggtaccatcaaagatggtgacacagaagcgaatcccggcaaaggaggaactgacgacgatgcggcttggggaaaagaagtccctgattttaagactgaaatccagtttgctaaacaggaagatgatgccttagatgatgacgatgaggaggaggacgaacagcaaattcagcagcatctagctccacagtataagcaccttattactataagagcaggaaagcccaagggtggtactacgtctgatgccttgaagagcgacccaaacaaagttaggcggctcagtttgagcgagcaacagcttgcaaaagctgtagttaatcatggtaccgaaatagtgaggtttacacagagaaacctactgaggatatacccaaagggcactcggattacttcatccaactataatccgtttattggctgggtgcatggtgctcagatggtggccttcaatatgcagggatatggaagagcactttggttaatgcatggattttataaagccaacggtgcatgtggctacgtgaagaaaccagatttcttgatgcaatctgaaccagaagtttttgatccaaagaaaactcaacctgttaagaaaattttgaaggtaaaagtgtacatgggagatggatggcggatggacttcaagcagacgcactttgatcaatactctcctccagatttttatgcacgggttgggatagccggtgttccagcggactctataatgatgaagacaaaggcgatcgaggacaactgggtgccggtgtggggggaggagttctccttcgagctgacggtcccggagctcgcgctgctccgcgtggaggtgcacgagtacgacatgtcggagaaggacgacttcgcggggcagaccgtgctgccggtgtcggagctgcagcccgggatccgcgcggtggcgctctgcgaccgcaaggggaacaagtaccccaacgtcaagctcctcatgcgcttcgagttcgagtcggtctgatctggtttggtctgagaaagctgagagacggcatgttggtgtttgtgcattctttgttcattctgtacatatgtgaatgtgcggtggtggtgccgtctgtgtgaatatgcgatgtgctgttggtgtgtgtctatgtcagttgtgtgtgtttgtgcataggcacaacgattcatgagactctgttcatgtgttgtgaatgaacaaataataaaaggtgattgttttcaccatcatccgttaacagca

SEQ ID NO: 217 - DNA, 1946 bp, Lolium multiflorum
tcctcctcctcacttctctctctacgtatacccagccaagaaaagcagagcacccagcaccagcccagccaagctacctccggccgtcagccatgggcacgtacaagtgctgcctcatcttcaagcgccggtaccgctggacggacgcgccgccgccggaggacgtgcgctcgctcttcgcccagcactccggcgggaccgccaccatgggcgccgacggcctccgccgctacctcgagtccaccggcaccgacccggacttggacggcgacgccgaggccgagcgcctgctcgaccagatccgccaggcccagcgcgtccgggtcccgcgcgtggggcgcccgctcctgggcatcgacgacttccaccgcttcctcttctccgacgacctcaacccgccgctccgccgcccgcaggtccaccacgacatggccgcgccgctctcccactactacgtctacacgggccacaactcctacctcaccggcaaccagctcagcagcgactgcagcgacgtccccatcatcaaggcgctgcagaggggcgtcagggtcatcgagctcgacatgtggcccaactccgccgaggacgacatcaacatcctccatggcaggacattgaccaccccagtttcactcctcaagtgcttgaggtccatcaaagagtatgctttcgtcgcgtcgccttaccctgttatcataacgctcgaagaccaccttccacctgaactccaggacaaagttgccaagatggtccttgaagtatttggcaacatactgtattaccctcaagaagaacatcccaaagaactcccttcaccggaagacctcaagggccgtgtcctcctgtcgacaaagcccccgaaggagtaccttgaagccaaggctggtggtaccatcaaagatggtgacgcagaagcgaatcccggcaaaggaggaactgacgacgatgcggcttggggaaaagaagtccctgattttaagactgaaatccagtttgctaaagaagatgatgacgaagatgatgatgaggaggaggaggacgaacagaaaattcaacagcatctagctccacaatataagcaccttattactataagagcaggaaagcccaagggtggtagtacgtctgatgccttgaagagcgacccaaacaaagttaggcggctcagtttgagcgagcaacaacttgcaaaagctgtagttaatcatggtaccgaaatagtgaggtttacccagagaaacctactgaggatatacccaaagggcactcggattacttcatccaactataatccgtttattggctgggtgcatggtgctcagatggtggccttcaatatgcagggatatggaagagcactttggttaatgcatggattttataaagccaacggtgcatgtggctacgtgaagaaaccagatttcttgatgcaatctgaaccagaagtttttgatccaaagaaacaacaacctgttaagaaaattttgaaggtaaaagtgtacatgggcgatggttggcggatggacttcaagcagacgcactttgatcaatactctcctccagatttttatgcacgggttgggatagccggtgttccagcggactctataatgatgaagacaaaggcgatcgaggacaactgggtgccggtgtggggggaggagttctccttcgagctgacggtcccggagctcgcgctgctccgcgtggaggtgcacgagtacgacatgtcggagaaggacgacttcgcggggcagaccgtgctgccggtgtcggagctgcagcccgggatccgcgcggtggcgctctgcgaccgcaaggggaacaagtaccccaacgtcaagctcctcatgcgcttcgagttcgagtcggtttgatctggtttggtctgagaaagctgagagacggcatgttggtgtttgtgcattctttgttcattctgt

SEQ ID NO: 218 - DNA, 2116 bp, Brachypodium distachyon
tcttcgtcttcctcccgacgtctcactctccctctcccttaagtacaacccaaccaaccacctagcttccaatcctcgctcgccaggcaccaaggccatgggcacgtacaagtgctgcttctgcttcaggcgccgctaccgctggacggacgcgccgccgccggacgacgtgcgctccctcttcgcccaccactccggcggtgccgccaccatgggcgccgacggcctccgccgctacctcgagtccaagggcaccggcgccgaagacgacaattctgaggccgccgccgaccggctcctcgaccagatccgccacgggcagcggggcgcgcgcatcccgcgggtggggcggccgctcatcgccctcgaagaattccaccgcttcctcttctccgacgacctcaacccgcccatccgccgcccgcaggtgcaccacgacatgaccgcgccgctctcccactacttcatctacacgggccacaactcctacctcaccggcaaccagctcagcagcgactgcagcgacatccccatcatcaaggcgctgcagaagggcgtcagggtcatcgagctcgacatgtggcccaattccaccagggacgacatcaacatcctccatggcaggacattgaccactccggtctcactgttgaaatgcttgagatccatcaaagagtatgctttcgtcgtgtcttcctatcctgtcatcataacactcgaagaccatctcccacctgatctccaggacaaagttgccaagatggtccttgaagtgtttgcgagcatactgtactaccctgacacagaacatatcaaagaactcccttcacctgaagacctcaaaggccgtgtcctcctttcgacaaagcccccgaaggagtacctcgaagcaaaggctggtggtaccatcaaagacggtgatgcggatcccaatcttggcaaaggagctggcgaagatgccgcttgggggaaggaagtcccagattttaagactgaaattcaatctgccaaacaggaagatgatgtgtcagagcatcacagggatgacgacgacgaagacgacgatgatgatgaggaggaacagaaaatgcaacagcatctagctcctcagtataaacaccttattactataaaagcaggaaaaccaaagggtactacggccgatgccttaaggtgcgatccagacagagttaggcgactcagtttgagcgagcaagaacttgcaaaagcggtagttcatcatggcactgaaattgtgaggttcacacagaggaacctactgaggatatacccaaagggaactagggtcacttcatccaactataatccatttcttggttgggtgcacggtgctcagatggttgccttcaatatgcagggatatggaagagccctttggttaatgcatggattctacaaagccaatggtggctgtggatatgtgaagaaaccggatttcctgatgcaatctgacgttttcgatccaaaaaaacgccaacctgttaagaaaaccttaaaggtgaaaatatacatgggcgatggttggcggatggacttcaagcatacacattttgatcagtattctcctccggatttttatgcacgggttgggatagctggagttccagcagattcggtgatgaagaagaccaggacaatagaggacaactgggtgcctgtgtgggaagaggagttcgccttcgatctgacggtcccggagatcgcgttgctccgagtggaggtacacgagtatgacatgtccgagaaggacgactttggcgggcagactgttctgccggtgtcagagctgcagcctgggatccgggcagtggcactcttcgaccgcaaggggaacaagttcaacaacgtcaagctcctcatgcgctttgagtttgtttgatgagatttggcttttagagacgacgatcatgcggcggcccagtgttctgttatgtgcattcttattgtgtacatatattttcagtgtgaatatgcatgtactaccaatgtatttgtcagcttgtacataagactctgtttgcaataatttattgtgttgtgagagcaataaaaactgatttgcaagtgtggaaaagaaagaaggattaagttggtc

SEQ ID NO: 219 - DNA, 2463 bp, Setaria italica
aattacttcaaattggttatgcttatatatatcatgcatgttggaaatgatttcggttccagatttgcaatatatggttggttgtgccagggcaagcggaattgaagcagctaatggatgctgctggtgccttcctttggatggtgatgcatattattcattatgatgtcgacggacaactgagtcgcatcaagcacaaaaacacaagtagtagaacaacacaagtgcattgtggatttgtgcagactcaaaatggtaaagaaaaaggaagctttgaagagaaaataaagaaagaggaggggaaaaggacggtttggtagttactactccttatagcgctgagtcagacgcgtcccctcccgtccccttcccttcccttcccttcccccgcttctcctcccaggctccagcctccaggcctcctcccccatcaagtcaagaacaaggaaagctgcaggcacgcaatcatgggcaccacctacaagtgctgcctcatcttcaagcgccgcttccagtcccgggacgccgccccgcccgacgatgtccgcgccctcttcaacctccactccggcggcgggacccacatgggcgccgacggcctgcgccgctacctcgacgccacggaggacgcgctggacgacggcgaggtcgaccgcctgctcgaccagatccgtatccagcagcagcagggccgcgcccgcctcccccgcctctcccgcccgctgctcgcgctcgacgacttccaccgctacctcttctcccacgacctcaacccgcccatccgacgcccgcaggtgcaccacgacatgtcccacccgctctcccactacttcatctacacgggccacaactcctacctcaccggcaaccagctcagcagcgactgcagcgacgtccccatcatcaaggcgctgcagaggggggtgagggtcatagagctcgacatgtggccaaattcagcaaaggacgacatcaacatcctacacggcaggacattgaccaccccagtttcactcatcaaatgcctgcggtccatcaaagaatatgcctttgtggcgtccccctatcctgtcatcataacgctcgaagaccaccttccggctgacctccaggcaaaagttgccgagatggtccttgaagtatttggcaacacactcttctaccccggaaccgatcatttcaaagaattcccatcacctgaagagctcaagggccgcgtcctcctctccaccaagccccccaaggagtaccttgaagccaaggttggcaccatgaaagagggtgacgctgacccacatcctggcaaaggagctgctgatgatgccgcgtggggaaaagaagtaccggattttcagactgagattcagtctgctaataagcatgatgatgatggctcagatcaccaaagagatgacgaagaggacgacgacgacgatgacgacgaggaacagataatgcatcctcattcagctccacagtataaacagcttattactattagagcagggaagccaaaaggctctctggctgctgccttgaacagtgatccagataaagttaggcgtctcagtttgagcgagcaacaacttgccaaactggcagaggatcatggaactgaaattgtgaggttcacacagagaaacatattgaggatataccccaagggaactcgtgttacttcatccaactacaacccatttcttggttgggtgcatggtgctcaaatggtggccttcaatatgcagggatacggaagagccctttggctaatgcatggattttataaagccaatggtgggtgtggttatgtgaagaaaccagatttcttgatgcagacagaaccagaagtgtttgacccaagggaacgccaacctgtgaagaaaaccttgaaggtcaaggtgtacctgggtgatgggtggcggatggactttaagcagacacactttgatcagtattctcctccagatttctatgcgcgggttggcatagctggagtcccagcagactcgatgatgaagaagaccagggcgatcgaggataactgggtgccagtatgggaggaggagttcaccttccccctgaccgtcccggagatcgctctgctacgggtggaggtgcacgagtacgacatgtcggagaaggacgacttcggagggcagacggtgctgccggtgtcggagctgcggccggggatccgggcggtggcgctcttcgaccgcaagggaaaccagtacaaccacgtgaagcttctcatgcgcttcgagtttgtctagtctgagtgccgacgccctttctgtttgcattatatgtttaatttgtgtgaatatgcataagtgattctgggagttgagtgtgctctctcatcgtttctttgtacatagattggaattggaattggattgtatggttgttctgaatccaggacgctgatcgatcactaatacctattgcgttgatccttga

SEQ ID NO: 220 - DNA, 1797 bp, Setaria italica
ccactcttcacgctttacttccactcccccgcgccctgccgtttcccgatggagactgtgttggcatctatcgccgccggcgggatggtcgcagcggccgcgctcgccgcgggggccagccgggtcgcggggcaaaaggaccgcctcaacgcacccccagctgttcctggtttacctatcattgggaaccttcatcagctgaaagaaaaaaagcctcatcaaacctttgcaagatgggcccaagtctacgggccaatatacactataagaagtggtgcatcttctatggctatcgtcaattcaactgaagttgccaaagaggctatggttgcaaagttccaatccatatctactcggaaactacccgctgcaatttcagtgctcagtcgtgacaaaaagatggttgctacaagcgaccatggcgacttccataaaatagcgaagcgctatattatgctgagcgtgctgggcgcttctggccagaaacaatttcggggcataagggacatggtgattggtaacatgttgagcaccttccacgcattggtggctaatgaccccaaagctcctgtgaacttccgggaagttttcaaggatgagctattccgcctatccttgattcaggctttaggtgaggatgtgagctcgatctacgtagaagagtttgggaaaattatatcgaaggaggaaatctaccagatcgctgtggttgacccgatgatgtgtgctcttgaggtcgactggagggagttcttcccctacctcggttggattccaaatcagagctttgacacaacagtgagtacaacagaagctagacgaactgcagtcgtacgagccttgatcgatcagcagaagaaaagaatcgcacgcggagaggctcgggtatcctatctggacttcctgctagcacagaatacactgactgatgagcaagtgacatcactgatctgggaggcaatcatagaagctgcagatactactctgtccacaaccgaatgggccatgtatgagctctccaagaaccaagaaaaacaggaacgtctttacgaggaaattcaagaggtatgcggcaatgagacagtcactgaggatgacctcccacggttaccttacttgaacgcggtgttccatgagacccttaggcgtcatccttcagtttcagtagtgcctccacgatttgtccatgaggataccaacttggctggctatgacattccagccggcacagaggtgatcgtcaacctctatggatgcaacatgaacaagaacgactgggacgagccggaggaatggaagcccgagaggtttctggatgggaggttcgagcgtgcggacaagtttaagaccatggccttcggcgccggaaggagggtctgtgctggcgccacgcaggctacgaacatctcgtgcacggccatggcgaggttcgtgcaggactttgcctggaggctcaaggaaggcgacgagggcaaggatggaaccatccagtttacgaccaacaggctttaccctttgcacgtgtacctcacaccgagaggaaggaaatgagcggcagtcctggtcaaacggttttggtaactttgctgtcgttgcctgtgtgtggcgaaatgaacttttgggatgaaaactctatgctgtgtggtaggttttcttctgtgggaaaaggtccagccatgactaagtatcgtacagagcgtggacagcacaaaacttgcatcatatatagtgaatagattaatatacaggccatgttacacatatgtttacttggttacatgaatctatactataatg

SEQ ID NO: 221 - DNA, 1868 bp, Setaria italica
gtctcatcttcagtcttcttccccgctccgccgcgctcccataccacccccaacgccaacaatctcacagcagcagggtagtcgggtccgggtcccgcatggagtccctggtggcggcgctccccttgggcggcgcagcggcggcggcggcggccgtcgggggcctgctggcggccgccgcgctagccgggagggccggcctcgtcggccccaagaacaacggctccaacgcgcccccagctgttcctggtttaccacttattggtaatcttcttcagttgaaagaaaagaaaccccaccaaacctttacaaaatgggctgaaacttatgggccaatttacactataaagaccggtgcttcttctgtagttgtgctcaattcaactcaagtagccaaagaggcaatgattgcaaaattctcatccatatctactcgaaagctgtctaaagcattgtcagtgctcacatgtgacaaaactatggttgctacaagtgactatggtgacttccacaaaatggtcaagcgttatgtcatgacaagcatgctaggtacttctggccagaaacaatttcgggacacaagaaacatgatggttgataacatgctgagcactttccacacattgttgaatgatgatccaaatgctcctctgaatttccgggaagttttcaagaatgagttattccgtttatccctgattcaggctttaggtgaggatgtgagttcagtctatgtggaagagtttggaaaggtcatatcaaaggaggaaatctaccaggccacggtggttgacatgatgatgtgcgcaattgaggtcgactggagggatttcttcccatacctcagctgggttccaaataggagctttgaaacaagagtactaactacagaaggtaggcgaacagcagtgatgcgagccttgattgatcagcaaaggaaaagaattgctcgtggagaggctaggatatcctatctggacttcctgctagcagagaatacactgactgatgaacaattgctaatgctggtgtgggaggcagtcatagaagctgctgatactactctggtcaccaccgagtgggctatgtttgagattgcaaagcacccagaaaaacaggatcgcctttaccaggaaatccaagaggtctgcagtaatgagatagttactgaggatcacctcccacggttgccttacctgaatgcagtattccatgaaaccctgaggagacattctccagttccactagtgcctccaagatttgtccatgagaacacaaacttagccagctatgacattccagccggcacagagatgatcatcaacctgttcggatgcaacatgaataagagagactgggatgaacctgaggaatggaagccagagagatttctggatgggaggtttgagtctgcagacatgtacaagaccatggcctttggcgcaggaaggagggcctgtgctggcagcatgcaggcgatgaacatctcgtgcacagccatcgcgaggtttgtgcaagagttcacctggaggctcaaggaaggcgacgaggagaaggctgacaccatccagcttacaaccaacaggctttacccgttgtatgtgtaccttacacctagaggaaggaaatgagcatcatttctgggcaggttttcgcacttcttcagtaatctgctgttgcagtgttgcctgtgtatgaaactttgggatgagaactctgtatgctgttgtaatttttcgtctgtggtagttaataataagaagtgtacatcacgcaagttagatacaaacttgcagcatatactaatgaatcttgattactatgtaggtcatgttactaccctgatgtttgcttggttccatgaaaga

SEQ ID NO: 222 - DNA, 1888 bp, Sorghum bicolor
cgcaccgcgctgtctctcatctccactctcgctctccagtctccactccggcccgctccccattccgatcccagcgcacgggcagtccagtccggttcacgcatggagtctctagtggctgcgctccccgcgggcggcgcggcggcggcggccgccgtcggcgggctggtggctgctgcagcgctcgccggaaaggccggcctcgtcgggcccaagaaacacctcaacgcgcccccagctgtccctggtttaccaatgattgggaatcttcatcagttgaaagagaagaaaccccaccagacctttacaaagtgggctgaaatttatgggccactttacactataaggaccggtgcttcttctgtagttgtgctcaattcagctcaagttgccaaggaggcaatgatcgcaaaattctcatcaatatctactcgaaagctatctaaagcattgtcagtgctcacccgagacaaaactatggtcgctacaagtgactatggtgacttccacaaaatggttaagcgttatgtcatgacatccatgctgggtacttctgcccagaaacaatttagggacacaagaaacatgatggttgacaacatgttgaacactttccacacattgttgacggatgatccaaattctcctctgaactttcgggaagttttcaagaatgaattatttcgcttatccctgattcaggctttaggtgaggatgtgagttcagtctatgtggaagagtatgggaaggttatatcacaggaggaaatctaccaggccactgtggctgacatgatgatgtgtgcaattgaggtcgattggagggatttcttcccatacctcagctggattccaaataggagctttgaaacaagagtattgactacggaagctaggagaactacagtgatgcaagccttgatcaatcagcaaaaaataagaattgcacgtggagagactaggatctcctacctggactttctgctggcagagaatacactgactgatgaacaattactaatgctggtgtgggaggcagtcatagaagctgctgatactactttggtcacgaccgagtgggccatgtatgagattgcgaagcacccagaaaaacaggaatacctttatcaagaaatccaaaaagtgtgcggcaataagacagttaccgaggatcacctgccagagttaccgtacttgaacgcggtgttccatgagaccctgaggcggcattctccagttccattagtgcctccaagatttgtccacgagaataccaacttggctggctatgaggttccagccggcacagagatgatcattaatctttacgggtgcaacatgaacaaaagcgactgggcagaaccggaggaatggaagccagagaggtttctggacgggaggtttgaagctgcagatatgtacaagaccatggcctttggtgcaggaaggagggcctgtgctggcagcatgcaggcgatgaacatctcgtgcacagccatcgctaggtttgtgcaagagttttcctggaggctcaaggaaggtgacgaggacaaggctgacaccatccagcttacaaccaacaggctttacccattgcatgtgtacctcacacctagaggaaggaaatgagcatctgttgtagacaggttacataaactgtactaatataataatcagtattttgctgttgcctgtgtatgacttttggatatctctatgcctgtcgaagtttttggtctgtgaaaatgggttaataatacgaagtgcatatcatataggacttggacacgaacttgcagcatctactagtgatacagatcactacataggccatgtatataaacattcttcacccaagaagaatatgatctatatctgaattctactc

SEQ ID NO: 223 - DNA, 1458 bp, Triticum aestivum
cacgcgtccgaaagtcctccagctcctcctcactccacagcaggttcatctccaccccgtcagtcagtcaggcggcagcaatggcggaagaggggaacagcgcgggcagcggcgggcgcggcgtccgggtgtgcgtcaccggcggcgccgggttcatcggctcctggctcgtcaggaagctgctccaggccgggtacaccgtccacgccaccctgcggagcatcggggacgaggggaaagtggggctgctgcggcggctcgtccccggcgccgcgccgccggagcggctggtgctgttcgaggccgacctcttcgacgccgccagcttcgcgccggccatcgccggctgccagttcgtcttcctcgtcgccaacccctccgcgcacgaggccgccgcctccaagtacaagacatcggcggaagccgccacggatggggtgcgcatcatcctccggctatgcgcggaatctatgacggtgaagcgcgtcatccacaccgcatcggtgacggccgcttcgccgctgacaaagtcctccagcgccgcggccgctgtgtacagcgatttcatctctgaatcttgttggactctgttggatgtcgattaccctctccggagcgtgcacttcgataagtacatagagtccaaggtcctgtcagagaaggagctcctcagctacaacgacggcgagagcccggcgttcgaggtggtcaccctgtcgttgggccttgtcgggggcgacacagtgctcagccacctcccagagacggtggagagcatggtggccccggtaacaaagcaagagccctacttcatgctgccgaggatcctgcagaggttgctgggctcgctgccgctggtgcacgtcgacgacgtgtgctccgcgctcatcttctgcatcgagcaacctgccctctcaggtcggttcctctgtgccgctgcctacccgacaatccacgacatcctggaccactacagcagcaagtacccccatctggatctcctcagagaggctgatgaggtagcgagggtgcaacccgagaagaacaagcttgtggagctgggcttcaggtacaagtatggggtggaggagatactagacgaaagcattgactgtgctgtgaggctgggctccctggatgcatccaagctcatcgtccagcaggagtgatgaactcaatgatgtcgagggcaagtgatcacagtatcctctttacttgttcagcatttacagtaacacatgtattaaaagaagaaaaacggtacataaataacagagctgctttgttatttactggcagcttaacgttagcttgttcttcgaattttgctctggaaatcggtacacattcatatcatccctgaaatccttgggttttccatgtaatctaatacacgagtttataatagataaacttacacatctttatcatggcaaagaactatgaaccagcacattt

SEQ ID NO: 224 - DNA, 1420 bp, Triticum aestivum
gcagcaatggcggaagtggggaacggcgcgggcagtggcgggcgcggcgtccgggtgtgcgtcaccggcggcgccgggttcatcggctcctggctcgtcaggaagctgctggaggcaggctacaccgtccacgccaccctgcggagcgtcgcggacgaggggaaagcggggctgctgcggcggctcgtccccggcggcgcgccgccggatcggctggtgctgttcgaggccgacctctacgacgccgccagcttcgcgccggccatcgccggctgccagttcatcttcctcgtcgccaacccctccgcgcacgaggccgccgcctccaagtacaagacttcggcggaagccgcggcggatggggtgtgcgtcatcctccggctatgcgcgcaatctaagacagtgaagcgcgtcatccacaccgcctcggtgacggccgcttcgcctctaactaagtcctccagcgccgcggccgcggtgtacagcgatttcatctctgaatcttgttggactctgctggatgtcgattaccctctccggagcgtgcatttcgataagtacatagagtccaaggtcctgtcagagaaggagctcctcagctacaacgacggcgagagcccggcgttcgaggtggtcaccctgtcgctgggcctcgtcgggggcgacacagtgctcagccacctcccagagacggtggagagcatggtggccccggtaaccaagcaagagccctacttcatgctgccgaggatcctgcagaggctgctgggctcggtgccgctggtgcacgtcgacgacgtctgcgctgcgctcatcttctgcatggagcagcctgccctctccggtcggttcctctgtgccgccgcctacccgacgatccacgacatcctagaccactacagcagcaagtacccccaccttgaagtcctcagagagactgatgaagtagccagggtgcaccccgagaggagcaagctttgggaactgggcttcaggtacaagtacggggtggaggagatactagacgaaagcatcgactgtgctgtgaggctgggctccctggatgcatccaagctcatcgtccagcaggagtgatgaactcaatggtgtgtagggcaagtgatcatagtatgttctttacttgttcattattttacagtaccacatgtattactaaaagaagaaaaacgatatataaataacagagatgctttgttatttactggcagcttaaggttagcttgttctttgatttttgctctggaaatctgtacacattcatatcatcgctgaaatctttggattttccatgtaacctaatacacgagctaagcatataaaggcacacatctttatcatggacaaagaactatgaaactacacaattaccaatgctcatcttcaacttgtctctaacccg

SEQ ID NO: 225 - DNA, 1241 bp, Secale cereale
ccgcaggttcatctcgaccccgtcagtcaggcggcagcaatggcggaagaggcgaagagcgcgtgcggtcgcggcgttagggtgtgcgtcaccggcggcgccgggttcatcggctcctggctcgtcaggaagctgctggaggcaggctacaccgtccacgccacactgcggagcgtcggggacgaggggaaagcgggtctgctgcggcggctcgtcccgggcggcgcgccggcggagcggctggttctgttcgaggccgacctctacgacgccgccagcttcgcgccggccatcgccggctgccagttcgtcttcctcgtcgccaacccctccgcgcacgaggccgccgcctccaagtacaagacttcggcggaagccgccgcggatggggtgcgcgtcatcctccggctatgcgcggaatccaagacggtgaagcgcgtcatccacaccgcatcggtgacggctgcttcgccgctgacaaagtcctccagcgcggcggccgcggtgtacggcgatttcatctctgaatcttgttggactctgctggatatcgactaccctctccggagcgtgcatttcgataagtacatagagtccaaggtcgtgtcagagaaggagctcctgagctacaacgacggcgagagcccggcgttcgaggtggtcaccctgccgctgggcctcgtcgggggcgacacagtgctcagccacctcccagagacggtggagagcgtggtggccccggtaacaagcaagagccctacttcatgctgccgaagatcctgcagaggttgctgggctcgctgccgctggtgcacgtcgacgacgtctgctccgcgctcatcttctgcatggagcagccttccatctccggccggttcctctgtgccgccgcctacccgacgacccacgacatcctagaccactacagcagcaagtacccccaactcgaagtcctcagagagactgatgaagtagccagggtgcaacccgagaggaacaagcttggggagctgggcttcaggtacaagtacggggtgatggagatactagacgaaagcatcgactgtgctgtgaggctgggctctctggatgcatccaagctcatcgtccagcaggagtgatgaactcaatggtgtgcagggcaagtgatcatagtatggtctttacttgttcattattttacattaccacatgtactactaaaagaagtaaaacgatatataaataacagagatgctttg

SEQ ID NO: 226 - DNA, 1281 bp, Secale cereale
gactgaccgagcctcctgctcacttcaccgcaggttcatctcgaccccgtcagtcaggcggcagcaatggcagaagaggggtgcggcgttcgggtgtgcgtcaccggcggcgccgggttcataggctcctggctcgtcaggaagctgctccaggcaggctacaccgtccacgccaccctgcggagcgtcggggacgaggggaaagtggggctgctgcggcggctcgtccccggcggcgcgccggcggagcggctggtgctgttcgaggccgacctctacgactccgccagcttcgcgccggccatcgccggctgccagttcgtcttcctcgtcgccaacccctccgcgcacgaggccgccgcctccaagtacaagacttcggcggaaaccgccgcggatggggtctgcgtcatcctccggctatgcgcggaatccaagacggtgaagcgcgtcatccacaccgcatcggtgtccgccgcttcgccgctgacaaaatcctccagcaccgcgaccgcggtgtacggcgatttcatctctgaatcttgctggactctgctggatgtcgattaccctcttcggagcgtgcacttcgataagtacatagagtccaaggtcgtgtcagagaaggagctcctgagctacaacgacgacgagagcccggcgttcgaggtggtcaccctgcccttgggcctcgtcgggggcgacacagtgctcagccacctcccagagacggtggagagcatggtggccccggtaacaagcaagagccctacttcatgctgccgaagatcctgcagaggttgctgggctcgctgccgctggtgcacgtcgacgacgtctgctccgcgctcgtcttctgcatggagcagccttccatctccggccggttcctctgtgctgccgcctacccgacgacccaggacatcctagaccactacagcagcaagtacccccaccttgaagtcctcagagagactgatgaagtagccagggtgcaacccgagaggaacaagcttggggagctgggcttcaggtacaagtacggggtgaaggagatactagacgaaagcatcgactgtgctgtgaggctgggctccctggatgcatccaagctcatcgtccagcaggagtgatgaactcaatggtgtgcagggcaagtgatcatagtatgctctttacttgttcattattttacagtaccacatgtactactaaaagaagaaaaacgatatataaataacagagatgctttgttatttactggcagcttaaggttagctt

SEQ ID NO: 227 - DNA, 1344 bp, Secale cereale
atggcggaagaggcgaagagcgcgtgcggtcgcggcgttagggtgtgcgtcaccggcggcgccgggttcatcggctcctggctcgtcaggaagctgctggaggcaggctacaccgtccacgccaccctgcggagcgatcggggacgaggggaaagcggggctgctgcggcggctcgtccccggcggcgcgtcgccggagcggctggtgctgttcgaggccgacctctacgacgccgccagcttcgcgccggccatcgccggctgccagttcgtcttcctcgtcgccaacccctcggcgcacgaggcagccgcctccaagtacaagacttcggcggaagccgccgcggatggggtgcgcgtcatgctccggctatgcgcggaatccaagacggtgaagcgcgtcatccacaccgcatcggtgacggctgcttcgccgctgacaaagtcctccagcgcggcggccgcggtgtacggcgatttcatctctgaatcttgctggactctgctggatgtcgattaccctcttcggagcgtgcacttcgataagtacatagagtccaaggtcgtgtcagagaaggagctcctgagctacaacgacgacgagagcccggcgttcgaggtggtcaccctgcccttgggcctcgtcgggggcgacacagtgctcagccacctcccagagacggtggagagcatggtggccccggtaaccaagcaagagccctacttcatgctgccgaagatcctgcagaggttgctgggctcgctgccgctggtgcacgtcgatgacgtctgctccgcgctcatcttctgcatggagcagccttccatctcgggccggttcctctgtgccgccgcctacccgacgacccacgacatcctagaccactacagcagcaagtacccccaccttgaagtcctcagagagactgatgaagtagccagggtgcaacccgagaggaacaagcttggggagctgggcttcaggtacaagtacggggtgaaggagatactagacgaaagcatcgactgtgctgtgaggctgggctccctggatgcatccaagctcatcgtccagcaggagtgatgaactcaatggtttgcagggcaagtgatcatagtatgctctttacttgttcattattttacagtaccacatgtactactaaaagaagaaaaacgatatataaataacagagatgctttgctatttactggcagcttaaagttagcttgatctttgacttttgctctggaaatcatttaacatgactaacaaaaaaaaaaaaaaaaactagagactagccaacgacgacaacgagggtaagtaggagccccccccccccc

SEQ ID NO: 228 - DNA, 1680 bp, Brachypodium distachyon
aaagcaacaatttcctggaagttcagcagaaagtaacccttggtaaagcttgaaccaaatctaaatctggtctctttactgaggtcagcctctgcggcattgaacatgaccagattggcgttgattaaagaaaaaacttcagtgtaggcccagtggcgaatcagcccaaatgggctggccttccacatccccacccctatatatacgagtagcacaggccgaactatcttcctcgcgtgtcaacagtcaaaacactcgtctcaaaacacaagcccatccatccccaccacgaaacgaaggcagcaagaggagcagcaatggcggaagcggggagcagcggcggcggcgtccggacgtgcgttaccggaggcgccgggttcatcggctcgtggctcgtcaggaagctcctcgagcgcggctacaccgtccacgccaccctgcgaagcatcggggacgaggggaaagcggggctgctgcggcggctcgttccagggggggtgccgccggagcggctggtgctgttcgaggccgacctctacgacgccgccagcttcgcgccggccatcgccggatgccagttcgtcttccttgtcgccacgccgtccgcgcacgaggccgccggttccaagttcaagaattcggcagatgcagctgcggacgcggtgcgcgtcatcctccggctatgcgcggagtccaagacggtgaagcgcgtcatccatactgcatcggtgtcagccgcttcaccactgctagatgcctctagtgccgccgctgccatgtacaaaggtttcattactgaatcctgctggactcggctcgacatcgactatcctcttcggagcgtgcactttgataagtacatagagtcaaagatcctgtcggagaaggagctcctgagctacaacgtcagggagagccccgcgttcgaggtggtcacactgccctgcggcctcgtcggaggggacacggtcctcggccacgtcccggagacagtggagagcgtggtgtcaccggtgacaaagcaagagctctacttcatgctcccaaggattctacaggggctgctgggctcggtgccgttggtgcacgttgatgacgtctgtgccgcgctcatcttctgcatggagcagccttccctctctggccggttcttgtgcgccgctgcttacccgacggtccatgacattgtggatcactatggtcgcaagtaccctcaccttgacctcctcaaagagaatgatgaggcagtgaaggttcaatctgagaggaacaagcttggggagctgggtttcaggtacaagtacgggatggaggcgatactaggtgacagcatcggctgcgccgtgaggctgggctacatcgatgcatccaagctcagcgggcagtagaaatgatgaactcatgtcatgtgctgtgtatggcaagtgaccatctgtctgccgcttaattgttttgcattttacactttccagagatcatattattacacatacatgtattacactagtagagagaagaaatgcacgtaaattaacatctgttcgctattgttgttttttagcataggtgtgatcctttcagtatttttcaatatttgtcctggaaatgagagaaagaactcatgcgcagatgtgtgttaatactaatttgcacttatagcttttctgaggacaagcaatt

SEQ ID NO: 229 - DNA, 2236 bp, Secale cereale
gactcggagtctcctctccgctacgtatacatcgccgacccaagcaaccaagccaccagcgacaaaccgtcagacccagccaatccaatccaatccaaccctcgccggcgagaccgccggcgccatgggcacctacaagtgctgcctcatcttcaagcgccggtaccgctggacggacgcgccgccgccggacgacgtgcgtgccctcttcgccgagcactcgggcggggcggccaccatgggcgccgacggcctgcgccggtacctcgagtcctccgcgggcggcgaccacgacgccgccgacgccgacgccgagggcgaggcggaccgcctgctggaccagatccgcctgcaggggcaccagcagcgcgccggcccgcgcctcccgcgcctggggcgcggccagctgctctccctcgacgacttccaccgcttcctcttctccgccgacctcaacccgcccgtccgccgggcccaggtccaccacgacatgtccgcgcccctctcccactactacatctacacgggccacaactcgtacctcaccggcaaccagctcagcagcgactgcagcgacgtccccatcatcaaggccctgcagcgcggcgtccgggtcatcgagctcgacatgtggcccaactccgccaaggacgacatcagcatcctccatggcaggactttgaccaccccggtttcgctgctgaaatgcttgaggtccatcaaagagtacgctttcgtcgcgtctccctacccggttatcatcacgctcgaagaccaccttacaccggagctgcagggcaaagttgccaagatggtccttgaagtgtttggcggcatactgtactaccctgaagaagaacatcccaaagaactcccttcacctgagtccctcaagggccgtgtgctcctatcgacgaagcccccgaaggagtaccttgaagccaaggatggtggtgccgcgaaagacggtgatgcggagcagaatcctggcaaaggaggaactgacgatgatgcggcttggggaacagaagtcccagatttcaagactgaaatccaatctgctaaacaggaggaagatgccgcagagcaccataaagatgacgatgaggacgatgatgatgatgaggacgaacagaaaatgcaacagcatctagctccacagtataagcaccttattactataagagcaggaaagccaaaggggggtactacgtctgatgccttgaagtgtgacccgaacaaagttaggcggctcagtttgagcgagcaacaacttgccaaagctgtagttaatcatggcaccgaaatagtgaggtttacacagaggaatctactgaggatatacccaaagggcactcgggttacttcatccaactacaatccatttattggttggttgcatggcgctcagatggtagccttcaatatgcagggatatggaagagctctttggttaatgcatgggttttataaagccaatggtggctgtggctacgttaagaaaccggatttcttgatgcagtctgagccggaagtttttgatccaaaaaagcctcaacctgttaagaaaaccttgaaggtaaaagtgtacatgggcgatggttggcggatggacttcaagcagacacactttgaccagtattctcctccagatttctatgcacgggtcgggatcgccggcgttccggcggactcggtgatgaagaagaccaaggcggtggaggacaactgggtgccggtgtggggggaggagttcctgttcgacctgacggtgccggagctggccctgctgcgggtggaggcgcacgagtacgacatgtcggagaaggacgactttgcggggcagacggtgctgccggtgtcggagctgcagcccgggatccgcgcggtggcgctgttcgaccgcaaggggaacaagctccccaacgtcaagctcctcatgcgctttgagtttgtctgattgggtccggtttggtttgagagatgtggtgtgttggtactctctgcattctttgttcatcctgtacatatacgatgcgtggtggttctgtctcgtgtgaatatggagttgtaccgttgtactatatgtcagtcagttgtgcagacacgagaattcatcgatcttgtatttgttgcgagagtggcgtaataaggtgttttaccatcataatctcttctgatgctaccggaaatctagcagagtatgaaacggtttcatttcgttgctaaggagaat

SEQ ID NO: 230 - DNA, 1763 bp, Secale cereale
ggccagctgctctccctcgacgacttccaccgcttcctcttctccgccgacctcaacccgcccgtccgccgggcccaggtccaccacgacatgtccgcgcccctctcccactactacatctacacgggccacaactcgtacctcaccggcaaccagctcagcagcgactgcagcgacgtccccatcatcaaggccctgcagcgcggcgtccgggtcatcgagctcgacatgtggcccaactccgccaaggacgacatcagcatcctccatggcaggactttgaccacccctgtttcgctgctgaagtgcttgaggtccatcaaagagtacgctttcgtcgcgtctccctacccggttatcatcacgctcgaagaccaccttacaccggagctgcagggcaaagttgccaagatggtccttgaagtgtttggcaccatactgtactaccctgaagaagaacatcccaaagagctcccttcacctgaattcctcaagggccgtgtgctcctatcaacaaagcccccaaaggagtaccttgaagccaaggatggtggtgccgcgaaagacggcgatgcagagcagaatcctggcaaaggaggaactgacgatgatgcggcttggggaacagaagtcccagatttcaagactgaaatccaatctgctaaacaggaggaagatgccgcagagcaccataaagatgacgatgaggacgatgatgatgatgaggacgaacagaaaatgcaacagcatctagctccacagtataagcaccttattactataagagcaggaaagccaaaggggggtactacgtctgatgccttgaagtgtgacccgaacaaagttaggcggctcagtttgagcgagcaacaacttgccaaagctgtagttaatcatggcaccgaaatagtgaggtttacacagaggaatctactgaggatatacccaaagggcactcgggttacttcatccaactacaatccatttattggttggttgcatggcgctcagatggtagccttcaatatgcagggatatggaagagctctgtggttaatgcatgggttttataaagccaatggtggctgtggctacgttaagaaaccagatttcttgatgcagtctgagccggaagtttttgatccaaaaagcctcagcctgttaagaaaaccttgaaggtaaaagtgtacatgggagacggttggcggatggacttcaagcagacacactttgaccaatattctcctccagatttttacgcacgggttgggatagccggcgttccggcggactcggtgatgaagaagaccaaggctgtggaggacaactgggtgccggtgtggggggaggagttcctgttcgacctgacggtgccggagctggcgctgctgcgggtggaggcgcacgagtacgacatgtcggagaaggacgactttgcggggcagacggtgctgccggtgtcggagctgcagcccgggatccgcgcggtggcccttttcgaccgcaaggggaacaagctccccaacgtcaagctcctcatgcgctttgagtttgtctgattgggtccggtttggtttgagagatgtggtgtgttggtactctctgcattctttgttcatcttgtacatatacggtgcgtggtggttctgtctgtgtgaatatggaggtgtaccgttgtactatatgtcagtcagttgtgcagacacgagaattcatcgatcttgtatttgttgcgagagtggcgtaataaggtgttttaccat

SEQ ID NO: 231 - DNA, 2596 bp, Aegilops tauschii
ttttgtttagacaaatttggaaaattgatctaatagattattattttttgagaaaaactgatctttttttgggaaaaattgatctagtagatggagtgcagttgagttaattgatgggccatatcttaatgagtgccatttgtgtgccgacagttagttttaacccccactctccccattcgtctccctccctccgtccctttcgccttcccctctccctccctcccctgtttctctccataccagtctcccctacggatacatcgccgacgacccaagcaagcaaagccacccagcagcaaaccaacccaaccctcgctgccgagaccgccggagccatgggcacctacaagtgctgcctcatcttcaagcgccggttccgctggacggacgcgccgccgccggacgacgtgcgggcgctcttcgccgagcactcgggcggggccgccaccatgggcgccgacggcctgcgccgctacctcgagtccacgggcggcgaccccgacgccgccgacgccgacgccgagggcgaggcggaccgcctgctggaccagatccgcctccccccccccccccccccccccccccccccccccccccccctctccgccgacctcaacccgcccctccgccgcccgcaggtccaccacgacatgtcccagcccatctcccactactacgtctacacgggacacaactcgtacctcaccggcaaccagctcagcagcgactgcagcgacgtccccatcatcaaggccctgcagcgcggcgtccgggtcatcgagctcgacatgtggcccaactccgccaaggacgacatcagcatcctccatggcaggacattgaccaccccggtttcgctgctgaaatgcttgaaatccatcaaagagtacgctttcgtcgcgtctccctacccggttatcatcacactggaagaccaccttacacccgagctgcaggacaaagttgccaagatggtccttgaagtgtttggcgacatactgtactaccctcaagaagaacatcccaaagaactcccttcacctgagttcctcaagggtcgtgtgctactatcaacaaagcccccaaaggagtaccttgaagccaaggatggtggtgccgtgaaagatggtgatgcggagcagaatcctggcaacgggcttgacgatgatgcggcttggggaacagaagtcccagatttcaagactgaaatccagtctgctaaagaggaggatgcctcagagcaccgtagagatgacgacgaggacgatgacgatgaggacgaacagaaaatgcaacagcatctagctccacagtataaacaccttattactataagagcaggaaagccaaaggggggtactacgtctgatgccttgaagtgtgacccaaacaaagttaggcggctcagtttgagcgagcaacaacttgccaaagctgtagttaatcatggcaccgaaatagtgaggtttacacagaggaatcttctgaggatatacccaaagggcactcgggttacttcatccaactataatccatttattggttgggtgcacggtgctcagatggtggccttcaatatgcaggggtatggaagagccctttggttaatgcatgggttttataaagcaaatggtggctgtggctacgtgaagaaaccagatttcttgatgcagtccgaaccagaagtttttgatccaaaaaagcctcaacctgttaagaagaccttgaaggtaaaagtgtacatgggcgatggttggcggatggacttcaagcagacacactttgaccagtattctcctccagatttctatgcacgggtcgggatcgccggcgttccggcggactcggtgatgaagaagacaaaggcggtggaggacaactgggtgccggtgtggggggaggagttctccttcgatctgacggtgccagagctggcgctgctgcgggtggaggcgcatgagtacgacatgtcggagaaggacgattttgcggggcagacggtgctgccggtgtcggagcttcagcccgggatccgcgcggtggcgctcttcgaccgcaaggggaacaagttccccaacgtcaagctcctcatgcgctttgagtttgtctgatttggtatggtttggtctgagagatgatggtgtgtcggcggcatggttggtactctgtgcattctttgttcatcctgtacatacgtgatgcgtcgtggtgccgtctgtgtgaatattgagttgtgccgttgtatatgtgagtcagttgtgtagacacgagaattcatcaaccctgtatttgttgtgagagtggcgtaataaggtattttaccatcatgatctcttctgtcgatggaatagaagagaacaggcctccacaatgtatagtgaaatggacgatcacgaactctcaatttgtctgtgtaccgttgtatttgttgcgagtgaaataaggtacttacgtaattagagcatctccagccgcgcctccaacaaaccccccaacgcctttttttattgccggcgtcgaaaaatcggcctagacgcgccccagaagctcaatttttgccggttaggccgaatttggtgtcgacggacccagg

SEQ ID NO: 232 - DNA, 2176 bp, Sorghum bicolor
cccaattctctctattcctcttcctcagagttcctctagtctagcttcctattgagaggccccgccccgccccgcctcgcctagggacgttggttcctctccgtccgcagcactcccaccaccatgggcaccacgtacaagtgctgcctcatcttcaagcgccggttccacgcccgcgacgcgccgccgcccgaggacgtccgcgccctcttctccctccacaccggcgggggtacccacatgggcgccgacggcctgcgacgctacctggacgccacacaggaggaggcgtcgcggctggacgacgccgaggtggagcggctgctggagcagatccgcctgcagcagcaccagggcggccaccgcgcccgcctcccgcgcctggcccgcccgctcctcgccctcgacgacttccaccgctacctcttctcgcacgacctcaacccgcccctccgacaccaccaggtgcaccacgacatgacgcgcccgctctcccactacttcatctacaccggacacaactcctacctcaccggcaaccagctcagcagcgactgcagcgacgtccccatcatcaaggcgctgcagagaggggtcagggtcatcgagctcgacatgtggccaaattcaacaaaggacgacatcaacatcctgcacggaaggacactgaccaccccagtttcgctcatcaaatgcttgatatccatcaaagaatatgcctttgttgcatctccctatcctgtcatcataacgcttgaagaccaccttccctctgaactccaggaaaaagttgccaagatggttcttgatgtatttggtgacatactgtactacccgcctgactccgatcacctcaaagaattcccatcacctgaacaactcaagggccgtgtcctcctctcaacaaagccccccaaggagtaccttgaagccaaggctgatgacaccatgaaagagggtgatgctgacctccatcttgccaaaggggctaatgatgatgccgcgtggggaaaagaagtaccggattttcagactgagatccagtccgcaaaaaagcacgacgatgatgccccaggacaccaaagagaagatgatgacgacgacgatgatgaggaggaagaacagaaaatgcaaccacatttagctccacagtataaacaccttatcacaatcagagcagggaagccaaaaggctctctagctgatgccttgaagagtgatccagaaaaagttaggcgtctcagtttgagcgagcaacaacttgccaaagtggcagaggatcacgccacagaaattgtgaggttcacgcagaggaacatattgaggatatacccgaagggcactcgagtcacttcatctaactacaacccgtttattggttgggtgcatggtgctcaaatggtggcattcaatatgcagggatatggaagagcgctttggctaatgcacggattttataaagcgaacggtgggtgcggttatgtgaagaagccagatttcttgatgcagacagaaccacaagtctttgacccaagagaaccccaacctgtgaagaaaaccttgaaggtgaaggtgtacatgggcgatgggtggcgaatggacttcaagcagacacacttcgatcaatattctcctccagatttctacacacgggttgggatcgctggggtcccagcagactcggtgatgaagaagaccaaggctatcgaggacaactggatgccggtgtgggaggaggagttcagcttcccgctgacggtcccggagatcgctctgctgcgggtggaagtgcacgagtacgacatgtcggagaaggacgacttcggtggacagacggtgctgccggtgtcggagctgcggccggggatccgggcggtggcgctcttcgaccgcaaagggaacaagtacaacaacgtgaagcttctcatgcgtttcgagtttgcctagcctgatgtcttaccgtgagtgagacgacgattgcattgattgatatatacattccatattattatgtatcttgtgtgaacattgcaacctgagcgtgctttgtacatagatagattgcttggattggatgatatgtgcaacacttgatcagcaaacaattccttccgttccgttgttatgatcaaataataataaggcagcgtccttatgaataaattaaattaaaccc

SEQ ID NO: 233 - DNA, 1654 bp, Triticum aestivum
cccgcccctccgccgcccgcaggtccaccacgacatgtcccagcccatctcccactactacgtctacacgggacacaactcgtacctcaccggcaaccagctcagcagcgactgcagcgacgtccccatcatcaaggccctgcagcgcggcgtccgggtcatcgagctcgacatgtggcccaactccgccaaggacgacatcagcatcctccatggcaggacattgaccaccccggtttcgctgctgaaatgcttgagatccatcaaagagtacgctttcgtcgcgtctccctacccggttatcatcacactcgaagaccaccttacacccgagctgcaggacaaagttgccaagatggtccttgaagtgtttggcgacatactgtactaccctcaagaagaacatcccaaagaactcccttcacctgagttcctcaagggtcgtgtgctactatcaacaaagcccccaaaggagtaccttgaagccaaggatggtggtgccgtgaaagatggtgatgcggagcagaatcctggcaaagggactgacgatgatgcggcttggggaacagaagtcccagatttcaagactgaaatccagtctgctaaagaggaggatgcctcagagcaccgtagagatgacgacgaggacgatgacgatgaggacgaacagaaaatgcaacagcatctagctccacagtataaacaccttattactataagagcaggaaagccaaaggggggtactacgtctgatgccttgaagtgtgacccaaacaaagttaggcggctcagtttgagcgagcaacaacttgccaaagctgtagttaatcatggcaccgaaatagtgaggtttacacagaggaatcttctgaggatatacccaaagggcactcgggttacttcatccaactataatccatttattggttgggtgcacggtgctcagatggtggccttcaatatgcaggggtatggaagagccctttggttaatgcatgggttttataaagcaaatggtggctgtggctacgtgaagaaaccagatttcttgatgcagtccgaaccagaagtttttgatccaaaaaagcctcaacctgttaagaagaccttgaaggtaaaagtgtacatgggcgatggttggcggatggacttcaagcagacacactttgaccagtattctcctccagatttctatgcacgggtcgggatcgccggtgttccggcggactcggtgatgaagaagacaaaggcggtggaggacaactgggtgccggtgtggggggaggagttctccttcggcctgacggtgccggagctggcgctgctgcgggtggaggcgcatgagtacgacatgtcggagaaggacgattttgcggggcagacggtgctgccggtgtcggagcttcagcccgggatccgcgcggtggcgctcttcgaccgcaaggggaacaagttccccaacgtcaagctcctaatgcgctttgagtttgtctgatttggtttgagagatgatggtgtgtcggcggcatggttggtactctgcattctttgttcatcctgtacatacatggtgccgtctgtgtgaatacggagtgtacctatgtcagtcagttgtgtacatgagaattcatcgaccttgtatttgttgtgagtg

SEQ ID NO: 234 - DNA, 1208 bp, Triticum aestivum
ctcgatcgttccggacctagctagctagctcctgcacacccgtacgtacggccggtagcagtacaatctccatcgatccacgcacgcacacgtacgcagctgagcttgctcgacctagctcgatcaatggcctcaaccggagtttcgcgtaggtcgtccatcatggcgtcccggctgagcgcgtcagcggaggccgtgcgggcgagcgaggggaggaagcagcgacatgccgtggtggcgcggcgggtggagtacgacgaggagtctctggccggtgaaccccaatacgacgtgttcatcaaccaccgcggcgtggacacgaagcggactgtggcgcgcctgctctacgaccgcctcgcgcagagcggcatccgcggcttcctggacaacatgtcgatgcggccgggcgaccggctcaaggagacgatcagcgccggaatcagcgaatgcagcgtcgccgtggccatcttctccccgagctacttcgactcggagtactgcctgtgggagctcgccacgctcgtagagtcacgcaagaccatcatcccaatcttctacaacatcaagccctccgacctcgtgctccccgaggccctcgccgcctccgacgactacctcccgcaagacgtggagcgctacaagtacgcgctccgcgaggccaagaacaccgtcggcctcacctacgactcggccacaggggacatagccgagctggtgtcagcggcaaccgacgcggtgctgtaccacatagaaaaaatggagagagtgcagaggagggaaacgatcgtttcaaggctctaattttgaacggaaaatcaacggctactattcagcgaagtacccggctccacgtcaggaataacaaatagtcgaaggggcagattaacagtcaaataattaaacatgcagaggattcattcgttcgtttttttcttttcttttgaggggacattcgtttttctttggttgattctttttcggtaaattaggtttatgggtgcatgccttagccgccaatgtgtagtaaaataaagctatacggctggccatgcaggcaccgcaacttcagatttttcaaataatgacgggcatatgtacatgtactgcacaaagtcaaataatatagttcgatcacatattccacaattgcttctgtttacaaaatttgtgaggccttggatcttcatcaatggtgatcttttaaccat

SEQ ID NO: 235 - DNA, 1251 bp, Hordeum vulgare
ctgctgtcgcctccatcgctccggacctacctagctagccacgacctgcacgcccgtagcagcagtacagatctccatcgtcgatccaacgcacacacacgtacgtacgcagctgagagcttgctttgctcgacctctccatcaatggcctcaaccggagtttcgcgtaggtcgtccatcatggcgtcccggctgagcgcgtcggcggaggccgtgcgcgccagcgaggggaggaagaagcaacaggccgtggtggcgcgacgggtggagtacgacgaggagtctctggccggggaaccccagtacgacgtgttcatcaaccatcgcggcgccgacaccaagcgcacggtggcgcgcctgctctacgaccgcctcgcgcagggcggcatccgcggcttcctggacaacatgtcgatgcggccgggtgaccggctcagggacaccatcagggctgggatccgcgaatgcagcatcgccgtcgccatcttctccccgagctactgcgactcggagtactgcctctgggagctcgccatgctcgtggagtcacgcaagaccatcatccccatcttctacaacatcaagccctccgacctcgtgctccccgaggccgtcgccgcctccgaaggctacctcccagaagacgtcgagcgctacaagtacgcgctccgcgaggccaagaacaccgtcggcctcacctacgactcggccacaggggacatggccgagctggtgtcagcggcagccgacgcggtgctgtacaacatagaaaaaatggagagagtgcagaggagggaaacgatcgtttcaaggctctaattttgaacggaaattcaacggctactattcagcgaagtacccggctccacgtcaggaataacaaaatagtcgagggggcagattaacagtcatcaaataattaattaacgtgcagaggattcattcgttcgttttgtttttttattaggggacattcgtttttctttggttggttctttttcggtaaattaaagtataggttcatgggtgcatgccttagccgccaatgtgtagtaaaataagctatacggctggccatgcaggcaccggaagttcagattttgcaaataatgacgggcatatgtacatgtactgcacaaagtcaaataaagtatagatcgatcacatattcaataatttgcttttgtttactaaatttgggaggccttggatcttcaccaatggcgatctaaccatatcctgcaggctctg

SEQ ID NO: 236 - DNA, 849 bp, Aegilops tauschii
atggcgtcccggctgagcgcgtctgcagaggccatgcgcgcgagcgaggggggggagcagcgacacgccgtgctggcgcggcgggtggagtacgacgaggagtctctggccggtgaacccccaatacgacgtgttcatcaaccaccggcggcgtggacacgaagcggacggtggcgcgcctggctctacgacccccgcgcgcagggcggcatccgcggcttcctggacaacatgtcgatgcggccgggcgaccggctcagggagacgatcagcgccggaatcagcgaatgcagcgtcgccgttgccatcttctccccgagctacttcgactcggagtactgcctgtgggagctcgccacgctcgtagagtcacgcaagaccatcatccccatcttctacaacatcaagccctccgacctcgtgctccccgaggccctcgccgcctccgacgactacctcccgcaagacgtcgagcgctacaagtacgcgctccgcgaggccaagaacaccgtcggcctcacctacgactcggccacaggggacatagccgagctggtgtcagcggcagccgacgcggtgctgtaccacatggaaaaaatgataactaaccttggctcagtggtttggcatgcggttctgcagcctaacgacccgaattcaattcctggaatcgacatggaaggaggtgttgtctggcgccgtggtggcatcgacagcaagcctggcaaggttgatacgttagtatatgctctaaagatggatcgatggaagaaggcagcgacgacctatgagagtgcatcagacaggcatctgaaatcagatgcagaggcaaggggttatcccctttaa

SEQ ID NO: 237 - DNA, 3377 bp, Hordeum vulgare
gggcgctcggcctccctctgcctctgggttagctacccttcgccctcctcccgccagcgcctatatataatgcgctcccagtcccactacgagagagaaaggcagcacaaaagaaaacaggggggctgctactggtgtccggtccaaccgtccaagatccagagcgagaaacatatccccctgcccggccagccgccctgacccatttcgtccccggcgagcgatcttaaccttgctaatctgcgccgacgagggaggggagcttctttctacggtcatgccgccgatggagctgctggggagatccttcttgcaggcggcaggctctgccagcaccgcggcgcctcgcggcggccgggagcgcgggctctgcttcgcgagcctgggcgggaggccctcgaggaggacggtgcggtccaaggcgccggtgggcgccctcgccgagcgggtcgtcctcacctcggcgccggccgagagggtggcccggccggaggcgcacccgcagagcgtggcggcgagggccgtggtcaccgtgcgccggaagcggaaggtggaggtcaaggagcaggtcgccgagcagatggacgcctacgccgacagggtcggccggagcgtcctgctcgagctcatcagcaccgagacggacccaagaaagggagaccccaagaagagcaacaagtcggggctggtggggtggttcgagaaacgggacgtcaaggcggaactggtggtgtacacggcggagttcaccgtcgacgccgccttcggcgagccgggcgccgtcaccgtgctcaaccggcaccagcgtgagttcttcatcgagagcatcctggtggagggcttcccgtccggcccggcgcacttcacctgcaactcgtgggtccagcccagccgcatcgaccctgccccgcgggtcttcttcaccaacaagccctacctgccgtcccagacgccgccggggctgagggacgtccggcgtcgggagctcaaggagctgcgcggcagcggcaccggcgtgcggaagaccaccgaccgggcctacgactacgacgtgtacaacgacctgggcaacccggacaagggcgccgggttcgagcgccccgtcctcggcggcgacaagctgccgtacccgcgccggatgcggacggcccggccaagcaccgtcacagacgagggcgcggagagcagggtggagtacccggagcccatctacgtgtcgcgggacgaggagttcgaggagggcaagaacgagatgctgtccgagggcgccatcaaggcgctgctccacaacttcatgccgctgctggtgagctccgtgtcgccggacagccgcgacttcgccggcttccacgacgtcgacaacctcttcaaggagggcctccgcctcaagcaggccctgcacgaccagctgttccagaagatcccattcgtgcgcaagatccaggagaacagcgagggcctcctccgctacgacacccccgacatcatcaagaaggacaagttcgcgtggctgcgtgacgacgagttcgcgaggcaggcgctggctggcattaaccccgtcaacatcgagcggcttcaggtgttcccgccggtgagcaagctcgacccggccgtctacggcccgccggagtcggccatcacggaggagcacatcatcgggaacctggacggcatgtcggtgcagcaggcgctggaggagaacaagctgtacatgctggactaccatgacatcttcatgcctttcctcgaccggatcaactccctggacggccggaaggcctatgggacgcgcacgctcttcttcctcacggccgggggcacgctaaagccgatcgcgatcgagctgtgcctgccgcccatgaccgacgactgcaagcgcgccaagcgggtgttcacgccccccgccgacgccaccagcatctggctgtggcagctcgccaaggcccatgtctgctccaacgacgccggcgtccaccagctcatcaaccactggctgaggacgcacgcgtgcatggagcccttcatcatcgcggcgcaccggcaaatgagcgccatgcaccccatcttcaagctgctcaagccgcacatgcggtacacgctcaagatcaacgcgctggcgcggcagatcctcatcaacggagacggcgtcatcgagtccgggttcacccctggccgctactgcatggagatgagctccttcgcctacgacaacctctggcggctcgaccaggaaggcctccccgccgacctcatcagaagaggtatggctgtggaggacgcgagccagctgcacgggctccggctgctcatcgaggactacccctacgccaccgacgggctgctcctctggtcggccatcgcgcggtggtgccaggcctacgtggcggcctactacccgtccgacgaggccgtgcaggacgactacgagctgcagtcgtggtacacggaggccgtgcaggtggggcacccggacaagtgcgacgcgccgtggtggccgcgcctcaccacggccggcgacctcgcgtccctgctcaccacgctggtgtggctgtgctcggcgcagcacgccgcgctcaacttcggccagtacccgctcggcggctacatccccaaccggccgccgctcatgcgccggctggtgccggccgagggcgacccggagtacgagcacctcgtcgccgacccgcaccggttctacctgtcggcgctgcccagcctcacgcagacgacgaccttcatgacggtcatcgacacgctctccacgcactccgccgacgagcagtacctcggggagcggcccaacgaggagtggacggcggacccggcggcgctggctgctgcgcaagagttcgcggcggaagtgcgccgcgccgaggaggagatcgagcggcgcaacgctgaccccgcccggcgcaaccgctgtggcgccggcgtgctgccgtacgagctcatggcgccgtcgtccgggccgggcatcacctgccgaggcgtcccgaacagcgtcaccatctagcccgcagagagtgaattgaagcggaccgtgggaatttttcagcctcgatatactttgggccgggaacgtctcagggaaaagtacgtacatataagagaatcgccattgatttgggccctcgccacgaaggccgaatcgccattgatttgggcccagataggagaagatttaattgcatttttttctgttcaaaagttgggacatgctaatatggtggaatgtgtaaatgatctcgtaagttcctatagttaagagattccgacagatgcttgaaacatttgtaaatcaatggtaaataatccagagtactagctcaaagcatgcttgagaacatcataataatggaaaccattccctctgtctc

SEQ ID NO: 238 - DNA, 3130 bp, Secale cereale
gatcgctcttgcaggcagcaggctctgccagcaccgcggcgccgcgcggcggccgggagcgcgggagcggcgggctctgcttcgcgagcctgggcgggaggccgtcgaggaggacggtgcggtccaaggcgccggtgggcgccctggccgagcgggtcgtcctcaccccggcgccggcggagagggtggcccggccggaggcgcacccgcagagcgtggcggcgagggccgtggtcaccgtgcgccggaagcgcaaggtggaggtcaaggagcaggtcgccgagcagatggacgcctacgccgacagggtcggccggagcgtcctgctcgagctcatcagcacggagacggacccgagaaagggaggccccaagaagagcaagaagtcgaggctggtggggtggttcgagaagcgggacgtcaaggcggagctggtggtgtacacggcggagttcaccgtcgacgccgccttcggcgagccgggcgcggtcaccgtgctcaaccgccaccagcgcgagtcttcatcgagagcatcctggtcgagggcttctcgtccggcccggcgcacttcacctgcaactcgtgggtccagcccacccgcgtcgaccccgccccgcgggtcttcttcaccaacaagccctacctgccatccgagacgccgccggggctgagggagctccggcgacgcgagctcaaggagctgcgcggcagcggcaccggcgtgcggaagaccaccgaccgggcctacgactacgacgtgtacaacgacctgggcaacccagacaagggcgccgggttcgagcgccccgtcctcggcggcgacaagctgccgtaccctcgccggatgcggacggcccggccaagcaccgtcacagacgagggcgcggagagcagggtggagtacccggagcccatctacgtgtcgcgcgacgaggagttcgaggaaggcaagaacgagatgctgtccgagggcgccatcaaggcgctgctccacaacttcatgccgctgctggtgagctccgtgtccccggacagccgcgacttcgccggcttccacgacgtcgacaacctcttcaaggagggcctccgcctcaagcaggccctgcacgaccagctcttccagaagatccccttcgtgcgcaagatccaggagaacagcgagggcctcctccgctacgacacccccgacatcatcaagaaggacaagtttgcgtggctgcgtgatgacgagttcgcgaggcaggcgctggctggcatcaaccccgtcaacatcgagcggcttcaggtgttcccgccggtgagcaagctcgacccggccgtctacggcccgccggagtcggccatcacggaggagcacatcatcgggaacctggacggcatgtcggtgcagcaggcgctggaggagaacaagctgtacatgctggactaccacgatatcttcatgcctttcctggaccggatcaactcgctggacggccggaaggcctacgggacgcgcacgctcttcttcctgacggccgggggcacgctgaagccgatcgccatcgagctgtgcctgccgcccatgaccgacgactgcaagcgcgccaagcgggtgttcacgccccccgccgacgccaccaatatctggctgtggcagctcgccaaggcccatgtctgctccaacgacgccggcgtccaccagctcatcaaccactggctgaggacgcacgcgtgcatggagcccttcatcatcgcggcgcaccggcagatgagcgccatgcaccccatcttcaagctgctcaagccgcacatgcggtacacgctcaagatcaacgcgctggcgcggcagatcctcatcaacggagacggcgtcatcgagtcggggttcacccccggccgctactgcatggagatgagctccttcgcctacgacaacctctggcggctcgaccaggaaggcctccccgccgacctcatcagaagaggcatggccgtggaggacgcgagccagccgcacgggctccggctgctcatcgaggactacccctacgccaccgacgggctgctcctctggtcggccatcgcgcggtggtgcgaggcctacgtggcggcctactacccgtccgacgaggccgtgcaggacgactacgagctgcagtcgtggtacacggaggccgtgcaggtggggcacccggacaagtgcgacgcgccgtggtggccgcgcctcacgacggccggcgacctcgcctcgctgctcaccacgctggtgtggctgtgctcggcgcagcacgcggcgctcaacttcggccagtacccgctcggcggctacatccccaaccggccgccgctcatgcgccggctggtgccggccgagggcgacccggagtacgaacacctcgtcgcggacccgcaccggttctacctgtcggcgctgcccagcctcacgcagacgacgacgttcatgacggtcatcgacacgctgtccacgcactccgccgacgagcagtacctcggggagcggcccaacgaggagtggacggcggacccggcggcgctggctgctgcgagcgagttcgcggcggaggtgcgccgcgccgaggaggagatcgagcagcgcaacgccgaccccgcccggcgcaaccgctgtggcgccggcgtgctgccgtacgagctcatggcgccgtcgtcagggccgggcatcacctgccgaggcgtcccgaacagcgtcaccatctaagcccgcagagagtaaaatcgaaggggccgtgggaatttttcagcctcgatataccttgggcaggggacgtctcgggaaaaaaagtagataagagagaatcgccattgatttgggccctcaccacgaaggccgaatcgccattgatttaggccctcaccacgaaggccgaatcgccattgatttgggcccagatagaagaagatttaattgcatttttttctgttcaaaagctggggcatgctaatatagtggaatgtgtaaatgatctcataagttcctatagttaagggattccgacagatgcttgaaacatgtgtaaatcaatggaaaataattcagagtactagctcaaaacatgctttgtactaaacttgagacatttaattttaagggaaaaaaaaaaaaaactta

SEQ ID NO: 239 - DNA, 4113 bp, Zea mays
cgagcctccgacgccatattttctccggtcgcgtacgacgcatgcaacacgtgtgcggccagcgcaggaattcgcgtcgctgcgccttgcgcgtccgtccagccgcgccgagcccgagctcgtcgcatcggttgctgctcgtgcggaccccatcgagtcctcacttactcctacagtcctacttccctgagcggcgtccgagccgggcggcgcgtctatatattctgctgctcccactagctcggagctcgcggccactgcccaccttaaaaaaaacagtcggatacgatccgcgaatgcgagctgttttgaacggcgatttgtctttttgttctccagcgcgccagccaaccttaactgctacgatcgatcgaggggaggaagtttctggagctctagttctgcccatggcgtcggcgatggagctactggggagatcgttcgcgccgggccatgccgccgcggcgccgaggcggggaggcgggccctgcttcgcggcggtcggaagggaggggagtggtgcgcacaggaggagatcgtcgtcgtcgtcgtcgctgaggtcgaccgcgccggtgggcgcgctggccgagcgagtcgtggcgccgccggagagggccgaggcggtcccgccggagccgagcgtggccgcgcgggccgtggtcaccgtgcggcggagtcggaaaagggacgccaagtgccgggtcgccgagcggctggacgcgtgcgccgactgggtcggccgcagcgtcctcctcgagctcatcagcaccgagaccgacccaagaaaaggggggccaaagaagagcaggcggtcggcgctggtgggctggtttggggagaaggacgtgaaggcggagcgggtggtgtacaccgccgacttcaacgtcgacgggtccttcggcgagccgggcgcggtcgccgtgctcaaccggcaccagcgcgagttcttcgtcgagagcatcgtggtggagggctttccctccggccccgcgcacttcacctgctactcgtgggtgcagcccacgcgcgtgcaccgcgacccgcgcgtgttcttcaccaacaagccgtacctgccggcgcagacgccgccggggctgcgggagctccgccgcctggagctcagcgacctgaggggcgagggcgctcgcaccggcggcgagcgcaggaccaccgatcgggtgtgggagtacgacgtgtacaacgacctcggcaacccggacatgggcgccgagttcgcgcgcccgatcctcggcggcgaccagcagctgccgtacccgcgccggatgcggacgggccggcctaagaccttcacagacgaccgcgcggagagcagggtggagtacccggagcccatctacgtgtcccgggacgaggagttcgaggagggcaagaacgagatgctgtcggaaggcgcgctcaaggcgctgctccacaacttcatgccgctgctggtgagctccgtgtcgccggacttccgcgacttcgccggcttccacgacgtggacaacctcttcaaggagggcctcaggctaaagcaggccctgcaggaccagctgttccagaagatccccttcgtgcgcaaggtccaggagaacagcgagggcctcctccgctacgacacgcccgacatcatcaagagagacaagtttgcttggctgcgggacgacgagttcgcgaggcaggcgctggctggcattaaccccgtcaacatcgagcgccttcaggcgttcccgccgatgagcaagctggacccggccgtgtacggcccgccggagtcggccatcacggaggagcacatcatcgggaggctcgacggaatgtcggtgcagcaggcgctggaggacaaccggctgtacatgctggactaccacgacatcttcctgccgttcctggaccggatcaacgcgcaggacgggcggaaggcctacggcacgcgcacgctcttcttcctgacgggcgcgggcacgctgaagcccatcgcgatcgagctgcgcctcccgccgatgaccgacgggtgcgcgcgcgccaagcgggtgctcacgccgcccgccgacgccaccagcaactggctgtggcagctcgccaaggcgcacgtctgctccaacgacgcgggcgtccaccagctcatcaaccactggctgaggacgcacgcgtgcatggagccgttcatcatcgctgcgcaccggcagatgagcgcgatgcaccccatcttcaagctgctgaagccgcacatgcgctacacgctcaagatcaacgcgctggcgcggcagatcctcatcaacggcgacggcgtcatcgagtccgggttcacccctggccgctactgcatggagatgagctcgttcgcgtaccgggagctctggcggctcgaccaggagggcctccccgccgatctcatcagaaggtacacaaaaacacctggaatggaaattaaaatcggaagtacgagccgcaggctgacatggtgtgtgttcccttgtcacagaggaatggccgtggaggacccgacgaagccgcacggtctgcggctgctcatcgaggactacccgtacgccaccgacgggctgctcctctggtcggccatcacgcggtggtgcggcgcctacgtggccacgtactacccgtcggacgagtcggtgcaggccgacaccgagctgcagtcgtggtacacggaggccgtgcagacggggcacgcggacaagcgcggcgcgccgtggtggccgcgcctgacgacgcccggggacctggcgtcgctgctcacgacgctgctgtggctgacctcggcgcagcacgcggcgctcaacttcgggcagtacccgctgggcggctacatcccgaaccggccgccgctgatgcggcggctggtgcccgccgagggggacccggagcacgcgcacctggtggccgacccgcaccgcttcttcctgtcggcgctgcccggcctgacgcaggccaccacgttcatgaccgtcatcgacacgctgtccacgcactccgccgacgagcagtacctcggggagcgccccgacgaggcgtggacggccgacccggccgcgctggcggccgagcgcgagttcgcggacgaggtgcgccgcgccgaggaggagatcggccggcgcaacaccgacgcgggccgccgcaaccgctgcggcgccggcgtgctgccctatgagctcatggcacccacgtccggcccgggcatcacctgccgcggcgtccccaacagtgtcaccatttagtcttctcgcttgggcggacagcggagatgatctcgaagcgaattttatccgttcattgtaatcgggcgggaagaaatctaaaagcagaagcaaatggtttttgcttcagttctccccgatctccaaacatccattgatttggggtccgaacatgtggagtttgagcttctactagggggacgacgagagtaactgaatgggtgtaaataatttgttgtacaaaaaaatcaatgggatatagtgattatagagttctctggataaaccaatgtctctgtgtttcgtcaaatactacgccacttttacctgcgacattttgcagtcaagatttcgtttgaacagatcgatttggatcgacgaagcttaagtactgtctgaactattgaatgcgtcaaataatggacctgtttggttcagcttttttctgaccagcttttctgagaatctggctgtgtagagaatctgactgtgtagacaatctgagtattattaggattacgtgtggagaaagataaatgtgtcctttaagacttaggatgtagaaagtgacagattactactattgcaacaactcaaccgattatgtgtttatgttgattttaaatggtttttaaccaaacgaattttatagaagctgactgaaaagctaagcgtttgacagtccgcagcagcttttggtggccagaagctctaaaaagctgaaacaaacaggggcaatattgaactgatgaatgcgtcatacaaaaagatggaagtgacgctactgaaagaagctttattgccatgtctccaggtcaatttaagccaatttttcgtttagtgatttgtttgtaagtcaattcaagccaaactttcgtttgatgatttgtttgac

SEQ ID NO: 240 - DNA, 445 bp, Avena sativa
agaatatcttccttcgttctaccagcagcaacaagtaatccttgatgccagactgcctgatcaaagcattcggcagtagaggatccatggctatggagaggttcttcacggcgctcgtcttctgcgaggccccgctggacggctacggcacatcggtgcttaccgccggcacggtcaaaaggctggtctcaggtggcggccacgcgacgaagccagcagtggctaacaagccggactctgagaaggcgcagggttacttcactggcaagccgacggcgcagcggccgcccgggttcgagctcgcgttcgacggctcattgcttgacacatcgtcatgcactagcaagtcagtgtcagtcggtccggtctttcgttgtatttgatcagtactattctagtatagtagttggtagttcggttagtagtcgtcgttgtacgtacggtt

SEQ ID NO: 241 - DNA, 887 bp, Triticum aestivum
caaaactaatcaaacaagaatctcctccttcgctcgaggagcagcagcagcaaggaatccttctttccagactgcctgattcaagcatccgtcagtagaggatccatggctatggagaggttcttcacggcgctcgtcttctgcgaggcaccgctggacggctacggcacgtcggtgctcaccgccggcacggtcaaaaggctggtctcgggtggtggtgacgcgacgaagccgttggtggctatcaagccggacgctgagaaggggcagggtttcttcactggcaagcagatggcgcagcggcgtgctgggttcgagctcgcgttcgacggcctgaattgctttgacaccgtcgtcatgcactgagcatgtcattgtcatgtcgctttcttgattttaatctgtatagaacttggatcagttagaatgtttgagacgttggtggggttgtgatgtttcgttcattctagtctagtatttgaccggtgcacaagcttgtttacaaacgaaaggaatttaaaggggacatctcctagtatcattttatgtcttcgattccatgtcatgtagatcattcagtcagactactatttgactatctgtggcacgcgcttgttgtacaattaagaggtgtggctggtaatacgacgtcgaaaatttccctccggctctgctttcctgtgcatgtaccatctcttcctgaaaagtagtaagaatataagaggaagataatgacactgaggagagaacaaaactagtctctgcgtgtgtgtagaattgaagtaggagttggaccttacaggccaagcttgccatttggcaaaagaatagcgcaactttgcttagcaatgcttgacagaaacagagcgagcgtacattagagatat

SEQ ID NO: 242 - DNA, 463 bp, Triticum aestivum
gactgcctgatcaaagcattcggcagtagaggatccatggctatggagaggttcttcacggcgctcgtcttctgcgaggccccgctggacggctacggcacatcggtgcttaccgccggcacggtcaaaaggctggtctcaggtggcggccacgcgacgaagccagcagtggctaacaagccggactctgagaaggcgcagggttacttcactggcaagccgacggcgcagcggcgccccgggttcgagctcgcgttcgacgggctcaattgcttcgacaccattgtcatgcactaagcaagtcagtgtcatgccggctttcttgattttgatcagtaattctgtatagaattggatcggttagatgcttgacacgtacttggggctgtgattttttttgttcattcgattgtactgttcgactggtgcataagcttcaatacaaacgaaaagagtttaaagg

SEQ ID NO: 243 - DNA, 693 bp, Triticum aestivum
cccaaccccaacttcccactcgatcaccaaacaaacaagaatcccttccttcgtttgacgagcagcagcaatgaatcgttcgtaccagactgcttgatcaaagcatccgtcagagatccatggcgatggagaggttcttcacgacgctcgtcttctgtgaggcgccgctagacggctatggcacatcggtgctcaccgccggcacggtcaaaaggctggtctctcgtggcggcgatgcgaccgagccggcggtggctaacaagccagacgctgagaaggagcagggtttcttctctggcaagccgacttccgaaaggcgcgctgctttcgagcttgccttcgacggcgtcaattgcttcgacaccatggttatgcactaagcatgttagttatcttgattgaatttgagctgtatgtaaaaactcggatcagttagaaattactagaatgcttgacgcggacgtggacttgtgatttttttttgttcattcgattgtattgtactgttcgactggtccataagcatcagtacaaatgacaggatcttaaagtggatatctagtagtatcagtttgtagcttgggttcagagtttatgtagatcacatcatattcagtcagcctgtgtttctgactatatatcttgcacacacttggcggaggaacaatgcaattaagaggtgtggctctgctt

SEQ ID NO: 244 - DNA, 1809 bp, Triticum aestivum
ttgaagagatgtttccagtgacgggttcgccgaaatgcgttgctttccgatcaaagcatacccgcaagtaccttggtagcgtgcatgtagggagcgaggagagcgccgtcggcggaggcaggttcttcgaggagctgagcgacggcgccgacgacgtcgatgtccttgcaagcccgtacactagattctacctggagccatccaaggagcacgacgggctcctgcacgtcaggtgctgccacaacaacaagtactgggtggccaaacatggcggtgaaggcagcggccactggatcattggcatcgtcaatgaaccgaacgacgacctgtccaagccgtcatgcacgctttttgagcccgtccctctcacggacggggacaataatctatccatcaggttcttccgtccccagcagacaaccagctctgaatctgagatggtcatggaaaaggagacagcagaagaagcctacttgcgtctgggaaccggagggcatgaaaaaacagttgatcaagtgaaatctcttcatgacttctccgccattgatctgtcgaagcaattggtactgcccaaatatgttgcttttaaaggcgacaatgacatgtacctccgggcaaggatcatccagaaatacaattacctggaattctcatcatctgatattgcagattcaactgtggtcaacactattttccccaactatgctaatggaaacgtgcgcataaaatctaaccacttcaacaggttttggaggctcagccccaactggatctgggctgactccgccgacagcagcagcagagaccgtgacacactcttcagggtggtcatgttgcctgactacatcggtctccagaacctgggaaactccaggtactgcaagaggctaactgccgacagaaagacaagctgccttaacgccgccgtcgataccatcacactggaagcaaggttacgggtggaagaagccgtactttcacgagagatctatggcgtggagttcaagctctccgaagctaggatctacggcgagaagcctattacctttcccagcatgacttcaaccaatgacaccaacgaaccacatgccaagaccctgaccctgaaatacgaggagacgcaggccaagacctggagctcgactgttagcctcaagattggtgtcacggccaagttaagagctgggatcccagtcatagcagaagggaaggttgaggtatccactgaattcaattcagaatacgagtgggggtcatccattcatacaacggcctcacaagaggcctcctaccatgctgtggtgcctccgatgaccaaggtgacagtcagagcggctgtgacacagggttctgttgacgtcccgttctcctacactcagagggacattctgaccacaggagaggttgttacctacaagatggatgatggtctgttcactggtatgaacaactataatttccaatttgaagccacacaagagcccatttgaagtgacgatgcatgcattagttagccgtattaaataaagccatccctgccttggagtggcccggcttttctgtgtggtgatttgatggtgtgttgtgactttcattttattttttagtttgtgggttgtgtgctcttatatgtttccctttacccactatatacatttctatttgatgatcgacagaatattgtgccccctccgttttgctttatttggcatagttatgctaatttagagcatcttgtgggttgtaactgttattttatattttttactatgtggactgtgtgttgttatatactacaccagtattatt

SEQ ID NO: 245 - DNA, 1777 bp, Triticum aestivum
tgtttccagtgacgggttcgccgaaatgcgttgctttccgatcaaagcatacccgcaagtaccttggtagcgtgcatgtagggagcgaggagagcgccgtcggcggaggcaggttcttcgaggagctgagcgacggcgccgacgacgtcgatgtccttgcaagcccgtacactagattctacctggagccatccaaggagcacgacgggctcctgcacgtcaggtgctgccacaacaacaagtactgggtggccaaacatggcggtgaaggcagcggccactggatcattggcatcgtcaatgaaccgaacgacgacctgtccaagccgtcatgcacgctttttgagcccgtccctctcacggacggggacaataatctatccatcaggttcttccgtccccagcagacaaccagctctgaatctgagatggtcatggaaaaggagacagcagaagaagcctacttgcgtctgggaaccggagggcatgaaaaaacagttgatcaagtgaaatctcttcatgacttctccgccattgatctgtcgaagcaattggtactgcccaaatatgttgcttttaaaggcgacaatgacatgtacctccgggcaaggatcatccagaaatacaattacctggaattctcatcatctgatattgcagattcaactgtggtcaacactattttccccaactacgctaatggaaacgtgcgcataaaatctaaccacttcaacaggttttggaggctcagccccaactggatctgggctgactcggccgacaccagtagcagagaccgtgacacgctcttcagggtggtcatgttgcccgactacatcggtctccagaacctaggaaactccaggtactgcaagaggctaactgccgacaagaagacaagctgccttaacgccgccgtcgataccatcacccttgaagcaaggttacgggtggaagaagccgtactttcgcgagaggtctatggcgtggagttcaagctctccgaagctaggatctacggcgagaagcctcttacctttcccagcatgacttcaaccaatgacaccaacgaaacacatgccaagaccctgaccctgaaatacgaggagacgcaggccaagacctggagctcgactgttagcctcaagatcggtgtcacggccaagttaagagccgggatcccggtcatagcagaagggaaggttgaggtatccactgaattcaactcagagtacgagtgggggtcatccattcagacaacgacatcacaagaggcctcctaccaggctgtggtgcctccgatgaccaaggtgacaatcagagcggctgcgactcagggttctattgacgtcccgttctcctacactcagaaggacattctgaccacaggagaggttgttacctacaagatggacgatggcctgttcactggtatgaacaactataatttccaatttgaagccacacaagagcccatctgatgtgaagatgcatgcattagttagcagtattaaataaagccatcccaacctgggagtggcccggcttttctgtgcggtgattcgatggtgtattgtaatttttatttaatttttactttgtgggttgtgtgctcttatattgttcccctttaccccactgtatacttttctatgtgatgattgacagatatctgcccctccgtttgtcttaagaaaaagaaaagtaaccgactgcgactctgtcgtgatactggccgcgtctcgttgagactgccacggacacacgagggagtagg

SEQ ID NO: 246 - DNA, 1839 bp, Triticum aestivum
gatgtttccagtgacgggctcgccgaaatgcgttgctttccgatcaaagcatacccgcaagtacctaggtagcgtgcaagcagggagcgaggagagcgccggcggaggcaagttcttcgaggagctgagccacggcgccgacgacgtcgatgtccttgcaagcccgtacactagattctacctggagccatccaaggagcacgacgggctcctgcacgtcaggtgctgccacaacaacaagtactgggtggccaaacatgtcggtgaaggcagcggccactggatcattggcatcgtcaatgaaccggaggacgacctgtccaagccgtcatgcacgctttttgagcccatccctctcgcggacacggacaataatctatccatcagattcttccgtcctcagcagacaacaagctctgaatctgatatgaccaaggaaaaggggacaactgaagaagcctacctgtttctgggaatcggagggcatgaaaaagcagttgatcaagttaaatctcttcatgacttctccgccattgatctgtcgaagcaattggtactacctaaatatgttgcttttaaaggcgacaatgacatgtacctccgggcaaggatcatccagaaacgcaattacctggaattctcatcatctgatattgcagattcaactgtggtcaacactattttccccaactatgctaatgggaacgtgcgcataaaatctaaccacttcaataggttttggaggctcagccccaactggatctgggctgactcggccgacaccagtagcagagaccgtgacacgctcttcagggtggtcatgttgcccgactacatcggtctccagaacctgggaaactccaggtactgcaagaggctaactgccgacagaaagacaagctgccttaacgccgccgtcgataccatcacactggaagcaaggttacgggtggaagaagccgtactttcccgaaagatctatggcgtggagttcaagctctccgaagctaggatctacggcgagaagcctattacctttcccagcatgacttcaaccaatgacaccaacgaaccacatgccaagaccctgaccctgaaatacgaggagacgcaggccaagacctggagctcgactgttagcctcaagattggtgtcacggccaagttaagagctgggatcccagtcatagcagaagggaaggttgaggtatccactgaattcaattcagaatacgagtgggggtcatccattcatacaacggcctcacaagaggcctcctaccatgctgtggtgcctccgatgaccaaggtgacagtcagagcggctgtgacacagggttctgttgacgtcccgttctcctacactcagagggacattctgaccacaggagaggttgttacctacaagatggatgatggtctgttcactggtatgaacaactataatttccaatttgaagccacacaagagcccatttgaagtgacgatgcatgcattagttagccgtattaaataaagccatccctgccttggagtggcccggcttttctgtgtggtgatttgatggtgtgttgtgactttcattttatttttagtttgtgggttgtgtgctcttatatgtttccctttacccactatatacatttctatttgatgatcgacagaatattgtgccccctccgttttgctttatttggcatagttatgctaatttagagcatcttgtgggttgtaactgttattttatattttttactatgtggactgtgtgttgttatatactacaccagtattattgtaccccacctcccgttccctttaaccaacatagacttctc

SEQ ID NO: 247 - DNA, 1655 bp, Triticum aestivum
gcagtcgaaaggatgtttccagtgacgggctcgccgaaatgcgttgctttccgatcaaagcatacccgcaagtacctaggtagcgtgcaagcagggagcgaggagagcgccggcggaggcaagttcttcgaggagctgagccacggcgccgacgacgtcgatgtccttgcaagcccgtacactagattctacctggagccatccaaggagcacgacgggctcctgcacgtcaggtgctgccacaacaacaagtactgggtggccaaacatgtcggtgaaggcagcggccactggatcattggcatcgtcaatgaaccggaggacgacctgtccaagccgtcatgcacgctttttgagcccatccctctcgcggacacggacaataatctatccatcaggttcttccgtcctcagcagacaacaagctctgaatctgatatgaccaaggaaaaggggacaactgaagaagcctacctgtttctgggaatcggagggcatgaaaaaacagttgatcaagttaaatctcttcatgacttctccgccattgatctgtcgaagcaattggtactacctaaatatgttgcttttaaaggcgacaatgacatgtacctccgggcaaggatcatccagaaacgcaattacctggaattctcatcatctgatattgcagattcaactgtggtcaacactattttccccaactatgctaatgggaacgtgcgcataaaatctaaccacttcaataggttttggaggctcagccccaactggatctgggctgactcggccgacaccagtagcagagaccgtgacacgctcttcagggtggtcatgttgcccgactacatcggtctccagaacctaggaaactccaggtactgcaagaggctaactgccgacaagaagacaagctgccttaacgccgccgtcgataccatcacccttgaagcaaggttacgggtggaagaagccgtactttcgcgagaggtctatggcgtggagttcaagctctccgaagctaggatctacggcgagaagcctcttacctttcccagcatgacttcaaccaatgacaccaacgaaacacatgccaagaccctgaccctgaaatacgaggagacgcaggccaagacctggagctcgactgttagcctcaagatcggtgtcacggccaagttaagagccgggatcccggtcatagcagaagggaaggttgaggtatccactgaattcaactcagagtacgagtgggggtcatccattcagacaacgacatcacaagaggcctcctaccaggctgtggtgcctccgatgaccaaggtgacaatcagagcggctgcgactcagggttctattgacgtcccgttctcctacactcagagggacattctgaccacaggagaggttgttacctacaagatggacgatggcctgttcactggtatgaacaactataatttccaatttgaagccacacaagagcccatctgatgtgaagatgcatgcattagttagcagtattaaataaagccatcccagcctgggagtggcccggcttttctgtgcggtgattcgatggtgtattgtaatttttattttattttttactttgtgggttgtgtgctcttatatgtttccctttacccactgtatac

SEQ ID NO: 248 - DNA, 1651 bp, Triticum aestivum
gatgtttccagtgacgggctcgccgaaatccgttgctttccgatcaaagcatacccgcaagtacctaggtagcgtgcaagcagggagcgaggagagcgccggcggaggcaagttcttcgaggagctgagccacggcgccgacgacgtcgatgtccttgcaagcccgtacactagattctacctggagccatccaaggagcacgacgggctcctgcacgtcaggtgctgccacaacaacaagtactgggtggccaaacatgtcggtgaaggcagcggccactggatcattggcatcgtcaatgaaccggaggacgacctgtccaagccgtcatgcacgctttttgagcccatccctctcgcggacacggacaataatctatccatcagattcttccgtcctcagcagacaacaagctctgaatctgatatgaccaaggaaaaggggacaactgaagaagcctacctgtttctgggaaccggagggcatgaaaaagcagttgatcaagttaaatctcttcatgacttctccgccattgatctgtcgaagcaattggtactacctaaatatgttgcttttaaaggcgacaatgacatgtacctccgggcaaggatcatccagaaacgcaattacctggaattctcatcatctgatattgcagattcaactgtggtcaacactattttccccaactatgctaatgggaacgtgcgcataaaatctaaccacttcaataggttttggaggctcagccccaactggatctgggctgactcggccgacaccagtagcagagaccgtgacacgctcttcagggtggtcatgttgcccgactacatcggtctccagaacctaggaaactccaggtactgcaagaggctaactgccgacaagaagacaagctgccttaacgccgccgtcgataccatcacccttgaagcaaggttacgggtggaagaagccgtactttcgcgagaggtctatggcgtggagttcaagctctccgaagctaggatctacggcgagaagcctcttacctttcccagcatgacttcaaccaatgacaccaacgaaacacatgccaagaccctgaccctgaaatacgaggagacgcaggccaagacctggagctcgactgttagcctcaagatcggtgtcacggccaagttaagagccgggatcccggtcatagcagaagggaaggttgaggtatccactgaattcaactcagagtacgagtgggggtcatccattcagacaacgacatcacaagaggcctcctaccaggctgtggtgcctccgatgaccaaggtgacaatcagagcggctgcgactcagggttctattgacgtcccgttctcctacactcagagggacattctgaccacaggagaggttgttacctacaagatggacgatggcctgttcactggtatgaacaactataatttccaatttgaagccacacaagagcccatctgatgtgaagatgcatgcattagttagcagtattaaataaagccatcccagcctgggagtggcccggcttttctgtgcggtgattcgatggtgtattgtaatttttattttattttttactttgtgggttgtgtgctcttatatgtttccctttaccactgtatacttttctat

SEQ ID NO: 249 - DNA, 5414 bp, Sorghum bicolor
atgcgaccggagcagccatcgcccactccgccgctgccgccgtcacaacagacggaggaagcggcgggagcaccaggaatggacgtgcccaccaggctgccggacccggtgccgtcgccgattctgaggcccgcgtctgccaactccatgaggcggacgcggtcgctgcggtccctcatggccgactcgccgtccgtcaccttcgcaaccaataacctccggtcgggctccaaggccgagtccacggcgtcgtcgctcgagagcttccggttccaccgcgacgggtccgcgtcggggacccccgcctctgggctcgggcgggtgtccaccagcaggcggtccgcgtccgagcgcgccggctcgcagcgcgacctccgcgacgaggacgcccggttcgtgtacatcaacgacgcggagcgcacgaacgcgccgccggcggggctccccgacaactccatccacaccaccaagtacaccgtcctcaccttcctcccgcgcaacctctacgagcagttccaccgggtggcctacctctacttcctcgtcctggtggcgctgaacatggtgccgcagctcggcgtgctctcgccggccgcggccgtgctcccgctggcgttcgtgctcggcgtgacggcggtgaaggacgcgtacgaggactggaggcggcaccggtccgacaagaacgagaacaaccgaacggcgtcggtgctggtgggcggcgtgttcgtgcccaagtgctggaaggaggtgcaggtcggggaggtgctgcgcgtggtggccaacgagacgctgccgtgcgacatggtgctgctgtcgacgagcgaccccacgggcgtcgcctacgtgcagaccatcaacctcgacggtgagtccaacctcaagacgcggtacgccaagcaggagacgatgcccacgccggcggaggcgctggcgggggtcatcaagtgcgagaggcccaaccgcaacatctacggcttcctcgccacggtcgacatcgacggccgccgcgccgtctcgctcggcccctccaacatcgtgctccgtgggtgcgagctcaagaacacggcctgggccgtcggcgtggccgtctacaccggccgggacaccaaggtgatgctcaacagctccggggcgccgtccaagcgcagccgcctggagacgcacatgaaccgcgagaccatcatgctcgccgtcgtcctcttcctcctctgcaccatcgtgtcgctgctcgcgggcatctggctcggcgatcatggcgacgagctcggggtgatccccttcttccgcaagagggacttctccgacaaggacaaaccgaacgccacgtacaactggtacggggcgggcgcggaggtggccttcagcttcatgaagtcggtgatccagttccaggtgatgatccccatcgcgctgtacatctccatggagatcgtcagggtcgggcaggctttcttcatggtgcaggacaagcacatgttcgacgacaagcggcaggccaagttccagtgccgcgcgctcaacatcaacgaggacctggggcagatcaagtacgtcttctccgacaagaccggcacgctcaccgagaaccggatggagttccggtgcgccagcgtgcacggcgccgacttcagcgatactgccgccggcggcggcgacgacgacgggcattccgtgaccgcagcgccccacgcctcgcgctcgcccgccatggccgacgaccacgggtcgtcgcggcacatgtcggcgtcgcagaaggagctgggcgacgaggacgcccgcgtggtgcgcgtgggcgaccccgcgcgcaccaacgagcgcctcgacctcgcgggcaacgccgtgcgcaccgccaagtactcgccgctcaccttcctgccgcggaacctcttcgagcagttccaccgcctcgcctacgtctacttcctcgccatcgccgtgctcaaccagctgccccagctcgccgtcttcgggcggggcgcctccgtcatgccgctcgccttcgtcctcctcgtcaccgccgtcaaggacgcgtacgaggactggcgacgccaccgctccgaccgcgccgagaacggacgcctcgccgaggtcctctcccctgacgcgcacgggggcggcgcccagttcgtccccaccgagtggaagcacgtccgcgtcggcgacgtcgtgcgcgtcgtgtccgacgagtcgctcccggcggacatggtcctcctcgccaccagcgaacccaccggcgtcgcctacgtgcagacgctaaaccttgacggcgagtccaacctcaagacccgctacgccaagcaagagacgctgtccacgccgcccgagcgcctcgccggggccgtcatccgcagcgagcgcccgaaccgcaacatctacggcttccaggccaacctcgagctcgaaggggagacccgccggataccgctaggtccgtccaacatcgtgcttcggggctgcgagctcaagaacacggcatgggccgtcggcgttgtggtgtacgcggggcgggagaccaaggccatgctcaacaacgccggcgcgcccaagaagcgcagccgcctcgagacgcacatgaaccgcgagacgctcttcctctctgccatcctcgtcgtgctctgctccatcgtcgccgcgctctccggcgtctggctgcacacccacgagttggggctcgagctcgcgcagttcttccacaagaaggactacctgcgcctcgacaaggacaatgactaccgcgactacaattactacggcatcgcggcccaaatcgtgttcatctacctcatggcggtcatcgtgttccagatcatgatacccatctcgctctacatctccatggagctggtcaggctggggcaggcctatttcatgatccgagacacgaggctgtacgacgagtcctccaattcgaggttccagtgccgggctctcaacatcaacgaggacctaggccagattaagtgcatattctccgataagaccggcacgctcacacagaataagatggagttccggtgcgcgagcgttgacggtatcgattacagtgacatcgcacggcagcggcctcctgagggtgagcggatttgggcgccaaaaatatcggtgaacaccgatagggagctggtgaagttgatcagggatggggctgataccgagcaagggacgcagactcgggagttctttctcgccctggcaacgtgcaacaccattgttcccatgatcgccgatggtccagaccctaagaagaaggtgattgattaccaaggcgagtcaccggatgagcaggcattggtctctgctgccgcggcatatggctttgtgctagtcgaacgaacatcaggtcacattgtgatcgacgtccttggtgagaagctgagatacgatgtccttggtcttcatgagtttgacagcgatcgcaagaggatgtctgttataattggctgccctgataagtctgtcaagctgtttgtaaaaggtgcagatagttcgatgtttggagtcattgacaaaactgtgaattcagatgttgtccaagcaacagagaagcatctccattcatattcatcactaggtctgcgaacacttgtcattggtatgcgggaacttagccaagaagagtttcaggagtggcaaatggcttatgaaaaggctagcaccgcactactaggaagaggaaaccaactccgcaatgtggctgccaacatcgagacgaacttgcgtctattgggtgccactggaattgatgacaagctgcaggatggagtacctgaagcaattgagaaactgagggaagcagggattaaggtttgggtgttaacaggtgacaagcaagaaactgccatctccatcggctattcgtgcaagcttttgacaagggacatgacacagattgtaattaacagtcgctcaagagactcatgcaggaagagtctagaagatgcaatcgccatggttaacaaataccaatcattctcgacagacccccaacttagggtgccccttgctttgattattgatggtaatagccttgtctacattttcgatacggattgggaagaaaagctttttgaaatcgctatagcttgcgacgtcgtcctatgctgtcgtgtagctccccttcagaaggctggtattgttgatctcataaagaagcgaacaagtgacatgactctagctattggagatggtgctaatgatgtatccatgattcaaatggctgacgttggcattggcatcagtgggcaagagggaaggcaagctgtaatggcctcagattttgccatggggcaattcagatttttggttcctctattgttggtccatggccattggaactaccagaggatggcctacatgatcctatataacttctacagaaatgctacttttgtctttgtgctattctggtatgtgctttacactggtttcaccctaacaacagcaataactgagtggagcagtgtgctatactctgtgatatatactgctgtccctactattgttgttgccattctcgacaaggatctcagccggcggacattgctgaagtatccccaactctatggcccagggcagcgtgaggagaattacaacctgaggctattcatattcatcatgatagactccgtctggcagagccttgcgtgtttcttcatcccctaccttgcatacaggaagagtataattgatggttccagcctcggagatctatggacactatctgttgttattcttgtcaacattcatctggcaatggatgtcatcagatggaattggattacgcatgcagcaatatggggtagcattgctgcaacatggatttgcgtcatgatcatagattccataccaaccatgcctggtttctgggcaatctataaggtgatgggaactgggttgttctgggcactgctgcttgcggtaactgttgttggtatgattcctcattttgccgcaaaggctttcagtgagtacttcatccccagtgacattcagattgcaagagaaatggagaagttgcaagatttccatgatgtaactcatccagaagttcaaatgagtacagtcagtagagcttaggataggatttacacagtgatcttttgttcatgagtaggttagctctacacctttctttggttctttttgttgtgtgtataggcaattctttcagcagtgggcaagctttcttgatgcttgctcccttgccaactatccaaaggataggtccgttgtaccattctgtgtatccaccagccaaattttgttgatttacatgaaaggagatcgtacaggagttaattgtacaaaatagaaactgatcgacatgtcttatgattgtgtacagtacacattcactggagtcaactgtacagattcagaaatcgcacaagctatgttgcagccttataaaagtt

SEQ ID NO: 250 - DNA, 1028 bp, Zea mays
gacccttttcaactgcatctactgcatggattatacacgggcatcgtcgcagcgagcagcccgccccgccggtaacaatctccggaatcctatcatttttgtggctttgttcagggatcatcgtcagtcacatgcttttgatggatcaaaagcgaccgcatagatagcacagagtgacatatcctcccttggggcaatttttagaattgtcttgatattttaggaaccatttttcttttgcatttgatgatgcatttattgattccacaccagttgacgtgtggtctgtgggctgtatctttgcggaaatggtgaaccaaaagccactattccctggtgattctgagatcgacgaactgttcaagatattcagggtgctaggtacaccgaatgaacaaagttggcctggagtcagttgtttgcctgacttcaagactgctttccccaggtggcaatctcaggacctggcaacaatagtcccaaatcttgaacctgctggcttggaccttctctctaagatgcttcggtatgagccaagcaaaagaatcacagctaggcaagcacttgagcacgagtacttcaaggaccttgagatggtacagtgacctgctaaatgtgcttggcgctgctttggcatttgtaattgtatgagctgagtcgctcattcctttttatgggcgtctgtactctctgcatttttgtcgttcagctggatattttgaatctggtgtgttttgagatgtattaaggaatatcaaatagattaccgccttggtctctatttactgaaagtaaatatcctccatgtttatttcctccgaagcatccatggtttccttctcttttgtgtgcatcacgtaatgccgatataaggtagtgtttgtttcgggagccggttgggatggagtggttgtgtctaggagattttagggagtcgaatgattcctcatttgaacataatttttcttttttagtctttctatatgaaactaatccaaataacgacaaaaatatcctccatgttcaga

SEQ ID NO: 251 - DNA, 1063 bp, Zea mays
ctgcatctactgcatggattatacacgggcatcgtcgcagcgagcagcccgccccgccggtaacaatctccggaatcctatcatttttgtggctttgttcagggatcatcgtcagtcacatgcttttgatggatcaaaagcgaccgcatagatagcatagagtgacatatcctcccttggggcaatttttagaattgtcttgatattttaggaaccatttttcttttgcatttgatgatgcatttattgatttcacaccagttgacgtgtggtctgtgggctgtatctttgcggaaatggtgaaccaaaagccactattccctggtgattctgagatcgacgaactgttcaagatattcagggtgctaggtacaccgaatgaacaaagttggcctggagtcagttgtttgcctgacttcaagactgctttccctaggtggcaatctcaggacctggcaacaatagtcccaaatcttgaacctgctggcttggaccttctctctaaaatgcttcggtatgagccaagcaaaagaatcacagctaggcaagcacttgagcacgagtacttcaaggaccttgagatggtacagtgacctgctaaatgtgcttggcgctgctttggcatttgtaattgtatgagctgagtcgctcattcctttttatgggcgtctgtactctctgcatttttgtcgttcagctggatattttgaatctggtgtgttttgagatgtattaaggaatatcaaatagattaccgccttggtctctatttactgaaagtaaatatcctccatgtttatttcccccgaagcatccatggtttccttctcttttgtgtgcatcacgtaatgccgatataaggtagtgtttgtttcgggagccggttgggatggagtggttgtgtctaggagattttagggagtcgaatgattcctcatttgaacataatttttcttttttagtctttctatatgaaactaatccaaataacgacaaaaatatcctccatgttcagaactctatttgtacttatgtttgcataggctaccatgctctaatttca

SEQ ID NO: 252 - DNA, 4709 bp, Zea mays
atggcggtcgacggccagcagcagatccagtggtccaagcgtcagagttgcggtggaggtgctagggccggcgctggcactctggagaagtgtggcgggtctcagccgtccgcgtcgcctcccgtccgccccttccccgtccacgcgagcctccctctgcccctcccgttcgcagttctccgcacgctggcaaccgctccctctctccgcctccacctcgtcgctcccgctccactcgctcctgctccacctcaccgcgcttgcccccgcgccgcggcggtcgcaccagacgccgacgccgccgcactccttcctctcccccgccgcgcaggcgctggtgctcgccatctcctcgcacccgctcccacgctcgcggccttcctggcctcccgccgcgacgagctcctccgcgcggacatcacgtccctgctcacggcgctggagctctcggggcactgggagtgggcacccgcgctcctccggtgggccggcaaggaaggtgccgccgatgcgtcggcgctcgagatggtcgtctgcgcgctgggccacgagggccagcacgacgccgtctgcgtgctgctcgacgaaatgccgctcccgcctggacgtccgcgcctacacgtggactgcgcgtccgacagccagtccaccgagtccgaggccccggcggccgacgacttcgcggacgccatcgtccggggctccgctccgacgaccgcctcctcttcgctcccgctccacacccttaagcaatctctctgttatctgtaagaaaagggattcttttctatcaagctgctaacggccattatttgtatggatctgggttcagattcaacaagacgcaggaacacttccctactctgaaggactacaacgattatctggaagaagttgaggatatgactttcaacctgatcgaagggataaatgtctaggagattgaagcaaaaattgcaagataccaacaggaaaatgcggagcagatatacttgtccagagctaaaagggcggaagatcttgcagaagaagggatcaaggaacagcgaccagagaaaggttgcgtctgtcgctgctcctacgactgctgatgctacgaacaagaggcccagggttagtgccttcttcctcttggatggcagtagaattccgaacttcattttcagcaaaatgtgtacaagcaagcagcattctgccttaactttctttcattgtttactaccttgtgaagtttctgttatgtggtgtaaggtgcatagttttgtattcatcatgagtgaagagatgaagagacttattgcttatgtggaagatctctacgaggatacaaactcatgcaacatggtcaaggtacaatggttcgacaaagttgatgaggttggtgttcccttgcccatggatttcgatgacagggagatcttcttctctctgggccgtcaagatctcaatgtagaatgcattgatggattggctgcagtcctgagtgtccagcactacgagaagttcaagggtgataccagatacaacttgtggcaaccttatttttgctgtcggcagattgataatggtgacatcaaaccttttgatgtcacacagctgcaaggctactggagccaggaagtacttaggaccatgttcaatgcaacttcctctctgaaggtgcgtttcaaggtccctaaatccagacccagttcagatggagggctgaagaggaagcgtgatgcattcaacgatgatgctaatccacagaagttcattccttctggtgcttctacttctaggttttatggtgagaacatccaacaattgtgtcctggttgccatgtggaagtactctctcaagatagtggtataaggggatgttggtttagatgtttgattctgaagaggcataaagataaaatcaaggtgcgctacctagaacttcaggatgctgatgagactggaaacttggaggagtgggttttgctaacacgagttgccaaacctgatcaactgggtgtacgtttccttggaaggccaatggttcgtccacagcgcgtggaacaaagcaaggcctcatgctttgatgttggagccattgttgatgcgtggtggcatggtggctggtgggagggaatcgtgctgtgccaggtgggcagcgggcgtctacaagtttattttccaggagaaaaccgaacagctgaatttggtgaagatgagctgaggtgttcccttgagtgggttggtaacaaatggaatcctttgaagggaagaaaagatgtcacaagcaagctgacctccactgcagattgtggaagtgaatatttgattgcgaaacaagatccactgaattttcatgtgcctaaaaattcagaacctcaactagagagacatcaatatgacaaggggggtattgagaaatcttcagtcagcacaatttcacgagatcagaaacgtgtccttgccgacctgactaatgatttgaagttagataacttgaggtggaggcaaagaaagcagtcggacacaagcagtggaagcagcagcggggacatggacttgctcagcctcagccccagtggaagctttggtcatcataatttagtgcctgacgaggagacatgcaagagaagtggagagcagacttttatgggtctgcgaggtagtaccatcgacgaggcttctccatcccctccggcgagctccccttccaaaaaacgtggtgagctgaagctgacccttttcagctgcatctactgcatggattatacacgggcgtcgtcgcagcgagcagcccgccccgccgttgacgtgtggtctgcgggctgtatctttgcggaaatggtgaaccaaaagccactattccctggtgattctgagatcgacgaactgttcaagatattcagggtgctaggtacaccgaatgaacaaagttggcctggagtcagttgtttgcctgacttcaagactgctttccccaggtggcaatctcaggacctggcaataatagtcccaaatcttgaacctgctggcttggaccttctctctaaaatgcttcggtatgagccaagcaaaagaatcacagctaggcaagcacttgagcacgagtacttcaaggaccttgagatgctggatattttgaatctggtgtgttttgagatgtattaaggaatatcaaatagattaccgccttggtctctatttactgaaagtaaatatcctccatgtttatttcctccgaagcatccatggtttccttctcttttgtgtgcatcacgtaatgccgatataaggtagtgtttgtttcgagagccggttggaatgggccggttgggatggagtggctgtgtctaggagattttagggagtcgaatgattcctcatttgaacataatttttcttttttagtctttctatatgaaactaatccaaataacgacaaaaatatcctccatgttcagaactctatttgtacttatgtttgcataggctaccatgctctaatttcacacgagattttgagatacttcttggcacttgtatttttttgtcattgaagcccatatgctctgctttataaaggtatatgttgatagatgccttattttcatttttatttatattaataccctatattgtttttttgttttgaggaatgaagtgcataggaattttgtagtgtgggcgatgatgcttatcttattctgtgggatgctcaaactggcattggctcaattaattcgatgcttgtcttattctgtgaattttaatatattttatcataatatgttcttccgtagcaacgcacagtcatttacctatattgtaatatttttcatatgtctgtgtataatcaaactctttgatgccaatgtcatggattgacgatgatgaaaaaattacagtgattgactttccgcagatggtgtctgtttctcaccgtaatgcccaaatgttttttgaccgagacattgaatgcatctacaagttctttaacaaaagattcaatctgaggtcagtgaaaaatgaagaacaagctggatctgaaaatgatgatgaaggaaacagcataccttccttttttgtccgtggaaaagggtgctggttccttggacaaggaactagctgccagtggatttaccaggaaagagcaagtggatatggagaagtacaccgaggaagttgttgaagggcatgattccagttcagatgatgagaatgatgaggacagttccgatgagcctgattgtgatcttacccaagtgattcagaggcgcctggaactttttctgaagagtccggttccacaagttaaccggaaatcttcatgggtgatagttgtgtcagattctttcgcgcatagggcaagtaacgcaagtgatagctgtgtcagtttacccccattttcttgggcatcacttgtctcaaataaagtccattggaggttcgcaatttatgttctgtggcatcgcacgggcacctacctatgagtgatgaattgtgctaatttggtgttacattgatgtggtttgtgaaactatgagtataattactattttctaatgttaaattaatttgaaattaactaaaaataattattatgtacatattatttttttctgctctggctcgcgagctaaacgagacagctcgagctcgtaaacgagccgagccgagctgactctgtgactcgttaccttaacgagccgagccgagctggctcgtta

SEQ ID NO: 253 - DNA, 1393 bp, Sorghum bicolor
aaaagccaaaagccaccagggcagggcagcagcaatagaaacgagcggagccagcagcggcggggcgaggagtggaggacgaggaccaggccagcagccccccggcggagaggcgtccccaatggcagctgcagcttcgcccgccgccgcctttccccacctcctgtccctctcctcctaatccccttccatttctcccccaaccccctctcgcttcctcgccagttgcttcgttccgcacccgcagccgtcgccgtcgccgcattcgtggacgcaatggagcagtacgagaagcaggagaagatcggggagggcacctacggggtggtgtacaaggcggtgaacaaggtcaccaacgagacgatcgcgctcaagaagatccgactcgagcaggaggacgagggcgtcccgtccaccgccatccgcgagatctctctcctcaaggagatgaaccacgacaacatcgtcaggttacatgatgttatccacagtgagaagcgcatacatcttgtctttgagttcctggatctggacctgaagaagttcatggactcttgcccggagtttgctaagaatcccactttgattaagtcatacctctaccagatactccgtggtgttgcttactgccattctcatagatttcttcatcgagatttgaaacctcagaacttattgatagatcggcgtactaatacactgaagcttgctgactttggtttatccagggcatttggaattcctgtccgtacatttactcatgaggtagtgacattatggtacagagctccagaaattctgcttggagcgaaacagtattcaacaccagttgatgtatggtctgtgggctgtatctttgctgaaatggtgaaccaaaagccactattccctggtgattctgagatcgacgaactgtttaagatattcagggtactaggtacaccaaatgaacaaagttggccaggagtcagttgtttgcctgacttcaagactgctttccccaggtggcaagctcaggacctggcaacaattgtcccaaatcttgaacctgctggtttggaccttctctcaaaaatgcttcgatacgagccaagcaaaagaatcacagctaggcaagcacttgagcatgagtacttcaaggaccttgagatggtacagtgacctgctaaatgtgcttgacgttgcattggcaattgtatgagctgagtctgctctgtcgctaattccttttgtgaacgcctgtactctcattctctctacatttttgtcattcgactggatattttaaatctggtgtgttttgagatgtattaaggaatttcaagtagattaccgcctgggtctctatttattgaatgtaaatatccttcgtatgtttatttttgccccaagc

SEQ ID NO: 254 - DNA, 1471 bp, Saccharum officinarum
agctgccgcagtcaaacagccaccagggcagcagcaattgaagcgagcagcggcgggggcgaggagtggaggacgaggaccagaccagcacccagcagccccggcggagaggcgtcctcaatggcagctgcagcttcgcccgccgccgcctttccccacctcctctccctctcctcctaatccccttccatttctcccccaaccccctcccgcttcctcgccagttggttcgttccgcagccgtcgccgtcgccgtcgccgcattgggggacgcaatggagcagtacgagaagcaggagaagatcggggagggcacgtacggggtggtgtacaaggggctggacaaggccaccaacgagacgatcgcgctcaagaagatccgcctcgagcaggaggacgagggcgtcccttccaccgccatccgcgagatctctctcctcaaggagatgaaccacgacaacatcgtcaggttacatgatgttatccacagcgagaagcgcatatatcttgtctttgagttcctggatctggacctgaagaagttcatggactcttgcccggagtttgctaagaatcccactttgattaagtcatacctctaccagatactccgtggtgttgcttactgccattctcatagatttcttcatcgagatttgaaacctcagaacttattgatagatcggcgtactaatacactgaagcttgcagactttggtttatccagggcatttggaattcctgtccgtacattcactcatgaggtagtgacattatggtacagagctccagaaattctgcttggagcgaaacagtattccacaccagtcgatgtatggtctgtgggctgtatctttgcggaaatggtgaaccaaaagccactattccctggtgattctgagatcgacgaactgtttaagatattcagggtactaggtacaccaaatgaacaaagttggccaggagtcagttgtttgcctgacttcaagactgctttccccaggtggcaggctcaggacctggcaacaattgtcccaaatcttgaacctgctggtttggaccttctctcgaaaatgcttcgatacgagccaagcaaaagaatcacagctaggcaagcacttgagcatgagtacttcaaggaccttgagatggtacagtgaaatgtgcctgacgttgcattggcatttgtatgaactgagtcgctctgtcgctcattacttttatgaacgcctgtactctcattctctctctgcatttttgtcattcaactggatatgttgaatctggtgtgttatgagatgtattaaggaatgtcaagtaaattaccgccttggtctctatttattgaatgtaaaaaaaaaaaaaagggccgccgctctaaagatccaacttacctacccgtcattcaactcatatctctctattattcacctaaatcaattacttgccatctttacacacgtcctacttg

SEQ ID NO: 255 - DNA, 760 bp, Cenchrus ciliaris
aagcttgcagattttggtttagccagagcatttggaattcctgtccgtacattcactcatgaggtggtgacgttatggtacagagccccagaaattcttcttggagcaagacagtattccacaccagttgatgtatggtctgtgggttgtatctttgcggaaatggtgaaccaaaagccactattccctggtgattctgagatcgatgaactgtttaagatattcagggtactaggtacaccaaatgaacaaagttggccaggagttagctgtttgcctgacttcaagactgctttccccaggtggccggctcaggacctggcaacaatcgtcccaaatcttgaacctgctggtctggatcttctctctaaaatgcttcggtacgagccaagcaaaaggatcacagctaggcaggctcttgagcatgagtacttcaaggaccttgcgatggtacagtgacctgctagtgtggtgtgtttggcatttgtatgagctgagccccttcgtttcattccttttatgaacccgtgtacctctctctctctctctctctctctctctctctctctctgcatttttgtcattcagctggatatttcgaatctggtgtgctttgagatgtattcaggaatatcaagtagattacctccttgcctctattcgttgaaagtaaatatccttcatatgtttatcttttgttttccaagccttggtgggtttttccccttgaacatttatactgtaatgtttttatgagtgc

SEQ ID NO: 256 - DNA, 1170 bp, Setaria italica
cccttcccccctcttccttcctcacctgtctgttccgcaaccgccgccgccgcattgggcgcctaggaggggggcgcaatggagcagtacgagaagaaggagaagattggggagggcacgtatggggtggtgtacaaggcgctggacaaggccaccaacgagacgatcgcgctcaagaagatccgcctcgagcaggaggatgagggcgtcccctccaccgccatccgcgagatctctctactcaaggagatgaaccacggcaacatcgtcaggttacatgatgttgtccacagcgagaagcgcatatatcttgtctttgaatacctggatctggacctcaagaagttcatggattcttgtccggagtttgcgaaaaatcccactttgatcaagtcatacctctaccagatactccgtggtgttgcttactgccattctcatagagttcttcatcgagatttgaagcctcagaatttattgatagatcggcgtactaatgctgtgaagcttgcagattttggtttagccagagcatttggaattcctgtccgtacatttactcatgaggtggtgacattatggtacagagccccagaaattcttcttggagcaagacagtattccactccagttgatgtatggtctgtgggttgtatctttgcggaaatggtaaaccaaaagccactattccctggtgattctgagatcgatgagctgtttaagatattcagggtactaggtacaccaaatgaacaaagttggccaggagttagctgtttgcctgacttcaagactgctttccccaggtggccggcccaggacctggcagcaatcgtcccaaatcttgaacctgctggtttggaccttctttctaaaatgcttcggtacgagccaagcaaaagaatcacagctaggcaggctcttgagcatgagtacttcaaggaccttgagatggtacagtgacctgctagtgtggtgtgttggcatttgtatgagctgagtcccttgtttcattccttttatgaacccgtgtactctctctctctctctctctctctctctctctctctctgcatttttgtcattcagctggatatttcgaatctggtgtgctttgagatgtattcaggaatatcaggtagattacctccttggtctctattcgttgaa

SEQ ID NO: 257 - DNA, 1266 bp, Zea mays
gaggagtggaggacaccgatccccgccggagagcgcgtccatcccaaatggcgactgcagcttcgcccgccgctgcctttccccacatcctctccctctcctcctaatcccctcccaatccccccctctctctctcttcctcgccagctggttcgttccgcacccgccgccgcattgggtgccgaggagggacgcaatggagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcaggttacatgatgttgtccacagcgagaagcggatatacctcgtcttcgagtacctggatctggacctcaagaagttcatggactcttgcccggagtttgctaagaatcccactttgattaagtcatacctctaccagatactccgtggcgttgcgtactgccattctcatagagttcttcaccgagatttgaaacctcagaacttgttgatagatcggcgtaataatgcactgaagcttgcagactttggtttagccagggcatttggaattcctgtccgtacatttactcatgaggtagtgacattatggtacagagctccagaaatccttcttggagcgagacagtattccacaccagttgacgtatggtctgtgggctgtatctttgcggaaatggtgaaccaaaagccactattccctggtgattctgagatcgacgaactgttcaagatattcagggtgctaggtacaccgaatgaacaaggttggcctggagtcagttgtttgcctgacttcaagactgctttccccaggtggcaagctcaggacctggcaacaatagtcccaaatctagaacctgctggcttggaccttctctctaaaatgcttaggtatgagccaagcaaaagaatcacagctaggcaagcacttgagcacgagtacttcaaggaccttgagatggtacagtgacctgctaaatgtgcttcgcgttgctttggcatttgtaattgtctgagctgagtcgctcattcctttttatgggcgtctgtactctctcattctctctgcatttttgtcgttcagctggatattttgaatctggtgtgttttgagatgtattaaggaatatcaaatagattaccgccttggtctct

SEQ ID NO: 258 - DNA, 934 bp, Panicum virgatum
caggttacatgatgttatccacagcgagaaacgcatatatcttgtcttcgaatacctggatctggacctcaagaagttcatggattcttgcccggactttgcgaaaacccccactttgattaagtcctacctctaccagatactccgtggcattgcctactgccattctcatagagttcttcatcgagatttgaaacctcagaatttattgattgatcggcgcactaatgccctgaagcttgcagactttggtttagccagggcatttggaattcctgtccgtacatttactcatgaggtagtgacattatggtacagagctccagaaattcttcttggcgcaagacagtattctacaccagttgatgtatggtctgtgggctgtatctttgctgaaatggtgaaccaaaagcccttattccctggtgattctgagattgatgaactgtttaagatattcagggtactaggtacaccaaatgaacaaagttggccaggagtcagctgtttgcctgacttcaagactgctttccccaggtggccggctcaggacctggcaacaatcgtcccaaatcttgaacctgctggtttggaccttctctctaaaatgcttcgatacgagccaagcaaaagaatcacagctaggcaggctcttgagcatgagtacttcaaggaccttgagatggtacagtgacatgctagtgtggtactgtggtgtgttggcatttgtatgagctgagtcgctcgtttcattcctttttatgaacccctgtactccctcccttcccgccctccttatctctgcatttttgtcattcagctggatatttcgaatctggtgtgctttgagatgtattcaggaatatcaactagattaccgccttggtctctattcgttgaaagtaaatatccttcacatgtttatctcttgttt

SEQ ID NO: 259 - DNA, 1401 bp, Panicum virgatum
gggcagcaggcagcaatagaagcgagcagcagcggggcgaggaggaccagcagccaagcccccacggcgaggcgtccccaatggccgctgcagctttgcccgccgcggccgctcccgcttttccccacctcttctccatctcctcctgatccccttccatttctccccatccccctcttccttcctccacgcctgtttgctccgcaaccgtcgcagtcgccgccgccgcattgggagccgaggaagggcgacgcaatggagcagtacgagaagcaggagaagattggggagggcacctacggggtggtgtacaaggcggtggacaaggccaccaacgagttcatcgcgctcaagaagatccgcctcgagcaggaggatgagggcgtcccctccaccgccatccgcgagatctctctgctcaaggagatgaaccacggcaacatcgtcaggctacatgatgttatccacagtgagaaacgaatatatcttgtcttcgaatacctggatctggacctcaagaagttcatggattcttgcccggactttgccaaaacccccactttgatcaagtcctacctctaccagatactccgtggcgttgcttactgccattctcatagagttcttcatcgagatttgaaacctcagaatttattgattgatcggcgcactaatgccctgaagcttgcagactttggtttagccagggcatttggaattcctgtccgtacatttactcatgaggtagtgacattatggtacagagctccagaaattcttcttggagcgagacagtattctacaccagttgatgtatggtctgtgggctgtatctttgctgaaatggtgaaccaaaagccactattccctggtgattctgagattgatgaactgtttaagatattcagggtactaggtacaccaaatgaacaaagttggccaggagtcagctgtttgcctgacttcaagactgctttccccaggtggccggctcaggacctggcaacaatcgtcccaaatcttgaacctgctggtttggaccttctctctaaaatgcttcgatacgagccaagcaaaagaatcacagctaggcaggctcttgagcatgagtacttcaaggaccttgagatggtacagtgacctgctagtgtggtactgtgatgtgttggcatttgtatgagccgagtcactcgtttcattcctttttatgaacccctgtactccctccctccctccctgtctctgcatttttgtcgttcagctggatatttcggatctggtgtgctttgaggtgtattcaggaatatcaactagattaccgtcttggtctctattcgatgaaagtaaatatccttcacatgtttatctattgttttcccaagcgtcgatggtttctttttt

SEQ ID NO: 260 - DNA, 1420 bp, Zea mays
tgcatggattatacacgggcgtcgtcgcagcgagcagcccgccccgccggtaacaatctctggaatcctatcattttcgtggctttgttcagggatcatcgtcagtcacatgcttttgatggatcaaaagcgaccgcatagatagcacagagtggcatatcctcccttggggcaattttcagaattgtcttgatattttaggaaccatttttcttttgcatttgatgatgcatttattgattccacaccagttgacgtgtggtctgtgggctgtatctttgcggaaatggtgaaccaaaagccactattccctggtgattctgagatcgacgaactgttcaagatattcagggtgctaggtacaccgaatgaacaaagttggcctggagtcagttgtttgcctgacttcaagactgctttcccccggtggcaagctcaggacctggcaataatagtcccaaatcttgaacctgctggcttggaccttctctctaaaatgcttcggtatgagccaagcaaaagaatcacagctaagcaagcacttgagcacgagtatttcaaggaccttgagatgattgacgatgatgaaaaaattacagtgattgactttccgcagatggtgtctgtttctcaccgtaatgcccaaatgttttttgaccgagacattgaatgcatctacaagttctttaacaaaaggttcaatctgaggtcagtgaaaaatgaagaacaagctagatctgaaaatgatgatgaaggaaacagcagaccttcctttttgtccgtggaaaagggtgctggttccttggacaaggaactagctgccagtggatttaccaggaaagagcaagtggatatggagaagtacaccgaggaagttgttgaagggcatgattccagttcagatgatgagaatgatgaggaagtacgtctgcctagcaagttagtttgaacatgtgcagactgtaccagtgaccaggtcgtcgggccagtctctggttaggggtcactgttattgaagtgtattttggttgtctctcaggacagttccgatgagcctgattgtgatcttacccaagtgattcagaggcgcctggaactttttctgaagaggttagttgtcttcccatcagaatgaacaaacaacttctgattgcattttcttacatctgttttcaccacacagcatggaacaagttgtagcgtcgagaacagattggaaattcctccctcgggtggcaatggagtggttatggcaccgctcaaatctaggatcaagacgttttccacggaagttttacatgtagagtaaaaaaaaggtcctgctctcgtgttctcgtgtaaaactggattctgttcaattcttactgtggagctatgcttcctaggtaaaacttctcgatttgtataaacttcttgattt

SEQ ID NO: 261 - DNA, 1042 bp, Pennisetum glaucum
ggcacgtacggggtggtgtacaaggcggtggacaaggtcaccaacgagacgatcgcgctcaagaagatccgcctcgagcaggaggacgagggcgtcccctccaccgccatccgcgagatctccctcctcaaggagatgaaccacggcaacatcgtcaggttacaagatgtcgtccacagtgagaagcgcatatatcttgtctttgaatacctggatctggacctcaagaagttcatggattcttgtccggagtttgcgaaaaatcccgctttgatcaagtcatacctctaccagatactccgtggtgttgcttactgtcactctcatagagttcttcatcgagatttgaagcctcagaatttattgatagatcggcgtactaatgccctgaagcttgcagattttggtttagccagagcatttggaattcccgtccgtacatttactcatgaggtggtgacattatggtacagagccccagaaattcttcttggagcaagacagtattccacaccagttgatgtatggtctgtgggttgtatctttgcggaaatggtgaaccaaaagccactattccctggtgattctgagatcgatgaactgtttaagatattcagggtactaggtacaccaaatgaacaaagttggccaggagttagctgtttgcctgacttcaagactgctttccccaggtggccggctcaggacctggcaacaatcgtcccaaatcttgatcctgctggtttggatcttctctctaaaatgcttcggtacgagccaagcaaaaggatcacagctaggcaggctcttgagcatgagtacttcaaggaccttgcgatggtacagtgacctgctagtgtggtgtgtttggcatttgtatgagctgagccccttcgtttcatcccttttatgaacccgtgtactctccctcccccgtctctctctctctctctctgcatttttgtcattcagctggatatttcgaatctggtgtgctttgagatgtattcaggaatatcaagtagattacctccttgcctca

SEQ ID NO: 262 - DNA, 475 bp, Echinochloa colona
aggtagtgacattatggtacagagctccagaaattcttctaggagcgagacaatactccacacctgttgatgtatggtctgtgggttgtatctttgcggaaatggtgaaccaaaagccactattccctggtgattctgagatcgatgaactgtttaagatattcaggatactaggtacaccaaatgaacaaagttggccaggagtcagctgtttgcctgacttcaagactgctttccccaggtggccggctcaggacctgacaacaatcgtcccaaatcttgaaccttctggtttggacctcctctctaaaatgctgcgatacgagccaagcaaaagaatcacagctaggcaggctcttgagcatgagtacttcaaggaccttgagatggtacagtgatctgctagtgtggtgtgccggcatttgtatgagcttagtcgctcttttcattccttttatgaccccctgtactctct

SEQ ID NO: 263 - DNA, 1147 bp, Zea mays
gcgagcagcagtaggcagcggcgcgggcgaggagcagaccagcacccagcagccctcgtcggggggcggcagctgcagcttcaccagccgccgcctttccccgtctcctctgcctctgcctctccccctaacccccttccatttctccaccccaccccgctcccgcttccgcttcctcgccacttagttcgttccgcacccgcagccgcggctgcgttcgcattgggggcacgcaatggagcagtacgagaaggtggagaagatcggggagggcacgtacggggtggtgtacaaggcgctggacaaggccaccaacgagacgatcgcgctcaagaagatccgcctcgagcaggaggacgagggcgtcccgtccaccgccatccgcgagatctctctcctcaaggagatgaaccacggcaacatcgtcagattacatgatgttgtccacagcgagaagcgcatataccttgtcttcgagtacctggatctggacctcaagaagttcatggactcctgcccggagtttgctaagaatcccactttgatcaagtcatacctctaccagatactccatggtgttgcgtactgccattctcatagagttcttcatcgagacttgaaacctcaaaacttattgatagatcggcgcactaatgcactgaagcttgcagactttggtttagccagggcatttggaattcctgtccgtacatttactcatgaggtagtgacattatggtacagagctccagaaattctgcttggagcgcggcagtattccacaccagttgatgtgtggtctgtgggctgtatctttgcggaaatggtgaaccaaaagccactattccctggcgattctgagatcgacgaactttttaagatattcaggatactaggtacaccgaatgagcagagttggccaggagtcagttgtttgcctgacttcaagacagctttccccaggtggcaagctcaggacctggcaacagtagtcccaaatcttgaccctgctgggttggaccttctctctaaaatgcttcgatacgagccaagcaaaagaatcacagcgaggcaagcacttgagcatgagtacttcaaggaccttgaagtggattgctgacgttcgcatctccgcatcttccttggc

SEQ ID NO: 264 - DNA, 1312 bp, Oryza sativa
aaggcaagcgagttgggaggaggaccagcgagcaaccagccccccgcccccaatggcggcagcagcagctttgcccaccgctgccgcttttgcccacctctcctccgattaatcccctcccctcctcttcctcccacttctccgcctcctcttcctcccctcgccgaccctacctactcgcgccgccgccgtcgcattgggcggcaaacggagggggggttaaccctgatggagcagtacgagaaggaggagaagattggggagggcacgtacggggtggtgtacagggcgcgggacaaggtcaccaacgagacgatcgcgctcaagaagatccggcttgagcaggaggatgagggcgtcccctccaccgcaatccgcgagatctcgctcctcaaggagatgcatcacggcaacatcgtcaggttacacgatgttatccacagtgagaagcgcatatatcttgtctttgagtatctggatctggacctaaagaagttcatggactcttgtccagagtttgcgaaaaaccccactttaattaagtcatatctctatcagatactccgcggcgttgcttactgtcattctcatagagttcttcatcgagatttgaaacctcagaatttattgatagatcggcgtactaatgcactgaagcttgcagactttggtttagccagggcatttggaattcctgtccgcacgtttactcacgaggttgtaaccttgtggtatagagctccagagatccttcttggatcaaggcagtattctacaccagttgatatgtggtcagttggttgtatctttgcagaaatggtgaaccagaaaccactgttccctggtgattctgagattgatgaattatttaagatattcagggtactaggaactccaaatgaacaaagttggccaggagttagctcattacctgactacaagtctgctttccccaagtggcaagcacaggatcttgcaactattgtccctactcttgaccctgctggtttggaccttctctctaaaatgcttcggtacgagccaaacaaaaggatcacagctagacaggctcttgagcatgaatacttcaaggaccttgagatggtacaatgaccctgctatggctttacattggattggcatatgtatgggctgggctcctcatttcattccttctgtgaacgctgtgcccttcgtttgggcatttttgtcattcagctggatatttcaaatcttgtgtgtttgatatgtattcaggaacgctaaatagatcaccgtcttggtctctatttgttcagagtaaatatcttcc

SEQ ID NO: 265 - DNA, 2297 bp, Oryza sativa
ccgcctccatcgtctcgcccccgccccgaacgatccatctgctcggaacggaattacataaagtactagtagaccgctgggctgggctgggctgcgctgggttgggaggacggtttggtcaatggactgaacaaaaaggaaaaagtgcactgaagatccctcaacttatcatcgaattacaaaatcgtccttaaatcgtaaaaccccctgacttacaaaaccagtacaaactaaatccctcggcaattttgactccggttttatccttagggggggccacgtgggtcccacatgtcagccccttcttcccctcccctctcttcctctctcctcttcttttctctccctccgccactcgacgcccaaccgagcgcgacctcgccgcgccgcccatggtcctatccacgccgcgtcaggaggaagcagagaagcgtcggcgagtaggtcgtcggccggccgatggaggcagcgacgatcccgagtcgaaggtgcagtagagatggcaacaggatgaggccgagaggatgccgacagtgaggttgaccggtagggggagtcaagattgtcaggggaagcaatagcggtggccttgggccttggatcccggtggcgaggtcgcgctcggccatcgagcccacccccatggcgccccggccatcgatggccggctccgagttctcctacgcgttcgcaatcgtcgccgatccaatctgtactctgatgagagaaggggatagcgttggcaccttggcagcagcaaaggagaggcgcagtcaaagagagtcacgcacgcagttaggggaagcaggcaaggcgagttgggagaaggagaggaggaggagcgagcaatggcggcagcagcagcagctttgcccaccgctgccgcttttccccacctctcctccgattaatcccctcctcccatttctccgcctcccctacctactcgcgccgccgccgccgccgccgtcgcattgggcggcaaacggcctgatggagcagtacgaggaggagaagattggagagggcacgtacggggtagtgtacaaggcgcgggacaaggtcaccaacgagacgatcgcgctcaagaagatccggcttgagcaggaggatgagggtgtcccctccaccgccatccgcgagatctcgctcctcaaggagatgcatcaccgcaacatcgtcaggttacacgatgttatccacagtgagaagcgcataggtcttgtctttgagtatctggatctggacctgaagaagttcatggactcttgtccagagtttgcaaaaaaccccactttaattaagtcatatctctatcagatactccgcggcgttgcttactgtcattctcatagagttcttcatcgagatttgaaacctcagaatttattgatagatcggcgtactaatacactgaagcttgcagactttggtttagccagggcatttggaattcctgtccgcacatttactcatgaggttgtaaccttgtggtatagagctccagagatccttcttggatcaaggcagtattctacaccagttgatatgtggtcagttggttgtatctttgcagaaatggtgaaccagaaaccactgttccctggtgattctgagattgatgaattatttaagatattcagggtactaggaactccaaatgaacaaagttggccaggagttagctcattacctgactacaagtctgctttccccaagtggcaggcacaggctcttgcaactattgtccctactcttgaccctgctggtttggaccttctctctaaaatgcttcggtacgagccaaacaaaaggatcacagctagacaggctcttgagcatgagtacttcaaggaccttgagatggtacaatgaccctgctatggctttacattgaattggcttatgtatgggctgggctgctcatttcattccttgtgtgaacgctgtgcccttcgtttgggcatttttgtcattcagctggatatatttcaaatcttgtgtgtttgatatgtatattcaggaacgctaaatagatcaccgtcttggcctctatttgttgagagtaaatatcttccaatgactgcctttcaggccctgtttagatcctccaaaatggtaaaacttttaccattttagatctaaacactagtagtaaaagttaacaatttggtatttggcatttgctagtctatggtagcaaattttgccaaaaagtgctccggaaccacaccacctctctctctctctctctagtgctaaaatggtaaaactttaagatgtatctaaataccaac

SEQ ID NO: 266 - DNA, 1299 bp, Hordeum vulgare
cagcagcagcagcagcagcttcgcccgccgctgccgctctcccccgcctctcctccccgtgatccgcctcccttcccccgctccctcctctccccctctcatccacccatttcccacgcccgcgccgccgccgccgccgcccccgccggagcattggacgcccgccgacccgatggagcagtacgagaaggtggagaagatcggggagggcacgtacggggtggtgtacaaggcccgggacagggccaccaacgagaccatcgccctcaagaagatccgcctcgagcaggaggacgagggcgtcccctccaccgccatccgcgagatctcgctcctcaaggagatgcagcaccgcaacatcgtcaagctgcacgatgttgtccacagcgagaagcgcatatggctcgtcttcgagtacctggatctggacctgaagaagttcatggactcctgcccagagtttgccaagagtcccgccttgatcaagtcatacctctatcagatactccgtggcgttgcttattgtcattctcatagagttcttcatcgagatttgaaacctcagaatttattgatagaccggcgtactaatgcactgaagcttgcagactttggtttagcaagggcatttggaattcctgtccgtacatttactcatgaggtagtgacattatggtacagagctccagaaatccttcttggagcgaggcagtattccacaccagttgacgtgtggtcagtgggctgtatctttgcagaaatggtgaaccagaagccactgttccctggcgattctgagattgatgaattatttaagatcttcagggtgcttggcactccaaatgaacaaacctggccaggtgtgagctccttgcctgactacaagtccgctttccccaggtggcaggcagaggaccttgcaacaattgtccccaatcttgaacctgttggcctcgaccttctctctaaaatgcttcggttcgagccaaataagaggatcacggccaggcaggctcttgagcacgagtacttcaaggatatggagatggtacagtgagctggctgtgtggtagtgactggcatatgtatgagctgagctgctcgtttcattccttttgcgagacaagccttccccttttcggcatttttgtctgtcaactgaatatttcagatctggtgtgtttgaggtgtgctcaggatttgctgctaaatagattaccatcttggtctctatttgttcaaagtaaatattgtcatgcgttcatctttcaatgaggcatccattcttttgctcctctc

SEQ ID NO: 267 - DNA, 1126 bp, Aegilops tauschii
attggacgccagcccccggccccgatggagcagtacgagaaggtggagaagattggggagggcacgtacggggtggtgtacaaggcccgggacagggccaccaacgagaccatcgcgctcaagaagatccgcctggagcaggaggacgagggcgtcccctccaccgccatccgcgagatctcgctcctcaaggagatgcagcacggcaacatcgtcaagctgcacgatgttgtccacagcgagaagcgcatatggctcgtctttgagtacctggatctggacctgaagaagttcatggactcctgtccagagtttgccaagagtcccgccttgatcaagtcatatctctatcagatactccgcggcgttgcttactgtcattctcatagagttcttcatcgagatttgaaacctcagaatttattgatagaccggcgtactaatgcactgaagcttgcagactttggtttagcaagagcatttggaattcctgtccgtacatttactcatgaggtagtaacattatggtacagagctcctgaaatccttcttggggcaaggcagtattccacaccagttgacgtgtggtcagtgggctgtatctttgcagaaatggtgaaccagaaaccactgttccctggcgattctgagattgatgaactatttaagatattcagggtactgggcactccaaatgaacaaacttggccaggcgtgagctccttgcctgactacaagtccgccttccccaggtggcaggcagaggaccttgcaaccgttgtccccaatcttgaacctgttggcctggaccttctctcgaaaatgcttcggttcgagccaaacaagaggatcacggccaggcaggctcttgagcatgagtacttcaaggacatggagatggtgcagtgagctcgctatgtggtagtgactggcatatgtatgagctgagctgctcgtttcattccttttgtgaacgctctgccttcccctttccagcatttttgtctgtcaactgaatatttcagatctggtgtgtttgaggtgcactctggattgctactaaatagattaccatcttggtctctattttgttcaacgtaaatattgtcatgtgttccattttcaa

SEQ ID NO: 268 - DNA, 1228 bp, Secale cereale
ccgcctctcccccgccccctcctcccccgtcgatccccttccccctctccctcccctcccacctcccgcctcctcgcccatttcgcccccgcgccgccgccgccgccgtagcattggacgcgacccccgatggagcagtacgagaaggtggagaagatcggggagggcacgtacggggtggtgtacaaggcccgggacagggccaccaacgagaccatcgcgctcaagaagatccgcctcgagcaggaggacgagggcgtcccctccaccgccatccgcgagatctcgctcctcaaggagatgcagcaccgcaacatcgtcaagctgcacgatgttgtccacagcgagaagcgcatatggctcgtctttgagtacctggatctggacctgaagaagttcatggactcctgtccagagttcgccaagagccccgccttgatcaagtcatatctctatcagatactccgtggcgttgcttattgtcattctcatagagttcttcatcgagatttgaaacctcagaatttattgatagaccggcgtactaatgcactgaagcttgcagactttggtttagcaagggcatttggaattcctgtccgtacatttactcatgaggttgtgacattatggtacagagctccagaaatccttcttggagcgaggcagtattccacaccagttgacgtgtggtcagtgggctgtatctttgcagaaatggtgaaccagaagccactgttccctggagattctgagattgatgaattatttaagatattcagggtgcttggcactccaaatgaacaaacttggccaggtgtgagctccttgcctgactacaagtccgctttccccaggtggcaggcagaggaccttgcaaccgttgtccccaatcttgaaccagttggcctggaccttctctcgaaaatgcttcggttcgagccaaacaagaggatcacggctaggcaggctcttgaacatgagtacttcaaggacatggagatggtacagtgagagctggctatgtggtagtggctggcatatgtatgagctgagctgctcgtttcattccttttgtgaacgctctgccttccccttttcggcatttttgtctgtcaactgaatatttcagatctggtctggtgtgtttgaggtgcactcgggattgctactaaatagattaccatcttggtctctattttgttcaacgtaaatattgtcatgtgtt

SEQ ID NO: 269 - DNA, 1158 bp, Secale cereale
ggacgcggcccccgatggagcagtacgagaaggtggagaagatcggggagggcacgtacggggtggtgtacaaggcccgggacagggccaccaacgagaccatcgcgctcaagaagatccgcctggagcaggaggacgagggcgtcccctccaccgccatccgcgagatctcgctcctcaaggagatgcagcaccgcaacatcgtcaagctgcacgatgttgtccacagcgagaagcgcatatggctcgtctttgagtacctggatctggacctgaagaagttcatggactcctgtccagagttcgccaagagccccgccttgatcaagtcatatctctatcagatactccgtggcgttgcttattgtcattctcatagagttcttcatcgagatttgaaacctcagaatttattgatagaccggcgtactaatgcactgaagcttgcagactttggtttagcaagggcatttggaattcctgtccgtacatttactcatgaggtagtgacattatggtacagagctccagaaatccttcttggagcgaggcagtattccacaccagttgacgtgtggtcagtgggctgtatctttgcagaaatggtgaaccagaagccactgttccctggagattctgagattgatgaattatttaagatattcagggtgcttggcactccaaatgaacaaacttggccaggtgtgagctccttgcctgactacaagtccgctttccccaggtggcaggcagaggaccttgcaaccgttgtccccaatcttgagccagttggcctggaccttctctcgaaaatgcttcggttcgagccaaacaagaggatcacggctcggcaggctcttgaacatgagtacttcaaggacatggagatggtacagtgagaactggctatgtggtagtggctggcatatgtatgagctgagctgagcctgagctgctcgtttcattccttttgtgaacgctctgccttccccttttcggcatttttgtctgtcaactgaatatttcagatctggtctggtgtgtttgaggtgcactcaggattgctactaaatagattaccatcttggtctctattttgttcaacgtaaatattgtcatgtgttcgtttttcaacgaggcatccattattttgctcca

SEQ ID NO: 270 - DNA, 1279 bp, Triticum aestivum
aatggcggcagcagcagcttcgcccgccgcagccgctctcccccgccgctcctccccgtgatcccctcccccgcttcccccctctcccgcctcccgcctcctcgtccattcccgccgcccgcgccgccgtagcattggacgccgacccccccgatggagcagtacgagaaggtggagaagatcggggagggcacgtacggggtggtgtacaaggcccgggaccgggccaccaacgagaccatcgcgctcaagaagatccgcctcgagcaggaggacgagggcgtcccctccaccgccatccgcgagatctcgctcctcaaggagatgcagcacggcaacatcgtcaagctgcacgacgttgtccacagcgagaagcgcatatggctcgtcttcgagtacctggatctggacctgaagaagttcatggactcctgtccagagtttgccaagagtcccgccttgatcaagtcatatctctatcagatactccgcggcgttgcttactgtcattctcatagagttcttcatcgagatttgaaacctcagaatttattgatagaccggcgtactaatgcactgaagcttgcagactttggtttagcaagggcatttggaattcctgtccgtacatttactcatgaggtagtaacattatggtacagagctcctgaaatccttcttggagcaaggcagtattccacaccagttgacgtgtggtcagtgggctgtatctttgcagaaatggtgaaccagaaaccactgttccctggcgattctgagattgatgaactatttaagatattcagggtactcggcactccaaatgaacaaacttggccaggcgtgagctccttgccagactacaagtccgccttccccaggtggcaggcagaggaccttgcaaccgttgtccccaatcttgaacctcttggcctggaccttctctcgaaaatgcttcggttcgagccaaacaagaggatcacggccaggcaggctcttgagcatgagtacttcaaggacatggagatggtgcagtgagctcgctatgtggtagtgactggcatatgtatgagctgagctgagctgctcgtttcattccttttgtgaacgctctgccttccccttttcggcatttttgtctgtcaactgaatatttcagatctggtgtgtttgaggtgcactcaggattgctactaaatagattaccatcttggtctctatcttgttcaacgtaaatattgtcatgtgttcatttttcaacgaggcatccattattttg

SEQ ID NO: 271 - DNA, 1341 bp, Triticum aestivum
aatggcggcagcagcagcagcagcagcagcagcttcgcccgccgcagccgctctcccccgcccctcctccccgtgatccccttccccttcccctcccccgcttcctcctctcccccctcccgcctcctcacccatttcccacgcccgcgccgccgccgccgccgtagcattggacgccgacccgatggagcagtacgagaaggtggagaagatcggggagggcacgtacggggtggtgtacaaggcccgggacaggaccaccaacgagaccatcgcgctcaagaagatccgcctggagcaggaggacgagggcgtcccctccaccgccatccgcgagatctcgctcctcaaggagatgcagcacggcaacatcgtcaagctgcacgatgttgtccacagcgagaagcgcatatggctcgtctttgagtacctggatctggacctgaagaagttcatggactcctgtccagagtttgccaagagtcccgccttgatcaagtcatatctctatcagatactccgcggcgttgcttactgtcattctcatagagttcttcatcgagatttgaaacctcagaatttattgatagaccggcgtactaatgcactgaagcttgcagactttggtttagcaagggcatttggaattcctgtccgtacatttactcatgaggtagtaacattatggtacagagctcctgaaatccttcttggagcaaggcagtattccacaccagttgacgtgtggtcagtgggctgtatctttgcagaaatggtgaaccagaaaccactgttccctggcgattctgagattgatgagctatttaagatattcagggtactcggcactccaaatgaacaaacttggccaggcgtgagttccttgcctgactacaagtccgccttccccaggtggcaggcagaggaccttgcaaccgttgtccccaatcttgaacctgttggcctggaccttctctcgaaaatgcttcggttcgagccaaacaagaggatcacggctaggcaggctcttgagcatgagtacttcaaggacatggagatggtgcagtgagctcgctatgtggtagtgactggcatatgtatgagctgagctgctcgtttcattccttttgtgaacgctctgccttccccttttcggcatttttgtctgtcaactgaatatttcagatctggtgtgtttgaggtgcactcaggattgctactaaatagattaccatcttggtctctattttgttcaacgtaaatattgtcatgtgttcatttttcaatgaggcatccattattttgctcccctcttttagtttttctgtttactcatcactt

SEQ ID NO: 272 - DNA, 1155 bp, Brachypodium distachyon
ccctcctcctctccctcctcgtctattcatccattccgccgccgccgcattggacgccaatggagcagtacgagaaggtggagaagatcggggagggcacgtacggggtggtgtacaaggcgcgggacaaggccaccaacgagacgatcgcgctcaagaagatccgcctcgagcaggaggacgagggcgtcccctccaccgccatccgcgagatctcgctcctcaaggagatgcagcacggcaacatcgtcaagctgcatgatgttgtccacagcgagaagcgcatatatcttgtctttgagtacctggatctggacctcaagaagttcatggattcttgcccagagtttgccaagaaccccactttgattaagtcgtatctctatcagattctccgcggcgttgcttattgtcattctcacagagttcttcatcgagatttgaaacctcagaatttattgatagatcggcgtactaatgcactgaagcttgcagactttggtttagccagggcatttggaattcctgttcgtacatttactcatgaggtagtaacattatggtacagagcaccagaaattcttcttggagcaaggcagtattccacaccagttgacgtgtggtcagtgggctgtatctttgcagaaatggtgaaccagaagccactgttccctggagattctgagattgatgaattatttaagatattcagggtactcggcactccaaatgaacaaacctggccaggtgtgagctccttacctgactacaagtccgctttccccaggtggcaggctgaggaccttgccactatcgtccccaatcttgaacctgtcggcttggaccttctctccaaaatgcttcggtttgagccaaacaagaggatcacagctaggcaagctcttgagcacgactacttcaaggacatggagatggtataacgagcttgctatgtgtctgacattgtattggcatatttatgagctgagttgctcatttcattccttttgtgaacgctctgccttcctttttggcatttttgcattcaactggatatttaagatctggtgtgttcgaggtgtattaaggaatgctaaatagattaccatcttggtctctattttgttcagagtaaatatttctatgtgtccttta

SEQ ID NO: 273 - DNA, 1965 bp, Cocos nucifera
cgtgtacgcctggcacgtatcatggccaagtgagatgcccttttctcatacagctcacctgcaaagaaatctggataataagaagactgggaagacaattagtagtatatatacacgcgcacgcgcaccgctattagcctatcttagggagaaagaagcagggtattctacttgacagcgacgacactaagcataggagaagacgagggctagagagacagggagggagaggggcggagaggcattcaggcagctccgtgtctctctcgcgcgtcctctctgcccagttcccatgctctctattctttcgaagcccaagaagaaaccctgtctcctcgatttccgcgcccgactccgttcgattctggcagctcctcctctgtcttggggatccgatccttcgtcgtatctcggttttggatttcttgtgtttgtgccccggtagagtttggttgggatctaatggaccagtacgagaaggtggagaagattggggaagggacctacggagtggtgtacaaggctcgagaccgtctgaccaatgagatgatagcgctgaaaaagattcgcctggagcaagaagatgagggagttcccagcacagccatcagagagatctccctcttgaaggaaatgcagcacaacaacatagtcaggttgcaagatgtagttcacagtgagaaacggatttatttagtttttgagtatctggacttggacttgaagaagcacatggattcctctccagagtttgctaaagattttcgtcttgttaaaacatatctctatcagatactccgtggcattgcctactgtcattctcatagggttcttcaccgggatctgaaaccacaaaatttattgatagatcgccgcacaaatgctttgaagcttgctgactttgggctagccagggcttttggcattcccgtccggacatttactcatgaggtagtgacactctggtacagagcaccagaaatcctacttggatcccggcattactccacgcctgtcgatgtgtggtcagttggctgtatttttgctgaaatggtgaaccagaaaccattattcccaggagattccgagattgatgaattgtttaaaatattcagagtacttggcaccccaaatgaagaaacttggccaggggtcacttccttacctgacttcaagtctgctttccccaagtggcctcctaaggatctggcaacagtggtcccaaatcttgaacctgctggagttgatctactctctaaaatgcttcgcttggaaccaagtaaaagaatcacagctcggcaagctctggagcatgagtacttcaaggatcttgggttggtaccgtgatccactctcctccactgtacaatatctcatcaagtacatcggatgttttgcagctttatccttgtatttctgtgaggtttgtgattcgtttgttttcatttcttcatcctgcctcctgaacttgtatggagagctggtgcttggattttcctttgatagcctgaaagcaatcccctcttttcttcatacgtgtttgaggagatccttggcgtcatttaccatgtagatttctggctttcatgctgaaatgatggtaaaacatatttggaggaccaaggtatcaaaaactccctgctccattccagttgcagccaaacaaccgtgcatcaccactttagtgatgaaagtatgtcatttcgtttgtcgatcgagttgcaggagatctgaagtcagttcggttattgattgcgttgcaggaaaactgagttgtgttcatcattctctctgagcatcaacctttgctgagaaggcttatcaaggtggtttctgagttgcttgatcccaagtattcggagtttgcttgatattggtctcgtcctattaaactcatgcatggcctaaaattaggaaactgaaaatttatacttggattaaagtttttcaaattcataattttct

SEQ ID NO: 274 - DNA, 1147 bp, Phalaenopsis aphrodite
aagctgtggagttggttgaatggaccagtatgagaaggtggagaagattggagaaggaacatacggagtagtgtacaaggctcgggacaagctcactaatgagacgattgctttgaagaagataaggttagagcaggaagatgagggagtccccagcacggctattagagagatctctcttttaaaggaaatgcagcatggaaacatagtcaggttgcaagatgttgtgcacagtgagaaacgaatatacttagtttttgagtatttggacttggacttgaagaagcacatggattcatgtccagacttcgccaaagatccacgtttaacgaaatctttcctgttccagatactccgtggcattgcctattgccattcacatagggttcttcaccgagatctgaaaccacagaacttattaatagatcggcggactaatgctttgaaacttgcggactttggactagcccgtgcattcggtattcccgttcggacttttacacacgaggtggtcacactttggtatagagcaccagaaattctccttggagctcgacagtactctaccccagtggatgtgtggtcagttggatgtatttttgctgagatggtcaatcagcgaccattgtttcctggagactcagagattgatgaattgttcaagatatttagagttttaggaaccccaaatgaagaaacttggccaggtgtttcatccttgcctgactttaaatctgctttccccaagtggccctctaaggacctagcaactgtggtaccaaaccttgagcctgcgggagttgatcttctttctaaaatgctccgattggaacccagtaaaagaatcacagctcggcaggctcttcaacatgagtatttcaaggatcttggggtcgttccatgataaggctttttcttcgttctttcctgtctacgtgtttgtttgttctatctcctgattaagtttgataagcaggcagtggactttttattctacctgagttgtgtgcttccatttgtttcttggaagagtttctgtaaagattgtttgtttgtttcccttacatagatcttttgaactcggttatgtcttgacagaaagcagagggggctgctgtctatttgatttgctaggattcgttttaaa

SEQ ID NO: 275 - DNA, 1704 bp, Cocos nucifera
aaaaaacacgcgactcattccttcatcttctccccttattattgcttaatcctgctccctctccccctgtctcatccgtttccaccccggctccgttcgattctggcagctcctccgctgtctcggggatccgatcctccgtcgtagctcggttttggatttcttgtgttcgggagccgatagagtttggctgggattgaatggaccagtacgagaaggtggagaagattggggaagggacctatggagtggtgtacaaggctcgagaccgtctcaccaatgagacgatagctctgaaaaagattcgcctggagcaagaagacgagggagttcccagcacagccataagagagatctcgctcttgaaggaaatgcagcacaacaacgtagtcaggttgcaagatgtagttcacagtgagaagcggatttacttagtttttgagtatctggacttggacctgaagaaacacatggattcctgtccagagtttgctaaagatcctcgtctagttaaaaaatatctctatcagatactctgtggcattgcctactgtcattctcatagggttcttcaccgggatctgaaaccacagaatttgttgatagatcgccatacaaatgctttgaagcttgcagactttgggctagcaagggcttttggcattcctgtccggacatttactcatgaggtagtgacactctggtacagagcaccagaaatcctacttggatcccggcattactccacgcctgtcgatgtgtggtcagttggctgtatttttgctgaaatggtgaatcagaggccattattcccaggagattctgagattgatgaattgtttaaaatattcagagtacttggcaccccaaatgaagaaacttggccaggggtcacttccttacctgacttcaagtctgctttccccaagtggcctcctaaggatctggcaacagtggtcccaaatcttgaacctgctggagttgatctactctctgaaaatgcttcgcttggaaccaagtaaaagaatcacagctcggcaagctctggagcatgagtacttcaaggatcttgggttggtaccgtgatccactctcctccactgtacaatatctcatcaagtacatcggatgttttgcagctttatccttgtatttctgtgaggtttgtgattcgtttgttttcatttcttcatcctgcctcctgaacttgtatggagagctggtgcttggattttcctttgatagcctgaaagcaatcccctcttttcttcatacgtgtttgaggagatccttggcgtcatttaccatgtagatttctggctttcatgctgaaatgatggtaaaacatatttggaggaccaaggtatcaaaaactccctgctccattccagttgcagccaaacaaccgtgcatcaccactttagtgatgaaagtatgtcatttcgtttgtcgatcgagttgcaggagatctgaagtcagttcggttattgattgcgttgcaggaaaactgagttgtgttcatcattctctctgagcatcaacctttgctgagaaggcttatcaaggtggtttctgagttgcttgatcccaagtattcggagtttgcttgatattggtctcgtcctattaaactcatgcatggcctaaaattaggaaactgaaaatttatacttggattaaagtttttcaaattcataattttct

SEQ ID NO: 276 - DNA, 543 bp, Cynodon dactylon
gggctccagaaattcttcttggatcaagacagtattccacaccagtggatgtatggtctgtgggctgtatctttgcagaaatggtgaaccagaagccactattccctggtgattcggagatcgacgaactttttaagatattcagggtactaggtacaccaaatgaacaaagttggccaggagtcacctctttgcctgatttcaagtcagctttccccaagtggcagggtcaggaacttgcaacagttgtcccaaatcttgaacctgctggtctggaccttctctcacaaaagaatcacagctaggcaagcccttgagcatgagtacttcaaggaccttgagatggtacaatgaccttctgtgttcttgacattgtattggcatctgtatgagattagtcgctcgtttccttccttttacggacgctgctctctcttgctccttccctctccctctgcatttttgtcatccagctggatatttggaatctggtgtgttttgagatgtattcagtaatgtcaagtagattaccaccttggtctc

SEQ ID NO: 277 - DNA, 1350 bp, Elaeis guineensis
acgcgattcattccttcaacttctccccttattattgcttaatctcgctcccctctcctgctgtctcgtcggtttccacggccggcttcgttcgattccggcagctccttcgctgtcttggggatccgatcctccgtcgtagctgggttttggatttcttgtgttcgtgagccgattgagtttggttgggattgaatggaccagtacgagaaggtggagaagattggggaagggacctacggagtggtgtacaaggctcgagaccgtctcaccaatgagacgatagctctgaaaaagattcgcctggagcaagaagacgagggagttcccagcacagccataagagagatctcgctcttgaaggaaatgcagcacaacaacgtagtcaggttgcaagatgtagttcacagtgagaaacggatttacttagtttttgagtatctggacttggacctgaagaaacacatggattcctgtccagagtttgctaaagatcctcgtctagttaaaaaatatctccatcagatactctgtggcattgcctactgtcattctcatagggttcttcaccgggatctgaaaccacagaatttgttgatagatcgccgtacaaatgctttgaagcttgcagactttgggctagcaagggcttttggcattcctgtccggacatttactcatgaggtagtgacactctggtacagagcaccagaaatcctacttggatcccggcattactccacacctgttgatgtgtggtcggtcggctgtatttttgctgaaatggtgaatcagaagccattattcccaggagattctgagattgatgaattgtttaaaatattcagagtacttggtaccccaaatgaagaaacttggccaggggtcacttccctgcctgacttcaagtctgctttccccaagtggccttctaaggatctggcaacagtggccccaaatcttgaacctgctggaattgatcttctctctaaaatgcttcgcctggaaccaagtaaaaggatcacagctcggaaagctctggagcatgagtacttcaaggatcttggattggtaccatgatttgctcttctccactgtacattatatcagcaagtatgtcggatgttttgcggctttagccttgtgtttctgtgaggttggtttgtgattcctttgttttcattgctttctcctgcctccgggactctacggagaatttatgcttgggtgcttgggatttccctactcagatagcatgaaagcatctcctcttttcttcatgtatctgaggatatgccgagtgtcatttgctatgtggatttcttgctttcatgctgaaattacgataaa

SEQ ID NO: 278 - DNA, 1203 bp, Lolium multiflorum
atggaccagtacgagaaggtggagaagatcggggagggcacgtacggggtggtgtacaaggcgaaggaccgctacaccaacgagaccatcgcgctcaagaagatccgcctcgagcaggaggacgagggcgtcccctccaccgccatccgcgagatctcgctgctcaaggagatgcagcacggcaacatcgtcaagctacacgatgtcatccacagcgagaagcgcatatggctcgtctttgagtacctggatctggacctcaagaagttcatggactcttctccagagtttgccaagagccctgctttgatcaagtcatatctctatcagatactccgcggcgttgcttattgtcattctcatagagttcttcatcgagatttgaaacctcagaatttattgatagatcggcgtactaacgcactgaagcttgcagactttggtttagccagggcatttggaatccctgttcgtacatttactcatgaggtagtaacattatggtacagagctccagaaattcttcttggagcgaggcagtattccacaccagttgatgtgtggtcagtgggctgtatctttgcagaaatggtgaaccagaagccactgtttcctggcgattctgagattgatgaattatttaagatattcagggtacttggcactccaacagaacaaacttggccaggagtgagctccttgcctgactataagtctgctttccccaagtggcaggcagaggagctggccactgttgtccccaatcttggatctgttggcttggaccttctctccaaaatgcttcggttcgagccaagcaaaaggatcacagctaggcaggctctggagcacgagtacttcaaggacatcgaggtggtacaatgagctggctatttatttgatgttgaattggttggcatatgtatgagctgggctgctcatttcattcctttgtgaacgttgtgcctttggcatttttgtcattcagctggatatttcagatctggtgtgttgggaggtgtactcaggaatgctaaatagattaccatcttggtctctatttgttcaaagtaaatattcccgtgtgtttgtttatcattgagcatttggtggtttgcagtcaatattttaacccattgcttcatcgggttgcaagaactgcgattgctcattgtatactctcctgatacaggatgtgaaact

SEQ ID NO: 279 - DNA, 388 bp, Avena sativa
aggtagtaacattatggtacagagctccagaaattcttcttggagcgaggcagtattccacaccagttgatgtgtggtcagtgggctgtatctttgcagaaatggtaaaccagaagccactgttccctggcgattccgagattgatgaattatttaagatattcagggtactgggcactccgactgaacaaacttggccaggagtgagctccctgcctgactacaagtctgctttccccaagtggcaggcagaggaccttgcatctgttgtccccaatcttggacctattggcttggatcttctctccaaaatgcttcggttcgagccaagcaaacggatcacagctaggcaggctctcgagcacgagtacttcaaggacattgaggt

SEQ ID NO: 280 - DNA, 1418 bp, Elaeis guineensis
cacacacacaccacaattagtctatcagagggagaaagaaacagggtactctatttgacagcgacggcactacccagcattggagaagacaaggggtagagagacagggagggagaggggcggagaggcattcaggcgtctccgtgtctctctcgcgcgtcctctctgcccagttcccatactttctttcgaagcccacgaaggggaagaacccttgtctcctcgatttcggcgcccgaccccgttcgattctggcagctcctcctctgtctcgaggatccgatcttcgtcgtagcttggttttggatttcttgtgtttgtgccccagtagagtttggttgggatctaatggaccagtacgagaaggtggagaagattggggaagggacctacggagtggtgtacaaggctcgagaccgtctgaccaatgagatgatagcgctgaaaaagattcgcctggagcaagaagatgagggagttcccagcacagccataagagagatctccctcttgaaggaaatgcagcacagcaacatagtcaggttgcaagatgtagttcacagtgagaaacggatttatttagtttttgagtatttggacttagacttgaagaagcacatggattcctctccagagtttgctaaagattcgcgtcttgttaaaacatatctctatcagatactccgtggcattgcctactgtcattctcatagggttcttcaccgggatctgaaaccacaaaatttattgatagatcgccgcacaaatgctttgaagcttgcagactttgggctagccagggcttttggcattcctgtccggacatttactcatgaggtagtgacactctggtacagagcaccagaaattctacttggatcccggcattactccacacctgtcgatgtgtggtcagttgggtgcatttttgctgaaatggtgaaccagaaaccattattcccaggagattccgagattgatgaattgtttaaaatattcagagtactcggcaccccaaatgaagaaacttggccaggggtcacatccttacctgacttcaagtctgctttccccaagtggcctcctaaggatctggcaacagtggtcccaaatcttgaacctgccggagttgatctactctctaaaatgcttcgcttggaaccaagtaaaagaatcacagctcggcaagctctggagcatgattacttccaggatcttgggttggtaccgtgatccactcttctccactgtacaatatctcatcaagtacatcggatgttttgcagttttatccttgtatttctgtgaggtttgtgattcgtttgttttcatttcttcatcctgcctcctgaactttatggagagctggtgcttggattttcctttgatagcctgaaagcattcccctcttttcttca

SEQ ID NO: 281 - DNA, 3285 bp, Brachypodium distachyon
tagctagcagggaagaaacagagaccggtgaaccggtccaagatccacagtgaaaaaaataaaatcccggtcccgtccccgttcccggccgcgagcgccagctgctttgaccgattttgttttgagggagcagtattcatggcgtcgatggagctgttgggaaggtccttcttgaagggctccgccggccccgccaccgccgcggcgccccgcggcgggctctgtttcgcgagcgtggggggaagaaggcaggggaggtcgacgaggaagacgctgaggtcgaagccgcccgtgggagcgctggcggagcgggtcgtcctgacgccggcgccgacggagagagtcgggcggccggaggcgcactcgcagagcgtggcggcgagggccgtggtcaccgtgcggcggaagcggaaggaggacgtcaaggagcgggtcgcggagcagatggacgcctacgccgacagggtcggccggagcgtcctgctggagctcgtcagcacggagaccgacccaaggaagggagggcccaagaagagcaagaagtcgaggctggtggggtggttcgagaagagggacgtgaaggcggagctggtggtgtacacggcggagttcaccgtggacgcggccttcggcgagccgggcgccgtcacggtgctcaaccggcaccagcgcgagttcttcatcgagagcatcgtggtggagggcttcccgtccggcccggcccacttcacctgcaactcctgggtccagcccacccgcgtcagcggcggcgtcacccctcgcgtcttcttcaccaacaagccgtacctgccgtccaagacgcccgcggggctgagggagctccggcgccgggagctcaaggagctgcgcggcagcggcaccggcgagcggaggatcaccgaccgagcctacgactacgacgtgtacaacgacctcggcaacccggacaagggcgccggcttcgagcgccccgtcctgggcggcgaggccatgccgtacccgcgccggatgcggacagcccggcccagcactatcacagacgagggcgcggagagcagggtggagtacccggagcccatctacgtgtcgcgggacgaggagttcgaggaaggcaagaacgagatgctgtccgagggcgccatcaaggcgctgctccacaacttcatgccgctgctggtgagctccgtgtcccccggcagccgcgacttcgcgggcttccacgacgtcgacaacctcttcaaggaaggactgcgcctcaagcaggcactgcacgaccagctcttccagaagatcccctttgtccgcaagatccaggagaacagcgagggcctcctccgctacgacacccccgacatcatcaagaaggacaagttcgcgtggctgcgcgatgacgagtttgccaggcaggcgctggcaggcatcaaccctgtcaacatcgagcgtcttcaggagttcccaccggtcagcaagctcgacccggccgtgtacggcccgccggagtcggcgatcacggaggagcacatcatcgggaacctggacggaatgacagtgcagcaggcgctggaagagaacaagctgtacatgttggactaccacgatatcttcatgcctttcctggaccggatcaattcgctggacggccggaaggcgtacgggacgcgcacgctcttcttcctcacggccgggggcacgctgaagccgatcgccatcgagctgtgcctgccgccgatgaaagaagactgcaagcgcgcgaagcgggtgttcacgccccctgccgacgccaccagcatctggctgtggcagctcgccaaggcgcatgtctgctccaacgacgccggtgtccaccagctcatcaaccactggctgaggacgcacgcgtgcatggagccgttcatcatctcggcgcaccggcagatgagcgcgatgcaccccgtgttcaagctgctcaagccgcacatgcggtacacgctcaagatcaacgcgctggcgcggcagatcctcatcaacggcgacggcgtcatcgagtccggcttcactcccggccgctactgcatggagatgagctccttcgcctacgacaacctctggcggctcgaccaggaaggcctccccgccgacctcatcagaagaggtatggccgtggaggacgcgagccaaccgcacgggctccggctgctcatcgaggactacccgtacgccacggacgggctgctcctctggtcggccatctcgcggtggtgcgaggcctacgtggcggcgtactacgcgtccgacgaggccgtgcagtccgactacgagctccaatcctggtacgcggaggccgtccggtcgggccacccggacaagcgcgacgcgccgtggtggccgcgcctctcgaccccgggcgacctcgcttccttgctcacgacgctggtgtggctctgctcggcgcagcacgcggcgctcaacttcggccagtacccgctcggcggctacatcccgaaccggccccctttgatgcgccgcctggtgcccgccgagggcgacccggagcacgcccacctggtcgccgacccgcaccgcttctacctgtcggcgctgcccagcctcacgcagaccaccacgttcatgaccgtcatcgacacgctctccacgcactccgccgacgagcagtacctcggggagcggcccgacgaggacgactggacggcggaccccgcggcgctggccgccgcgcgcgagttcgcggccgaggtccgccgcgccgaggaggagatcgagcggcgcaacgccgaccccgcccggcgcaaccgctgcggcgccggcgtgctgccgtacgagctcatggcgccgtcgtccggcccgggcatcacctgccgaggcgtccccaacagcgtcaccatctagcccccatccccagacagtaaattcatcgatctgtgcggatttttttgaggctgatttgcaaggaattttcagcttcagtaagtactttgggcaggggaatgtctcaggaaaaaaggtagataaaatttgctgtgacttccacccccatataggccgaatcgccattgatttgggcccaaataggagaagattctattttgtaactccgtagtagtatagtacagtgtgtaaataactctgtatgctttataggcaagggattccaataagatcaaacgatggaaatgtgggatcttcagaatactacctatgcttgcaaacttggggtgcgaaatttgttttggtgttattacttaagcgacatacgggaaagaacatccaaatgaaacataaattcaa

SEQ ID NO: 282 - DNA, 5005 bp, Setaria italica
agctcgcggaggccaccgcacaaacacagactggtccaagctccaaagccagcacgcagcggagtggaaaaataataactcgctccggaacaactacaactacccccaccctcgccgctgctgacgcgagctgtcttgaccggcggcgatttctttcttttctctctctttctctccctccctcccgtgcctgcaccaacctttaactgctacgatcgatcgatcgagcgggggtgggcgagggaggaaggttccagtccagtcgtacggcacatggcgtcggcggcgatggagctgctggggagatccttcttgccgggccctgcggcgggcgcggcgggccgggagcggggaggcgggccctgcttcgccgcggtcggaagggagggtaggagggggaggaggccgctgcggtcggcggcgccggtgggggcgctggcggagcgggtcgtcgtgacgccggcgccggcggagagggccggggcggcgccgccggaggagcagccgccgcagcacccgcagagcgtcgcggcgcgggccgtggtgaccgtgcggcggaggcgcaaggaggacaccaagcgccgcgtcgccgagcagctggacgcctacgccgacagggtaggccggagcgtcctcctcgagctcgtcagcacggagaccgacccaaggaaagggggccccaagaagagcaagcgatcggcgctggtggggtggttcgagaagaaggacgtcaaggcggagcgggtggtgtatacggcggagttcaccgtcgacgcgtccttcggcgagcccggcgcggtgaccgtgctcaaccgccaccagcgggagttctttatcgagagcatcgtcgtggagggcttccccaccggccccgcgcacttcacctgcaactcgtgggtccagcccacccgcgtggaccgcaacccgcgcgtgttcttcaccaacaagccgtacctccccgccgagacgccgccggggctgcaggagctccggcaaaaggagctcagcgacctgaggggagagagcgccgccgacgccgccggcgagcgcaagctcaccgaccgggtgtgggactacgacgtgtacaatgacctcggcaacccggacaagggcgccgagttcgcgcgccccgtcctcggcggcgagcagctgccgtacccgcgccggatgcgcacgggccggcccaagaccgtcacagacgagcgcgcggagagcagggtggagtacccggagcccacctacgtgtcgcgggacgaggagttcgaggagggcaagaacgagatgctgtcggagggcgcgctcaaggcgctgctccacaacttcatgccgctgctggtgagctccgtgtcccccgacatccgcgacttcgccggcttccacgacgtcgacaacctcttcaaggaggggctccggctgaagcaggcgctgcaggaccagctgttccagaagatccccttcgtgcgcaagatccaggagaacagcgagggcctcctccgctacgacacccccgacatcatcaagaaggacaagtttgcgtggctgcgcgacgacgagttcgcgcggcaggcgctggctggcatcaaccccgtcaacatcgagcgccttcaggcgttcccgccggtgagcaagctggacccggccgtgtacggccctaaggagtcggccatcacggaggagcacatcatcgggcagctggacggcatgtcggtggcgcaggcgctggaggacaaccggctgtacatgctggactaccacgacatcttcctgccgttcttggacaggatcaactcgctggacgggcgcaaggcctacggcacgcgcacgctcttcttcctgacggccgccggcacgctcaagcccatcgccatcgagctcagcctgccgcccatgaccgaggggtgcaagcgcgccaagcgtgtgttcacgccgcccgccgacgccaccagcaactggctgtggcagctcgccaaggcgcacgtctgctccaacgacgccggcgtccaccagctcatcaaccactggctgaggacgcacgcgtgcatggagccgttcatcatcgcggcgcaccggcagatgagcgcgatgcaccccatcttcaagctgctcaagccgcacatgcggtacacgctcaagatcaacgcgctggcgcggcagatcctcatcgccggcgatggcgtcatcgagtccggcttcacccccggccgctactgcatggagatgagcgccttcgcgtaccgggagctctggcggctcgaccaggagggcctccccgccgatctcatcagaaggggcatggccgtggaggacccgacgaagccgcacggtctccggctgctcatcgaggactacccgtacgccaccgacgggctgctgctgtggtcggccatcgagcggtggtgcgacgcttacgtcgccacgtactacccgtccgacgagtcggtgcggggcgacgccgaactgcaggcgtggtacgacgaggccgtgcgggtggggcacgccgacaagcgcgacgcgccgtggtggccgcgcctgtcgacgccggcggacctggcgtcgctgctcacgacgctgctgtggctgacctcggcgcagcacgcggcgctcaacttcgggcagtacccgctgggcggctacatccccaaccgcccgccgctgatgcggcggctggtgcccgccgagggcgacccggagcacgcgcacctggtggcggacccgcaccgcttcttcctgtcggcgctgcccagcctcacgcagaccaccaccttcatgaccgtcatcgacacgctctccacgcactccgccgacgagcagtacctcggcgagcgccccgacgaggcgtggacggccgacccggccgcgctggcggcggcgcgggagttcgcggaggaggtgcggcgcgccgaggaggagatcgagcgccgcaacgccgacacgggcaggcgcaaccggtgcggcgccggcgtgctgccgtacgagctcatggcgcccacgtccgggccgggcatcacctgccgcggcgtccccaacagcgtcaccatctagtctcagttcagcagacatgggaggataacgagatgatttggaagtgagaaatttccgctcattatactcgggcggggagaaatcttagcagaagaagattacttttgccataattctccccatttgattcggggtccggataggatgaatattttgacatgggtgggaggaattgatattgtagagtgggtgtaaataacacaatcaatggaatatagtcgtatagagttctcaaggaaagttatccagtatctcatcatgattatgcagaactgttcagcgtggggtttatcttcatgtcagtgttgtctacaaacactactgcacattatttgctttgtccagattcatggcgtcatataggtggatcgtcaaaatgtaagtattatttgaacagattgatagtgtcatttaagcagatagtcaaacttcacttagcacacgatttggtaagagctcatatctgttctttttcatccttctcagttctcattccgaaattctgaatttgatttattcagtttattggcagttgacaatcgatggaatattgcggtatagagttctcaaagttgtctatcatcttatacataactggttagtgtgctttttatcttgctcatgtcagtgttatcttgcacatcatttgctttgaccagattgatggcgtcacttaagcggatcgtcaaactgtaagttttatttgaacagattgaaactgtcatttaagcagatacggagtagtcataattattttagcacgtgatttggtaggagctcgtatcagttctgctgcgttcttcacatttctcattcccaaattctgaagttcttttattcagctcagaactgagctattttcatatactacttaaaattatttgctttgtccagactgattgtaatgtacgtggttcgtcagaatttcagtttgtttgacctgattggaagtgtcattaagcagatagtcaaaattcacattagcacgacttggtaagagctcaaatccttttgtgttctcagttctcactcggtcactccaagattctgaagtcaaattattcggagcaagtctttgctcacttttttataagaaatattggcttattattagtggcaaaccataagataagcctgtacagataggatcaatctcttttattcacaactgtatggacaagttgaatgcacgcgccataccagaggatggcgagtgccagaatcatagcccgattgttttcggcaacgtacagcgctgaaaacgctactaatagaagcgcatcagagactctaatttattgcctcaacgataggtcacagcaattaatttgattttctctgtagtcattagcttaagcaactgttgacggttctttctccgtccatctcaatcattgagttgatcagcgcaaggattttcgttttgactaacaggagaacgaatcctttttaaagatcaactgaaagaacagatctagtcggaaaagggggaaattgagcagatcgagtgactgtacggacaagttgaatgcacaggccatacgagaggatggccactgccagaatcttagcccgatcactctcggcaacgtacagcgctgaaaacgctactgaaagaagcgcatcagagactctaatttattgcctcgaaactagttcagaaacactacaagcacagcaaactattggacccagatcgaagattcgagggagagaaaaaaaaagaggagaaaggttgcattagactcacgacagctttgtgcaatcaacagagcgtatgattgttcagagtttgatggtatgtatgagcaaatcatcatcgtccaacgcagaaccgaatcaccaagaacaaatcacagaagaaaaggcaaaaacagagaggaaaccgggcaacgagaaatcaatcggaaactgaagcaagcggagaagaacggcggcggtggcggccggggagtgaaaggtt

SEQ ID NO: 283 - DNA, 3508 bp, Sorghum bicolor
ccctgcgcgtccgtctccgtctccgtctccgtccaaccccagccgagcgagaccgagatgaactcgtcgtcgcgtcggttgctgctcgcgcgggccccgtcgagtcctcacttgctcccagtcccacagctgacccgagtgaccgtcccccgggcggcgcgcctatatatatggtgcttctcccactgcgagcaagggtagctcgcggccactgcacaaacagagactggtccaaagcactagaacgcgaggggaaagaaggaaaaaaaaaacacccgagctgttttgaccggcgatttgatttgatttttttttggttcttcagtgcgccagccaaaccttaactgctacgatcgatcgatcgaagggggtaggaagtttctagagttcttcagcccatggcgtcggcgatggagctggttgggagatctttcttgccgggctctgccgccgcggcgtcgccggcgggccgggagcggcggcgaggcgggccctgcttcgccgcggtcggaagggaggggagtgcgcacaagcggcggccgtcgctgaggtcgaccgcgccggtgggcgcgctggccgagcgcgtcgtggtgaccccggcgccgccggaggagagggccgggacggccccgccggagccgcacccgcagagcgtggccgcgcgcgccgtggtcaccgtgcggcggaggcgcaaggaggacgccaagcgccgcgtcgccgagcagctggacgcctacgccgacagggtcggccgcagcgtcctcctcgagctcatcagcacggagaccgacccaagaaaagggggccccaagaagagccggcggtcggcgctggtggggtggttcgagaagaaggacgtcaaggcggagcgggtggtgtacacggcggacttcaccgtcgacgggtgcttcggcgagcctggcgccgtcaccgtgctcaaccggcaccagcgcgagttcttcatcgagagcatcgtggtggagggctttccctcgggccccgcgcacttcacctgcaactcgtgggtgcagcccacccgcgtggaccgcaacccgcgcgtgttcttcaccaacaagccctacctgccggccgagacgccgccggggctgcaggagctccgccgccaggagctcagcgacctgaggggcgagggcggcgccgacaccaccggcgagcgcaggatcaccgaccgggtgtgggagtacgacgtgtacaacgacctcggcaacccggacaagggcgccgagttcgcgcgcccgatcctcggcggcgagcagcagctgccgtacccgcgccggatgcgaacgggccggcccaagaccttcacagacgatcgcgcggagagcagggtggagtacccggagcccatctacgtgtcccgggacgaggagttcgaggagggcaagaacgagatgctgtcggagggcgcgctcaaggcgctgctccacaacttcatgccgctgctggtgagctccgtgtcgccggacatccgcgacttcgccggcttccacgacgtggacaacctcttcaaggagggcctccggctgaagcaggcactgcaggaccagctgttccagaagatccccttcgtgcgcaagatccaggagaacagcgagggcctcctccgctacgacacgcccgacatcatcaagaaggacaagtttgcgtggctgcgcgacgacgagttcgcgaggcaggcgctggctggcatcaaccccgtcaacatcgagcggcttcaggcgttcccgccgatgagcaagctggacccggccgtgtacggcccgccggagtcggccatcacggaggagcacatcatcgggcagctggacggcatgtcggtgcggcaggcgctgcaggacaaccggctgtacatgctggactaccacgacatcttcctgccgttcctggaccggatcaacgcgcaggacgggcggaaggcctacggcacgcgcacgctcttcttcctgacggcggcgggcacgctcaagcccatcgccatcgagctgtgcctgccgcccatgaccgacgggtgcgcgcgcgccaagcgggtgttcacgccgcccgccgacgccaccagcaactggctgtggcagctcgccaaggcgcacgtctgctccaacgacgccggcgtccaccagctcatcaaccactggctgaggacgcacgcgtgcatggagccgttcatcatctcggcgcaccggcagctgagcgcgatgcaccccatcttcaagctgctcaagccgcacatgcgctacacgctcaagatcaacgcgctggcgcggcagatcctcatcaacggcgacggcgtcatcgagtccggcttcacccccggccgctactgcatggagatgagctcgttcgcgtaccaggagctctggcggctcgaccaggagggcctccctgccgatctcatcagaagaggaatggccgtggaggacccgacgcagccgcacggtctccggctgctgatcgaggactacccgtacgccaccgacgggctgctcctctgggacgccatcacgcggtggtgcgacgcgtacgtggccatgtactacccgtccgaccaagccgtgcagggcgacacggagctgcagtcgtggtacagggaggcggtgcagacggggcacgcggacaagcgcggcgcgccgtggtggccgcgcctgtcgacgccgggcgacctggcgtcgctgctcaccacgctgctgtggctcacctcggcgcagcacgcggcgctcaacttcgggcagtacccgctgggcggctacatcccgaaccgaccgccgctcatgcggcggctggtgcccgccgacggcgacccggagtacgcgcacctggtggccgacccgcaccgcttcttcctgtcggcgctgcccagcctgacgcagacgaccaccttcatgaccgtcatcgacacgctgtccacgcactccgccgacgagcagtacctcggggagcggcccgacgaggcgtggacggccgacccggcggcgctggcggcggcgcgcgagttcgcggacgaggtgcgccgcgccgaggaggagatcgaccggcgcaacgcggacacgggacgccgcaaccggtgcggcgccggcgtgctgccgtacgagctcatggcgcccacgtccgggccgggcatcacctgccgcggcatccccaacagcgtcaccatttagtctctcgcggtaccgatagccatgggagaaatctaagcagaagcaaaatgattttttttttgctttacttctcccccattgccaaattgccattgatttggaggtctgaacaggtggagtttgatttttgactaggggagagacactgaggaactgaatgggtgtaaataatttgttattatagaaaaaaaatcaatgaaatataatcattagagttctttggacaaagcaatgtcatcatacagaacagtttgctgtgctttgtcatgctcaagctgtgttttcttcaattacccccgcgacaattggcagtcaacatttcgttcgaactgacc

SEQ ID NO: 284 - DNA, 3287 bp, Zea mays
gccactgcacaaacagagactagtccaaagcaccataacgagagagagagaaaaaaaaaacactcggaaacgatccgcgaactagtccaccggcgatttgttgttttgttcttcagtgcgtcagccaaccttaactgctacgatcggtcgatcaagggggaggaagtttctggagctctgcccatggcgtcggcgatgaagctgctggggagatcttccttggcgagccctgctgccgcggcgcccggacgggagcggcgaggcgggccctgcttcgccgcggtcggaagggaggggagcgcgcacaggaggaggtcgtcgctgaggtcgaccgcgccggtgggcgcgctggccgagcgggtcgtggtgacgccggcgccaccggagagggccggggcgggccccccggagccgcacccccagagcgtggccgcgcgggccgtggtcaccgtgcggcggaggcggaaggaggacgccaagcgccgggtcgccgagcagctggacgcgtacgccgaccgggttggccgcagtgtcctcctcgagctcatcagcacggagaccgacccaagaaaggggggccccaagaagagcaggcgctcggcgctggtgggctggttcgagaagaaggacgtcaagacggagcgggtggtgtacacggcggacttcaccgttgacgggtccttcggcgagccgggcgcggtcaccgtgctcaaccggcaccagcgcgagttcttcatcgagagcatcgtggtggagggctttccctccggccccgcgcacttcacctgcaactcgtgggtgcagcccacccgcgtggaccgcaacccgcgcgtgttcttcaccaacaagccgtacctgccggccgagacgccgccgggcctgcaggagctccgccgccagcagctcagcgacctgaggggcgagggtgccgacaccggcgagcgcaggatcaccgaccgggtgtgggagtatgacgtgtacaacgacctcggcaacccggacaagggcgccgagttcgcgcgcccggtcctcggcggcgagcagcagctgccgtacccgcggcggatgcgaacgggccggcccaagaccatcacaggcaagcctccgctttcccacgaccgcgcggagagccgggtggagtacccggagcccatctacgtgtcccgggacgaggagttcgaggacgggaagaacgagatgctgtcggagggcgcgctcaaggcgctgctccataacttcatgccgctgctggtgagctccgtgtcgccggacatccgcgacttcgccggcttccacgacgtggacaacctcttcaaggagggcctccgcctgaagcaggccctgcaggaccagctgttccagaagatccccttcgtgcgcaagatccaggagaacagcgagggcctcctccgctacgacactcccgacatcatcaagagtaagccagcgcccatgcgccttcctcctcctccgtccatgatccatggagaggacaagtttgcttggctgcgggacgacgagttcgcgaggcaggcgctggctggcatcaaccccgtcaacatcgaacgtcttcaggcgttcccgccgatgagcaagctggacccggccgtgtacggcccgccggagtcggccatcacggaggagcacatcatcggacagctcgacggcatgtcggtgcagcaggcgctgcaggacgacaggctgtacatgctggactaccacgacatcttcatgccgttcctggaccggatcaacgcgcaggacgggcggaaggcctacggcacgcgcacgctcttcttcctgacggccgcgggcacgctgaagcccatcgcgatcgagctgtgcctgccgccgatgaccgacgggtgcgcgcgcgccaagcgggtgttcacgccgcccgccgatgccaccagcaactggctgtggcagctcgccaaggcacacgtctgctccaacgacgccggcgtccaccagctcatcaaccactggctgaggacgcacgcggccatggagccgttcatcatcgcggcgcaccggcacctgagcgcgatgcaccccatcttcaagctgctcaagcctcacatgcggtacacgctcaagatcaacgcgctggcgcggcagatcctcatcaacggcgacggcgtcatcgagtccgggttcacccctggccgctactgcatggagatgagctcgttcgcgtaccgggagctctggcggcttgaccaggagggcctccctgccgatctcatcagaagaggaatggccgtggaggacccgacgcagccgcacggtctccggctgctcatcgaggactacccctacgccaccgacgggttgctgctctggtcggccatcacgcgatggtgcgacgcctacgtggccatgtactacccgtccgacgagtccgtgcagggcgacaccgagctgcagtcgtggtacagggaggccgtgcagacggggcacgcggacaagcgcgacgcgccgtggtggccgcgcctgtcgacgcccgcggacctggcgtcgctgctgacgacgctgctgtggctcacctcggcgcagcacgcggcgctcaacttcgggcagtacccgctgggcggctacatcccgaaccggccgccgctgatgcggcggctggtgcccgccgagggcgacccggagtacgcgcacctggtggccgacccgcaccgcttcttcctgtcggcgctgcccagcctgacgcagaccaccacgttcatgaccgtcatcgacacgctgtccacgcactccgccgacgagcagtacctcggggagcggcctgatgaggcgtggacggccgacccggcggcgttggcggccgcgcgcgagttcgcggacgaggtgcgccgcgccgaggaggagatcgaacggcgcaacgctgacactggccgccgcaaccggtgcggcgctggcgtgctgccgtacgagctcatggcgcccacatcggggccgggcatcacctgccgcggcgtccccaacagcgttaccatttagcctctcagtaccgacagacagccatgggcgcatgacagagatgatctgaaaggagaatttttttccactcattatagtcgggtggggagaaatctaagcagaagcaaatgaattttgcattatttctccccccattgccaaattgccattgatttggtggtccgaacaggtgaaatttgatttttgactagggccaagactgtgaggaactgaatgggtgtaaataatttgtcatatacaaaaatcaatggaatataatcattatagagttctctgga

SEQ ID NO: 285 - DNA, 3238 bp, Oryza sativa
ttctcttttcacatcgcgagtgtcgtgtgttcgagtattcggattgacctgtagcgtaggggatttctatggcgtcgttggagttgctggggaggaggatgtcgtcgtgctcgtggggagggggatcggcggcggcgatgaggggaggggcggggatgtgtttcgcgagcatggaggcggcggggagcagggggatggggaagggggcgagtaggaggaggacggcgaggtcgacggcgccggtgggcgcgctggtggagcgggtggtggtggcgccggcgccggtggagcagcagcgcggggcggggcggccggaggcgcacccgcagagcgtggcggccagggccgtggtgaccgtgcggcggaggcgcaaggaggacgccaaggaccgcttcgccgagcagctcgacgccctcgccgacagggtcggccgcagcgtcctcctcgagctcgtcagcacggagaccgacccaaggaaggggacgccgaagaagagcaagccgtcggcgctggtggggtggttcgacaagaaggacgtcaaggcggagcgcgtggtgtacacggcggagttcgccgtcgacgccgggttcggcgagccgggcgcggtgaccgtgctcaaccgccaccagcgggagttctacatcgagagcatcgtcgtcgaggggttcccgaccggcccggcgcacttcacctgcaactcgtgggtgcagcccacgcgcgtgagccgcgaccggcgcgtgttcttcagcaaccggccgtacctgccgtcggagacgccgccggggctgagggagctccggctccgggagctcgccgacctccgcggcgacggcaccggcgagcggaggatcaccgaccgggtgtacgactacgacgtgtacaacgacctgggcaacccggacaagggcgtcgcctccgcccgccccgtcctcggcggcgagcagatgccgtacccgcggcggatgcgcaccggccgtcccagcaccgccacagacgcgagcgcggagagcagggtggagtacccggagcccatctacgtgtcgcgggacgaggagttcgaggagggcaagaacgagatgctgtcggagggcgcgatcaaggcgctgctccacaacttcatgccgctgctcgtctcctccgtctcgccggacatccgcgacttcgccggcttccacgacgtcgacaacctcttcaaggagggcctccgcctcaagcaggcgctccacgaccagctcttccagaagatccccttcgtccgcaagatccaggagaacagcgagggcctcctccgctacgacacccccgacatcatcaagaaggacaagttcgcgtggctgcgtgacgacgagttcgcgaggcaggcgcttgccggcatcaaccccgtcaacatcgagcgtctccaggtaagacgtcgcgctcacgaccaacacggcaaaactctgcaacttccaaagcagagctcgcacgagtttgtagtactagctgttgctgtccatgtgcaacacagtggagctgattggtggtcgccgttttttttttttttttactctttgcgcgcacaggcgttcccgccggtgagcaagctcgacccggccgtgtacggcccgccggagtcggcgatcacggaggagcacatcatcgggcacctcgacggcatgtcggtgcaggaggcggtggaggggagcaggctgtacatgctggattaccacgacatcttcctcccgttcctggacaggatcaacgcccaggacggccggaaggcgtacggcacgcgcgcggtcttcttcctgacggccgccggcacgctgaagccgatcgccatcgagctgtgcctgccgccgatgacagacggctgcaagcgcgccaagcgggtgttcacgccgccggccgacgccaccagcaactggctgtggcagctcgccaaggcacacgtctgctccaacgacgccggtgttcaccagctcatcaaccactggttgaggacgcacgcgtgcatggagccgttcatcatcgcggcgcaccggcagatgagcgcgatgcaccccatcttcaagctgctcaagccgcacatgcggtacacgctcaagatcaacgcgctggcgcggcagatcctcatcaatggcgacggcgtcatcgagtcgggcttcacacccggcaacgtctgcatggagatgagcgccttcgcctaccgggaactatggcggctggaccaggagggcctccccgccgacctcatccgaagaggcatggccgtggaggacccgagccagccgcacgggctacggctgctcatcgaggactacccgtacgccgccgacgggctgctcctctggtcggcgatctcgcggtggtgcgaggcgtacgtggcggcctactacccgagcgacgaggccgtgcaggcggactacgagctgcagtcgtggtacgccgaggccgtgcagagcgggcacgcggacaagcgcggcgcgccgtggtggccgcgcctctcgacgcccggcgacctggcctccctgctcaccaccctggtgtggctctgctcggcgcagcacgcggcgctcaacttcgggcagtacccgctcggtggctacatcccgaaccgcccgccgctgatgcgccgcctggtgcccgccgagggcgacccagagtacgcgcacctcgtcgccgacccgcaccgcttcttcctctcggcgctgcccagcctgacgcagaccacgacgttcatgaccgtcatcgacacgctgtccacgcactccgccgacgaggagtacctcggggagcgccccgacgaggcgtggacggccgacccggcggcgctggcggccgcgcgggagttcgcggccgacgtgcgccgcgccgaggaggagatcgagcggcgcaatgccgacccctcccggcgcaaccgttgcggcgccggcgtgctgccgtacgagctgatggcgccgtcgtccggaccgggcatcacctgccggggcgtgccaaacagcgtaactatatagacgttattattgcgatttgcgcgaatttttcgcggtcattatacagggagaaatttgggcgaaagtaaatgattttgctgcaaatttttcttcggataggtcgattgctaagttttcggctcaaataggaaaatattgattttttgtcgaaaggtggacatttgatattgtagattgtaaataatctggtatagtcaataggaaaataagtggaatatagagaatctcatgatatttttttc

SEQ ID NO: 286 - DNA, 1262 bp, Panicum virgatum
cctatggcaagtgttggtagatcacaagacgcagcgcgatctcacttgcaaacattgccatagctaagctagtgcagacgaagccatggcttcccgtgccctcgctgcgctgctcactgtgctagcgtttgtcggctttgcttcagttccccgtgctctggcaactgacccgacccagctccaagacttctgtgtcgctgataacaataacaaagctgtgttggtgaacgggttggtgtgcaagaacccaaatgtggtgacagcgaacgacttcttcttcaagataatgccggccaccccgaacgcgcagggctccggggtggcgggggtggcggcggacgtgctcccggggctcaacacgctgggcatctcgctggcgcgcatcgacttcgtccccggcgggcagaacccgccgcacacgcacccgcgcgcgtcggagatcctgacggtgatgcagggcaccctcctggtgggcttcgtcacctccaaccagctgctcaacaacacgctcttcaccaagcagctggtggtcggcgacgtcttcgtcttcccgcaggggctcatccacttccagctcaacaacggcaaggcccccgccgtcgccatcgccgcgctcagcagccagaaccccggcaccgtcaccatcgccaacgccgtgttcggctccaagccgcccatcctggacgccatcctcgccaaggccttcatgctcgagaaggacacggtcgactgggtccagcaggcgttcggcgcggccccggtggccggcggcggcggcggcatgcccggtggcggcggctaccccggcggcgggtatcctggcaacgggaccggcggcggctaccccggcggcgggtatcctggcaacgggaccggcggcggctaccccggcgtgccagggtacccctaataaggtggaggcggtgtgcctcgacggcgcctagcattgctgcacaagagcagatgctgatgatcatcgatcgatcaggccggccgtcattacacaagtatatatagtatactccaaacatgcatgaagccacttgcagattgtgatggtcaggttcacggtgtagcacacacgtagtgtactagcatatgtgtttgtgttgatcgaggagtagaagctccatcgattgggttgaataatggagtgtgtggcgaaacggcaacaagtgtactacaaactttattgttcgttgcctctatatgaaataaacttaaattaagtgcaaagaggagaggccgagcagcagcagatc

SEQ ID NO: 287 - DNA, 1086 bp, Sorghum bicolor
acacacttgatcactagttagcaaataaacagagaaccatggcttcccgttttgctacactgcttgcagtgctagcagttgtgggctttgcttcagttccccgtggtggtctggcaactgacccgacccagctccaggacttctgcgttgctgataacaacaaccttgcagtgctggtgaatggtgtggtttgcaagaacccgaaggtggtgaaggcaaacgacttcttcttccacatagagccgatggcagcaaacgcgcagggctcagccgtgacgccggtggcggtgacggagatcccggggctgaacacgctgggcatctcgctggcgcgcatcgacttcgtccccggcgggcagaacccgccgcacacgcaccctcgcgggtcggagatcctgacggtgatccagggcacgctcctggtgggcttcgtcacctccaaccagctgctcaacaacacgctcttcaccaagcagctggtcatgggcgacgtgttcgtcttcccgcaggggctcatccacttccagctcaacaacggcaagacccccgccgtggccatcgccgcgctcagcagccagaaccccggcaccatcaccatcgccaacgccgtgttcggcgccaagccgcccatcctcgacgagatcctcgccagggccttcatgctcgagaaggccaccgtcgactgggtccagcaggcgttcggcgcggcaccagtggcaggcggcggcggcggcggcggctatcctggcggtggcctgccgggtggcggcggctatcctggcggcaacggtaccggcggcggctatccggggtaccctggccgtggctgatctgtacgctggtggctcagcgtcggcggcacaagtgcagccgcgcgcgcgggtcaggcagccattacaagtattgatatgaataatttgtaccacacaccaacacagtaccaatgcgggcgtttgtgttgatcgagcagtagcagtagctcgatcgggttgaataattgtggcaaaaccgcaccaagtgtactgcaatctcttttactgtttcctctatatatgaaatgaaattggaagtttcagtgtttgatct

SEQ ID NO: 288 - DNA, 1345 bp, Panicum virgatum
ctcacttgcaagcattgccatagccagtgtagacgacgaagaacgaagccatggcttcccgtgccctcgctgcgctgcccatcactgtgctagcgtttgtaggccttgcttcagttccccgtgctttggcaactgatccgacccagctccaagacttcttgctggtgaatggggtggtgtgtaagaacccaaatgtggtgacggcgaacgacttcttcttcaagataatgccggccgccccgaacgcgcagggctccggggtggcgggggtggcggtggacatgctcccggggctgaacacgctgggcatctcgctggcgcgcatcgacttcgtccccggcgggcagaacccgccgcacacgcacccgcgcgcgtcggagatcctgacggtgatccagggcacgctcctggtggggttcgtcacctccaaccagctgctcagcaacacgctcttcaccaagcagctggcggtcggggacgtgttcgtcttcccgcaggggctcatccacttccagctcaacaacggcaaggcccccgccgtggccatcgcggcgctcagcagccagaaccccggcaccgtcaccatcgccaacgccgtgttcggctccaagccgcccatcctggacgagatcctcgctaaggcgttcatgctcgagaaggccacggtagactgggtccagcaggcgttcggcgcggccccggtggccggcggcggcggcggctaccccggaaacgggaccggcggcggttaccccggcgtgccagggtatgggtacccataaggcggtgtgcatgctgcctccacggcgcctagcattgctgcacaagagcagatgctgatgatcatcgatcaggcaggccgtcatacataaaactatacaggtatagtactccaaacatgaagccacatgcaggttgtgatggtcaggtttacggtgtagcactagcacacacgtagtctactagcgcgtatgtgcacgcgcacaatgtgtttgtgttgatcgaggagtagaagctcgatcgattgggttgaataatggactatgtggggaaacggcaacaagtgtactacaaactttattgttcgttacgttgcctctatatgaaataaacttgaattaagtgccagcatgctctagatgtttatctccgctgacttgtggacacgacgtttgaccatttatctttttaaaaaaaaatgtaaataccattttagttgttgtggttttgttttagcatcataataaattcaacggtaactaacgtttaggaacgaaggtcgatgatacgctgaacagcgtgccggcagaggcgcgaccgctagtttcctcaactccagtatcac

SEQ ID NO: 289 - DNA, 1142 bp, Zea mays
cgaagcagctcgatcgagcacacacacacttgatcactactagacagtaaacacattgcgcaaaggccgccatggcttaccgcgcctttgctacgctgcttgcagtgctagcatttgtgggcttcgcttcagttccccgtggtctggcaactgacccgacccagctccaggacttctgcgttgctgataacaagaaccctgtgctggtgaacggggtggtgtgcaagaacccgaacatggtgaaggcaaccgacttcttctccacgatagtgccggtggcgccaaacgggcagggctccgccgtgacgccggtggcggtgaacgagatcccggggctgaacacgctgggcatctcgctggcgcgcatcgacttcgtccccggcgggcagaacccgccgcacacgcacccgcgcgggtccgagatcctgacggtcatccagggcacgctcctcgtcggcttcgtcacctccaaccagctgctcaacaacacgctcttcaccatgcagctgaacatgggcgacgtcttcgtgttcccgcaggggctcatccacttccagctcaacaacggcaagacccccgccgtggccatcgccgcgctcagcagccagaaccccggcaccgtcaccatcgccaacgccgtgttcggggccaagccgcccatcctggacgacatcctcgccagggcgttcatgctcgagaaggccaccgtcgactgggtccagcaggcgttcggcgcggcaccagtggccggcggcggcggtggcctgcccggaggaggtggctatcccggcagcggtggtggcctgcccggaggaggtggctatcccggcagcggctttccgggctaccccggccgtagctgatcggtacggtggtggctccacggcggcgccgcctagctagcatgctgcacaagtgcagccgcgcgcgcggatcaggccgtcatacacaaagtatacttatatatagtacctcaaagtcctcaagcattaagccacgtgaagtgaaggctatacgtattaagttcggttgtaatggtcaggtgtaccaaacacccaccaacacctagctagtgagcaggcgcaatgcggcgtctgtgttgatcgagccgtagctctagctctagctcgatcgggttgaat

SEQ ID NO: 290 - DNA, 2653 bp, Panicum virgatum
cggttccggttgggataaaaaaccctggccccgcccagccgcccaacgcgcggcaacgcaaaggctgccgccgacccgccgtaggccggcggcgatcggtatggcgtccgtctggcgcgagccccggcgggaacgttccagcgagcagcctcagtgcccatcgcctttaaatcccgtcgacctcgccgcgcctcgccagcgcggacgcggcccggtcagtcacgcaaccgccccgttcctcctccgatcccacgcagacgcagaggctgctgctgctgtgctccacggccacccagccatccccgtcagttcacacgcagctgggtgattatatatagtatccgacccggttcgttgcgaggtaggtgatcaccccgatccatctcccgccccgcccgcgctcgctcagttcgcgcggcaccactactccgctgctaaatcctacaggtagcccaggcgcggcgcggccctccctcctaatcccaccgctccgccgcaggtgcgaggtggttggcggccgcttacccgaaccgggcgccgtgcgcgcgcgcgccaggcgctcgtggtcaagccaaacgctgcccaccgccgcggcctcggcctatatcctcgcgcacgtcctctcccgtctctgcacccgcttcccttccttctttggactcgtcgtccgtccaccagtgttccatccatcagccctccacggctcggcctgatcgcaacacgtaaagtctagctcgatcaagatcgccgccgcaccgatggtgacgatgccggcggcggcgtcgccgggcgcgcggcggtccgtggtggcggagctggagggcgggctgctccggggcgcggacacgttcccctacttcatgctggtggcgttcgaggcgtcgggcctgccgcgcttcgcggcgctgctggcgctgtggcccctgctgcggctgctggagctggccggccggggcggcctggcgctgcgcgccgcggcgctcgtggccaccgcgggggtgccccgggccgaggtggaggccgtgtcccgcgccgtgctgcccaagttcatggccgacgacgtcgacccgcgcgcctgggccgccttcggggcctgcgaggggagacgcgtcgtcgtcgccacgcggctgccgcgcgtcatggtggagcgcttcgccagggagcacctcggcgcgcacgaggtggtcggctgcgagctcgagtacagccggctcaggcggtgcacggggctcctcaggggcggcggcgccgaggccgtcgcgggccgcgtccgcgcgctcttcgccggcggcgaccacccggacctcggcatcggccggtcagagatggcgcgctccttcttgccgttctgcaaggagcagctcgagccgccgttcaccgcgggcgccgcgacgacgagcgccgccgcgccgccgttccggccggtcatcttccacgacgggcgcctcgtgtgccgtcccactgcgctcatgtccctcgtcatcctcctctggctgcccctcggtgcgctggtcgccttcgtccgcatcgccgtcggcctcatggtgcccatctggaccatcccctacatcgcccccatcttcggcggcgccgtgatcacgcacggccgcgcgcctccccccgtccgccgtgccagcgacgccgccgccgcggaggacggcggctcgccctcgggcgtgctcttcgtctgcacgcaccgcacgctcatggaccccgtggtcctggccaccgtgctcggccgccgcgtggccgccgtgacctactccatctcccggctgtcggaggtcctgtccccgatcccgacggtgcagctgacgcgcgaccgggtcgtggacgcggcgcggatgcgcgcggagctggcccggggcgacgtggccgtgtgccccgagggcaccacctgccgggagcccttcctgctccgcttctcggcgctgttcgcggagctcagcgaccggatcgtgccggtggcgatgaactaccgggtggggctcttccacccgacgacggcgcgcgggtggaaggccatggaccccatcttcttcttcatgaacccgcggcccgtgtacgaggtgacgttcctgaaccagctccccgcggaggcgacgtgcgcggcggggaggagccccgtggacgtggccaactacgtgcagcggatgctcgccgccacgctcgggttcgagtgcaccagcctcacgcgcaaggacaagtacagggtgctcgccgggaacgacggcatcgtcagcgccgccaagccggcggcgcccgggaaggcggcgtggcagagccgcgtcaaggaggtcctcggcttcctgctccactaaccagttggtcgatgcagagagacgacacgtcgtagctctggccaaatactcgatcggctcaccaatttcattgagttattatacacttatacatgtacgtatagtcacgtaaagaatgccctcctagcaaaaatacagtttttgtggcattttcttacacgaaatttaccctgtatattgatctgttcattttactttaatctgtaaatgcttttggcaaattctactggtttgtaattaaagattagatcgagttgttcctcatcaacttcaacagtagtatgttctatgctggactgctggctgctgggcgtccatctacaattcgcact

SEQ ID NO: 291 - DNA, 2822 bp, Panicum virgatum
tttggacatatagtttgtctagattcagagaatgttcaatgaatttgataaaatgccagaatgcattacatttcaggacagagggagtatatctagaaagatgaggataacctctaatttacaacggagggagcagctaatagccttcgaagcaaacactgtgctgacgaggaccgaggggaggaggagtcgtagaccgagcctcgcaagagccatcacggtcacggcctcccgggaacaggctgccccgcccagccgcgcaacgcaaaggctgccgccgcaggcatgtccgcatgtaggacctgccgcgcgccaccccggcgatcggtatggagtcgtctggcgcgagccccggcgggaacggtccagcgagcagcctcagtgcccatcgcctttaaatcccgtcgacctcgccacgcctcgccagcgcgtcgatcgcggcccggtcagtcacgcaaccgccccgttcttcctcctcccacgcaggctgctgtgctccacggccaccgagccatccccgtcagttcacacgcacctaggcgattatatatagtatccgaccgggttcgttgcgaggtaggtgatcaccccgatccatctcctattctcccgccccgcccgcgctcacttcgcgcgccactaccactccgctgctaatccgatcctacaggtagcccaggcgcggcgcggcccggtcctccctcctaatcctaccgctccgccgcaggtgcgaggtggttggcggccgcttacccgaaccgggcgccgtgcgcgcgcgccaggcgcgcgtggtcaagccaaacgctgcccaccgccgcggcctcagcctatatcctcgcgcacgtcctctctcgtctctgcacccgctttccttccttggactcatcgtaagtcttagctcggtcaggactaccgccaacgcgccgatggtgacgatgccggcggcgccgccgcgcgcgcggcggtccgtggtggcggagctggagggcgcgctgctccggggcgcggacacgttcccctacttcatgctcgtggcgttcgaggcgtcgggcctgccgcgcttcgcggcgctgctggcgctgtggcccctgctgcggctgctggagctggccggccggggcggcctggcgctgcgcgtcgccgcgctcgtggccaccgcgggggtgtcccgggccgaggtggaggccgtgtcccgcgccgtgctgcccaagttcatggccgacgacgtcgacccgcgcgcctgggcggccttcggggcctgcgaggggaggcgcgtcgtcgtcgccacgcggctgccgcgcgtcatggtggagcgcttcgccagggagcacctcggcgcgcacgaggtggtcgggtgcgacctcgagtacagccggctcaggcggtgcacggggctcctcaggggcggcggaggcgaggccgtcgcgggccgcgtccgcgcgctcttcgccggcggcgaccgcccggacctcggcatcggccggtcagagatggcgcgctccttcttgccactctgcaaggagcagctcgagccgccgttcaccgcgggcgccgcgacgccgagcgccgccgcgccgccgttccggccggtcatcttccacgacgggcgcctcgtgtgccgtcccacggcgctcatgtccctcgtcatcctcctctggctgcccctcggcgcgctggtcgccttcgtccgcatcgccgtcggcctcatggtgcccatctggaccatcccctacatcgcgcccatcttcggcggcgcggtgatcacgcacggccgcgcgcctccccccgtccgccgcggcagcgacgccgccgtggaggacagcggcggctcgccctcgggcgtgctcttcgtctgcacgcaccgcacgctcatggaccccgtggtcctggccaccgtgctcgggcgccgcgtggccgccgtgacctactccatctcccgcctgtcggaggtcctgtccccgatcccgacggtgcggctgacgcgcgaccggggcgtggacgcggcgcggattcgcgcggagctggcccggggcgacgtggccgtgtgccccgagggcaccacctgccgggagcccttcctgctccgcttctcggcgctgttcgcggagctcagcgaccggatcgtgccggtggcgatgaactaccgggtggggctcttccacccgacgacggcgcgcgggtggaaggccatggaccccatcttcttcttcatgaacccgcggcccgtgtacgaggtgacgttcctgaaccagctccccgcggaggcgacgtgcgcggcggggaagagccccgtggacgtggccaactacgtgcagcggatactcgccgccacgctcgggttcgagtgcaccagcctcacgcgcaaggacaagtacagggtgctcgccgggaacgacggcatcgtcaccgccgccaagccggcggcgctcgggaaggcggcgtggcagagccgcgtcaaggaggtcctcggcttcctgctccactaaccactatagttgcagagagagacgccacgtagctctggtcaaatactcgatccgctcaccaatttcaatgagttattatacactttatacatgtacgtatagtcacgtaaagaatgcactcctagcaaaaaatatagtttttagctttttcttacacacgaaatttgcaccgtattgcatgctcttttcattttactttaatctgtaaatgtttttggcaaattctactggttgtaagtaaagatcagattgctccctcatcaacctcaacagtagtatgttctgtgctggactgctggctgttgggcatccatctacaattcgcactcttcttct

SEQ ID NO: 292 - DNA, 2167 bp, Zea mays
cccgcgcttattctgcgcgccaccctgctgcttctgcacgcacgttacgtaatcccattcccaggcgcagccctctccctgcaagtcctaccgctccgcggccgcaggtgcggggtggttgacggccgcttacccgcaccggcgccatgcgcgcgcgctaggtggtcgaggtcaagccaaacgctgcccaccgcctctgcctcccataacccatataaccctcgtccacgtcctttgctcgactcgcaaaaacttgcttccttcgacggccgcatcagtcctccacgtacgtcccggcacgtcgatcacggcaaaagctagccagcgcacaggacctgcggaggagctcggttttcgatcagggtcaataatcaccacgccgacgctgatgacgccggcgtcccaggcggcaccgccgcgcgcgcggcggtccgtggtggcggagctggagggcgcgctgcttcggagcgcggacacgctcccgtacttcatgctcgtggcgttcgaggcgtccgggctgccgcgcttcgcgctgctgctggcgctgtgcccgctgctgcggctgctggagctggcgggccgtggcggcctggcgctgcgcgccgccgcgttcgtggccaccgcgggggtgacacgcgccgagctggaggccgtgtcccgcgccgtgctgcccaagttcatggccgacgacgtcgaccccgcggcctgggcggccttcgggagctgcgaggggaggcgcgtcgtcgtcacgcggatgccccgcgtcatggtcgagcgcttcgccaaggagcacctcggcgcgcacgccgtggtcggctctgacctcgagtacagccggctcaggcgctccacggggctcctcaaaggcgcctgccatgaggccgtcgccagccgtgcccgcgcgctgttcgccggcgacgacctgccggacctcgcgatcgccggctcagagatggcgcgctccttcacattctgcgaggagcagatcagcccgccgttcactggagaccacgggatgaacgccgccccaccgttccggccggtcatcttccacgacggtcgcctcgtgtgccggcccacgccattcatgtccctcgtcatcctcctctggctgcctctcggcgtgctggtcgccttcgtccgcatcgccgtcggcctcatggttcccatctggagcatcccctacatcgcgccggtcttcggcggcgccgtgatcattcacggccgcgcgccgcccccagtcaggcccagcgacgccgcggacgtcggctcgccgccctcgggggtcctcttcgtctgcacgcaccgcacgctcatggaccccgtggtgctggccaccgtgctcgggcgccgcgtggccgccgtgacatactccatctcccgcctctccgagatcctctccccgatcccgacggtgcgcctgacgcgagaccgggaagtggacgcggcacgcatgcgcgccgagctggccagtggcgacgtggccgtgtgccccgagggcaccacgtgccgggagcccttcctgctccgcttctccaagctcttcgcggagctcagcgacaggatcgtgcccgtggcgatgaactaccgcgtggggctcttccacccgacgacggcgcgcgggtggaaagccatggaccccatcttcttcttcatgaacccgcggcccgtgtacgaggtgacgttcctgaaccagctccccgcagaggcgacgtgcgcggcggggaagagccccgttgatgtagccaactacgttcagcggatactcgctgccacgctcgggttcgagtgcaccaccctcacaaggaaggacaagtacacggtgctcgccggcaacgacggcgtcctgaacgccaagccggcggcggccgggaagccggcttggcagagccgcgtgaaggaagtcctcgggttcctgctccactaacaattacaccttgcccagatctggactctggcacaaatacttcgctcaccgatttgtttgagtttatactttgttacatttatacatgtacgtaaaaataaaacatgtagtagtaaaatacagcagtgatcagcctttctttacataataagtactgtatattgtattgttctttattttacaattgttttggtgaatttttactgggtccaatcaaagatgaaagttgttccacatcta

SEQ ID NO: 293 - DNA, 2436 bp, Sorghum bicolor
ccccccccccccccccccccccccccctgtttgttgcgagttaggtgatcaccttcgatctcccgcgcttattttgcgcgccaccctgctgccgctctctgcacgtacgtcgtgtcgtatcccaggaggacccggcgcggcgcaaggctccccgctaatcctaccgctccgcagccgccgcagcccgcaggtgcggggtggttgacggccgcttacccgctccggcgccatgcgcacacgctaggtgcatcgaggtcaagccaaacgctgcccaccgcctctgcctcccatataatcctcgtgcacgtccttgctcatcatctcaacacacttcgtctccgatccttccgactcatcgccatccatcaggaccatcaccagtaggcccagaggagatcgtatcagaggagctcgattttccttccgatcaggaccacaccacaccacaccaccgacgtgacgctgatgacgatgccgacgacgtcctcggcggcggcgccggcgtcgccgcctcgcgcgcggcggtcccggtccgtggtggccgaactggagggcgcgctgctccggagcgccgacacgttcccgtacttcatgctcgtggcgttcgaggcgtccggcctgccgcgcttcgtgctgctgctggcgctgtggccgctgctgcggctgctggagctgggcgccggccggcgcgacctagcgctgcgcgccgccgcgttcgtggccaccgtcggggtgcctcgcgccgacgtggaggccgtgtcgcgggccgtgctgcccaagttcatggccgacgacgtcgacccggccgcgtgggcgtcgttcgggagctgcgaggggaagcgcgtcgtcgtcacgcggatgccccgcgtcatggtggagcgcttcgccaaggagcacctcggcgcgcacgccgtggtcggctgtgacctcgagtacagccggctcaggcgatccacggggctcctcaaaggcgccgggcatgacgccgtcgccacccgtgtgcgcgcgctgttcgccggcgacgaccgcccggacctcgggatcggtgcgtcagagatggcaagctccttcttgacattctgccaggagcagctcaggccgccgttcaccgcggaccacgacacgaacgcgccaccgttccggccggtcatcttccacgacgggcggctggtgtgccggcccacgccattcatgtccctcgtcatcctcttctggctgcccctcggcgtgctggtcgccttcgtccggatcgccgtcggcctcatggtccccatctggaccatcccctacatcgcgccggtcttcggcggcgccgtgatcatccacggccgcgcgcctccccccgtcagagtcagcgacgacgccgccgccgccgccggctcgccgtcgggggtcctcttcgtctgcacgcaccgcacgctcatggaccccgtggtgctggccaccgtgctgggccgccgcgtggccgccgtgacctactccatctcccgcctctcggagatcctgtccccgatcccgacggtgcggctgacgcgcgaccggggcgtggacgcggcgcgcatgcgcgcggagctggcccggggcgacgtggccgtgtgccccgagggcaccacgtgccgggagcccttcctgctccgcttctccaagctcttcgcggagctcagcgacagcatcgtgcccgtggcgatgaactaccgcgtggggctcttccacccgacgacggcgcgcgggtggaaggccatggaccccatcttcttcttcatgaacccgcggcccgtgtacgaggtgacgttcctgaaccagctccccgcggaggcgacgtgcgcggcggggaagagccccgtggacgtggccaactacgtccagcggatcctcgccgccacgctcgggttcgagtgcaccacgctcacgaggaaggacaagtacacggtgctcgccggcaacgacggcagcgtcaacgccaagccgccggcggccgggaagccggcttggcagagccgcgtgaaggaggtcctcgggttcctgctccactaacccattacttgcacagctctggactctggcccaaatacttcgattgctcaccaatttgattgagtttatactgttacattacatttatatacatgtacgtaataataaagcatgtgtagagtagtagtaaaatacagcagtgattcgcaaaaaaaaaaacaaaaaaagggagtagtgattagcctttctttacataataagtactgtatattgtattgttctttatttttcaattgttttggtgaatttttactgggtgtaatcaaaggtcaaagttgttcctcatctacactaggctttgtgctgaactgctgatcgttgtttggcgtccatttattacagtttgagtgcaatcgtcttcctacctgggtgatccagtatggtcgtagtagatattgatta

SEQ ID NO: 294 - DNA, 2381 bp, Oryza sativa
gaggcataaatacgggagagggaaggggaaacccgacgcgacacgtctcctcgattccgctggttttttaagtttggtgaaactcgatcgcttaggttaaacctcggtagctgttgggtgcgaggttggccatcgatcatctctcgctggatcacgccactttttcgcatgcaaagcgtaggatttctctctttgtttttaggatttcttggtggttgcgagccgcttacctgaacccagaaccccccagttgccggtcaagccaaaccctgcccactgcgatcgcctcccatataacacatactctcttcctctttctcttcgcttcatcaagtagtagtcgtgttcattaatctgcatctctcgcttcacgtactttgaagtggtggtgaactgtgttttgtgtcatcgatggtgaccatgtcggcgtcggcggaggcgaagagtcgacgggagaggcggtcggtggtggcggagctggagggggcgctgctgcgcgacgcggcgacgttcccgtacttcatgctggtggcgttcgaggcgtccgggctgccgcggttcgcggcgctgctggcgctgtggccgctgctgtgggcgctggagcgggcgctggggcggggcgacctggcgctgcgcgccgcggcgttcgtggcgacagcgggcgtgccgcgcgcggaggtggaggccgtggcgcgcgccgtgctgcccaagttcatggccgacgacgtcgacccggcggcgtgggcggcgttcgggtcctgcggcgggcggcgcgtcgtggtgacacgcatgccccgggtcatggtggagcggttcgccagggagcacctcggcgcgcacgaggtggtcggctgcgacctcgagtacagccgcctcaggcggtccaccggcttcgtcaggggcggcggcggcggcgagcgcgcggtcgccgaacgcgtgcgcgcgctcttcgccgatggcgaccggccggacgtcgggatcgcgcggtccgagtcggcgacgcgatccttcttgcccttctgcaagaagcaactccggccgccgttctgtgaggacgacggcgacgacgtcgccgccgccggcgagcagcacaaatgccctccgttccggccagtcatcttccacgacggccgcctcgtgtgccggcccacgccgctcatgtcgctcgtcatcctcctgtggcttccgcttggcgcgctcgtcgccttcgtccgcatcgccgtcggcatctccgtgcccatccagatcatcccccgcatcgcgccctacttcggcggcgccgtcgtcgtgcacggcgccccgccgcccgccgccgccagcgggccggcgtccggcgtcctcttcgtgtgcacgcaccggacgctgatggacccggtggtgctcgccaccgtgctcggccgccgcgtggccgccgtgacgtactccatctcccgcctctcggaggtcctctcgccgatcccgacggtgcggctgacgcgcgaccgcggcgtggacgcggcgcagatgcgcgccgagctgtcgcgcggcgacgtcgcggtgtgccccgaggggacgacgtgccgggagcccttcctgctccgcttctccgcgctgttcgccgagctcagcgaccggatcgtgccggtggcgatgaactaccgcgtcgggctcttccacccgacgacggcgagggggtggaaggccatggaccccatcttcttcttcatgaacccgaggccggtgtacgaggtgaccttcctcaaccagctccccgccgaggagacgtgcgccgccggcaagagcgccgtcgacgtcgccaactacgtgcagaggatactcgccgccaagctcgggttcgagtgcaccaccttcacgcgcaaggacaagtaccgcgtgctcgccggcaacgacggcatcgtcaacgtcaagccgccggcggcggcggatccggcgccgtggcagcgccgcctcaaggaggttctcggcttcttgctccactaatcgatcacaaattcacaatactttcgtggccaaagtgctctgctcacaagattaatttgacgaattttaattgcgataccccccaaaaaaattgcgagttttaatttacatgcgtgtgcatgtatgtacgcaaagaaatgtaaatgaagacagcagccaccattagatatcaaacctacacctacggttgcttttccttgctttttcttacgaaatttgttcatgattcatttgattttatttttgttgtaatcaaactatactgctgtatatatatatttacacatccattatcacaagttgcatgctcaatctattttactcatacgtagattttgtgttggtctagttgttgatcagtcctccctagctagtgcctattaattccattttttttatct

SEQ ID NO: 295 - DNA, 1780 bp, Hordeum vulgare
aggagcatcaaaccaacaggacgccgcacgcacccatcgagagcagcaactccattcccttcccccttccttcttcatcaccctccccctccccctctccgcccccaaaaaatctcaacgaaaccccgtcgcatcccctcctcatcccaggccaaaagccctctgcttttcgcctccctctctcctcccctcctccgggccgggggttcgccggcggtggtgcctttgcacttcctgcctcgggttttagggggattcttgtggggttttaggtaggccgtgtctggggcgcaggcaaatgcgagtggagttttagggagagtttttgtttcttcctttcctcgatgtggcccatggaggagttcttcatggcggtgaagaggaccgagcacgtcgaggtgacgtcccggtcgctggcggcgtcggccacggggatggaggggtttggtggcggcgtcgagcagcccaagatggtgcgggtcttctgcgatgacttcgacgccaccgattcctcgagcgatgaggaggacggcgagcgccgccgcgtcaagcgctacgtccaggagatccgtctgcagcccgctgtccaggttaaggtggaggagtcggcgccggtcgccaaggccgcgtcggcgaccgcgacggcgacgaggccgagggtcatggttcccgtcaggaagaggaaggccgaggccggcggcgagcggcggttccgcggcgtgcggcgccgtccgtggggcaagtacgcggcggagatccgcgacccgtggcgacgcgtccgggtgtggctcggcaccttcgacaccgccgaggaggccgccaaggtctacgactctgccgccatcaagctgcgcggccccgacgccaccgtcaacttccagcagtccgaggacggcgaggacatggaggtcccggcggaggtcgccgagcgccttccacagccaccggcgggttccaagaactcctccacctcggccacctcgtacgactcgtgcgaggagtcccacgtcgccgcggcgtccccgacctccgtcctccgctccttccctcagtccaccttgcccgccgcagtggacggcgacaccgccaagaagccgtcgtcgtcttccagcaccgccgagaccgacgagtcgagcggcgtcttcggctgctcgttctccggcgacgacttcgcgggcgagctggcgccgctctacagcgacttcgacctcctctccgacttcgcggagccgccgatggacttcctgtccaacctcccggagccggccttcgcgttcaccagcgactgctcgtcgtcggccttccagccttgcccgccgtctccggcggcgttgcagcaggcggacgagttcttccaagacatcaccgacctgttccaaatcgatcccctccccgtcatctagcggaacaagtgtaaaacaccggattaggcgcctaattcggtcaattttgtttgcattcgttcgtttttcttttcttttttggcttttcttttctagagagaggagagagagagagagagaaagagagtatggttttatgattcgcctgtgtagctgcctgccgccaaacaatccccggcagagggaagcctcgccggggtttagacgagagtctgaaagaatgagatggctgtcattagtcccttcatcgctggttttgtaaccagctctggagccaagttatcagtaattagcaacagtatcatcgagttatgagttgaacatttccgtatatatttatatttatgtcaatgaatgaatgaatgaaaggcgaagag

SEQ ID NO: 296 - DNA, 1095 bp, Secale cereale
cttcccctcctccttccatccaggccaaagccctttgctttcgctccgctcgagcgagtcgcgcgtgtcgcttccgtccgcgtgccttgggttttaggggggattcttgaggggttttaggtaggccgcgtctggggcgcaggcaaatgcgagtggagttttagggtgagtgttttcctttccccgatgtggcccatggaggaggagtttttcagtggcggtgaagaggacggagcacgtcgaggtgacgtcccgttcggtggcggcgccggccaaggcgaaggaggggtttggtggcgtcgtcgagcagcccaagatggtgagggtgttctgcgatgacttcgacgccaccgattcctccagcgatgaggaggagggcgagcgccgccgcgtcaagcgctacgtccaggagatccggctgcagcccgcggtccaggttaaggtggaggagtcggcgccggtggccaaggccgcgtcggcgacggcgaccacgaggcccagggtgatggtccccgtgaggaagaggaaggccgaggccggcggcgagcggcggttccgcggcgtccggcgccgtccgtggggaaagtacgccgcggagatccgcgacccgtggcgacgcgtacgcgtgtggctgggcaccttcgacaccgccgaggaggccgccaggtgctacgactcggccgccatcaagctgcgcggcccgacgccaccgtcaacttccagcagtccgaggacggtgaggacatggaggtacccgccgaggtcgctgagcgccttccgcagccaccggcgggttccaagaactcctcctcggccacgtcctacgactcgtgcgaggagtcccacgtcgcggccgcgtccccgacctccgtctccgctccttccctcagtccaccattgccgccgccgtcgacgacaacgcctccacgaagccgtcgtcgtcttcgagcaccgccgaaaccgctgagtcgagcggcgtcttcggctgctcgttctccggcgacgacttcgccggcgagctggccccgctctacaccgacttcgacttcctgtccgacttcgcggagccgccgatggacttcctgtccaacctcc

SEQ ID NO: 297 - DNA, 1349 bp, Setaria italica
gcagtagcaaggagtagcatagcaacgaccatggggagcgctccggcggccaacttccgtgagatctgccgcgcgcggcgtgccgacggccccgcggccgtgctcgccatcggcacggccaacccgggcaactgcgtgctccaggaagacttccccgacttctacttccgcgccaccaagagcgagcacctcactggcctcaaagaaaagttcaagagagtttgccagaaactgggcgtgcagaggcgctacctgcaccacaccgaggagctcctgagcgcgcacccggagttcctcgacctcgtctgctcgccgtccctcgacgagcggctggacatcgtcaagaccgcggtgccggagctcgccgcggcggcgtcccggaaggccatcgccgagtggggccgcccggccgccgacatcacgcacctcgtcgtcaccaccaactccggcgcgcacatcccgggcgtcgacttccagctggtcccgctcctgggcctccgcccgaccgtgcgccgcaccatgctctacctcaacggctgcttcgccggcgcggccgcgctgcgcgtcgccaaggacctcgccgagaacaaccgcggcgcgcgcgtgctcgtcgtctgcgccgagctcaccgtcctggtcttcacgaggcccgtggaggggtacttccagacgctcgtcaagcaggccctgttcggagacggcgcgggggccgtcatcgtcggcgccgaccccgtgatgaccatccccgccgagcgcccactgttcgagatcgtgtccgccgcgcagaccatcatatcggagtccgaggacgccatcaccatgcacctcacgaaaggcggctgcggcggcaacatctccaccaggcaggtccccgtgttgatcggccacaacatcgagcgctgcctcctggacgcgttccagccgctcggcattggcgcagggtggaacgacctgttctgggatgtgcacccgggctcgtcggcgatcctggaccaggtcgacaccgtgctccacctcaagcccgagaagcttgcggcgagcagacgtgtcctgagtgagtacgggaacatgcaaggtgtcacggtgatcttcgtgctcgacgagctgcggcgccggatggaaaagggggaagaggagggggagcctgagtggggggtcatggtggcgttcggaccggggctcaccgttgagacgatggtgctgcaccggtgcgcggcgcaggccacaggcgcgccaacagaggagggactgactgttttttgcgggtgaccaatttgtgttggatttggatcccaagcatgttgcttggtgaacatttcgttcatccgtgtaaaatatcgtgcaaagat

SEQ ID NO: 298 - DNA, 1552 bp, Sorghum bicolor
tgaaacgtcaaatgcaaggtacatacatatagacgcacgacgtccgtgcctttcagcaacaactcgatcggtgacggctgctgtggtgctggtagcaacagcaagtaccaacaagtaccagcaaccatgggaagtagtgctgctccggccaacgtccgcgagatctgccgcgcacagcgtgccgacggccctgcagccgtgctcgccatcggcacggccaacccggcgaactgcgtgccccaggacgagttcccggacttctacttccgcgccaccaagagcgaccatctcactggcctcaaggaaaagttcaagagagtttgccagaagctgggcgtgcagaagcgctacctgcaccacaccgaggagctgctgagcgcgcacccggagttcctcgaccactcctcgccgtccctcgacgcgcggctggacatcgtcaagaccgccgtgccggagctcgccgcgcaggccagcaggaaggccatcgccgagtggggccgcccggccgccgacatcacgcacctcgtcgtcaccaccaactccggcgcgcacatcccgggcgtcgacttccgtctggtcccgctcctgggcctccgcccgaccgtgcgccgcaccatgctctacctcaacggctgcttcgcgggcgccgccgcgctgcgcctcgccagggacctggccgagaacaacagtggcgcgcgcgtgctcgtcgtctgcgccgagatcaccgtcctgctcttcaacgggcccgaggaggggtgcttccagacgctcgtcaaccagggcctgttcggcgacggcgctggggccgtcatcgtcggtgccgacccactggcggccgagcgcccgctgttcgagatcgtgtccgccgcgcaggccatcataccggagtccgaggacgtcatcaccatgcacctcaccaggggcggctacggcggcaacatctccaccaggcaggtccccgtcctcatcggcgacaacatcgagcgctgtctcaccgacgctttcgcgccgctcggcggcgttattggcgccgaatggaacgacctgttctgggacgtgcacccgggctcgtcggcgatcctggaccaggtcgacgccgtgctcaagctcaagcctgagaagctggcggcgagcaggcgtgtcctgagcgagtacgggaacatgttcggcgtcacggtgatcttcgtgctcgacgagctgcgccgccggatggagaagggggaagaggagggggcgccagagtggggggtcatggtggcgttcggacccgggctcaccgttgagacgatggtgctccaccgatcaggcaccccagctgagaagaaactggcggaggcatgagaccaatttgtgttggaacttggatcaggattgcatgcatgttgcttggtcaacattccctttatgcctgtattaattaatgtgcaaaactttgcttgtttcgtttgaattcttgataaatgcaaagtcggataactgataaacttcatttgatcattgcacacgtttattgttgactttaggctaaaataaataaattcaagtactccct

SEQ ID NO: 299 - DNA, 1889 bp, Zea mays
ttcttgcttgcggtatatagacgatgcaccacgttcgtgtctttcatcaacagctctgctagctgcctagcttcttgtagcactagcaagttgtactcctctcctaccaagtactagcagagtagctttgtagcaaccatgggaagcgcttgggccaacgtccgcgagatctgccgcgcacagcgtgccgacggccccgcagccgtgctcgccatcggcacggccaacccggcgaactgcgtgccccaggacgagttccccgacttctacttccgcgccaccaagagcgaccacctcactggcctcaaggaaaagttcaagagagtttgccagaagctgggcgtgcagaagcgctacctgcaccacaccgaggagctgctgagcgcgcacccggagttcctggaccgctcctcgccgtccctcgacgcgcggctggacatcgtcaagaccgccgtcccggagctcgccgcgcaggcctgcaggaaggccatcgccgagtggggccgcccggccgccgacgtcacgcacctcgtcgtcgccaccaactccggcgcgcacatcccgggcgtcgacttccagctggtctcgctcctgggcctccgcccgaccgtgcgccgcaccatgctctacctcaacggctgctccgcgggcgccgccgcgctgcgcctcgccagggacctggccgagaacaaccgcggcgcgcgcgtgctcgtcgcctgcgccgagatcaccgtcctgctctttgacgggcccgaggagggctgtttccagacgctcgtcaaccagggcctgttcggcgacggcgcgggagccgtcgtcgtcggcgccgacccggcggccccggccgagcgcccgctgttcgagatcgtgtccgccgcgcagaccgtcataccggactccgagggcgtcatcaccatgcacctcaccaagggtggctacggcggcaacatctccaccaggcaggtccccgtactcatcggcgaccacatcgagcgctgtctcacggacgcttttgcgccgctcggcgtcggcgccggatggaacgacctgttctgggacgtgcacccgggctcgtcggcgatcctggaccaggtcgacgccgtgctcaagctcaagcctgagaagctggcggcgagcagacgtgtcctcagcgagtacgggaacatgttcggcgtcacggtgatcttcgtgctcgacgagctgcgccgccggatgacgaatggggaagaggagggggcgcctgcagagtggggggtcatggtggcgtttggacccgggctcaccgtcgagacgatggtgctccaccgatcaggcaccccagccgagacgaaactaggtgaggcatgaaaaggtggacgtgaccaatttgtgttggaacttggatcaggattgcatcattgcatgcatgttacttggtcaacatattccgactatgtcactattcttgacttcagcctataataaattcaactacataaacaactgttaaactttatctagttacaaatacagtaccggcagtgagagaaactgttgagcaatattgctacaactccaaccaaccaggtgacaaatatgtgtgacagttctccaactgtgtttgatttgaaactatgtcaatgttgatgtcaaagaccatttacatgtcgaattacgacgatattatgtgaatgtcgaactatgaaaatactatgtgtaacggatgttggaactatttgttgatgttaaagacttgttgtaatgtgtttgtgaatgtgagttcatgtttgagaatgtgaattaatgtttgtgaatgtaattgaatgtgaatgcgaatgcgtggctcagtggttgtatatgaaatctatgtatatatgaaagctgtgttttcggtaatattaaaaatggac

SEQ ID NO: 300 - DNA, 1365 bp, Panicum virgatum
tgcgacagcaacatcggctagctctgtctgtgtccgctggtacccatagcagcaaccatgggaagcgctccggcgaacgtccgtgagatctgccgcgcgcggcgcgccgacggccccgccggcgtgctcgccatcggcaccgccaacccggccaactgcgtgctccaagacgagttcccggacttctacttccgcgccaccaagagcgagcacctcactggcctcaaggacaagttcaggagagtctgccagaagatgggcgtacggaagcgctacctgcaccacaccgaggagctgctgggcgcgcacccggagttcctggacccccacacgccgtccctggacgcgcggctcgacatcgccaaggccgcggtgccggagctcgccgcggaggcctcccgaagggccatcgccgagtggggccgcccggccgccgacattacgcacctcgtcgtcaccaccaactccggcgcgcacatgccgggcgtcgacttccggctagtcccgctcctcggcctccgccccaccgtgcgccgcaccatgctctacctcaacggctgcttcgccggcgccgccgcgctgcgcgtcgccaaggacctcgccgagaacaaccgcggcgcacgcgtgctcgtcgtctgcgccgagatcaccgtccagctcttcacccgccccgaggatggctgcttccagacgctcgtcaaccagggcctcttcggcgacggcgcgggcgccgtcgtcgtcggcgccgaccccgtgatgatcaggacccccgccgtcgttcgagagcgcccgattttcgagatcgtatccgccgcgcagaccatcgtaccggactccgaggacgtcatcaccatgcacctcaccaaaggcggctatggcggcgacatctccaccaggcaggtcctcgtgctcatgggcgacaacatcgagctctgcctcctcgacgcgttcgagccgctcggcatcggcacaggatggaacgacctgttctgggccgtgcacccgggctcgtcgccggtcctggatcaggtcgacgccgtgctccacctcaagcccgagaagctggcggcgagcaggcgcgtcctcagcgagtacgggaacatgttcggcgtcacggtgatcttcgtgctcgacgagctgcgccgccggatgcagaacggggaggagggggcgcccgagtggggggccatgctggcgttcggacccgggctcaccgttgagacgatggtgctgcaccggtgcgtggcgcagggcacaggcgccgccccacctgaggacaaactggctgcggcctaagcgagaccagttggtgttggatttggatcaggcttccatgcatgttgcttggtcaaagacattgcttgt

SEQ ID NO: 301 - DNA, 1563 bp, Panicum virgatum
gcggtctgcaaaccgcgtccgctgcagccctgcgtgcaggcgggctgcaaaacctctgctgctcctatataagcgctggacgcccggccgtgcgtttcagcaaagacacctgcgacagcaacatcggctagctttgtctgtgtccgctggaacccatagcagcaaccatgggaagcgctccggcgaacgtccgcgagatctgccgcgcgcggcgcgccgacggccccgccgccatcctcgccatcggcactgccaacccggccaactgcgtgctccaggacgagttcccggacttctacttcggcgccaccaagagcgagcacctcaccggcctccaggacaagttcacgagactttgccagaagctgggcgtgcggaagcgctacctgcaccacaccgaggagctgctgggcgcgcacccggagttcctggacccccacgcgccgtccctcgacgcgcggctggacatcgccaaggccgcggtgccggagctcgccgcggaggcctcccggagggccatcgccgagtggggccgcccggccgccgacatcacgcacctcgtcgtcaccaccaactccggcgcgcacatgccgggcgtcgacttccggctggtcccgctcctcggcctccgccccaccgtgcgccgcaccatgctctacctcaacggctgcttcgccggcgccgccgcgctgcgaatcgccaaggacgtcgccgagaacaaccgcggcgcgcgcgtgctcgtcgtcagcgccgagatcaccgtccagctcttcacccgccccgaggagggttgcttccagacgctcgtcaaccagggcctcttcggcgacggcgcgggcgccgtcgtcatcggcgccgaccccgtgatgatcaggacccccgccgtcgttcgagagcgcccgattttcgagatcgtgtccgccgcgcaggccatcgtaccggactccgaggacgtcatcaccatgcacgtcaccaaaggcggctatggcggcgacatctccaccaggcaggtcctcgtgctcatcggcgacaacatcgagcgctgcctcctcgacgcgtttgagccgctcggcatcggcgcaggatggaacgacctgttctgggccgtgcacccgggctcgtcgccggtcctggaccaggtcgacgccgtgctccggctcaagcccgagaagctggcggcgagcaggcgcgtcctgagcgagtacgggaacatgttcggcgtcacggtgatcttcgtgctcgacgagctgcgccgccggatggagaaggaggaggaggagggggcgcccgagtggggggccttgatggcgttcggacccgggctcaccgttgagacgatggtgctgcaccggtgcgtggcgcagggcacaggcgccgccccacctgacaaactggctgcggcctaagcgtcaccagtttgtgttggatttgcatcaggcttccatgcatgttgcttggtcaaagactttgcttgtgatgactgcttgtgtaataaattcagagctggataactgattccaaacgattgttgctgactttgatattgaatatacaacttcagca

SEQ ID NO: 302 - DNA, 2648 bp, Aegilops tauschii
ccctctcgcgtcttctttctttctcctcgcaacatttcgtccgactcaactcacgggcgagcgggaacgagagcgcggccgccattttgacccgcccggccggcggatcaagagcccttataagcgccttttcttccccatacggcttctcacgcaagctgagttttttgctccacctgcgccggtcgcagattcccgcgaaagcgagggccagagcttttcttttctatctatcttgctctgtcctctcccccctttgtgctctccgtcccgccaaagcggcagaaagctgcagctgttcttgattcttgcgggggactgccggcacggctcgccggtctgggcggcctggacgtgaaggagccgcggcgcggcgggggcgatcgatgggcacggtgaaggcgtgggtggcgggcaagtacgcggagcccatggggccgatgcacgactcgctgcgcgtcgcctacgtggtcttctccttctgcgccgccttcttgctcggcggcatcaaagcgatggtggtcggcccggtggcggcggcgctgatgatactggggaacgtgggcgtcatactcgtgctcttcccggcgcacgtctggtggaccatctactcgctcatcaagacggaccgcatcaacgcgggcctgaagctggcggtggccatcgcgctgccggtgctgttcgggctgtggcttgggctgggcatcttcgggagcgccctggtggccctgggctacggcttcttcacgccgtggatctcgaccttcgaggcgttccggcaggagagcgaggccaagaagttcgtgcatggcattgtggacgggacgtggggaacgatcaagggcagctgcacggtggtgagggacttcgcggacatgtgcttccactcctaccccgtttacctcaaggagctccgcgagtgcgcccaggaccgcgaacccctctccataaggctgttggacgtgccgtcgtgcatactcgtcggcctcctgggtttgatcgtggacataccgctctacacggtgatcgcgctgatcaagagcccctacatgctcttcaagggctggcagaggctgctgcacgacctcatcagccgcgaaggccccttcctggagccggtctgcgtgcccatcgccggcctcgccatccttttctggcccctagtggtggtcgggagcgtcctgctggccgtcgtctccagcatcttcgtgggtctctacggagcggtcatcgtctaccaggagaagtcgttccggcggggggcttcgtacgtggtgaccatggtcgccgagtttgacgagtacaccaacgactggctttaccttcgcgaaggcactgttctcccaaagccttcctatcggaagaggaaactgtccgattccgcggagttctcggtccggccaaatgtttctgtcaggggaggtgagcaccctagttcatccagtgaagcaccagcaatgctggttcccactttggttccggcgaggtccgtcagagaggcgatacaagaggtcaaaatggtccagatatgggaaaacgttatgaagtcatgcgagcagaggggcagggacctactgaacctgaatgtcataaccagcgtggacctgaccgagtggctgagaacaaaagacggtggcaatgagacgataaacctggggttgccttcctatgacatgctgtgcaccgtcctgcagtcgatcaaggccggctccgcggggctgctgctcggcaacggcgtggaggtcgaccagcagaaccggccgcaggacctgctgctggactggttcttccaccccgtgctggtgctcaaggaccagatacaggtgctcaagatgaccgagcaggaggtgaggttcctggagaagtcgacccttttcgtcggtggcagttctgctgctgccactgcggatgcgtgggataatggcgccgagaccccccgagatcccgtgaggaccgcgcagatccaggcgatcagtagaaggatggtggggatagtgaggagcatgtccaagttcccgacgtaccgcaggcgatacaggcatgtggtgaagctactggtggcgtacgcggtggagcgggaagggtcgttcgggtcgtcggcgtcaggtccgtcggtctccttcgaaatcacacgcctcgaagtgtagataatgccgtcgtcttttgcttctttttcgtcagtatataagtaggtatcgcacgccgtttttgtctgtgcctctcctgtttcaagtctactaggagcttctgtaattttgtgtagtggtagtacttttttttttccctttaggtaatgggagtgtgtatagttgttgtgttgtgagatgatgcgcgtgcccaaacttcaggcatgatcttcagctgtgctgtaaattcttgtatatacattttcctagggaattgtttggttctttaggtgttatacattgttgcatctttgcccggccggctgtgtttactgtggagagctggcatgatggtaacctatatgagcgagaattcctcgagtttgacggggccaaaatctgaaaaatcttgaggagaaacacacgaagcagccagctgctatccactttccccttgcatcgttttttagagaaaaggtctcttcctcttgtgcatcatttattcatcttcttctctgcttg

SEQ ID NO: 303 - DNA, 2097 bp, Aegilops tauschii
ctcccactcccacacaacgacacggcgaccgtcctgcccagacaccgacgagacggcctctctctccctctctgaccacttctccacaaagcacagcttataatgcgagctcggtggagccgaggagcttaactggctgctggtggagcggggatgatgatggacctgggcgccgcgcgcgcgacgccgccgtcggcgcaggaggcggccgaggccgccgtgcgcgcggtcggctgcggctacgacctcgccgacgacctccgcctcttccgcgccaaggaccgcctgctcgacctcggcggcggcggcgagcgggacctgtgcctgccgggcggggccgtggtgaccagcgtgcccgcgggggtcgtcgccgacaagggcgagcgcgcgcggttccgctccgacgtgctctccttcacgcagatggcggagcacgtgaaccagtcgctgtcgctgacgggcaagatcccctcggggcccttcaacgccatgttcgactaccgcggctgctggcaccgggacgccgccgccacgcgcagcctctgcttcgacgcccgcctcgtcgagctctacgccgtcgaggccccccgcggcgcgcggctcgccctccgcgaccacgtcgcccgcgacgtcccgacctcctgggaccccccggcgctcgccgccttcatcgacacgcacggcacccacgtcgtcgtcggcgtcaggatggggggcaaggacgtcgtctgcgtcaagcagctcaggggctccgccctcgagccgcgggacgtgcaggcccgcctcaagaagctcgccgacgccaccttctcccagtcccaggaccgacggcagagctccgccggcgccaagggccgcgggtcgtcgtcgcggagacctcccggccccggctccgctgcctggcgcgccttcaggtcgccggtcatccacaacaaggacgatgtcgtcggcatccacgtcaggcgaggcggcgtcgacgacgggcagggacacgacgactggcttaccaccatcgccgcctcgccggacgtcatctccatggccttcgtgcccatcacctcgctgctcaccggcgtccccggtcgcggcttcctcaaccacgccgtcaatctctacctcagatacaagccgccgatagaggagctggagcagttcctggagttccaggtgccgcggcagtgggcgccggagttcggcgagctcccgttggctctcggcccgcagaggaagaagaagaaggacagcctgccgtcgctccagttcacgctcatggggcccaagctccgggtcaacacggccaaggtggactctgggggccggccggtgacgggcatccggctgttcctggagggcaagaagaacagccggctgggcgtgcacctgcagcacctgtcggcgacgccgcgcgcggtcccaatcgtcgtcggcgaggcggtcaccaccgccgtcggggacgccgtgaacgagcgcgcctacttcgagcctgtgaggtcgtcgctgctgacgcacgcgtgcacggcgccggtgcagcacgccggcgcgcgcatcgacgactgcgcggccgtggtgaccgcggcctggctggaggtgcgcgaggcgtgcctgaagaaggtgctcttcctacgtctcggcttctccggcgtggcgcggaccaagatacggcggtcggagtgggacggcccgctcgccacgacccgcaagtcgggctcgctgtcggcgatgctcagcgcggcgctgtccggcaccgccgccgtgccgccgcagggggagccgatggaggggaaggtggaggtgaactcggccgtgttccccaagggcccgccggtgccgctgcccgtgcagaagatggccaagtacatcgacacgacggaggtgacgaggggccccgacgacctgccggggtactgggtggtcactggcgccaagctctgcgtggaaggcggcaaggtggcgctcaaggccaagtactcgctgctcatctcggcgccagaggacgacgaggtttgaatcagttgtgcatatcatgtacaaagtgcgcacatacatcaagaggtcgtacagactgtagattagagagtgcttgtcaattcttgtaaa

SEQ ID NO: 304 - DNA, 1874 bp, Aegilops tauschii
ggatcccggggatgatgatggacctgggcgccgcgcgcgcgacgccgccgtcggcgcaggaggcggccgaggccgccgtgcgcgcggtcggctgcggctacgacctcgccgacgacctccgcctcttccgcgccaaggaccgcctgctcgacctcggcggcggcggcgagcgggacctgtgcctgccgggcggggccgtggtgaccagcgtgcccgcgggggtcgtcgccgacaagggcgagcgcgcgcggttccgctccgacgtgctctccttcacgcagatggcggagcacgtgaaccagtcgctgtcgctgacgggcaagatcccctcggggcccttcaacgccatgttcgactaccgcggctgctggcaccgggacgccgccgccacgcgcagcctctgcttcgacgcccgcctcgtcgagctctacgccgtcgaggccccccgcggcgcgcggctcgccctccgcgaccacgtcgcccgcgacgtcccgacctcctgggaccccccggcgctcgccgccttcatcgacacgcacggcacccacgtcgtcgtcggcgtcaggatggggggcaaggacgtcgtctgcgtcaagcagctcaggggctccgccctcgagccgcgggacgtgcaggcccgcctcaagaagctcgccgacgccaccttctcccagtcccaggaccgacggcagagctccgccggcgccaagggccgcgggtcgtcgtcgcggagacctcccggccccggctccgctgcctggcgcgccttcaggtcgccggtcatccacaacaaggacgatgtcgtcggcatccacgtcaggcgaggcggcgtcgacgacgggcagggacacgacgactggcttaccaccatcgccgcctcgccggacgtcatctccatggccttcgtgcccatcacctcgctgctcaccggcgtccccggtcgcggcttcctcaaccacgccgtcaatctctacctcagatacaagccgccgatagaggagctggagcagttcctggagttccaggtgccgcggcagtgggcgccggagttcggcgagctcccgttggctctcggcccgcagaggaagaagaagaaggacagcctgccgtcgctccagttcacgctcatggggcccaagctccgggtcaacacggccaaggtggactctgggggccggccggtgacgggcatccggctgttcctggagggcaagaagaacagccggctgggcgtgcacctgcagcacctgtcggcgacgccgcgcgcggtcccaatcgtcgtcggcgaggcggtcaccaccgccgtcggggacgccgtgaacgagcgcgcctacttcgagcctgtgaggtcgtcgctgctgacgcacgcgtgcacggcgccggtgcagcacgccggcgcgcgcatcgacgactgcgcggccgtggtgaccgcggcctggctggaggtgcgcgaggcgtgcctgaagaaggtgctcttcctacgtctcggcttctccggcgtggcgcggaccaagatacggcggtcggagtgggacggcccgctcgccacgacccgcaagtcgggctcgctgtcggcgatgctcagcgcggcgctgtccggcaccgccgccgtgccgccgcagggggagccgatggaggggaaggtggaggtgaactcggccgtgttccccaagggcccgccggtgccgctgcccgtgcagaagatggccaagtacatcgacacgacggaggtgacgaggggccccgacgacctgccggggtactgggtggtcactggcgccaagctctgcgtggaaggcggcaaggtggcgctcaaggccaagtactcgctgctcatctcggcgccagaggacgacgaggtttgataggaattc

SEQ ID NO: 305 - DNA, 2352 bp, Hordeum vulgare
cctggccatacaccgacgcgacggcccctctctctctccctctctgaccacttctcctctccacaccggtggcgcggcttataatgcgcgcgccgcggagccggggagcttaacgggctcccggtggagtggggatgatgatgatggacttgggcgccgcgcgcgcgacgccgccgtcggcgcaggaggcggccgaggccgccgtgcgcgcggtcggctgcggctacgacctcgccgacgacctccgcctcttccgcgccaaggaccgcctgctcgacctcggcggcggcggcggcgagcgggacatgtgcctaccgggcggggccgtggtgaccggcgtgcccgcgggggtcagcgccgacaagggcgaacgcgcgcggttccgctccgacgtgctctccttcgcgcagatggcggagcacgtcaaccagtcgctgtcgctcacgggcaagataccgtccggccccttcaacgccatgttcgactaccgcggctgctggcaccgggacgccgccgccacgcgcagcctctgcttcgacgcccgcctcgtcgagctctacgccgtcgaggccccccgcggcgcgcgcctcgccctcctcgcccacgtcgcccgcgacgtcccgacctcctgggacccacccgcgctcgccgccttcatcgacaggcacggcacccacgtcgtcgtcggcgtcaggatggggggcaaggacgtcgtctgcgtcaagcagctcaagggctccgccctcgcgcccagcgacgtgcaggcccgcctcaagaagctcgccgacgccaccttctcccagtcccaggaccgacgacagagctcttccggctccaagagccgcggatcgtcgtcgcggagacccctcggccccggttccgctgcctggcgcgcgttcaggtcgccggtcatccacaacaaggacgatgtcgtcggcatccacgtaaggcgaggcggcgtcgacgacgggcagggccacgacgagtggctcaccaccgtcgccggctcgccggacgtcatatccatggccttcgtgcccatcacctccctgctcaccggcgtccccggccgcggcttcctcaaccacgccgtcaatctctacctcagatacaagccgccgatagaggagctggagcagttcctggagttccaggtgccgcggcagtgggcgccggagttcggcgagctcccactggctctcggcccgcagaggaagaagaagaaggacagcctgccgtcgctccagttcacgctcatggggcccaagctccgggtcaacacggccaaggtggactccggggggcggccggtgacgggcatccgactgttcctggagggcaagaagaacagccggctgggcgtgcacctgcagcacctgtcggcgacgccgcgcgctgtccccgtcgtcgtcggcgaggcggtcaccgccaccggcggggacgccgtgaacgagcgcgcctacttcgagcccgtgaggtcgtcgctgctgacgcacgcgtgcacggcgccggtgcagcacaacggggcgcgcatcgacgactgcgcggccgtggtgaccgcggcctggctggaggtgcgcgaggcgtgcctgaagaaggtgctcttcctgcggctgggcttctccggcgtggcgcggaccaagatacggcggtcagagtgggacggcccgctcgccacgacccgcaagtcaggctcgctgtcggcgatgctcagcgcggcactgtccggcaccgccgctataccaccgcaggcggagccgatggaggggaaggtggaggtgaactccgccgtgttccccaagggcccgccggtgccactgcccgtgcagaagatggcgaagtacatcgacactacggaggtgacaaggggccctgacgacctgccggggtactgggtggtcaccggcgccaagctctgcgtggaaggcggcaaggtggcgctcaaggccaagtactcgctgctcatctcggcgccagaggacgacgatgtttgaatcagttgtgcatatggtgtacagactacagagtgcgcgcacacatcaagagacagtacagactagtagattagagagtgcttgtcaattcttgtaaatcaggaacagttagagcaattccaaccggtctaactccaaccggaacgacggctttgttcgtctttgtccgtttgaatcgactactccgtcctcatttataaatgaatcgatcctgtgtttaacgtgtcgactcatttttttcacgcatgaacaattttcagtgctgcacatcttgccaaaatgtcgaagccttttgctcggaacctgtcttggggtcttgaccaatgtatctccaacattcataaaaaagtttgccctc

SEQ ID NO: 306 - DNA, 3920 bp, Triticum aestivum
gtggagtgaagccgggatgatgatggacctgggcgccgcgcgcgcgacgccgccgtcggcgcaggaggcggccgaggccgccgtgcgcgcggtcggctgcggctacgacctcgccgacgacctccgcctcttccgcgccaaggaccgcctgctcgacctcggcggcggcggcgagcgggacctgtgcctgccgggcggggccgtggtggccggcgtgcccgcgggggtcgtcgccgacaagggcgagcgcgcgcggttccgctccgacgtgctctccttcacgcagatggcggagcacgtgaaccagtcgctgtcgctcacgggcaagatcccctcgggccccttcaacgccatgttcgactaccgcggctgctggcaccgggacgccgccgccacgcgcagcctctgcttcgacgcccgcctcgtcgagctctacgccgtcgaggccccccgcggcgcgcgcctcgccctccgcgaccacgtcgcccgcgacgtcccgacctcctgggaccccccggcgctcgccgccttcatcgacacgcacggcacccacgtcgtcgtcggcgtcaggatggggggcaaggacgtcgtctgcgtcaagcagctcaggggctccgccctcgagccgcgggacgtgcaggcccgcctcaagaagctcgccgacgccaccttctcccagtcccagcaggaccgacggcagagctccgccggcgccaagggccgcgggtcgtcgtcgcggagacctcccggccccggctccgctgcctggcgcgccttcaggtcgccggtcatccacaacaaggacgatgtcgtcggcatccacgtcaggcgaggcggcgtcgacgacgggcagggacacgacgactggcttaccaccatcgccgcctcgccggacgtcatctccatggccttcgtgcccatcacctcgctgctcaccggcgtccccggtcgcggcttcctcaaccacgccgtcaatctctacctcagatacaagccgccgatagaggagctggagcagttcctggagttccaggtgccgcggcagtgggcgccggagttcggcgagctcccgttggctctcggcccgcagaggaagaagaagaaggacagcctgccgtcgctccagttcacgctcatggggcccaagctccgggtcaacacggccaaggtggactccggggggcggccggtgacgggcatccggctgttcctggagggcaagaagaacagccggctgggcgtgcacctgcagcacctgtcggcgacgccgcgcgcggtccccatcgtcgtcggcgaggcggtcaccaccgccgtcggggacgccgtgaacgagcgcgcctacttcgagcccgtgaggtcgtcgctgctgacgcacgcgtgcacggcgccggtgcagcacgccggcgcgcgcatcgacgactgcgcggccgtggtgaccgcggcctggttcgaggtgcgcgaggcatgcctgacgaaggtgctcttcctacgtctcggcttctccggcgtggcgcggaccaagatacggcggtcggagtgggacggcccgctcgccacgacccgcaagtcgggctcgctgtcggcgatgctcagcgcggcgctgtccggcaccgccgccgtgccgccgcagggggagccgatggaggggaaggtggaggtgaactcggccgtgttccccaagggcccgccggtgccgctgcccgtgcagaagatggccaagtacatcgacacgacggaggtgacgaggggccccgacgacctgccggggtactgggtggtcaccggcgccaagctctgcgtggaaggcggcaaggtggcgctcaaggccaagtactcgctgctcatctcggcgccggaggacgacgaggtttgaatcagttgtgcatatcgtgtacagactacagagtgcgcacacacatcaagaggtggtacagactgtagattagagagtgcttgtcaattcttgtaaatcaggaccagttagctgtgagatgttgaaatttgtcaaaaatagaaaatagaaactacacattttaagcatattgccttgctgaagatggaatggcatgaagcagcatccaccgattttgtatcacaaaacccgacagaactgaagctctgatatcatcatcatcctcgtcacacaagttcaggtaagaacatacacagttgcatctaatgtacatgcataaagcacagagggtgctcgggttctcggccgaagagctcgaaaggccaccttaaaacctctccatggtaccgaccaccggctgtgcctccacacgcggcctcttctcggaaagatagggaccccttctgaccgcctcattcagctttccaatgagttcagaaaggctcggttcatgaagaaggtgcgacgatgacaaggccttgttgattgccacacagcaagcgtaccgtgcctccatgccaagttttgttgtctccatttttggatccgtaacaattccgattatctctggctttgagcaaacttcccttaggcaccattctcggacaaccagtcctgacagtactctataaccagcaatccgaacgtctggatcttgttgtagaattgatagaagaagagctgaaggagttaattttggactgtttgatgctgcactgtagactaagcgcttcaggcactcttctgcttgatgatcatccagtttcatctggtcttcttgtcgatcaacaccacatatgcttccaaaggcatgtaaagcggccagctgtttacctctgccctgcctatcaaaggacatttctaccacatgtctggcaatatttggtggatcagagagcaacaagcatgctccttgagttgttgtaccaattagtcctaaggtctccaacgcgctctcaatttcatcagtattttgactttcctccgtcctcaatattttgtctatggccaagagcagattcgtcacacaagatttttctatagtcataaaagcatcagctgaagaaagaagcctcccactgatcaatgatgcccttgaccgtacaatagaatcagctgagggatcgttgatcacatcagttatgtgttgaagcaaactggtctttaacaagaacatattgctgtgagggtgctccgcaagctcatagaggacctctagtgcactcagggttttaagcatatcttttctatcttttatctcgtcctcaaataagctgagaaggtttgagtcacgaattgcagtagcagtacaacttgatgcaccaaagagcttagctatcaaagatagaatgcgaatccgtgccattgaggatgactgggctgccactttgttgagttgcaatccttgaccatctggtggaaatatgatatcggtccctgtaggaatttctgctagacgctttatggcatccaaaacaattgctgagatctcttcgtctccctcaaccaagcagttgatcagaagagggtacagattgtgctgtacaaatgtgtccacggcaacagcaatatctccagccttgtcaagaagatgtaccaccgctttgcaggccaattgtttgatactatttgagtttgtgagcaacccagcttgaataaattcaccatagcttggtagaagcgatgctccatatctagatgaaaatactttgtccaagcacgctgcaacagtttcaaccgtctcaggtaagtctgcctggctctgcaatacacctagcagcttaggcagagggaattgttccaggaactgcctcactgtgtcctcaccatgcgttcctgggtaggaggcgaagtcggccgccgcacggagcagggcgtccagctcgcctgtatccatctccgccgcgggatccatctggtggtggtgctgctgctgctgcttctcgccgccgcggtctcgctccgggttttggtttcggttgtgggggcaagaggggcagagggaggg

SEQ ID NO: 307 - DNA, 1863 bp, Aegilops tauschii
cctggacgtgaaggagccgcggcgcggcgggggcgatcgatgggcacggtgaaggcgtgggtggcgggcaagtacgcggagcccatggggccgatgcacgactcgctgcgcgtcgcctacgtggtcttctccttctgcgccgccttcttgctcggcggcatcaaagcgatggtggtcggcccggtggcggcggcgctgatgatactggggaacgtgggcgtcatactcgtgctcttcccggcgcacgtctggtggaccatctactcgctcatcaagacggaccgcatcaacgcgggcctgaagctggcggtggccatcgcgctgccggtgctgttcgggctgtggcttgggctgggcatcttcgggagcgccctggtggccctgggctacggcttcttcacgccgtggatctcgaccttcgaggcgttccggcaggagagcgaggccaagaagttcgtgcatggcattgtggacgggacgtggggaacgatcaagggcagctgcacggtggtgagggacttcgcggacatgtgcttccactcctaccccgtttacctcaaggagctccgcgagtgcgcccaggaccgcgaacccctctccataaggctgttggacgtgccgtcgtgcatactcgtcggcctcctgggtttgatcgtggacataccgctctacacggtgatcgcgctgatcaagagcccctacatgctcttcaagggctggcagaggctgctgcacgacctcatcagccgcgaaggccccttcctggagccggtctgcgtgcccatcgccggcctcgccatccttttctggcccctagtggtggtcgggagcgtcctgctggccgtcgtctccagcatcttcgtgggtctctacggagcggtcatcgtctaccaggagaagtcgttccggcggggggcttcgtacgtggtgaccatggtcgccgagtttgacgagtacaccaacgactggctttaccttcgcgaaggcactgttctcccaaagccttcctatcggaagaggaaactgtccgattccgcggagttctcggtccggccaaatgtttctgtcaggggaggtgagcaccctagttcatccagtgaagcaccagcaatgctggttcccactttggttccggcgaggtccgtcagagaggcgatacaagaggtcaaaatggtccagatatgggaaaacgttatgaagtcatgcgagcagaggggcagggacctactgaacctgaatgtcataaccagcgtggacctgaccgagtggctgagaacaaaagacggtggcaatgagacgataaacctggggttgccttcctatgacatgctgtgcaccgtcctgcagtcgatcaaggccggctccgcggggctgctgctcggcaacggcgtggaggtcgaccagcagaaccggccgcaggacctgctgctggactggttcttccaccccgtgctggtgctcaaggaccagatacaggtgctcaagatgaccgagcaggaggtgaggttcctggagaagtcgacccttttcgtcggtggcagttctgctgctgccactgcggatgcgtgggataatggcgccgagaccccccgagatcccgtgaggaccgcgcagatccaggcgatcagtagaaggatggtggggatagtgaggagcatgtccaagttcccgacgtaccgcaggcgatacaggcatgtggtgaagctactggtggcgtacgcggtggagcgggaagggtcgttcgggtcgtcggcgtcaggtccgtcggtctccttcgaaatcacacgcctcgaagtgtagataatgccgtcctcttttgcttctttttcgtcagtatataagtaggtatcgcacgccgttttt

SEQ ID NO: 308 - protein, 1122 aa, Zea mays
MAEDHGSSRHMSASQKELGDEDARVVRVADAARTNERLDLAGNAVRTAKYSPLTFLPRNLFEQFHRLAYVYFLAIAVLNQLPQLAVFGRGASVMPLAFVLLVTAVKDAYEDWRRHRSDRAENGRLAAVLSPAAPGGAQFVPTEWKHVRVGDVVRVVSDESLPADMVLLATSEPTGVAYVQTLNLDGESNLKTRYAKQETLSTPPERLAGAVIRSERPNRNIYGFQANLELEGESRRIPLGPSNIVLRGCELKNTPWAVGVVVYAGRETKAMLNNAGAPKKRSRLETHMNRETLFLSAILVVLCSIVAALSGVWLRTHEEELELAQFFHKKDYLHRDKDNDYKNYNYYGIAAQIVFIFLMAVIVFQIMIPISLYISMELVRLGQAYFMIRDTRLYDESSNSRFQCRALNINEDLGQIKCIFSDKTGTLTQNKMEFRCASIDGIDYSDIARQRPPEKGDRIWAPKISVNTDPELVKLIRDGGDTERGTQTREFFLALACCNTIVPMIADGPDPKEKVIDYQGESPDEQALVSAAAAYGFVLVERTSGHIVIDVLGEKLRYDVLGLHEFDSDRKRMSVIIGCPDKSVKLFVKGADSSMFGVIDKTANSDVVQATEKHLHSYSSLGLRTLVIGMRELSQEEFQEWQMAYEKASTALLGRGNQLRNVAANIERNLRLLGATGIDDKLQDGVPEAIEKLREAGIKVWVLTGDKQETAISIGYSCKLLTRDMTQIVINSRSRESCRKSLEDAIAMVNKYQSFSTDPQLRVPLALIIDGNSLVYIFDTDWEEKLFEIAIACDVVLCCRVAPLQKAGIVDLIKKRTSDMTLAIGDGANDVSMIQMADVGIGISGQEGRQAVMASDFAMGQFRFLVPLLLVHGHWNYQRMAYMILYNFYRNATFVFVLFWYVLYTGFTLTTAITEWSSVLYSVIYTAVPTIVVAILDKDLSRRTLLKYPQLYGPGQRDENYNLRLFIFIMIDSVWQSLACFFIPYLAYRKSIIDGSSLGDLWTLSVVILVNIHLAMDVIRWNWITHAAIWGSIAATWICVMIIDSIPIMPGFWAIYKVMGTGLFWALLLAVTVVGMIPHFAAKAFSEYFIPSDIQIAREMEKSQDFHDVTHPEVQMSTVSRA

SEQ ID NO: 309 - protein, 605 aa, Triticum aestivum
MGTYKCCLVFKRRYRWTDAPPPDDVRALFAVHSGGAATMGADGLRRYLESSDPDAADDAEGEADRLLDQIRLQGHQHQRAGPRLPRLGRGQLLGLDDFHRFLFSADLNPPVRRPQVHHDMSQALSHYYVYTGHNSYLTGNQLSSDCSDVPIIKALQRGVRVIELDMWPNSAKDDISILHGRTLTTPVSLLKCLKSIKEYAFVASPYPVIITLEDHLTPELQEKVAKMVLEVFGTILYYPEEEHPKELPSPESLKGRVLLSTKPPKEYLEAKDGGAAKDGDAEQNPGKGTDDDAAWGTEVPDFKTEIQSAKEEDASEHRRDDDEDDDDEDEQKMQQHLAPQYKHLITIRAGKPKGGTTSDALKCDPNKVRRLSLSEQQLAKAVVNHGTEIVRFTQRNLLRIYPKGTRVTSSNYNPFIGWVHGAQMVAFNMQGYGRALWLMHGFYKANGGCGYVKKPDFLMQSEPEVFDPKKPQPVKKTLKVKVYMGDGWRMDFKQTHFDQYSPPDFYARVGIAGVPADSVMRKTKAVEDNWVPVWGEEFSFGLTVPELALLRVEAHEYDMSEKDDFAGQTVLPVSELQPGIRAVALFDRKGNKFPNVKLLMRFEFV

SEQ ID NO: 310 - protein, 367 aa, Triticum aestivum
MTTSQDVVVSEMGIGPGGAAMPGSGAAGLFACRSAASAGAMSMGQTYRDLAAAASRSANCTWAELEAMRAASPTRSRPGTDVDELTAWMRKHPSALGKFEQIASASKGKKIVMFLDYDGTLSPIVANPDAAYMSDAMREAVRDVAKHFPTAIVSGRCRDKVHNFVGLSELYYAGSHGVDIKGPGSNPESVLCQPASEFLPMIDEVYKVLVEKTKSTPGAKVENNKFCLSVHFRCVDEKRWNFLAEQVKAVIKDYPMLKLTQGRKVFELRPSIMWDKGKALEFLLESLGFASCSDVLPVYIGDDRTDEDAFKVLRKRGQGVGILVSKCAKETSASYSLQDPAEVMEFLLRLVDWKRRSSAPPMVRPRV

SEQ ID NO: 311 - protein, 139 aa, Zea mays
MAMEVQGTRRPQDAGVKVKFIETQFISSDAASFKAVVQRLTGKSPAASSQTTQPPAHPQPQSLRPCRPTFIGAGQQQTTGWTDLQAAGGYLATMPAPKQEHLAAAPRLEDMNELCDFADLFYTTAASNRPDGGASVFPY

SEQ ID NO: 312 - protein, 98 aa, Zea mays
MVNQKPLFPGDSEIDELFKIFRVLGTPNEQSWPVVSCLPDFKTAFPRWQSQDLAIIVPNLEPAGLDLLSKMLRYEPSKRITARQALEHEYFKDLDMVQ

SEQ ID NO: 313 - protein, 353 aa, Aegilops tauschii
  Sequence also found in Organisms: Triticum aestivum
MGSISDDEAACIYAMQLAAAAVLPMTLKNAIELGMIEILVGAGGKMLSPSEVAAQLPSTANAEAPAIVDRMLRLLASHNVVSCEVEEGKDGRLARRYGTAPVCKWLSPDEDGVSLAPMVLLNDKVMLESWYHLKDTVLNGGLPFEKAYGMTAFDYQGTDPRFNRVFNEAMKTHSMIITKKLLEFYKGFDGVGTLVDVGGGVGATIHTILCRYPSIEGVNFDLPHVISEAPSFAGVHHIGGDMFKKVPSGDAILMKWILHDWNDEHCTTLLSNCYDALPAHGKVVIVEYILPVKPDETATAQRSFEADMIMLTHTPGGKERYLREYEELARSAGFASVKATYVYSNIWVIELNK

SEQ ID NO: 314 - protein, 493 aa, Aegilops tauschii
MFPVTGSPKCVAFRSKHTRKYLGSVHVGSEESAVGGGRFFEELSDGADDVDVLASPYTRFYLEPSKEHDGLLHVRCCHNNKYWVAKHGGEGSGHWIIGIVNEPNDDLSKPSCTLFEPVPLTDGDNNLSIRFFRPQQTTSSESEMVMEKETAEEAYLRLGTGGHEKTVDQVKSLHDFSAIDLSKQLVLPKYVAFKGDNDMYLRARIIQKYNYLEFSSSDIADSTVVNTIFPNYANGNVRIKSNHFNRFWRLSPNWIWADSADSSSRDRDTLFRVVMLPDYIGLQNLGNSRYCKRLTADRKTSCLNAAVDTITLEARLRVEEAVLSREIYGVEFKLSEARIYGEKPITFPSMTSTNDTNEPHAKTLTLKYEETQAKTWSSTVSLKIGVTAKLRAGIPVIAEGKVEVSTEFNSEYEWGSSVHTTASQEASYHAVVPPMTKVTVRAAVTQGSVDVPFSYTQRDILTTGEVVTYKMDDGLFTGMNNYNFQFEATQEPI

SEQ ID NO: 315 - protein, 362 aa, Aegilops tauschii
  Sequence also found in Organisms: Triticum aestivum
MAEEGNSAGSGGRGVRVCVTGGAGFIGSWLVRKLLQAGYTVHATLRSIGDEGKVGLLRRLVPGAAPPERLVLFEADLFDAASFAPAIAGCQFVFLVANPSAHEAAASKYKTSAEAATDGVRIILRLCAESMTVKRVIHTASVTAASPLTKSSSAAAAVYSDFISESCWTLLDVDYPLRSVHFDKYIESKVLSEKELLSYNDGESPAFEVVTLSLGLVGGDTVLSHLPETVESMVAPVTKQEPYFMLPRILQRLLGSLPLVHVDDVCSALIFCIEQPALSGRFLCAAAYPTIHDILDHYSSKYPHLDLLREADEVARVQPEKNKLVELGFRYKYGVEEILDESIDCAVRLGSLDASKLIVQQE

SEQ ID NO: 316 - protein, 442 aa, Aegilops tauschii
MDIDMEGGSQPQPQGASLSPAPFLIKTYEMVEDPATNRVVSWGPGGASFVVWNPPDFSRDLLPKYFKHNNFSSFIRQLNTYGFRKIDPERWEFANDDFIRGHMHLLKNIHRRKPVHSHSPQTQVNGPLAEAERREYEEDISRLKHENSVLVAELQRQARQQCGLSWLMQSLEDRLMAMERRQADVVASVRDTLQRRRGGVHPGQQTMLELEPTDHFSKKRRVPRLGFFVEEHSAAAAEEQRVPHLRAMGGETPGMVMVNAEPFEKMELALVSMEKLVQRAGDYASSEDMYNAAAAAPSTDDPAHADLQAAPVNLQPSSPEIAESPGYAVQSPMLLFPEIHEDKHKTMAEVDMSSEASTTDTSQDETTAEAEAETGVPHEPAVANDLFWERFLTDTPKPLAVEDSHESKDDVKTGLDCYWFGHRNNVEQITEQMGHLASAQKT

SEQ ID NO: 317 - protein, 474 aa, Aegilops tauschii
METMSYPCSPLLSLPTHEESNFFMWSPQVALHENATIHVDHPTDQQPDNVFLDTAVQDYANDWHQQDASDVGVFTYCDERIQGQESGNLVAIQEELMEENSVTDLLLTGAEAVEAGDPRFALAVFSRLDGLLLGSPENAAAGSFDRLAYHFAQGLRSRISSASTSCSLPEPLPSDRMSVQHIIQELSPFAKFAHFTANQAILDATKGDTHVHIVDLNIGEGIQWPSLMSDLARHGGMSFHLTAVTADADYSDGVHHASALRLSEFADSLNLPFQYSSLCLHSDEDLHEFSKNCKGSVILSCDTTSMPYKLLSKLPALLPACVKLLQPKLMVIVEEELVRVGKEASLCKASFVDFFFEALHHFTTVFESLASCFFGGNQGACLRLVEREMVGPRIQDFVGQYGSVTVEVTTPVVLERYGACDLSGCNVAQARMLVGLFNRGFEVVHEKGRLVLCWKSRPLTSVSVWAPILKERSS

SEQ ID NO: 318 - protein, 434 aa, Aegilops tauschii
MEVKVLGSKLVKPAYNAGAAPAPSTEYIPLSIFDKVTFNMQMAIIYAFAAPAPSTAAIENGLATVLAQYRAFAGQLGEAPDGTPSFILNDRGARLVEATVDAVLIDMAPAKPTPELLKLHPDLEAEHEEVVLLQLTRFRCGSLAVGFTSNHVVADGHATSNFLIAWGRGTRGLPMGLPPVHHHKDLFKPRSSPRVEHDHRNREYYLPSPTDVVGHHSDAADNIVIHKAHFTKDFIAGLRAKASEGRGRPFSRFETILAHLWRTMTRARDLSPEETTKIRLSVDGRHRLGQPAEYFGNMVLWAFPRSTVGDLLNRPLKHAAQVIHDEVAKVDGAYFQSFVDFASSGAAEKEGLARSAVCKDAQCPDVEVDSWLTFPFYELDFGTGSPSYFMPAYFPTEGMLFLVPSNFGDGSVDAFVPLFQENLQAFKECCYSME

SEQ ID NO: 319 - protein, 246 aa, Aegilops tauschii
MEQLRISLIDHTMASSSPSSTVIQMPPTPRTNGSQPTAPTTPKDVDDVPTTEPAPAAGPAATATDKVMSSAANLAQLLPTGTVLAYQALSPSFTNHGKCFSSNQWLTAALVIVLTISCVLFSFTDSLLGRDQKLYYGIATPRGFNVFNFSDEEEKLQWTPAEFRKLRIRPLDFVRAVFTALVFLTVAFSDVGLQNCFFPGAGRNTEELLKNLPLGIAFLSSFVFMIFPTKRKGIGYSDTTPREKLT

SEQ ID NO: 320 - protein, 106 aa, Aegilops tauschii
MKSSTLMVIMVLQATLVMGIFILPDMCNGDVHATSVGEGKAIDLNLGKLRCCSNCNSSSGLYTCEDVVKICDPVCKRCAVVKKNLVKEFRCTDTFLGLCENPCKNH

SEQ ID NO: 321 - protein, 485 aa, Aegilops tauschii
MASYDKAMESYKKAVTTAASLAASAMLVRGVVNELVPYEVRDLLFSGMGYLRSHMSSQHTIIIEETEGWANNQLYDAARAYLATRINTDMQRLRVSRVDETKSMMFSMEEGEEMADVHEGTEFKWRLVCRDNPSASSSNTNGRGGSGNFKLEVRSFEMSFHRKHKDKALTSYLPHILAVAKKIKEQNRTLKIYMNEGESWFAIDLHHPSTFSTLAMDHKLKQSVMDDLERFVKRKEYYKKIGKAWKRGYLLYGPPGTGKSSMIAAMANYLKFDVYDLELTEVNWNSTLRRLLIGMTNRSILVIEDIDCTVELQQREEGQEGTKSNPSEDKVTLSGLLNFVDGLWSTSGEERIIIFTTNYKERLDPALLRPGRMDMHIHMGYCCPESFRILASNYHSIDHHATYPEIEELIKEVMVTPAEVAEVLMRNEETDVALKGLIQFLKRKKDGAGKPENVDQVAKEEEQEKEMMTKSDVPDNEDQQDGSKE

SEQ ID NO: 322 - protein, 351 aa, Aegilops tauschii
MADHGDEMTTNKKVVLRRYVTGYPTAEDMEVVVPSHVRLRVPEGSTAAVVVKNLYLSCDPWMRGRMSKHDDGDAVPAEDFVLGEALVNFTVGEVLDSTHPEFDAGDLVWGMSAWEEYTLITQTEGLFKINHPELPLSHYTGVLGLAGLTAYAGLFEVGKPKQGESVFVSAASGAVGQIVGQLAKIAGCYVVGSAGSDEKVNLLKSKMGFDDAFNYKLEGDDLGAALGRRLPGGISVYFDSVGGATLDAALLRMRPGGRVVACGMISQYNLLEHQGVRNLWCIIPKRVRVEGFSCMDYHHLYPRFEEEMAGYIKAGKVTVVEDVVRGIERAPEALLGLFSGRNVGKLLVALA

SEQ ID NO: 323 - protein, 100 aa, Aegilops tauschii
MPDCLIKASGSRGSMAMERFFTALVFCEAPLDGYGTSVLTAGTVKRLVSGGGHATKPAVANKPDSEKAQGYFTGKPTAQRRPGFELAFDGLNCFDTIVMH

SEQ ID NO: 324 - protein, 215 aa, Aegilops tauschii
MAADTTATQTPLSISIQQHQPSTSSALHSAFQFQFQPQSMAAMKIALLAVAAMAVLLGTASAVTYNVGDQGGWTLSTDYSSWVSGKKFNVGDEIVFKYSTPTHDVVEVSKAGYDSCSIDGAINTLASGNDVITLNATGTRYFICGVPNHCSPTAAASMKVVINVASGSSSPSSPMPAAGPGASNSPPAPPSNAATSVGATAGFGLVALLAAGLMA

SEQ ID NO: 325 - protein, 224 aa, Aegilops tauschii
MASTGVSRRSSIMASRLSASAEAMRASEGGKQRHAVLARRVEYDEESLAGEPQYDVFINHRGVDTKRTVARLLYDRLAQSGIRGFLDNMSMRPGDRLRETISAGISECSVAVAIFSPSYFDSEYCLWELATLVESRKTIIPIFYNIKPSDLVLPEALAASDDYLPQDVERYKYALREAKNTVGLTYDSATGDIAELVSAAADAVLYHMEKMVRVQRRETIVSRL

SEQ ID NO: 326 - protein, 910 aa, Aegilops tauschii
MELLGRSLLQAGSASTAAPRGGRERAGGGLCFASLGGRPSRRTVRSKAPVGALAERVVLTPAPAERVARPEAHPQSVAARAVVTVRRKRKVEVKEQVAEQMDAYADRVGRSVLLELISTETDPRKGGPKKSRKSRLVGWFEKRDVKAELVVYTAEFTVDAAFGEPGAVTVLNRHQREFFIESILVEGFPSGPAHFTCNSWVQPTRVDPAPRVFFTNKPYLPSKTPPGLRELRRRELKELRGSGTGVRKTTDRAYDYDVYNDLGNPDKGAGFERPVLGGDKLPYPRRMRTARPSTVTDEGAESRVEYPEPIYVSRDEEFEEGKNEMLSEGAIKALLHNFMPLLVSSVSPDSRDFAGFHDVDNLFKEGLRLKQALHDQLFQKIPFVRKIQENSEGLLRYDTPDIIKKDKFAWLRDDEFARQALAGINPVNIERLQVFPPVSRLDPAVYGPPESAITEEHIIGNLDGMSVQQALEENKLYMLDYHDIFMPFLDRINSLDGRKAYGTRTLFFLTAGGTLKPIAIELCLPPMTDDCKRAKRVFTPPADATSIWLWQLAKAHVCSNDAGVHQLINHWLRTHACMEPFIIAAHRQMSAMHPIFKLLKPHMRYTLKINALARQILINGDGVIESGFTPGRYCMEMSSFAYDNLWRLDQEGLPADLIRRGMAVEDASQPHGLRLLIEDYPYATDGLLLWSAIARWCEAYVAAYYPSDEAVQDDYELQSWYTEAVQVGHPDKCDAPWWPRLTTAGDLASLLTTLVWLCSAQHAALNFGQYPLGGYIPNRPPLMRRLVPAEGDPEYEHLVADPHRFYLSALPSLTQTTTFMTVIDTLSTHSADEQYLGERPNEEWTADPAALAAAQEFAAEVRRAEEEIERRNADPARRNRCGAGVLPYELMAPSSGPGITCRGVPNSVTI

SEQ ID NO: 327 - protein, 82 aa, Aegilops tauschii
MAAVRRMRPALLVIVAALMLLAVLGEARPLGGADWAAAGGTPLPAAGGASTVVQALRRLYMQQLGSGPGPSCGTNSPNVHCP

SEQ ID NO: 328 - protein, 478 aa, Aegilops tauschii
MPSRSPSPSPMVRVVSSSTVKPPPRPRERIPLTSWDASMLSSNYIQKGLLFHRPTSCSPVNATDHLAAALGEALVPYYPIAGRFATEQHRDELTGAVVGCSVHVDCDGQGVEVVHAVADGVTMADVLPRDADVPRGVLAHFFQLTDAVNYGGQEQPLFAVQVTHLADGVFVGFAYNHALSDGTAFWDFVNYWAALARARLGLAAAPPAAKPSFERWSPDGGPAGPAVLPCADVSELIERAPPLQLRERMLHFSAESLAALKERAREELLAAGDTAGAAALTKFQALSSLLWRCITRARRLSPEQETTCRAAINNRGRLRPQLPQEYFGNTIYAIGTEATRAADVLNRGHGWAAAAVGRAVAAHTDASIRARVAAWTAKPMVYTHRFFDPTGTMMGSSPRFDMYGCDFGWGSPVAARSGLANKFDGKTSLYPGREGGGSIDAELTLSPDNMAALEEDDEFWAAVTPDAPVPAAPEKKAI

SEQ ID NO: 329 - protein, 1110 aa, Aegilops tauschii
MSPLLLRFLCLLLLAGEAALTGAQSGGDKEVLVELKRFLVANNRFNRGDYDGWQESDLSPCQWKGVGCDRGSRVASLNLAGSTISGQVFGNFSRLSALTSLDLSGNSINGPLPAADLNQCRGLLHLNLSHNLITGPLNLSGLTRLQTLDVSGNRLEGGVAVNFPAICADLNLLDLSTNNLTGNITGLFDGCVRLDKVDLSSNNFTGELWPGIAKFREFSAAENNLTGSVPWSTFPDGCRLQSLDLSDNQLVGGFPDSVANCTNLTYMSLWGNNFTGIIPAGIGKLAVLETLILGNNKFDRKIPPELTNCGRLQFLDMSTNNFGGDVQQIFGNFTSLKYLVLHHNNYTGGIVASGVPRLPLLARLDLSFNQFTGELPPEVANMKSLKYLMLAENNFSGTIPPVYGCLAELQALDLSNNTLTGGIPASIGNLTSLLWLMLAGNQLSGEIPPEIGNCTSLLWLNLADNRLTGKIPPEMAEIGRNPGPTFAKNRNDTSVLAGSGECQAMKRWIPASYPPFSFVYSVMTRENCRSIWDRILKGYGIVPICTNSSSPARSNTVSGYVQLSGNLLSGEIPSQIGAMRSLSLLHLDGNRLTGQLPPEIGRLPLVMLNVSRNNLSGPIPSEIGDILCIERMDLSFNNLSGELPASLFKLTELSMFNVSYNPLLSGNVSTTGQFGTFDEQSFLGNPLISLHQGGAAGKQQPPPEAADAPAVRTRSIPRTIVMWLLFSLVIAFIAATVVFAVTSLRARFPVDQEPEPDPFSCEHPKGKCAFGMSSSPPSWSSSATGCSSSTEGVKVFRLDKTAFTYRDIVAATGNFSDDRVIGRGGSGVVYRGVLPDGRAVAVKKLSRPRDGVDGDGEREFRAEMEVLADRMGFTWPHPNLVTLYGWCLSGGAKILVYERLDGGSLEALICDTGAFGRAARLDAAVGVARALAFLHHECVPAVVHRDVKASNVLLDGDGRAKVTDFGLARVVRPGDTHVSTMVAGTVGYVAPEYAQTWRATTKGDVYSYGVLLMELATARRAVDGGEECLVDWARRTAKEGRKQQTEDQQTTGTVFWELLELGMRCTADAPHERPDMPVVLAALLDIAGDVGCAYCKSSGHSDGEQTSSLT

SEQ ID NO: 330 - protein, 901 aa, Aegilops tauschii
MAPSPIPLLLLLLLAVAALCPLAAAQQRNVQTRFPSTRTPAVAAPPPPIVPPSPSPTGPAILPPQSASSSSSSSTKRSDIAVAVVSTALSSFALCGLAFFLFLRHGKKKELTHVGGNGHSNRPQDAALAGKLPERAPKRPPRGGMVDENGLDAIYWREFEKEGEGGGRGRKPAGGWRPPQPPPRQSRAERWPEAQASPAPSPPRPRKGKIDQEPLIPRGSLDSSSAVFDESPRPPSASSSSSFSVAAPEAYARPPPPAIAVPRPSPPPAPAAPPSASASASASLARPPGRGSPPPPPPPMATTSPPPKGPPPPPAPKGPPPPPAPKGPPPPPAPRGPPPPPPPGGKKGGPPPPPPPGGKKGGPPPPPAWASSSRPPAAPGGPSGADDLAKLKPLHWDKVNVAATDHSMVWDKLTGGSFNLDEGTIEALFGTAAVNRKTKSADAKDSSSGLGRSTSEEQIFLIEPRKSHNISIILRSLTVGRDEIIDALRDGNTELGTDVLEKLSRLSISKEEEATILKFSGNPDRLAPAEAFLLRLLLDVPNPFARVNALLFKVNYGSEIAVLKQSLQTLEMASQELRTKGLFFKLLEAVLKAGNRMNAGTARGNAQAFNLTALRKLNDVKSTDGGTTLLHFVIEEVVRAEGKRLAVNRNYTIRRSGSLAKSSVDGGISAAGSAGQGPSREDRQNEYLNLGLPIVGGLSSEFANVKKAATVDYDVTANECTILGNRLAGIKKLLETCGDDGFSRGLRGFVNAAEQEMKALSGVQEKVLDLVQRTTEYYHAGATKDRNAHPLQLFVIVRDFLGMVDQACVDIKRRLQQQKKPTPPSSQPTTAAAAKGPAEAAKGAPDGAKAVAGGAAAAPPAQKPPPEEADSKRKRVMPRFPNLPAHFMKDGADSDSSSDEE

SEQ ID NO: 331 - protein, 486 aa, Aegilops tauschii
MNLTLSLGVNGGAAAAKKRKVMDGVGDVGVLGAGDGGDRATVMRLLQARDRMVKVELDHDDGDVSDRGASPLMRLLLSSAAAGEVGDMHAAAVALQEVYRHASFRGGDPAQRVASYFADALASRLLLPPPAKAKTTTTTREEQFLAFTMFYQASPFYQFAHFTANQAIVEAFEAGGRRRLHVVDFDVSFGFQWPSLMQSLSDAATTSSSLSSQDDSGDCCDEPVSLRITGFGASADKLRDTEARLARFADGCPNLRFEFEGVVNNVNNGPEEGRHERITTDPAATVVVNLVFPAAQNVRQSSWDPRSASAHIRSLNPSLVFLIDKVDEGNGGVKGAGRCGSASLLPRFAANLRYYAAVFESLHECLPADSAERIAIERDHLGVEISDAMASLDRRRHDGDRAADKVSRGWKERLESAGFEDARLSSRTVSQAKLLLKMKSGGCGGGGFRVMEAGDGKAMALGWRDRALITASAWRPCRPSVGKNEP

SEQ ID NO: 332 - protein, 571 aa, Aegilops tauschii
MDAMERGQSSPRLPKIRGSKIDEESLRVPLIESKKAGSRAPAVVLGFECLESTAFNGVATNLVLYLESVLHGSGLASASNVTTWIGTSFLTPVLGAILADTFWGNYNTILVSLVVYLLGMMLITFSALLPTTELCGLGSSCHPMFGAHTVAFSGLYLVAFGSGGVRAALLPFGAEQFDDDNAVDRERKMAFFSWFYICVDFGMIVSGLFLVWIQQNVSWGLGFGIATACIALAFVGFVLFTPMYKRSMPTGSPFKSLCQVVVAACRKVTLRVPADAAVLYEVSDKIDQPRIAHTKEFTFLDKAAVVADSDLEEVTNVDAAAAAAGSWRLCTVTQVEELKILMRLLPIWATSIVLSAAYAQLNTTFVQQGSAMDMRVMSFTIPAASMVSFEVICVLAWVLIYGSVIVPALRRLSPASGEPSQLRRMGAGRLLMAFAMAVAALVEMRRLEAAGSGESISIGWQMPQYFVLAGGEVFCYIAQLEFFYSEAPESMKSMCTSFALLTVALGSYASSLIYAVVNALTATGGRPGWISDDLNEGHLDYFFWTMAALCTLNFVVYSAFARNYQVKTVVS

SEQ ID NO: 333 - protein, 334 aa, Aegilops tauschii
MASSLPPHVVEDVPPFLQLLSDGTVIRFTDGYPLPIPSPPPGQPVVDWKDVVYDASHGLKLRIYRPAAASSSGNKLPVIVYFHGGGYSIGSFDMPNFHACCVRLAGELPAVVLSADYRLAPEHRFPAGLDDAANVVSWVRAQAAAVGDNADPWLWETADFGRVFVAGDSAGGGIVHHTAVRLGSGRLGPLDPVRVAGCAMLCPMFGGEERTASEAEFPPGPFLSLPAVDQAWRLVLPPGSTRDHPLANPFGPDSPALDGVALPPMLVVAAAHDLLRDRAADYAARLKAMGKPVELVEFEGQHHGFFAVEPYGNAGSEVVRLVKRFVYGNGGASD

SEQ ID NO: 334 - protein, 922 aa, Aegilops tauschii
MAEEKAVGAPALDTNIETGGFDEKRGQAPATHNPKAPVAEDEEPDEDMDALIEDLESEDGHEIDDDEEATPGGGRVVPEDQLQTDSRVGLTEAEVIARRKKWGLNAMKEEQENMILKFLMFFVGPIQFVMEAAAVLAAGLEDWIDFGVICALLLLNACVGFIQEYQAGSIVEELKKTLALKAVVLRDGTLKEIEAPEVVPGDILQVEEGTIIPADGRFVTEGCFCQVDQSAITGESLAVDKHHGDNCYASSAVKRGEAFVIVTATGDNTFVGRAAALVSQSAGGTGHFTEVLNGIGTILLVLVVATLLIVWVSSFYRSNGIVDILRFTLAITIVGVPVGLPAVVTTTMAVGAAYLAKKQAIVQKLSAIESLAGVEILCSDKTGTLTKNKLSLAEPFCVAGVEPDDLMLTACLAASRKKKGIDAIDKAFLKALKFYPRAKGVLSKYKVLDFHPFDPVSKKVQAVVESPQGERIICVKGAPLFVLKTVEEDHPIPEEVDSAYKNCVAEFATRGFRSLGVARKRGEGAWEILGIMPCSDPPRHDTARTINEAKRLGLSIKMLTGDAVGIARETSRQLGLGTNVYNAERLGLGGGGDMPGSEVYDFVEAADGFAEVFPQHKYNVVEILQQRGYLVAMTGDGVNDAPSLKKADTGIAVEGASDAARSASDIVFLAPGLGAIIDALKTSRQIFHRMYAYVVYRIALSLHMEIFLGLWIAILNKSLNIELVVFIAIFADIATLAIAYDNAPFSQTPVKWNLPKLWGMSVLLGVVLAVGTWIALTTMYANSEDGGIVQNFGKIDEVLFLEISLTENWLIFITRANGPFWSSIPSWQLSGAILIVDILATLFCIFGWFVGGQTSIVAVVRIWIFSFGVFCVMGGLYYFMQGSTGFDNLMHGKSPKQNQKQRSLEDFVVSLQRVSTQHEKSQ

SEQ ID NO: 335 - protein, 409 aa, Aegilops tauschii
MGNFCVCMGGSAKCASASTPFQSKVNPRSSTSNSNSKASRRSSSGPDKPPQPAEAPTAAGEAQAVPPASLKSFSMADLRAATKNFGSTSYLGEGGFGCVYKGWIDETTLAPARPGATNAMMVAIKKLKKESFQGHREWLTEVTYLGDLHHDNLVKLVGYCSDSDSNKLLVYEYMPRGSLENHLFRRGSQPPLPWSTRVSVAVDVARGLAFLHSRDVIFRDLKSSNVLLGPDHRAKLSDFGLARAGPTGGKTHVSTRVVGTRGYAAPEYVATGHLSAKSDVYGFGVVLLELMTGRRALDEARGVASELLVDWAMPMLQGERRKVIRVMDTRLGGQYPKRQAQDMAALALRCLQNDPKSRPSMADDVLPSLELLLQPSAAKSFSSSSTTTTSRSPAASAALVHRGHRRNKA

SEQ ID NO: 336 - protein, 351 aa, Aegilops tauschii
MWPMEEEFFVAVKRTEHVEVTSRSVAASAMGKEGFGGGEQPKMVRVFCDDFDATDSSSDEEEGERRRVKRYVQEIRLQPAVQVKVEESAPVAKAASATATTRPRVMVPVRKRKAEAGGERRFRGVRRRPWGKYAAEIRDPWRRVRVWLGTFDTAEEAAKVYDSAAIKLRGPDATVNFQQSEDGEDMEVPAEVAERLPQPPAGSKNASSSATSYDSCEESHVAAASPTSVLRSFPQSTLGAAVDDDSSKKPSSSSSTAGTDESSGVFGCSFSGDDFAGELAPLYSDFDLLSDFAEPPMDFLSNLPEPAFAFSSDCSSSAYNPCPPSPAALQQADAFFEDITDLFQIDPLPVI

SEQ ID NO: 337 - protein, 249 aa, Setaria italica
MGRAPCCEKMGLKRGPWTPEEDRILVAHIERHGHSNWRALPKQAGLLRCGKSCRLRWINYLRPDIKRGNFTREEEDAIIHLHTVLGNRWSAIAARLPGRTDNEIKNVWHTYLKKRLEPKPATQQAPRRKSKKQQQQQPAEIVMLDGPASAVPVSSPEQSLSTSTTSSTDYSAASSVENNADSSFTSEEDYQIEDSFWSETLAMTVDSSDSFGMEREDACVEAAPSANDDMDFWLKLFMQASDMQNLSQI

SEQ ID NO: 338 - protein, 311 aa, Setaria italica
MDAAAAAAEIYRLPEECVAYAISLTTPGDACHSSAVSPAFRTAADSDAVWARFLPPDHAAVLARADEPVECESKKELFSRLCDTPVLLDGATMSFGLERRSGAKCFMLSARALSIAWGDDPTCWIWTASLPGSRFPEVAELVDVCWLEISGKLSLSLLSPGTTYAAYLVFAIADDSYGLECHVGMLPPKATVTVVSGTSGKPAATSTEHAICLQHMQGEEEVAVHRRKQQYMRLRKGYGRKMVTREADPDIRCPRRRGDGWVEVELGEFAVATGDGEDGGVVEVRLEEVDSRRWKRGLIVQGIEIRPKHAC

SEQ ID NO: 339 - protein, 778 aa, Setaria italica
MSALTAAAAPTVTTFLRARTARTWVQPALPQRSPHRPCERILAIANGKGTGAVTTCEPSERLKDEPRNVSEKIDAIRAKLKSISDGNINVSAYDTAWVALVKRLDGGGGPQFPTSIDWITKNQLPDGSWGDDTFFMVHDRIINTLACIVALKSWNIHHYQCQRGLSFIHGNLWRLTEEDAEWMPVGFEITLPTLLEMAKDLGLDLPYDEPALQEIYSRRELKLSKIPIDALHAGPTTLLLSIEGMPGLDWERLLTLQCPDGSFMSSPAPTAYALMQTGDRKCLQFLEEIVDNFKEGVPFTYPVDIFERLWVVDRLERLGISRYFTSEIQECLDYVYRHLTQKGLAATRDCPVNDIDDTAMGFRLLRLHGYYVSPSMFKHFEKDGEFVCYHGQTNKSITAMYNTYRAAQVSFPGESELERADVYCRGFLEEKRASGNFGDKWVIPKDLAGEVGYALDFPWRASLPRIEARMYLEQYGGSADVWIGKVLYRMPLVSNELFLETAREDFRSFQKLCRLEWNGLRKWYDRNKLAAFGVEPKCVLRAYFQAAASIFEPDRAAERLAWARTAVIAEAVSLHLRGKASDVSTRVHGAISELENHGRDALTRVNEDPKKALLGAIGELIDQSSSENASHCLREAWKQWLRSWTAKEGFESCGGNTALLIVRTVEIASGRYSLKEHDVNRSEYTQLERLTSSICSKLTSRVPVQNGGLKKSENSVSQVDLEMKELAQSVLQSCDSIDRVTRQTFLHVAKSYYYASYCSTETIDSHISKVLFEDVVSE

SEQ ID NO: 340 - protein, 412 aa, Setaria italica
MGRAPAPANVHEICRARRADGPAAVLAIGTANPGNCVLQEDFPDFYFRATKSEHLTGLKEKFKRVCQKLGVQRRYLHHTEELLSAHPEFLDHIFSPSLDERLDIVKTAVPELAAEASRKAIAEWGRPAADITHLVVTTNSGAHIPGVDFQLVPLLGLRPTVRRTMLYLNGCFAGAAALRVAKDLAENNRGARVLVVCAELTVLMFTRPAEGPFQFQTLINQGLFGDGAGAVIVGADPVATPAERPLFEIVSAAQNIIPESEDAVSMHLTKGGFGGNISARQVPTLIGDNIERCLLDAFEPLGIGAGWNDLFWDVHPGSSAILDQIDAVLQLKPEKMAASRRVLSDYGNMFGVTVIFVLDELRRRMEKGEEEGAPEWGVMVAFGPGLTVETMVLHRCVAQATGATAEEKLTVA

SEQ ID NO: 341 - protein, 517 aa, Setaria italica
MVMMPASPASPRARQSVVAELEGGLLRCADTFPYFMLVAFEASGLPRFAALLALWPLLRLLELAGRGGLALRAAALVATAGVPRAEVEAVSRGVLPKFMADDVDPAAWAAFGSCEGRRVVVATRLPRVMVERFAKEHLGAHEVVGCELEYSRLRRCTGLLRGGGDEAVAGRVRTLFAGGNRPDLGIGRSEMARSFLPFCKEQLKPPFAAGGAATTDAPPFRPVIFHDGRLVCRPTPFMSLVILLWLPLGALVAFVRIAVGLMVPIWTIPHIAPIFGGAIITHGRAPAPVRAARDDDGGGSPSGVLFVCTHRTLMDPVVLATVLGRRVAAVTYSISRLSEVLSPIPTVRLTRDRDVDAARMRAELARGDVAVCPEGTTCREPFLLRFSALFAELSDRIVPVAMNYRVGLFHPTTARGWKAMDPIFFFMNPRPVYEVTFLNQLPAEATCAAGKSPVDVANYVQRILAATLGFECTSLTRKDKYRVLAGNDGIVNAAKPAAPGKAAWQGRIKEVLGFLLH

SEQ ID NO: 342 - protein, 358 aa, Setaria italica
MRDMGEKRRHGGHHVHGVGFGVGHAEHDEKHREPKKLDMSGMSMDTIPHLSMPLGNITTLDLSNNNLQRIPESIIARLLNVVVLDVRSNQLKSLPNSIGCLSKLKVLNVSGNLLQDLPATIEECRALEELNANFNQLTRLPDTLGFELHSLRRLSVNSNKLAYLPSSTDHMTALRSLDARLNCLRSLPDGLENLGSLETLNVSQNFQYLRELPYGIGLLVSLRELDVSYNSISALPDSMGCLTKLARFSAVGNPLVCPPMDVVEQSLDAMRAYLSARMNGTDKDRRKKRSWVPKLVKYGTFTAGMMTPGRATKVHGNAEGLLMSDYRSLNGGGIASPGFLSMLSPRRIFSPRRNSTKH

SEQ ID NO: 343 - protein, 259 aa, Setaria italica
MASRAFAALLTVVAFVGFASVPRALATDPTQLQDFCVADNNNQVLVNGVVCKNAKVVTANDFFFHIMPQTPNAQGSGVAAVAVDKLPGLNTLGISLARIDFVPGGQNPPHTHPRGSEILTVIQGTLLVGFVTSNQLLNNTLFTKQLVEGDVFVFPQGLIHFQLNNGKSPAVAIAALSSQNPGTITIANAVFGSKPPISDLILAKAFMLEKDTVDWVQQAFGAAAVGGGGGMPGGGGYPGGGYPGGNGTGGGYPGGPGYP

SEQ ID NO: 344 - protein, 676 aa, Setaria italica
MEHPQQHVVQVGRPPSRGSSSDDAARLVGMCPALYRAANRGRTEEVMALLLQQHAAGAAAKDRQATGIIQHGQCDILEVSAEGNTVIHVAAEQGHHELIQELYARFNNIKGLLSHQNSALDTPLHCASRAGHVRTVAILIQLAQDYCGESILGCKNKAGDTALHMAARHGHGAATEVLISVAPELAAELNNAGVSPLYLAVMSGSVQALRAIIACRDASAVGPSLQKQNALHAAVFKSSVMVDLLLEWRPALAEQVDGSGSSPLHFASSDGDSDVVRAILRAAPPRTVYKKDSGGLSALFVAARMGHHRVVNEILEWCPDAAELRDDNGGTFVHAAAKEKSDSFAKEKHRHSVVSLAIENPMLRGLLDVQDKDGNTPLHLAVAAGAPRVVDELLRKGKVHADILNNDGRTALDLAAGSTSFFTTVKLVVMLVGFGAQLRPQRQDHLKLWSGHDSIAKDIERTSDSLAVVAVLIATAALAAGFNVPGGYGEKTGEANLEDRLVFKGFLVLDISAVAASVVAVILLVYGKASRSAGSWKSFAAALQCMWASLICLMLAFYAVLDAVTTTKAVYRYGFPVIFACIVVLSIFIMSRIEPVRTSLTVWRFMCHRAKSSRQTGWRFMCQQRCHLKGWHAVQRQFPLAGAYVLNLCLFTATYVLIGIVGFVGISWLEQLQRMF

SEQ ID NO: 345 - protein, 586 aa, Setaria italica
MGKISMAASILWLALVALAVVGEAAIVEHTFVVHEMNMTHLCNSTKVYVVNGQLPGPQLDVVDGDTVVVHLVNELPHGVTIHWHGVRQLRSCWADGAGYVTECPVAPGGNRTYRFDVSGQVGTLWWHAHVTCLRASVHGAIVVRPKDGRYPFPTPARDVPIVIGEWWTLDLVELDRRNLDGNFEDDPLSATLNGKLGDLSNCSGVPEESFVLDVEPGKTYLLRFINTALFSEYFFKVAGHTFTVVGADANYLTPFRTDMVTISPGETMDVLMVADAPPGLYHMTAVANQPPPPDLQIRALTSRGLVRYAGVRADNGGAPVPAPLMPGQHDTMPSYYFRGNFTGLAFPSRHRVPAHVDERLFVTLGLGSICRGGKKDCKLRRSNETITVATMNNVSFHHQTAASLLERHYDGTGEGLYTEDFPDRPPRPYNYTNMDLIPVGPLEEVLEPTTKAIRVRRFKYNSSVEIVFQSTALLQSDPNPMHLHGHDFFVLAQGLGNFDPKKDVKKFNYHNPQIRNTVHVPRVGWTAIRFIADNPGMWYLHCHFEFHIVMGMATAFIVEDGPTPETSLPPPPADFKRCGTNGFSKP

SEQ ID NO: 346 - protein, 610 aa, Aegilops tauschii
MAGGEGSSAAGGTGEMRSLALTPTWSVATVLTLLVAASLIVERSIHRLSHWLKKTHRNPLHKAMEKMKEEMMLLGFISLLLAATSRMISGICIDSKYYNSRFSPCNKEEAEESLSTEHDLTRKRNHIIDAILHRSLRRNLKAQSHQVESCHEGFESFVSHEGLEQLHRFIFVMAVTHVTYSCLTMLLAILKVHTWRKWEDEAFRDNHESFSQIAYASATRRQPPALTKSSSFRFWSQNNAVMWVFCFLAQFGQSVVRADYLILRKGFIMNHNLAPTYDFHTYMIRSMEEEFEKIVGVSGVLWGFVVAFMLFNVDGSNLYFWIAILPVALVLLVGAKLQHIIAILTSEGAKLTAFGPRIKPRDDLFWFKKPKFLLWLIHFVLFQNAFELASFFWFWWQFGYESCFIKNHLLVYCRLVLGFAGQFLCSYSTLPVYALVTQMGSKYKAALIPNRIRETMHGWGKDTRKKRKKRRGDDSTIRTETSTVCSLDYEDEDDDGHGHSDDAMTPRLPPYLKIELRPMQGGGGIPTPGMPSHQLPTGGSNWTPGGSSQHALLQRQGSASASAPSSPPPSSHGRGVVRSVSMPGIAAVATIASTIGLSTPPTRLSDDAHA

SEQ ID NO: 347 - protein, 511 aa, Setaria italica
METMLASLVPASGTAAAAAAAGGLVAAAALVAGGGRLVGQKDRLNAPPAVPGLPIIGNLHQLKERKPHQTFARWAQVYGPIYTIRTGASSVAVLNSTEVAKEAMVAKFSSISTRKLSNALSVLTCDKKIVATSDYGDFHKMVKRYVMVSMLGASSQKQFRGIRDMVIDNMLSTFHTLVTDDPKAALNFREVFKNELFRLSLIQALGEDMSSVYVEEFGKTISKEEIYQTTVVDLMMCALAVDWRDFFPYLRWIPNRNFETKVSTTEARRTAVIRALINQQKKRIARGEARVSYLDFLVAQNTLTDEQVTTLVWEAVIEAADTTLVTTEWAMYELCKNQEKQERLFEEIQEVCGYETVTEDDLPRLPYLNAVFHETLRRHPPVSLVPPRFVHENTTLAGYDIPAGTELIINLYGCNMNKNDWDEPEEWKPERFLDGRFEQADMFKTMAFGAGRRACAGATQATNIACTAIARFVQDFAWRLKEGDEDKDDTIQLTTNRLYPLHVYLTPRGRK

SEQ ID NO: 348 - protein, 475 aa, Zea mays
MPSSTMRLLSRRTVTPPPRPRHRIPLTTWDISFLSADYIQKGLLYAKPPFPTDRLLDHLQASLAQALDAYYPVAGRFVTDQHRDANGHVLGCSVSIDCDGQGVDILHAVADGVAVADVIPPDARVPRLVQSLFPLDGAVNHDGHHLPLFAVQVTDLHDGVFLGFAYNHALSDGTALWRFINVWAGIARDSPSPSPAPPPPPLLERWSPDAGPTTPPVVLPYPDLTGLIERLPPPPLCERMLQFSAETLEALKDRARQELLAAGDTAGAAAVTKFQALSSLVWRSVTRARRMPLGQTTFCRAAINNRTRLRPQLPPEYFGNTIYAIATEAVTAGDLLERGHGWATAAVGRAVAAHTDDAIRARVAAWMANPVLYNLRFFDPNGIMMGSSPRFDMYGGCDFGWGPPLAPRSGRANKSDGKASLYPGREGAESIAAELVLTSEHMTLLEQDDEFWAAVSPDRPFPPAALAAQPKSDRH

SEQ ID NO: 349 - protein, 1123 aa, Zea mays
MAEDHGSSRHMSASQKELGDEDARVVRVADAARTNERLDLAGNAVRTAKYSPLTFLPRNLFEQFHRLAYVYFLAIAVLNQLPQLAVFGRGASVMPLAFVLLVTAVKDAYEDWRRHRSDRAENGRLAAVLSPAAPGGAQFVPTEWKHVRVGDVVRVVSDESLPADMVLLATSEPTGVAYVQTLNLDGESNLKTRYAKQETLSTPPERLAGGAVIRSERPNRNIYGFQANLELEGESRRIPLGPSNIVLRGCELKNTPWAVGVVVYAGRETKAMLNNAGAPKKRSRLETHMNRETLFLSAILVVLCSIVAALSGVWLRTHEEELELAQFFHKKDYLHRDKDNDYKNYNYYGIAAQIVFIFLMAVIVFQIMIPISLYISMELVRLGQAYFMIRDTRLYDESSNSRFQCRALNINEDLGQIKCIFSDKTGTLTQNKMEFRCASIDGVDYSDIARQRPPEKGDRIWAPKISVNTDPELVKLIRDGGDTERGTQTREFFLALACCNTIVPMIADGPDPKEKVIDYQGESPDEQALVSAAAAYGFVLVERTSGHIVIDVLGEKLRYDVLGLHEFDSDRKRMSVIIGCPDKSVKLFVKGADSSMFGVIDKTANSDVVQATEKHLHSYSSLGLRTLVIGMRELSQEEFQEWQMAYEKASTALLGRGNQLRNVAANIERNLRLLGATGIDDKLQDGVPEAIEKLREAGIKVWVLTGDKQETAISIGYSCKLLTRDMTQIVINSRSRESCRKSLEDAIAMVNKYQSFSTDPQLRVPLALIIDGNSLVYIFDTDWEEKLFEIAIACDVVLCCRVAPLQKAGIVDLIKKRTSDMTLAIGDGANDVSMIQMADVGIGISGQEGRQAVMASDFAMGQFRFLVPLLLVHGHWNYQRMAYMILYNFYRNATFVFVLFWYVLYTGFTLTTAITEWSSVLYSVIYTAVPTIVVAILDKDLSRRTLLKYPQLYGPGQRDENYNLRLFIFIMIDSVWQSLACFFIPYLAYRKSIIDGSSLGDLWTLSVVILVNIHLAMDVIRWNWITHAAIWGSIAATWICVMIIDSIPIMPGFWAIYKVMGTGLFWALLLAVTVVGMIPHFAAKAFSEYFIPSDIQIAREMEKSQDFHDVTHPEVQMSTVSRA

SEQ ID NO: 350 - protein, 605 aa, Triticum aestivum
MGTYKCCLVFKRRYRWTDAPPPDDVRALFAVHSGGAATMGADGLRRYLESSDPDAADDAEGEADRLLDQIRLQGHQHQRAGPRLPRLGRGQLLGLDDFHRFLFSADLNPPVRRPQVHHDMSQPLSHYYVYTGHNSYLTGNQLSSDCSDVPIIKALQRGVRVIELDMWPNSAKDDISILHGRTLTTPVSLLKCLKSIKEYAFAASPYPVIITLEDHLTPELQDKVAKMVLEVFGTILYYPEEEHPKELPSPESLKGRVLLSTKPPKEYLEAKDGGAAKDGDAEQNPGKGTDDDAAWGTEVPDFKTEIQSAKEDDASENRRDGDEDDDDEDEQKMQQHLAPQYKRLITIRAGKPKGGTTSDALKCDPNKVRRLSLSEQQLAKAVVNHGTEIVRFTQRNLLRIYPKGTRVTSSNYNPFIGWVHGAQMVAFNMQGYGRALWLMHGFYKANGGCGYVKKPDFLMQSEPEVFDPKKPQPVKKTLKVKVYMGDGWRMDFKQTHFDQYSPPDFYARVGIAGVPADSVMKKTKAVEDNWVPVWGEEFSFDLTVPELALLRVEAHEYDMSEKDDFAGQTVLPVSELQPGIRAVALFDRKGNKLPNVKLLMRFEFV

SEQ ID NO: 351 - protein, 493 aa, Aegilops tauschii
MFPVTGSPKCVAFRSKHTRKYLGSVHVGSEESAVGGGRFFEELSDGADDVDVLASPYTRFYLEPSREHDGLLHVRCCHNNKYWVAKHGGEGSGHWIIGIVNEPNDDLSKPSCTLFEPVPLTDGDNNLSIRFFRPQQTTSSESEMVMEKETAEEAYLRLGTGGHEKTVDQVKSLYDFSAIDLSKQLVLPKYVAFKGDNDMYLRARIIQKYNYLEFSSSDIADSTVVNTIFPNYANGNVRIKSNHFNRFWRLSPNWIWADSADSSNRDRDTLFRVVMLPDYIGLQNLGNSRYCKRLTADRKTSCLNAAVDTITLEARLRVEEAVLSREIYGVEFKLSEARIYGEKPITFPSMTSTNDTNEPHAKTLTLKYEETQAKTWSSTVSLKIGVTAKLRAGIPVIAEGKVEVSTEFNSEYEWGSSIHTTASQEASYQAVVPPMTKVTVRAAVTQGSVDVPFSYTQRDILTTGEVVTYKMDDGLFTGMNNYNFQFEATQEPI

SEQ ID NO: 352 - protein, 439 aa, Aegilops tauschii
MDMDMEGGSQPQPQGASLSPAPFLIKTYEMVEDPATSRVVSWGPGGASFVVWNPPDFSRDLLPKYFKHNNFSSFIRQLNTYGFRKIDPERWEFANDDFVRGHMHLLKNIHRRKPVHSHSPQNQVNGPLAEAERREYEEEISRLKHENSVLVAELQRQAQQQCGLGWLMQSLEDRLMAMERRQADVVASVRDTLQRRRGGVHPGPEAMLELEPTDHFSKKRRVPTIGFFAKEPAAAAEEQRVPHLRATGGETPGMVMVNAEPFEKMELALVSMEKLVQRAGDYASSEDMYNAAAAAPSTDDPAHADLQAAPVNLQPSSPEIAESPGYAVQSPMLLFPEIHEDKHKTTAEVDMSSEASTTDASQDETNAEAETGAPHEPAVANDLFWERFLTDTPKPLAVEDSHESKDDVKTGLDCYWFGHRNNVDQITEQMGHLASAQKT

SEQ ID NO: 353 - protein, 434 aa, Aegilops tauschii
MEVKVLGSKLVKPAYNAGAAPAPSTEYIPLSIFDKVTFNMQMAIIYAFAAPAPSTAAIENGLATVLAQYRAFAGQLGEAPDGTPSFILNDRGARLVEATVDAVLIDMAPAKPTPELLKLHPDLEAEHEEVVLLQLTRFRCGSLAVGFTSNHVVADGHATSNFLIAWGRATRGLPIGLPPVHHHKDLFKPRSSPRVEHDHRNREYYLPSPTDVVGHHGDAADNIVIHKAHFSKDFIAGLRAKASEGRGRPFSRFETILAHLWRTMTRARDLSPEETTKIRLSVDGRHRLGQPAEYFGNMVLWAFPRSTVGDLLNRPLKHAAQVIHDEVAKVDGAYFQSFVDFASSGAAEKEGLARSAVCKDAQCPDVEVDSWLTFPFYELDFGTGSPSYFMPAYFPTEGMLFLVPSNFGDGSVDAFVPLFQENLQAFKECCYSME

SEQ ID NO: 354 - protein, 242 aa, Aegilops tauschii
MEQLRISLINNTMASSSPSSTVIQMPPSPHNNGGIAGPVPATPKDAGDVPTLAPTAATATDKVMSSAANLAQLLPTGTVLAYQALSPSFTNHGKCFSSNQWLTAALVIVLTISCVLFSFTDSVLGRDQKLYYGIATPRGFNVFNFSDEEEKLQWTPAEFRRLRIRPLDFMRAVFTALVFLTVAFSDVGLQNCFFPGAGRNTEELLKNLPLGIAFLSSFVFMIFPTKRKGIGYSDTTPREKLT

SEQ ID NO: 355 - protein, 107 aa, Aegilops tauschii
MKSSALMVIMVLQAALVMGIFILPDMCNGDVHATSVGEGKAIDVNPGKLRCCSNCNSSFSGLYTCDDVVKICDPVCKRCAVVKKILVKEFRCTDTFLGVCENPCKNH

SEQ ID NO: 356 - protein, 485 aa, Aegilops tauschii
MASYDKAMESYKKAVTTAASLAASAMLVRGVVNELVPYEVRDLLFSGMGYLRSHMSSQHTIIIEETEGWANNQLYDVARAYLATRINTDMQRLRVSRVDETKSMMFSMEEGEEMADVHEGTEFKWRLVCRDNSSASSTNANGRGGSGNFKLEVRSFEMSFHRKHKDKALTSYLPHILAVAKKIKEQNRTLKICMNEGESWFAIDLHHPSTFNTLAMDHKLKQSVMDDLERFVKRKEYYKKIGKAWKRGYLLYGPPGTGKSSMIAAMANYLKFDVYDLELTEVNWNSTLRRLLIRMTNQSILVIEDIDCTVELQQREEGQEGTRSNPSEDKVTLSGLLNFIDGLWSTSGEERIIIFTTNYKERLDPALLHPGRMDMHIHMGYCCPESFRILASNYHSIDHHATYPEIEELIKEVMVTPAEVAEVLMRNEEMDVTLEGLIQFLKRKKDGAGKPENVDQVAKEEEQEKEMMTKSDVPDNEDQQDGSKE

SEQ ID NO: 357 - protein, 351 aa, Aegilops tauschii
MADHGDEMTTNKKVVLRRYVTGYPTAEDMEVVVTSHVRLRVPEGSTAAVVVKNLYLSCDPWMRGRMSKHDDGDAVPAEDFVLGEALVNFTVGEVVDSTHPEFDAGDLVWGMSAWEEYTLITQTEGLFKINHPELPLSHYTGVLGLAGLTAYAGLFEVGKPKQGESVFVSAASGAVGQIVGQLAKIAGCYVVGSAGSDEKVNLLKSKMGFDDAFNYKLEGDDLGAALGRRLPGGINVYFDNVGGATLDAALLRMRPGGRVVACGMISQYNLLEHQGVRNLWCIIPKRVRVEGFSCMDYHHLYPRFEEEMAGYIKAGKVTVVEDVVRGIERAPEALLGLFSGRNVGKLLVALA

SEQ ID NO: 358 - protein, 100 aa, Aegilops tauschii
MPDCLIKASGSRGSMAMERFFTALVFCEAPLDGYGTSVLTAGTINRRVSGGGHATKPAVANKPDSEKAQGYFTGKPTAQRRPGFELAFDGLNCFDTIVMH

SEQ ID NO: 359 - protein, 213 aa, Aegilops tauschii
MAADTTATQTPLSISIQQHLPSTSSALHSSFRFQPQSMAAMKTTLLAVAAMAVLLGTASAVTYNVGDQGGWTLSTDYSSWVSGKKFNVGDEIVFKYSTPAHDVVEVSKAGYDSCSIDGAINTLASGNDVITLNATGTRYFICGVPNHCSPTAAASMKVVIDVASGSSSPSSPMPAAGPGASNSPPAPPSSAATSVGATAGFGLVALLAAGLMA

SEQ ID NO: 360 - protein, 910 aa, Aegilops tauschii
MELLGRSLLQAGSASTAAPRGGRERAGGGLCFASLGGRPSRRTVRSKAPVGALAERVVLTPAPAERVARPEAHPQSVAARAVVTVRRKRKVEVKEQVAEQMDAYADRVGRSVLLELISTETDPRKGGPKKSRKSRLVGWFEKRDVKAELVVYTAEFTVDAAFGEPGAVTVLNRHQREFFIESILVEGFPSGPAHFTCNSWVQPTRVDPAPRVFFTNKPYLPSKTPPGLRELRRRELKELRGSGTGVRKITDRAYDYDVYNDLGNPDKGAGFERPVLGGDKLPYPRRMRTARPSTVTDEGAESRVEYPEPIYVSRDEEFEEGKNEMLSEGAIKALLHNFMPLLVSSVSPDSRDFAGFHDVDNLFKEGLRLKQALHDQLFQKIPFVRKIQENSEGLLRYDTPDIIKKDKFAWLRDDEFARQALAGINPVNIERLQVFPPVSRLDPAVYGPPESAITEEHIIGNLDGMSVQQALEENKLYMLDYHDIFMPFLDRINSLDGRKAYGTRTLFFLTAGGTLKPIAIELCLPPMTDDCKRAKRVFTPPADATSIWLWQLAKAHVCSNDAGVHQLINHWLRTHACMEPFIIAAHRQMSAMHPIFKLLKPHMRYTLKINALARQILINGDGVIESGFTPGRYCMEMSSFAYDNLWRLDQEGLPADLIRRGMAVEDASQPHGLRLLIEDYPYATDGLLLWSAIARWCEAYVAAYYPSDEAVQDDYELQSWYTEAVQVGHPDKCDAPWWPRLTTAGDLASLLTTLVWLCSAQHAALNFGQYPLGGYIPNRPPLMRRLVPAEGDPEYEHLVADPHRFYLSALPSLTQTTTFMTVIDTLSTHSADEQYLGERPNEEWTADPAALAAAREFASEVRRAEEEIERRNADPARRNRCGAGVLPYELMAPSSGPGITCRGVPNSVTI

SEQ ID NO: 361 - protein, 475 aa, Aegilops tauschii
MPSRSPSMVRVVSSSTVKPPPRPRERIPLTSWDASMFSSNYIQKGLLFHRPTSCSPVNVADHLAAALGDALAHYYPIAGRFATEQHKDDAGNIVGCSVHVDCDGQGVEVVHAVADGVTMADVLPRDADVPRGVLAQFFRLTDAVNYGGQEQPLFAVQITDLADGVFVGFAYNHALSDGTAFWDFVNYWAALARASLGLEAVPPAPKPSFERWSTDGGAAGPAVLPCADVSELIERAPPLQLRERMLHFSAESLAALKERAREKLLAAGDTAGAAALTKFQALSSLLWRCITRARRLSPEQETTCRAAINNRGRLRPQLPQEYFGNTIYAIGTESTRAADLLERGHGWAAAAVGRAVAAHTDASIRARVAAWTARPMVYTHRFFDPTGTMMGSSPRFDMYGCDFGWGSPVAARSGVANKFDGKTSLYPGREGGGSVEAELTLSPENMAALEEDDEFWAAVTPDAPVPAPAPEKKAT

SEQ ID NO: 362 - protein, 1110 aa, Aegilops tauschii
MSPLLLRFLCLLLLAGEAALTGAQSGGDKEVLVELKRFLVANNRFNRGDYDGWQESDPSPCQWKGVGCDRGGRVASLNLAGSTISGQVFGNFSRLSALTSLDLSGNSINGPLPAADLNQCRGLLHLNLSHNLITGPLNLSGLTRLQTLDVSGNRLEGGVAVNFPAICADLNLLDLSTNNLTGNITGLFDGCVRLDKVDLSSNNFTGELWPGIAKFRAFSAAENNLTRSVPWSTFPDGCRLQSLDLSDNQLVGGFPDSVANCTNLTYMSLWGNNFTGIIPAGIGKLAVLETLILGNNKFDRKIPPELTNCGRLQFLDMSTNNFGGDVQQIFGNFTSLKYLVLHHNNYTGGIVASGVLRLPLLARLDLSFNQFTGELPPEVANMKSLKYLMLAENNFSGTIPPVYGRLAELQALDLSNNTLTGGIPASIGNLTSLLWLMLAGNQLSGEIPPEIGNCTSLLWLNLADNRLTGKIPPEMAEIGRNPGPTFAKNRNDTSVLAGSGECQAMKRWIPASYPPFSFVYSVMTRENCRSIWDRILKGYGIVPICTNSSSPARSNTVSGYVQLSGNLLSGEIPSQIGAMRSLSLLHLDGNRLTGQLPPEIGRLPLVMLNVSRNNLSGPIPSEIGDILCIERMDLSFNNLSGELPASLFKLTELSMFNVSYNPLLSGNVSTTGQFGTFDEQSFLGNPLISLHQGGAAGKQQPPPEAADAPAVRTRSIPRTIGVWLLFSLVIAFIAATVVFAITSLRARFPVDQEPELDAFSCEHPKGKCAFGMSSSPPSGSSSATGCSSSTEGVKVFRLDKTAFTYRDIVAATGNFSDDRVIGHGGSGVVYRGVLPDGRAVAVKKLSRPRDGVDGDGEREFRAEMEVLADRMGFTWPHPNLVTLYGWCLSGGAKILVYERLDGGSLEALICDTGAFGWAARLDAAVGVARALAFLHHECVPAVVHRDVKASNVLLDGDGRAKVTDFGLARVVRPGDTHVSTMVAGTVGYVAPEYAQTWRATTKGDVYSYGVLLMELATGRRAVDGGEECLVDWARRTAKEGRKQQTEDQQTTATVFWELLELGMRCTADAPHERPDMPVILAALLDMAGDAGCAYCMSSGHSDGEQTSSLT

SEQ ID NO: 363 - protein, 571 aa, Aegilops tauschii
MDAMERGQSSPRLPKIRGSKIDEESLRVPLIESKKAGSRAPAVVLGFECLESTAFNGVATNLVLYLESVLHGSGLASASNVTTWIGTSFLTPVLGAILADTFWGNYNTILVSLVVYLLGMMLITFSALLPTTELCGLGSSCHPMFGAHTVAFSGLYLVAFGSGGVRAALLPFGAEQFDDDNAVDRERKMAFFSWFYICVDFGMIVSGLFLVWIQQNVSWGLGFGIATACIALAFVGFVLFTPMYKRSMPTGSPFKSLCQVVVAACRKVTLRVPADAAVLYEVSDKIDQPRIAHTKEFTFLDKAAVVADSDLEEVTNVDAAAAAAGSWRLCTVTQVEELKILMRLLPIWATSIVLSAAYAQLNTTFVQQGSAMDMRVMSFTIPAASMVSFEVICVLAWVLIYGSVIVPALRRLSPASGEPSQLRRMGAGRLLMAFAMAVAALVEMRRLEAAGSGESISIGWQMPQYFVLAGGEVFCYIAQLEFFYSEAPESMKSMCTSFALLTVALGSYASSLIYAVVDALTATGGRPGWISDDLNEGHLDYFFWTMAALCTLNFVVYSAFARNYQVKTVVS

SEQ ID NO: 364 - protein, 334 aa, Aegilops tauschii
MASSSPPHVVEDVPPFLQLLSDGTVIRFTDGYPLPIPSPPPGQPVVDWKDVVYDASHGLKLRIYRPAAASSSGNKLPVIVYFHGGGYSIGSFDMPNFHACCVRLAGELPAVVLSADYRLAPEHRFPAGLDDAANVVSWVRGQAAAVGDNADPWLSETADFDRVFVAGDSAGGGVVHHTAVRLASGRLGPLEPVRVAGCAMLCPMFGGEERTASEAEFPPGPFLSLPAVDQAWRLVLPPGSTRDHPLANPFGPDSPALDGAALPPMLVVAAAHDLLRDRAADYAARLKAMGKPVELVEFEGQHHGFFAVEPYGDAGSEVVRLVKRFVYGNGGASD

SEQ ID NO: 365 - protein, 351 aa, Aegilops tauschii
MWPMEEEFFMAVKRTEHVEVTSRSVAASARGKEGVGGVEQPKMVRVFCDDFDATDSSSDEEGGERRRVKRYVQEIRLQPAVQVKVEESAPVAKAASATATTRPRVMVPVRKRKAEAGGERRFRGVRRRPWGKYAAEIRDPWRRVRVWLGTFDTAEEAAKVYDSAAIKLRGPDATVNFQQSEDGEDMEVPAEVAERLPQPPAGSKNASSSATSYDSCEESHVAAASPTSVLRSFPQSTLGAAVDDESSKKPSSSSSTAETDESSGVFGCSFSGDDFAGELAPLYTDFDLLSDFAEQPMDFLSNLPEPAFAFSSDCSSSAYNPCPPSPAALQQADAFFEDITDLFQIDPLPVI

SEQ ID NO: 366 - protein, 786 aa, Setaria italica
MSALTAAAAPTVTTFLRARTARTWVQPALPQRSPHRPCGKNSLVMHERILAIANGKGTGAVTTCEPSERLKDEPRNVSEKIDAIRAKLKSISDGNINVSAYDTAWVALVKRLDGGGGPQFPTSIDWITKNQLPDGSWGDDTFFMVHDRIINTLACIVALKSWNIHHYQCQRGLSFIHGNLWRLTEEDAEWMPVGFEITLPTLLEMAKDLGLDLPYDEPALQEIYSRRELKLSKIPIDALHAGPTTLLLSIEGMPGLDWERLLTLQCPDGSFMSSPAPTAYALMQTGDRKCLQFLEEIVDNFKEGVPFTYPVDIFERLWVVDRLERLGISRYFTSEIQECLDYVYRHLTQKGLAATRDCPVNDIDDTAMGFRLLRLHGYYVSPSMFKHFEKDGEFVCYHGQTNKSITAMYNTYRAAQVSFPGESELERADVYCRGFLEEKRASGNFGDKWVIPKDLAGEVGYALDFPWRASLPRIEARMYLEQYGGSADVWIGKVLYRMPLVSNELFLETAREDFRSFQKLCRLEWNGLRKWYDRNKLAAFGVEPKCVLRAYFQAAASIFEPDRAAERLAWARTAVIAEAVSLHLRGKASDVSTRVHGAISELENHGRDALTRVNEDPKKALLGAIGELIDQSSSENASHCLREAWKQWLRSWTAKEGFESCGGNTALLIVRTVEIASGRYSLKEHDVNRSEYTQLERLTSSICSKLTSRVPVQNGGLKKSENSVSQVDLEMKELAQSVLQSCDSIDRVTRQTFLHVAKSYYYASYCSTETIDSHISKVLFEDVVSE

SEQ ID NO: 367 - protein, 517 aa, Setaria italica
MVMMPASPASPRARRSVVAELEGGLLRCADTFPYFMLVAFEASGLPRFAALLALWPLLRLLELAGRGGLALRAAALVATAGVPRAEVEAVSRGVLPKFMADDVDPAAWAAFGSCEGRRVVVATRLPRVMVERFAKEHLGAHEVVGCELEYSRLRRCTGLLRGGGDEAVAGRVRTLFAGGNRPDLGIGRSEMARSFLPFCKEQLKPPFAAGGAATTDAPPFRPVIFHDGRLVCRPTPFMSLVILLWLPLGALVAFVRIAVGLMVPIWTIPHIAPIFGGAIITHGRAPAPVRAARDDDGGGSPSGVLFVCTHRTLMDPVVLATVLGRRVAAVTYSISRLSEVLSPIPTVRLTRDRDVDAARMRAELARGDVAVCPEGTTCREPFLLRFSALFAELSDRIVPVAMNYRVGLFHPTTARGWKAMDPIFFFMNPRPVYEVTFLNQLPAEATCAAGKSPVDVANYVQRILAATLGFECTSLTRKDKYRVLAGNDGIVNAAKPAAPGKAAWQGRIKEVLGFLLH

SEQ ID NO: 368 - protein, 676 aa, Setaria italica
MEHPQQHVVQVGRPPSRGSSSDDAARLVGMCPALYRAANRGRTEEVMALLLQQHAAGAAAKDRQDTGIIQHGQCDILEVSAEGNTVIHVAAEQGHHELIQELYARFNNIKGLLSHQNSALDTPLHCASRAGHVRTVAILIQLAQDYCGESILGCKNKAGDTALHMAARHGHGAATEVLVSVAPELAAELNNAGVSPLYLAVMSGSVQALRAIIACRDASAVGPSLQKQNALHAAVFKSSVMVDLLLEWRPALAEQVDGSGSSPLHFASSDGDSDVVRAILRAAPPRTVYKKDSGGLSALFVAARMGHHRVVNEILEWCPDAAELRDDNGGTFVHAAAKEKSDSFAKEKHRHSVVSLAIENPMLRGLLDVQDKDGNTPLHLAVAAGAPRVVDELLRKGKVRADILNNDGRTALDLAAGSTSFFTTVKLVVMLVGFGAQLRPQRQDHLKLWSGHDSIAKDIERTSDSLAVVAVLIATAALAAGFNVPGGYGEKTGEANLEDRLVFKGFLVLDISAVAASVVAVILLVYGKASRSAGSWKSFAAALQCMWASLICLMLAFYAVLDAVTTTKAVYRYGFPVIFACIVVLSIFIMSRIEPVRTSLTVWRFMCHRAKSSRHTGWRFMCQQRCHLKGWHAVQRQFPLAGAYVLNLCLFTATYVLIGIVGFVGISWLEQLQRMF

SEQ ID NO: 369 - protein, 343 aa, Panicum virgatum
MEAAAVAAGGSEIYRLPEECVAYAISLTTPGDACHSSAVSPAFRAAADSDSDSDSDSDADAVWDRFLPPDHAAVLARADEPVQCESKKDLFSRLCDSPVLLDGATMSFGLERRSGAKCLMLSARALSIVWGDDPTCWVWTASLPGSSRFPEVAELVDVCWLEISGKLSLSLLSPGTTYAAYLVFAIADDSYGLECHVGMLPPKATVTVVVSGSGSSSSKKPTTAGVAMTATTKTSTEHAICLQHMQGEEEAAMHRRKQQYMRLRKGYGRKMMLTREADPDIRCPRRRGDGWAEVELGEFAVAGDGEVADDGVVEVRLEEVDSRRWKRGLIVQGIEIRPKHAAS

SEQ ID NO: 370 - protein, 1044 aa, Hordeum vulgare
GSRRSRRSTSPTTPSPARSPPPTSTNAAASCTSTSPTTSSPGRSSSPGSPGSGCSTCRGTGWTAPSPSTSRPPPPPPPPPPPPDGAVAVNFPAICADLTLLDLSTNNLTGSVTGLLDGCARLDKVDLSSNNFTGELWPGIARFREFSAAENNLTGSVPWSTFPDGCRLQSLDLSANQLVGGFPDSIANCTNLTYMSLWGNNFTGKIPAGIGKLAVLETLILGKNKFDRQIPPDLTNCGRLQFLDISSNMFGGDVQQIFGNFTSLKYLVLHHNEYTGGIVASGVLRLPLLARLDLSFNQFTGQLPPQVADMKSLKYLMLAENNFSGTIPPEYGRLAELQALDLSNNTLSGVIPATIGNLTSLLWLMLAGNQLSGQIPPEIGNCTSLLWLNLADNLLTGRIPPEMAEIGRNPGPTFAKNRNDTSVLAGSGECQAMKRWIPASYPPFSFVYSVMTRESCRTIWDRMLKGYGIVPICTNSSSPVRSNTVSGYVQLSGNLLSGQIPSEIGAMRNLSLLHLDGNRLTGQLPAEIGRLPLVMLNVSRNNLSGPIPSEIGDILCIERMDLSFNNLSGELPASLFKLTELSMFNVSYNPLLSGNVSTTGQFGTFDEQSFLGNPLISLHQGGAAGKQQPPRPEAADAPGVRTGGIPRTIVMWLLFSLVIAFIAGTVVFAITSLRARFPVDQEPEPDSFSCEHSKGKYAFGLSSSPPSGSSSATGCSSSTEGVKVFRLDKTAFTYRDIVAATGNFSDDRVIGRGGSGVVYRGVLPDGRAVAVKKLSRPRDGVDGDSEREFRAEMEVLADRMGFTWPHPNLVTLYGWCLSGGAKILVYERLDGGSLEALICDTAAFGRAARLDAAVGVARALAFLHHECVPAVVHRDVKASNVLLDGEGRAKVTDFGLARVVRPGDTHVSTMVAGTVGYVAPEYAQTWRATTKGDVYSYGVLLMELATGRRAVDGGEECLVDWTRRTAKEGRKQQTEDQKTAGGTVSWELLALGMRCTADAPHERPDMPDVLAALLDIAGAANGDAGCAYCRSSEHSGGEQTSSVR

SEQ ID NO: 371 - protein, 147 aa, Sorghum bicolor
MAMEVQGTRRPPQDAGVKVKFIETQFISSDAASFKAVVQRLTGKSPAPASSQTAAHQAPAAPHPQRPRPCRPAFVGAGQQQQQAAGWTMDQQATAGYLAMMPAPKQEPLAAASRLEDMNELCDFADLFYTTTAASARRDVGGSAFPY

SEQ ID NO: 372 - protein, 488 aa, Triticum aestivum
PNLFLSPTHHQHHAVTVAVHGARRVVSTVKPPPRPRERIPLTSWDASMLSSNYIQKGLLFHRPTSCSPVNAADHLAAALGDALVHYYPIAGRFATEQHRDDRTGAVVGCSVHVDCDGQGVEVVRAVADGVTMADVIPPDADVPRGVLAQFFQLTDAVNYGGQEQPLFAVQVTDLADGVFVGFAYNHALSDGTAFWDFVNYWAALARARLGLAPAPPAAKPSLERWSPDGGPAGPAVLPCADVSELIERAPRLQLRERMLHFSADSLAALKERAREELLAAGDTAGAAALTKFQALSSLLWRCITRARRMAPEQETTCRAAINNRARLRPQLPQDYFGNTIYAIGTEATRAADVLNRGHGWAAAAVGRAVAAHTDASIRARVAAWTARPMVYTHRFFDPTGTMMGSSPRFDMYGCDFGWGSPVAARSGMANKFDGKTSLYPGREGGGSIDAELTLSPENMAALEEDDEFWAAVTPDAPVPAPAPEKKAT

SEQ ID NO: 373 - protein, 409 aa, Triticum aestivum
MGNFCVCMGGSAKCASASTPFQSKVNPRSSTSNSNSKASRRSSSGPEKPPQPAEAPTAAGEAQAVPPASLKSFSMADLRAATKNFGSTSYLGEGGFGCVYKGWIDETTLAPARPGATNAMMVAIKKLKKESFQGHREWLTEVTYLGDLHHDNLVKLVGYCSDSDSNKLLVYEYMPRGSLENHLFRRGSQPPLPWSTRLSVAVDVARGLAFLHSRDVIFRDLKSSNVLLGPDHRAKLSDFGLARAGPTGGKTHVSTRVVGTRGYAAPEYVATGHLSAKSDVYGFGVVLLELMTGRRALDEARGVASELLVDWAMPMLQGERRKVIRVMDTRLGGQYPKRQAQDMAALALRCLQNDPKSRPSMADDVLPSLELLLQPSAAKSFSSSSTTTTSRSPAASAALVHRGHRRNKA

SEQ ID NO: 374 - protein, 415 aa, Hordeum vulgare
MGNFCVCMGGSAKCASASTPFESKVNPRSSTSNSNSNSKASRRGSSGPEKPQVAEVQAAAAGEEVAEVPASLKSFSMADLRAATKNFGSTSYLGEGGFGCVYKGWIDEATLAPARPGATNAMMVAIKKLKKESFQGHREWLTEVTYLGDLHHDNLVKLVGYCSDSDSNKLLVYEYMPRGSLENHLFRRGSQPPLPWSTRVAVAVDVARGIAFLHSRDVIFRDLKSSNVLLGPDHRAKLSDFGLARAGPTGGKSHVSTRVVGTRGYAAPEYVATGHLSAKSDVYGFGVVLLELMTGRRALDESRGLASELLVDWAMPMLQGERRKVIRVMDTRLGGQYPKRQAQDMAALALRCLQNDPKSRPSMADDVLPSLQLLLQPTTAAKSSSSSSSLTTTSSRSPATTMTTPVQRGHRRHHR

SEQ ID NO: 375 - protein, 256 aa, Panicum virgatum
MGRAPCCERMGLKRGPWTPEEDRILVAHIERHGHSNWRALPKQAGLLRCGKSCRLRWINYLRPDIKRGNFTREEEDAIIHLHHMLGNRWSAIAARLPGRTDNEIKNVWHTHLKKRLEPKPASQQQAAAPKRKPTKKKQQQQPDAEVVVLDGPTSITAPVSPEQSSLYTSTTTSSADCSAASSLDNNADSFTSEEDYRIEDSFWSETLAMAVDSSGDYSSGMEREDAPAAPAANDDMDFWLKLFMQASDMQNNLLQI

SEQ ID NO: 376 - protein, 257 aa, Panicum virgatum
MGRAPCCERMGLKRGPWTPEEDRILVAHIERHGHSNWRALPKQAGLLRCGKSCRLRWINYLRPDIKRGNFTREEEDAIIHLHHMLGNRWSAIAARLPGRTDNEIKNVWHTHLKKRLEPKPASQQQAAPKRKPTKKQQQQQHQQPDVEVVVLDGPTSTVPVSPEQSLSTSTTTSTDCSAASSLDNNADSFTLEEDYHIEDSFWSETLAMAMDSSGDYYSSGMEREDAPAAPPANDDEMDFWLKLFMQASAMQNNLPQI

SEQ ID NO: 377 - protein, 244 aa, Zea mays
MGRAPCCEKMGLKRGPWTPEEDRILVAHIERHGHSNWRALPKQAGLPRCGKSCRLRWINYLRPDIKRGNFTREEEDAVIQLHQMLGNRWSAIAARLPGRTDNEIKNVWHTHLKKRLEPKTATQAPKRKPKKQQQPEAVTLAAPVSPEQSVSTSTTSTTTDYSAASSSLENADSFTSEEEDYQIDDSFWSETLAMAVDSSDSGMEEAEGAFGASPPAPSTNDDVDFWLKLFMQASDMQNSPQIYA

SEQ ID NO: 378 - protein, 435 aa, Triticum aestivum
MEGGSQPQPQGASLSPAPFLIKTYEMVEDPATSRVVSWGPGGASFVVWNPPDFSRDLLPKYFKHNNFSSFIRQLNTYGFRKIDPERWEFANDDFIRGHMHLLKNIHRRKPVHSHSPQNQVNGPLAESERREYEEEISRLKHENSVLVAELQRQAQQQCGLSWLMQSLEDRLMAMERRQADVVASVRDTLQRRRGGVHPGQETMMLELEPTDHFSKKRRVPTIGFFVEEPAEEQRVPHLRAMGGETPGMVMVNAEPFEKMELALVSMEKLVQRAGDYASSEDMYNAAAAAPSTDDPAHADLQAAPVNLQPSSPELAESPGYAVQSPMLLFPEIHEDKHKTMAEVDMSSEASTTDTSQDETTAEAEAETGVPHEPAVANDLFWERFLTDTPKPLAVEESHGPEDDVKTGLDCYWFGHRNNVDQITEQMGHLASAQKT

SEQ ID NO: 379 - protein, 443 aa, Secale cereale
MEGGSQPQPQGASLSPAPFLIKTYEMVEDPATNRVVSWGPGGGSFVVWNPPDFSRDLLPKYFKHNNFSSFIRQLNTYGFRKIDPERWEFANEEFIRGHMHLLKNIHRRKPVHSHSPQSQVNGPLAESERREYEDEISRLKHENSLLVAELQRQAQQQCGLGWLMQSLEERLVAMEQRQVDVVASVRDVQQRRRGGVHPGQETMLELEPTDHFSKKRRIPKIGFFVEEPAAAAEEQRVPHLPAMGGETPGMVMVNAEPFEKMELALVSMEKLVQRAGNYTSSEDMYNAAAAAAVAPSTDDPAHAGLQAAPVEAGVNLEPSSPELAKSPGYAVQSPMLLFPEIHGDKHKTTAEVDVSSEASSTDTSQDETAAEAEKTGVPHEPAVANDVFWERFLTDTPKPLAVEEGNESKDDLKMGLDCYWFGHRNNVAQITEKMGHLASAQQT

SEQ ID NO: 380 - protein, 247 aa, Aegilops tauschii
MEQLRISLINNTMASPSPSSTVIQMPPSPHTNGGTAGLAPATPEDAGDVPPPAPAAAAVDQHSPTDKVMSSAANLAQLLPTGTVLAYQALSPSFTNHGKCFSSNQWLTAALVIILTISCILFTFTDSVLGRDQKLYYGIATPRGFNVFNFSDEEERQQWTPAEFRRLRIRPLDFVRAIFTALVFLTVAFSDVGLQNCFFPNAGMDTQELLKNLPLGIAFLSSFVFMIFPTKRKGIGYSDTTPRQKLT

SEQ ID NO: 381 - protein, 235 aa, Triticum aestivum
MASSSPSSTVIQMPPSQHTNGGTAGLAPATPKDAGDIPTTAPATAAGPAATATDKVMSSAANLAQLLPTGTVLAYQALSPSFTNHGKCFSSNQWLTAALVIVLTISCVLFSFTDSVLGRDQKLYYGIATPRGFNVFNFSDEEEKLQWTPAEFRRLRIRPLDFMRAVFTALVFLTVAFSDVGLQNCFFPNAGMNTQELLKNLPLGIAFLSSFVFMIFPTKRKGIGYSDTTPRQKLT

SEQ ID NO: 382 - protein, 228 aa, Secale cereale
MASFSPSSIVIQMPLSPNTNGQPTAPATPKDASDVPTTAPAAASAADKVMSSAANLAQLLPTGTVLAYQALSPSFTNHGKCFSSNQWLTAALVVVLTVSCVLFSFTDSVLGRDQKLYYGIATPRGFNVFNFSDEEERLQWTDAEFRRLRIRPLDFMRAVFTALVFLTVAFSDVGLQNCFFPGAGRNTEELLKNLPLGIAFLSSFVFMIFPTKRKGIGYSDNTPRAKLT

SEQ ID NO: 383 - protein, 222 aa, Secale cereale
SSIVIQMPLSPNTNGQPIAPATPKDVGDVPTTAPAAASAADKVMSSAANLAQLLPTGTVLAYQALSPSFTNHGKCFSSNQWLTAALVVVLTISCVLFSFTDSVLGRDQKLYYGIATPRGFNVFNFSDEEEKLQWTPAEFRRLRIRPLDFMRAVFTALVFLTVAFSDVGLQNCFFPGAGRNTEELFKNLPLGIAFLSSFVFMIFPTKRKGIGYSDSTPRAKLT

SEQ ID NO: 384 - protein, 222 aa, Secale cereale
SSIVIQMPLSPNNNGQPTAPATPKDAGDVPTTAPAAASAADKVMSSAANLAQLLPTGTVLAYQALSPSFTNHGKCFSSNQWLTAALVVVLTISCVLFSFTDSVLGHDQKLYYGIATPRGFNVFNFSDDEEKLQWTPAEFRRLRIRLLDFVRAIFTALVFLTVAFSDVGLQNCFFPGAGRNTEELLKNLPLGIAFLSSFVFMIFPTKRKGIGYSDTTPRQKLT

SEQ ID NO: 385 - protein, 233 aa, Triticum aestivum
MASPPSSTVIEMPQSPHGNAGVPMAPTTPKDAGDVPTMASAATAGLAPTATDKVMSSAANLAQLLPTGTVLAYQALSPSFTNHGKCFSSNRWLTAALVIVLTISCVLFTFTDSVLGRDQKLYYGIATPRGFNIFNFSDEEEKLQWTPAEFRRLRIRPFDFIRAVFTALVFLTVAFSDVGLQNCFFPNAGMNTQELLKNLPLGIAFLSSFVFMIFPTKRKGIGYSDTTPRQKLT

SEQ ID NO: 386 - protein, 235 aa, Triticum aestivum
MASPPPSSTVIQMPPSPQTNGQPTAGTVPAMPNDAGDVTIAPAAAAGPASKATDKVMSSAANLAQLLPTGTMLAYQALSPSFTNHGKCEASNQWLTAALVIILAALCILFSFTDSVLGRDQKLYYGVATPRGFNVFNFSDEEEKLKWTPAEFRRLRIRPLDFLHAIFTALVFLTVAFSDVGLQNCFFPNAGRNTAELLKNLPLGIAFLSSFVFMVFPTKRKGIGYTDTTPRKKLT

SEQ ID NO: 387 - protein, 82 aa, Secale cereale
MAVARRMRLALAVIVAALVLLAALGEARPLSGADWAAAGGTPLPAAGGASTVVQALRRLYMQQLGGPGPSCGTNSPNVHCPP

SEQ ID NO: 388 - protein, 76 aa, Triticum aestivum
MAVVRRMRLALPVIVAALVLLAVLGEARPLGGADWAAAGGTPLPAVVQALRRLYMQQLGGPGPSCGTNSPNVHCPP

SEQ ID NO: 389 - protein, 76 aa, Hordeum vulgare
MAVARRTMRLALPLILAALMLLAVLGEARPLGGADWAAAGGTPLPAVVQALRRLYMQQLGGPGPSCGTNSPNVHCP

SEQ ID NO: 390 - protein, 479 aa, Hordeum vulgare
MNLTLSLGVNGGGAAAKKRKVMDGVGDVGVLGAADGCDRATVMRLLQARDRMVKVELDHDVDGDVSGCGASPLMRLLLSSAVAGEVGDTHAAAVALQEVYRHASFRGGDPVQRVAAYFADALASRLLLSPQPAQATTRQEQFLAFTMFYQASPLYQFAHFTANQAIMEAFEAGGTRRLHVVDFDVSFGFQWPSLIQSLSDAAATSSSLSSHDDSGDSCDEPVSLRITGFGASADELRDTEARLARFADGCPNLRFEFEGVLNSGPEDDGRHDRIKTDPAATVVVNLVFPAAQNARAGSWDPRSALAHIWSLSPSLVFLIDKVDEGAGRCGGSASLLPRFAANLRYYAAVFESLHECLPADSAERIAIEKDHLGVEISDAMATLDRRRHDGDRAADQNQTSRGWKERLESAGFEDARLSSRTVSQAKLLLKMKSGGCGGGGFRVMEAGDGKAMALGWRDRALVTASAWRPCRRSVGKNEP

SEQ ID NO: 391 - protein, 485 aa, Triticum aestivum
MASYDKAMESYKKAVTTAASLAASAMLVRGVVNELVPYEVRDLLFSGMGYLRSHMSSQHTIIIEETEGWANNQLYDAARAYLATRINTDMQRLRVSRVDETKSMMFSMEEGEEMADVHEGTEFKWRLVCRDNSSASSSNTNGRGGSGNFKLEVRSFEMSFHRKHKDKALTSYLPHILAVAKKIKEQNRTLKIYMNEGESWFAIDLHHPSTFSTLAMDHKLKQSVMDDLERFVKRKEYYKKIGKAWKRGYLLYGPPGTGKSSMIAAMANYLKFDVYDLELTEVNWNSTLRRLLIGMTNRSILVIEDIDCTVELQQREEGQEGTKSNPSEDKVTLSGLLNFVDGLWSTSGEERIIIFTTNYKERLDPALLRPGRMDMHIHMGYCCPESFRILASNYHSIDHHATYPEIEELIKEVMVTPAEVAEVLMRNEETDVALKGLIQFLKRKKDGAGKPENVDQVAKEEEQEKEMMTKSDVPDNEDQQDGSKE

SEQ ID NO: 392 - protein, 485 aa, Triticum aestivum
MASYDKAMESYKKAVTTAASLAASAMLVRGVVNELVPYEVRDLLFSGMGYLRSHMSSQHTIIIEETEGWANNQLYDAARAYLATRINTDMQRLRVSRVDETKSMMFSMEEGEEMADVHEGTEFKWRLVCRDNSSASSSNANGRGGSGNFKLEVRSFEMSFHRKHKDKALTSYLPHILAVAKKIKEQNRTLKIYMNEGESWFAIDLHHPSTFSTLAMDHKLKQSVMDDLERFVKRKEYYKKIGKAWKRGYLLYGPPGTGKSSMIAAMANYLKFDVYDLELTEVNWNSTLRRLLIGMTNRSILVIEDIDCTVELQQREEGQEGTKSNPSEDKVTLSGLLNFVDGLWSTSGEERIIIFTTNYKERLDPALLRPGRMDMHIHMGYCCPESFRILASNYHSIDHHATYPEIEELIKEVMVTPAEVAEVLMRNEETDVALEGLIQFLKRKKDGAGKQENVDQVAKEEEQEKEMMTKSDVPDNQDQQDGSKE

SEQ ID NO: 393 - protein, 485 aa, Triticum aestivum
MASYDKAMESYKKAVTTAASLAASAMLVRGVVNELVPYEVRDLLFSGMGYLRSHMSSQHTIIIEETEGWANNQLYDAARAYLATRINTDMQRLRVSRVDETKSMMFSMEEGEEMADVHEGTEFKWRLVCRDNSSASSSNTNGRGGSGNFKLKVRSFEMSFHRKHKDKALTSYLPHILAVAKKIKEQNRTLKIYMNEGESWFAIDLHHPSTFSTLAMDHKLKQSVMDDLERFVKRKEYYKKIGKAWKRGYLLYGPPGTGKSSMIAAMANYLKFDVYDLELTEVNWNSTLRRLLIGMTNRSILVIEDIDCTVELQQREEGQEGTKSNPSEDKVTLSGLLNFVDGLWSTSGEERIIIFTTNYKERLDPALLRPGRMDMHIHMGYCCPESFRILASNYHSIDHHATYPEIEELIKEVMVTPAEVAEVLMRNEETDVALKGLIQFLKRKKDGAGKPENVDQVAKEEEQEKEMMAQSDVPDNQDQQDGSKE

SEQ ID NO: 394 - protein, 485 aa, Hordeum vulgare
MASYDKAMESYKKAVTTAASLAASAMLVRGVVNELVPYEVRDLLFSGMGYLRSHMSSQHTIIIEETEGWANNQLYDAARAYLATRINTDMQRLRVSRVDETKSMMFSMEEGEEMADVHEGTEFKWRLVCRDNSSASSSNGNGRGGSGNFKLEVRSFEMSFHRKHKDKALTSYLPHILAVAKKVKEQNRTLKIYMNEGESWFAIDLHHPSTFSTLAMDHKLKQSVMDDLERFVKRKEYYKKIGKAWKRGYLLYGPPGTGKSSMIAAMANYLKFDVYDLELTEVNWNSTLRRLLIGMTNRSILVIEDIDCTVELQQREEGQEGTKSNPSEDKVTLSGLLNFVDGLWSTSGEERIIIFTTNYKERLDPALLRPGRMDMHIHMGYCCPESFRILASNYHSIDHHATYQEIEEMIKEVMVTPAEVAEVLMRNEETDIALEGLIQFLKRKKDGAGKMENVDQVAKEEEQEKEMMTKSDVLDNEDQQDGSKE

SEQ ID NO: 395 - protein, 485 aa, Secale cereale
MASYDKAMESYKKAVTTAASLAASAMLVRGVVNELVPYEVRDLLFSGMGYLRSHMSSQHTIIIEETEGWANNQLYDAARAYLATRINTDMQRLRVSRVDETKSIMFSMEEGEEMADVHEGTEFKWRLVCRDNSSASSSNGNGRGGSSNFKLEVRSFEMSFHRKHKDKALTSYLPHILAMAKKIKEQNRTLKIYMNEGESWFAIDLHHPSTFSTLAMDHKLKESVMDDLERFVKRKEYYKKIGKAWKRGYLLYGPPGTGKSSMIAAMANYLKFDVYDLELTEVNWNSTLRRLLIGMTNRSILVIEDIDCTVELQQRDEGQEGTKSNPSEDKVTLSGLLNFVDGLWSTSGEERIIIFTTNYKERLDPALLRPGRMDMHIHMGYCCPESFRILASNYHSIDHHATYPEIEEMIKEVMVTPAEVAEVLMRNEETDVALQGLIQFLKRKKDGAGKPENVDQLAKEEEQEKEMMTKSDVPDNQDQQDGSKE

SEQ ID NO: 396 - protein, 487 aa, Brachypodium distachyon
MASYDKAMESYKKAITTAASLAASAMLVRGVVNELVPYEVRNLLFSGMGYLRSHMSSQHTIIIEETEGWANNQLYDAARAYLATRINTDMQRLRVSRVDETKSMMFSMEEGEEMADVHEGTEFKWRLVCRDNSSASSSNGNGNGRSGNFKLEVRSFEMSFHRKHKEKALNSYLPHILAMAKKIKEQDRTLKIYMNEGESWFAIDLHHPSTFSTLAMDHKMKQSVMDDLERFVKRKEYYKKIGKAWKRGYLLYGPPGTGKSSMIAAMANYLKFDVYDLELTEVNWNSTLRRLLIGMTNRSILVIEDIDCTVELQQREEGQEGTKSNPSEDKVTLSGLLNFVDGLWSTSGEERIIIFTTNYKERLDPALLRPGRMDMHIHMGYCCPESFRILASNYHSIDHHATYPEIEELIKEVMVTPAEVAEVLMRNEETDIALEGLIQFLKRKRDGTKDGKAENAGQVAKEEEQEEEKLTKSDVPDNQNQQDESKE

SEQ ID NO: 397 - protein, 487 aa, Avena sativa
MASYDKAMESYKKAVTTAASLAASAMLVRGVVNELVPYEVRDLLFSGMGYLRSHMSSQHTIIIEETEGWTNNQLYDAARAYLATRINTDMQRLRVSRVDETKSMMFSMEEGEEMADVHEGTEFKWRLVCRDNSSASSSNGNGRGGNGNFKLEVRSFEMSFHRKHKEKALTSYLPHILAMAKKIKDQNRTLKIYMNEGESWFAIDLHHPSTFSTLAMDHKLKQAVMDDLERFVKRKEYYKKIGKAWKRGYLLYGPPGTGKSSMIAAMANYLKFDVYDLELTEVNWNSTLRRLLIGMTNRSILVIEDIDCTVELQQRDEGQEGTKSNPSEDKVTLSGLLNFVDGLWSTSGEERIIIFTTNYKERLDPALLRPGRMDMHIHMGYCCPESFRILASNYHSIDHHATYLEIEELIKEVMVTPAEVAEVLMRNEETDIALEGLIQFLKRKKDSAKDGKAENVDQAVNEEEQEKEMTTKIDLPDNQNHQDESKE

SEQ ID NO: 398 - protein, 488 aa, Brachypodium distachyon
MASYDKAMESYKKAITTAASLEASAMLVWGVVNELVPYEVRNLLFSGMGYLRSHMSSQHTIIIEETEGWANNQLYDAARAYLATRINTDMQRLRVSRVDETKSMMFSMEEGEEMADVHEGTEFKWRLVCRDNSSASSSNGNGNGRSGNFKLEVRSFEMSFHRKHKEKALTSYLPHILAMAKKIKEQDRTLKIYMNKGESWFAIDLHHPSTFSTLAMDHKMKQSVMDDLERFVKRKEYYKKIGKAWKRGYLLYGLPGTGKSSMIAAMANYLKFDVYDLELTEVNWKSTLRRLLIGMTNRSILVTEDIDCTVELQQREEGQEGTKSNPSEDKVTLSGLLNFVDGLWSTSGKERIIIFTTNYKERLDPALLRPGRMDMHIHMGYCCPESFRILASNYHSIDHHATYPEIEELIKEVMVTPAEVAEVLMRNEETDIALEGLIQFLKRKRDGTKDGKAENAAGQMAKEEEQEEEKMTKSDVPDNQNHQDESKE

SEQ ID NO: 399 - protein, 486 aa, Oryza sativa
MASYDKAIESYKRAVTTAASLAASAMLVRGVVNELVPYEVRDLLFSGVGYLRSRMSSQHMVIIEETEGWTNNQLYDAVRTYLATRINTDMQRLRVSRVDETKSMMFSMEEGEEMADVHEGSEFRWRLVCRDNSSSSNGNGNGRGGNGNYRLEVRSFEMSFHKKHKDKALNSYLPHILATAKKIKDQDRTLKIYMNEGESWFAIDLHHPSTFTTLAMDHKQKQSVMDDLERFIKRKEYYKKIGKAWKRGYLLYGPPGTGKSSLIAAMANYLKFDVYDLELTEVNWNSTLRRLLIGMTNRSILVIEDIDCTLELQQREEGQESSKSNPSEDKVTLSGLLNFVDGLWSTSGEERIIVFTTNYKERLDPALLRPGRMDMHVHMGYCCPESFRILASNYHSIDNHATYPEIEELIKEVMVTPAEVAEVLMRNDDTDVALEGLIQFLKRKKDVGKEGKAENVEQVVKAEETEKGMMKKNDVPENQDPQDASK

SEQ ID NO: 400 - protein, 485 aa, Panicum virgatum
MATYDKAIESYKKAVTTAASLAASAMLVRGVVNELLPYEVRELLTSGLGYLRSRMSSQHTVVIEETEGWAANQLYDAARAYLATRINTDMQRLRVSRVDEGKSLMFSMEEGEEMADLHEGAEFRWRLVCRDNLGAGAGNGNGGRGGNGSYRVEVRSFEMSFHKKHKEKAITSYLPHILATAKKIKEQDRTLKIYMNEGESWFAIDLHHPSTFSTLAMDRKMKQAVMDDLERFVKRKEYYKRIGKAWKRGYLLYGPPGTGKSSLIAAMANYLKFDVYDLELTEVNWNSTLRRLLIGMTNRSILVIEDIDCSIDLQQRDEGQDGTKSNPSEDKVTLSGLLNFVDGLWSTSGEERIIIFTTNYKERLDPALLRPGRMDMHIHMGYCCPESFRILASNYHSISDHDTYPEIEELIREVKVTPAEVAEVLMRNDDTDIALEGLIQFLKGKKSDAKDSKDENVDHVAKEGAKEMTKQDLSGDQNLNDAGKE

SEQ ID NO: 401 - protein, 487 aa, Setaria italica
MATYDKAIESYKKAVTTAASLAASAMLVRGVVNELVPYEVRDLLFSGLGYLRSRMSSQHTVVIEETEGWATNQLYDAARTYLATRINTDMQRLRVSRVDEGKSLMFSMEEGEEMADLHDGAEFRWRLVCRDNPGAGAGNGNGGRSGNGGYRVEVRSFEMSFHKKHKEKAIASYLPYILATAKKIKEQDRTLKIYMNEGESWFAIDLHHPSTFTTLAMDHKMKQSVMDDLERFVKRKEYYKRIGKAWKRGYLLYGPPGTGKSSLIAAMANYLKFDVYDLELTEVNWNSTLRRLLIGMTNRSILVIEDIDCSIDLQQRADEGQDGTKSSPSEDKVTLSGLLNFVDGLWSTSGEERIIIFTTNYKERLDPALLRPGRMDMHIHMGYCCPESFRILASNYHAISDHDRYPEIEELIKEVMVTPAEVAEVLMRNDDTDIALEGLIQFLKAKRSDAKDSKGENVVHEAKEDRKEMMTEQDISGDQNLNDAGKE

SEQ ID NO: 402 - protein, 497 aa, Sorghum bicolor
MATYDKAMESYKKAVTTVASLAASAMLVRGVVNELVPYEVREFLFSGLGYLRSRMSSQHTVVIEETEGWASNQLYDAARTYLATRINTDMQRLRVSRVDEGKSLMFSMEEGEEMADVHAGAEFRWRLVCRDGGGAGAGNGGHAHAHARGGGGGGSYRFEVRSFEMSFHRRHKDKAIASYLPHILAEAKKIKDQDRTLKIYMNEGESWFAIDLHHPSTFTTLAMDRDMKRSVMDDLERFVRRKEYYKRIGKAWKRGYLLHGPPGTGKSSLIAAMANYLKFDVYDLELTEVNWNSTLRRLLIGMTNRSILVIEDIDCSVDLQQRAEEGQDGGTKSSPPPSEDKVTLSGLLNFVDGLWSTSGEERIIIFTTNYKERLDPALLRPGRMDMHIHMGYCCPESFRILASNYHSITDHDTYPEIEALIKEAMVTPAEVAEVLMRNDDTDIALQGLIRFLKGKKGDAKNSQGENVEHVTKEEEKEMMPTKKDDPVDQNLNDAGKQ

SEQ ID NO: 403 - protein, 351 aa, Triticum aestivum
MAGHGDEVTRNKKVVLRRYVTGYPTAEDMEVVVTSDVRLRVPEGSAAAVVVKNLYLSCDPWMRGRMTKHDDGDAVPAEDFVLGEALVNFTVGEVVDSTHPEFDAGDLVWGMSAWEEYTLITQTEGLFKINHPELPLSHYTGVLGLAGLTAYAGLFEVGKPKQGETVFVSAASGAVGQVVGQLAKIAGCYVVGSAGSDEKVNLLKSKMGFDDAFNYKSEGDDLGAALGRRLPGGINVYFDNVGGATLDAALLRMRPGGRVVACGMISQYNLSEHQGVRNLWCIIPKRVRVEGFSCMDYHHLYPRFEEEMAGYIKAGKVTVVEDVVRGIERAPEALLGLFSGRNVGKLLVALA

SEQ ID NO: 404 - protein, 571 aa, Triticum aestivum
MDAMERGQGSPRLPKSRGSKIDEESLRVPLIESKKTGSRAPAVVLGFECLESTAFNGVATNLVLYLESVLHGSGLASASNVTTWIGTSFLTPVLGAILADTFWGNYTTILVSLVVYLLGMMLITFSALLPTTELCGLGSSCHPMFGAHTVAFSGLYLVAFGSGGVRAALLPFGAEQFDDDNAVDRERKMAFFSWFYICVDFGMIVSGLFLVWIQQNVSWGLGFGIATACIALAFVGFVLFTPMYKRSMPTGSPFKSLCQVVVAACRKVTLRVPAEAAVLYEVSDKIDQPRIAHTKEFTFLDKAAVVADSDLEEVTNVDAAAAATGSWRLCTVTQVEELKILMRLLPIWATSIVLSAAYAQLNTTFVQQGSAMDMRVMSFTIPAASMVSFEVICVLAWVLIYGSVIVPALRRLSPASGEPSQLRRMGAGRLLMAFAMAVAALVEMRRLEAAGSGESISIGWQMPQYFVLAGAEVFCYIAQLEFFYSEAPESMKSMCTSFALLTVALGSYASSLIYAVVNALTATGGRPGWISDDLNEGHLDYFFWTMAALCTLNFVVYSAFARNYQVKTVVS

SEQ ID NO: 405 - protein, 571 aa, Hordeum vulgare
MDAMERGQGSPRLPKSRGSKVDEESLKTPLIESKKTGSRAPAVVLGFECLESTAFNGIATNLVLYLESVLHGSGLASASNVTTWIGTSFLTPVLGAILADTFWGNYNTILVSLVVYLLGMMLITFSALLPTTDLCGLGSSCHPMFGAHTVAFSGLYLVAFGSGGVRAALLPFGAEQFDDDNAVDRERKMAFFSWFYICVDFGMIVSGLFLVWIQQNVSWGLGFGIATACIALAFVGFVLFTPMYKRSMPTGSPFKSLCQVVVAACRKVTLRVPADAAVLYEVSDKIDQPRIAHTKEFTFLDKAAVVADSDLEEVTNVDAAAAAAGSWRLCTVTQVEELKILMRLLPIWATSIVLSAAYAQLNTTFVQQGSAMDMRVMSFTIPAASMVSFEVICVLAWVLLYGSVIVPALRRLSPASDEPSQLRRMGAGRLLMAFAMAVAALVEMRRLEAAGSGESISIGWQMPQYFVLAGGEVFCYIAQLEFFYTEAPESMKSMCTSFSLLTVALGSYASSMIYAVVNALTATGGRPGWISDDLNEGHLDYFFWSMAALCTLNFVVYSAFARNYQVKTVVS

SEQ ID NO: 406 - protein, 575 aa, Brachypodium distachyon
MERGQSSPRLPKSRGSKIDEESLKVPLIEAKKKTGSRAPAVVLGFECLESTAFNGIATNLVLYLERVLHGSSLGSASNVTTWIGTSYLTPVFGAMLADTFWGNYNTILVSLVVYLLGMMLVTFSAFLPTTALCGVGSSCHPVLGSHTVAFAGLYLVAFGSGGVRAALLPFGAEQFDDDNAVDRERKMSFFSWFYIAVDFGMIVSGLFLVWVQQNVSWGLGFGIATACIALAFAGFVLATPMFKRRMPSGTPLKSLCQVVVAASRKVALRVVPSEAANLYEVSDKIEHEQPRIAHTDEFTFLDRAAMIVASDLAEVTANDAGAGAGSSSSSWRLCTVTQVEELKILMRLLPIWATSIVLSAAYAQLQTTFVQQGNAMDTRVMSFSLPAASMVSFEVICVLAWVLIYDFVILPALRSFSPASGEPSQLQRMGAGRLLMAVAMAAAALLEMKRLDAAAGGGSVSIAWQMPQYFVLAGGEVFCYIAQLEFFYNEAPESMKSMCTSFALLTVALGSYMSSLIYGVINMLTATDGRPGWIPDNLDEGHLDYFFWVMAALCTLNFVVYSAFARNYQVKTVVS

SEQ ID NO: 407 - protein, 575 aa, Oryza sativa
MDAGDAMERGQQRLPESWNPKLQDDVSLTVPLIQDKKSGSKAPAVVLGFECLESTAFNGIATNLVVYLETVLHGSSLASASNVTTWFGTSYLTPVFGAIIADTFFGNYNTILVSLVFYLLGMVLVTFSAFLPTTALCAVAGSTSCQQPVFGAQTIAFVGLYLVAFGSGGVRAALLPFGAEQFDDDNAVDRERKMSFFSWFYMCVDFGMIVSGLFIVWIQQNVSWGLGFGIATVCVAIAFGGFVLATPMYKRSMPTGTPLKSLAQVVVAACRKVSLRVPADAALLYEVHDKIDQPKITHTDEFSFLDKAAVIVQSDLEEDSNDASAAAAGSWRLCTVTQVEELKILMRLLPIWATSIVLSAAYAQLNTTFVQQGAAMNMRIMSFTIPAASMVSFEVFCVLAWVLVYGSVIVPLLRSFSPANGEPSQLRRMGAGRLLIAVAMAIAALVEMVRLDAAARGESLSIAWQMPQYFMLAGGEVFCYIAQLEFFYSEAPESMKSICTSLALLTVALGSYMSSFIYAVVNAFTAVDGRPGWISDNLNEGHLDYFFWVMSALCTLNFVVYSAFARNYKVKTVVS

SEQ ID NO: 408 - protein, 571 aa, Secale cereale
MDAMERGQGSPRLPKSRSPKVDEESLKVPLIESKKTGSRAPAVVLGFECLESTAFNGVATNLVLYLESVLHGSGLASASNVTTWIGTSFLTPVLGAILADTFWGNYNTILVSLVVYLLGMMLITFSALLPTTELCGLGSSCHPMFGAHTVAFSGLYLVAFGSGGVRAALLPFGAEQFDDDNAVDRERKMAFFSWFYICVDFGMIVSGLFLVWIQQNVSWGLGFGIATACIALAFVGFVLFTPMYKRSMPTGSPFKSLCQVVVAACRKVTLRVPADAAVLYEVSDKIDQPRIAHTKEFTFLDKAAVLVDSDLEEVANVDAAAAAVGSWRLCTVTQVEELKILMRLLPIWATSIVLSAAYAQLNTTFVQQGSAMDMRVMSFTIPAASMVSFEVICVLAWVLLYGSVIVPALRRLSPASGEPSQLRRMGAGRLLMAFAMAVAALVEMRRLEAAGSGESISIGWQMPQYFVLAGGEVFCYIAQLEFFYSEAPESMKSMCTSFALLTVALGSYASSLIYAVVDALTATGGRPGWISDDLNEGHLDYFFWTMAALCTLNFVVYSAFARNYQVKTVVS

SEQ ID NO: 409 - protein, 573 aa, Setaria italica
MDAGDAMERGQQRSPRLPESRSPKIQDESLTVPLIQDKKTGSKAPAVVLGFECLESTAFNGIGTNLVVYLESVLHGSNLASASNVTSWIGTSYLTPVFGAIVADTFWGNYNTILVSLVIYLLGMMLVTFSAFLPITELCGVGSSCHPVLGARNMAFLGLYLVAFGSGGVRAALLPFGAEQFDDDNAVDRERKISFFSWFYICVDFGMIVSGVFIVWVQQNVSWGLGFGIATACIALAFGGFVLATPMYKRTTPTGSPLKSLGQVVVAAFRKACLRVPSDAGLLYEVHDKIDQPKIAHTDEFAFLDKAAVVADSDLEEVTDADAAGSSSWRLCTVTQVEELKILLRLMPIWATSIVLSAAYAQLNTTFVQQGGAMDMRVASFTIPAASMVSFEVLCVLAWVLIYGSAIVPALRAVSPSRGEPSQLQRMGAGRLLMACAMAVAALVETKRLAAAGRGEAVSILWQMPQYFVLAGAEVFCYIAQLEFFYNEAPDTMKSMCTSLALLTVALGSYMSSLIYAVVDALTATGGRPGWIANNLNEGHLDYFFWTMAALCTLNFVVYSAFARNYKVKTVVS

SEQ ID NO: 410 - protein, 574 aa, Sorghum bicolor
MDAGDAMEKGQPERGSPKIQDESLTVPLIQDKKTGSKAPAVVLAFECLESTAFNGIGTNLVVYLETVLHGSNLASASSVTSWFGTSYLTPIFGAIVADTFWGNYNTILVSLLVYLLGMMLVTFSAFLPTTELCGVGSSCHPVLGSQNVAFLGLYLVAFGSGGVRAALLPFGAEQFDDDNAVDRERKMSFFSWFYICVDFGMIISGVFIVWIQQNISWGLGFGIATACVALAFGGFVLATPMYKRRMPTGTPLKSLGQVVVAAFRKVSLRVPADAGLLYEVHDMIEQPKIAHTDEFGFLDKAAVVAESDDPEEVTNDAAAAAAGSSSWRLCTVTQVEELKILLRLLPIWATSIVLSAAYAQLNTTFVQQGGVMDMRVMSSLTVPAASMVSFEVLCVLAWVLIYDAVILPALRAISPARGEPSQLQRMGAGRLLMACAMAVAALVEMRRLDAAGRGESISIAWQMPQYFVLAGGEVFCYIAQLEFFYDEAPETMKSMCTSFALLTVALGSYMSSLIYAVVDALTATGGGGRPGWISDNLDEGHLDYFFWTMAALCTLNFVVYSGFARNYKVKTVVS

SEQ ID NO: 411 - protein, 577 aa, Zea mays
MDAGDAMEKGQRSSSRLPERGAPKIQEESLTVPLIQNKKTGSKAPAVVLGFECLESTAFNGIGTNLVVYLETVLHGSNVASASSVTSWFGTSYLTPIFAAIVADTFWGNYNTILVSLLVYLLGMMLVTFSAFLPATELCGVGPWCHPMLGSRNVALFLGLYLVAFGSGGVRAALLPFGADQFDDDNAVDRERRMSFFSWYYICVDFGMIVSGVFIVWVQQNVSWGLGFGIATACIALAFGGFVLATPMYKRRMPTGTPLKSLGQVVVAALRKASLRVPADASLLYEVHDKIDEQPRITHTDEFGFLDKAAVVVETDLDLEEVTNDADAAGSSWRLCTVTQVEELKILLRLLPIWATSIVLSAAYAQLNTTFVQQGGVMDMRVMSLTVPAASMVSFEVLCVLAWVLIYGSAVVPALRAISPARGEPSQLQRMGAGRLLMACAMAVAALVETKRLDAAGRGESVSIAWQMPQYFVLAGGEVFCYIAQLEFFYNEAPETMKTMCTSFALLTVALGSYMSSLIYAVVDAFTATGGRPGWISDNLNEGHLDYFFWTMAALCTLNFVVYSGFARNYKVKTVVS

SEQ ID NO: 412 - protein, 434 aa, Hordeum vulgare
MEIKVLSSKLVKPAYSAGDAPMPATEYIPLSIFDRVTFEMQMAIIYAYAPPAPSTASIEKGLATVLAQYRGFAGQLGESPDGTPSVILNDRGARLFEASVDADLVDMAPSKPTPELLKLHPDLEAEHREVVLLQLTRFRCGSLAVGFTSNHVVADGHATSNFLVAWGRATRGLPMGLPPVHHHKELFKPRSSPRVEHDHRNREYYLPSPTDVVGHHGDAADNIVIHKAQFTKDFIAGLRAKASEGRGRPFSRFETILAHLWRTMTRARDLSPEETSKIRLSVDGRHRLGQPAEYFGNMVLWAFPRATVGDLLNRPLKHAAQVIHDEVARVDAAYFQSFVDFASSGAAEKEGLARSAVCKDAHCPDVEVDSWLTFPFYELDFGTGSPSYFMPAFFPTEGMLFLAPSNLGDGSVDAFVPLFQENLQAFKECCYSME

SEQ ID NO: 413 - protein, 434 aa, Secale cereale
MEVKVLSSRLVKPAYSAGEAPVPATEYIPLSIFDKVTFEMQMAIIYAFAPPAPTTASIEKGLATVLAQYRAFAGQLGESPDGTPSVILNDRGARLIEAAVDADLVDMAPSKPTPELLKLHPDLEAEHLEVVLLQLTRFRCGSLAVGFTSNHVVADGHATSNFLVAWGRATRGLAMGLPPVHPHADLFKPRSSPRVEHDHRNREYYLPSRTDVVGHHGDAADNIVIHKAHFTKDFIAGLRAKASEGRGRPFSRFETILAHLWRTMTRARDLSPEETSKIRLSVDGRHRLGQPAEYFGNMVLWAFPRANVGDLLNRPLKHAAQVIHDEVARVDGAYFQSFVDFASSGAAEKEGLARSAVCKDAHCPDVEVDSWLTFPFYELDFGTGSPSYFMPAYFPTEGMLFLAPSYLGDGSVDAFVPVFEHNLQAFKECCHSME

SEQ ID NO: 414 - protein, 431 aa, Aegilops tauschii
MKVKVLSSRLVKPAYTAGEAPVPATEYIPLSIFDKVTFEMQMAIIYAFAPPAPTTASIEKGLALVLAQYRAFAGQLGESPDGTPSVILNDRGARLIEASVDADLVDMAPSKPTPELLKLHPDLEAEHQEVVLLQLTRFRCGSLAVGFTSNHVVADGHATSNFLVAWGRATRGLPMGLPPVHHQKDLFKPRSSPRVEHEHRNREYYLPSPTDVVGHHGDAADNIVIHKAHFTKDFIAGLRAKASEGRGRPFSRFETILAHLWRTMTRARDLSPEETSKIRLSVDGRHRLRAGGRGCVRWASPRSAVGDLLNRPLKHAAQVIHDEVARVDGAYFQSFVDFASSGAAEKEGLARSAVCKDAHCPDVEVDSWLTFPFYELDFGTGSPSYFMPAYFPTEGMLFLAPSNFGDGSVDAFVPLFQENLQAFKECCYSME

SEQ ID NO: 415 - protein, 435 aa, Brachypodium distachyon
MEVKVLSSKLVKPAACNNGGATETEYIPLSIFDRVTFQMQMAIIYAFAPPAPSTAAIEKGLALVLGQYRAFAGQLGESPDGSPAVILNDRGARLVEASVDADLVDMAPAKPTPELLKLHPDLEGEQPLEEVVLLQLTRFRCGSLAVGFTSNHVVADGHATSNFLVAWGRATRGLPMGPPPVHHYHGLFKPRSSPRVEHDHRRREYHLPSPNDVVGHHGDAADNIVIHKAHFTKDFIAGLRADASVGRGRPFSRFETILAHLWRAMTRARGLGPEESSAIRLSVDGRHRLGKPAEYFGNMVLWAFPRSTVGDLLNRPLKHAAQVIHDEVARVDGAYFQSFVDFACSGAVQKEKLAPSAVLKDAHCPDVEVDSWLTFPFYELDFGTGSPSYFMPSYFPTEGMLFLAPSYIGDGSVDAFVPVFQHNLQAFKECCYSVE

SEQ ID NO: 416 - protein, 436 aa, Brachypodium distachyon
MEVKILSSKLVKPACSPHGGDTTETEYIPLSIFDRVTFQMQMAIIYAFAPPAPSTAAIEKGLAAVLGQYRAFAGQLGESPDGSPAVILNDRGARLVEASVDADLVDMAPAKPTPELLKLHPDLEGEQPLEEVVLLQLTRFRCGSLAVGFTSNHVVADGHATSNFLVAWGRATRGLPMGPPPVHHYHGLFKPRSSPRVEHDHRRREYYLPSLNDVVGHHGDAADSIVIHKAHFTKDFIAGLRAKVSEGRGRPFSRFEAILAHLWRTMTRARGLGPEETSAIRLSVDGRHRLGKPAEYFGNMVLWAFPRSTVGDLLSRPLKHAAQVIHDEVARVDGAYFQSFVDFACSGAVQKEKLAPSAVLKDAHCPDVEVDSWLTFPFYELDFGTGSPSYFMPSYFPTEGMLFLAPSYIGDGSVDAFVPVFQHNLQAFKECCYSME

SEQ ID NO: 417 - protein, 437 aa, Oryza sativa
MEVKVLSSKLVKPAYNGGVAAAPDVEYIPLSIFDKVTYKMQMAIIYAFPPPAPSTAAIEKGLAAVLAQYRAFAGQLGESPDGEAAVVLNDRGARLVEAAVDADLVDMAPAKPTPELLRLHPDLEGELQEVVLLQLTRFRCGSLAVGFTSNHVVADGHATSNFLVAWGRATRGLPMGAPPVHHHAALFKPRPSPHVEHDHRNREYYLPAAGDDSHGHGDGGAADNIVIHKAHFTKDFIAGLRAAASEGRGRPFSRFETILAHLWRTMTRARGLSPDEASTIRLSVDGRHRLGAPAEYFGNLVLWAFPRATVGDLLTRPLKHAAQVIHDEVARVDGAYFRSFLDFALSGAGGDKEGLAPSAVLKDVLCPNAEVDSWLTFPFYELDFGTGSPTYFMPSYFPTEGMLFLVPSYLGDGSVDAFVPVFNHNLEAFKECCYSME

SEQ ID NO: 418 - protein, 436 aa, Secale cereale
MEVKVLSSRLVKPAYKAGAPATEYIPLSIFDTVTYQIQMAIIYAFAPPAPSTAAIEKGLAAVLAHYRAFAGQLGQSPDGAPAVVLNDRGARLVEASVDANLVDMAPAKPTPALLKLHPDLDAEHQEVVVLQLTRFRCGSLAVGFTSKHVVADGHATSNFLVAWGRATRGLPMGLPPVHHQKGLFKPRSPPARLEHDHRSREYHRPSPTAAAGGHHHGVDGAESNIIIHKAHFTKDFIAGLRARASEGRGRPFSRFETILAHLWRTMTRARDLSPGEATSIRISVDGRHRLGRPAEYFGNLVLWAFPRTTVGDLLGRPLKHAAQTIHEEVARVDGAYFQSFVDFACSGAAEKEGLAPSAVLKDVVCPDVEVDSWLTFPFYELDFGTGSPSYFMPSYFPTEGMLFLAPSYLGDGSVDAFVPVFRHNLQAFKECCYSME

SEQ ID NO: 419 - protein, 444 aa, Zea mays
MEVKVLSSKLVKPAYNAGAGPAPAVSADEYTPLTIFDVVTYKMQMAIIYAFPPPAPSTAAIENGLAAVLAEYRAFAGQLGVAPDGTPAVLLNDRGARLVEAAVDADLVDMAPAKPTPELLRLHPDLEEEELQEVVLLQLTRFRCGSLAVGFTSNHVVADGHATSNFLVAWGRATRGLPTGLPPVPRQAGLFKPRPSPRVDFDHRSREWYLPSPAETEKQHGHGREGAAAAESIVIQKAHFTKDFIARLRAKASEGRGRPFSRFETVLAHLWRAMTRARGLSPDETSQIRLSVDGRHRLGLPAEYFGNLVLWAFPTATVADLLGRPLKHAAQVIHDEVASVDGSYFRSFIDFATSGAAEREGLAPSAVCKDVLCPNVEVDSWLTFPFYELDFGTGSPTYFMPSYFPTEGMLFLVPSYIGDGSVDAFVPVFQQNLEAFKECCYAMD

SEQ ID NO: 420 - protein, 245 aa, Hordeum vulgare
MEHLTISLIDHTMASSSPSTMIQMPPTPHTNGSQPTAPTTPKDAGDFPTMGHGAAAGRAPTATDKVMSSAANLAQLLPTGTVLAYQALSPSFTNHGKCLSSNQWLTAALVVVLTISCILFSFTDSVLGRDKKLYYGIATPRGFNVFNFSDEEEKLQWTPDEFRRLRIRPLDFMRAVFTALVFLTVAFSDVGLQNCFFPNAGRNTEELLKNLPLGIAFLSSFVFMIFPTKRKGIGYTDTTPPRKLT

SEQ ID NO: 421 - protein, 245 aa, Aegilops tauschii
MEQLRIFLVERTMASPPSSTVIQMPPTPHNNGEPTLAPATPKDAGDVPTTAPAAAAGPAPTATDKVMSSAANLAQLLPTGTVLAYQALSPSFTNHGKCFSSNQWLTAALVIVLAVLCVLFSFTDSVLGRDKKLYYGIATLRGFNVFNFSDEEEKLQWTPAEFRRLRIRPLDFVRAVFTALVFLTVAFSDVGLQNCFFPNTGMNTQELFKNLPLGIAFLSSFVFMIFPTKRKGIGYSDTTPRQKLT

SEQ ID NO: 422 - protein, 106 aa, Triticum aestivum
MKSSTLMVIMVLQATLVMGIFILPDMCNGDVHATSVGEGKAIDLNLGKLRCCINCNSSSGLYTCDDVVKICDPVCKRCAVVKKNLVKEFRCTDTFLGLCENPCKNH

SEQ ID NO: 423 - protein, 609 aa, Triticum aestivum
MAGGGEGAAGGTGEMRSLALTPTWSVATVLTLLVAASLIVERSIHRLSNWLKKTHRNPLHKAMEKMKEEMMLLGFISLLLAATSRMISGICIDSKYYNSRFSPCNKEEAEQSLSTEHDLTRKRNHIIDAILHRSLRRNLKAQSHQVESCHEGFESFVSHEGLEQLHRFIFVMAVTHVTYSCLTMLLAILKVHTWRKWEDEAFRDNHESFSQIAYASATRRQPPALTKSSSFRFWSQNNAVMWVFCFLAQFGQSVVRADYLILRKGFIMNHNLAPTYDFHTYMIRSMEEEFEKIVGVSGVLWGFVVAFMLFNVDGSNLYFWIAILPVALVLLVGAKLQHIIAILTSEGAKLTAFGPRIKPRDDLFWFKKPKFLLWLIHFVLFQNAFELASFFWFWWQFGYESCFIKNHLLVYCRLVLGFAGQFLCSYSTLPVYALVTQMGSKYKAALIPNRIRETMHGWGKDTRKKRKKRRGDDSTIRTETSTVCSLDYEDEDDDGHGHSDDATTPRLPPYLKIELRPMRGGGGIPTPGMPSHQLPTGGSNWTPGGSSQHALLQRQGSASASAPSSPPPSSHDRGVVRSASMPGIAAVATIASTIGLSTPPTRLSDDAHA

SEQ ID NO: 424 - protein, 609 aa, Hordeum vulgare
MAGGEGAGAGGGTGEMRSLALTPTWSVATVLTLLVAASLIVERSIHRLSNWLKKTHRNPLYKAMEKMKEEMMLLGFISLLLAATSRIISGICIDTKYYNSRFSPCTKEEVEESLSAEHALTRKRNHVIDAILHRSLRRNLKAQYHQVQACHEGFESFVSHEGLEQLHRFIFVMAVTHVTYSCLTMLLAILKVHTWRKWEDEAFRDNHESFSQIAYASATRRQPPALTKSSSFRFWSQNNAVMWVFCFLAQFGQSVVRADYLILRKGFIMNHNLPPTYDFHTYMIRSMEEEFEKIVGVSGVLWGFVVAFMLFNVDGSNLYFWIAILPVALVLLVGAKLQHIIAILTSEGAKLTAFGPRIKPRDDLFWFKKPKFLLWLIHFVLFQNAFELASFFWFWWQFGYDSCFIKNHLLVYCRLVLGFAGQFLCSYSTLPVYALVTQMGSKYKAALIPNRIRETMHGWGKATRKKRKKRRGDDSTIRTETSTVCSLDYEDEDDDGHGHSDDATTPRLPPYLKIELRPMRGGGGIPRPGMLSHHIPTGGSNWTPGGSSQHALLQRQGSASASAPSSPPPSSHDRGVVRSASMPGIASVATIASTIGLTTPPSRLSDANS

SEQ ID NO: 425 - protein, 600 aa, Brachypodium distachyon
MAGGEGAAAAAGEAGEMRSLALTPTWSVATVLTLLVAGSLVIERSIHRLSNWLKKTHRNPLHKAMEKMKEEMMLLGFISLLLAATSRIISGICIDSKYYNSKFSPCTKEEVEESMSAEHTLAEGILHHSLRRNLKAQYHHVQACPEGYESFVSHEGLEQLHRFIFVMAVTHVTYSCLTMLLAILKVHTWRKWEDEAFRDNHESFSQIAYVSATRRQPPALTKSYSFRFWSQNNAVMWVFCFIAQFGQSVVRADYLILRKGFIMNHNLPPTYDFHNYMIRSMEEEFEKIVGVSGVLWGFVVAFMLFNVDGSNLYFWIAILPVTLVLLVGAKLQHVIATLTSEGARMTSFGPRIKPRDDLFWFKKPKFLLWLIHFVLFQNAFELASFFWFWWQFGYDSCFIKNHLLVYCRLVLGFAGQFLCSYSTLPVYALVTQMGSKYKAALIPNRIRETMHGWGKAARKRRRKRRGDDSTIRTETSTVCSLDYEDEDDDDDHDHATPSRPPLPYLKIELQPTRSAGGGIPRPGTTPVHRHSISTLPCSGSSQHALLQQQASSSAPSSPPASNRGRGVTRSASMPGIASLTTMPGPGGSIGTPTCLSDDHA

SEQ ID NO: 426 - protein, 1121 aa, Panicum virgatum
MAEDHGSSRHMSASQKELGDEDARVVRVGDAARTNERLDFAGNAVRTAKYSPLTFLPRNLLEQFHRLAYVYFLVIAVLNQLPQLAVFGRGASVMPLAFVLAVTAVKDAYEDWRRHRSDRAENGRLAAVLSPDAAGGAQFLPTKWKHVRVGDVVRVVSDESLPADMVLLATGEPTGVAYVQTLNLDGESNLKTRYAKQETLSTPPERLAGAVIRCERPNRNIYGFQANLELEGESRRIPLGPSNIVLRGCELKNTAWAVGVVVYAGRETKAMLNNAGAPKKRSRLETHMNRETLFLSAILVVLCTLVAALSGVWLHTHEEELELAQFFHKKDYLKRDDNNDYENYNYYGIAAQIVFIFLMAVIVFQIMIPISLYISMELVRLGQAYFMIRDTKLFDESSNTRFQCRALNINEDLGQIKCIFSDKTGTLTQNKMEFRCANIDGVDYSDIARQRPAEGDRIWAPKISVNTDQELVKLIRDGGDTEQGRQTREFFLALATCNTIVPMVTDGPDPKKKVIDYQGESPDEQALVSAAAAYGFVLVERTSGHIVIDVLGEKQRYDVLGLHEFDSDRKRMSVIIGCPDKSVKLFVKGADSSMFEVIDKMLNSDVIQATEKHLHSYSSLGLRTLVIGMRELSQEEFQEWQMAYEKASTALLGRGNLLRGVAADIERNLRLLGASGIEDKLQDGVPEAIEKLREAGIKVWVLTGDKQETAISIGYSCKLLTRDMTQIVINSRSRDSCRRSLDDAITMVNKYQSFSTDPQLRVPLALIIDGNSLVYIFDTDWEEKLFEIAIACDVVLCCRVAPLQKAGIVDLIKKRTSDMTLAIGDGANDVSMIQMADVGIGISGQEGRQAVMASDFAMGQFRFLVPLLLVHGHWNYQRMAYMILYNFYRNATFVFVLFWYVLYTGFTLTTAITEWSSVLYSVIYTAVPTIVVAILDKDLSRRTLLKYAQLYGPGQREENYNLRLFIFIMMDSVWQSVACFFIPYLAYRKSVIDSSSLGDLWTLSVVILVNIHLAMDVIRWNWITHAAIWGSIAATWICVMILDSIPTLPGFWAIYKVMGTGLFWALLLAVTVVGMIPHFAAKAFIEYFIPSDIQIAREMEKSQDTHDATHPEVQMSSVSRA

SEQ ID NO: 427 - protein, 1121 aa, Panicum virgatum
MAEDHGSSRHMSASQKELGDEDARVVRVGDPARTNERLDFAGNAVRTAKYSPLTFLPRNLFEQFHRLAYVYFLVIAVLNQLPQLAVFGRGASVMPLAFVLLVTAVKDAYEDWRRHRSDRAENGRLAAVLSPDATGGAQFLPTKWKHVRVGDVVRVVSDESLPADMVLLATSEPTGVAYVQTLNLDGESNLKTRYAKQETLSTPPELLAGAVIRCERPNRNIYGFQANLELEGESRQIPLGPSNIVLRGCELKNTTWAVGVVVYAGRETKAMLNNAGTPKKRSRLETHMNRETLFLSAILVVLCTVVATLSGVWLRTHEDELELAQFFHKKDYLKRDDNNDYENYNYYGIAAQIVFIFLMAVIVFQIMIPISLYISMELVRLGQAYFMIRDSKLFDESSNTRFQCRALNINEDLGQIKCIFSDKTGTLTQNKMEFRCASIDGVDYSDIARQRPAEGDRIWAPKISVNTDQELVKLIRDGGDTEQGRQTREFFLALATCNTIVPMVTDGPDPNKKVIDYQGESPDEQALVSAAAAYGFVLVERTSGHIMIDVLGEKQRYDVLGLHEFDSDRKRMSVIIGCPDKSVKLFVKGADSSMLGVIDKMLNSDVIQATEKHLHSYSSLGLRTLVIGMRELSQEEFQEWQMAYEKASTALLGRGNLLRGVAADIERNLRLLGASGIEDKLQDGVPEAIEKLREAGIKMWVLTGDKQETAISIGYSCKLLTRDMTQIVINSRSRDSCRKSLDDAITMVNKYQSFSTDPQLRVPLALIIDGNSLVYIFDTDWEEKLFEIAIACDVVLCCRVAPLQKAGIVDLIKKRTSDMTLAIGDGANDVSMIQMADVGIGISGQEGRQAVMASDFAMGQFRFLVPLLLVHGHWNYQRMAYMILYNFYRNAIFVFVLFWYVFYTGFTLTTAITEWSSVLYSVIYTAVPTIVVAILDKDLSRRTLLKYAQLYGPGQREENYNLRLFIFIMMDSVWQSIACFFIPYLAYRKSVIDSSSLGDLWTLSVVILVNIHLAIDVVRWNWITHAAIWGSIAATWICVMILDSIPTLPGFWAIYKVMGTGLFWALLLAVTVVGMIPHFAAKAFTEYFTPSDIQIAREMEKSQDTHDATHPEVQMSSVSRA

SEQ ID NO: 428 - protein, 1120 aa, Oryza sativa
MAEEHDHHGSSRHMSASQKELGDEDARVVRVGDAERTNEQLEFAGNAVRTAKYSPLTFLPRNLFEQFHRLAYVYFLVIAVLNQLPQLAVFGRGASVMPLAFVLTVTAVKDAYEDWRRHRSDRAENGRLAAVLLSPGAGTHFAPTKWKHVRVGDVVRVYSDESLPADMVLLATSDPTGVAYVQTLNLDGESNLKTRYAKQETLTTPPEQLTGAVIRCERPNRNIYGFQANLELEGESRRIPLGPSNIVLRGCELKNTTWAIGVVVYAGRETKAMLNNAGAPTKRSRLETQMNRETLFLSAILVVLCSLVAALSGVWLRTHKADLELAQFFHKKNYVSDDKNANYNYYGIAAQIVFVFLMAVIVFQIMIPISLYISMELVRLGQAYFMIRDTTLYDASSNSRFQCRALNINEDLGQVKCVFSDKTGTLTQNKMEFRCASVGGVDYSDIARQQPVEGDRIWVPKIPVNVDGEIVELLRNGGETEQGRYAREFFLALATCNTIVPLILDGPDPKKKIVDYQGESPDEQALVSAAAAYGFVLVERTSGHIVIDVLGEKQRFDVLGLHEFDSDRKRMSVIIGCPDKTVKLFVKGADNSMFGVIDKTMNPDVVRATEKHLHAYSSLGLRTLVIGVRELSQEEFQEWQMAYEKASTALLGRGGLLRGVAANIEQNLCLLGASGIEDKLQDGVPEAIEKLREAGIKVWVLTGDKQETAISIGFSCKLLTREMTQIVINSNSRESCRKSLDDAISMVNKLRSLSTDSQARVPLALIIDGNSLVYIFDTEREEKLFEVAIACDVVLCCRVAPLQKAGIVDLIKKRTSDMTLAIGDGANDVSMIQMADVGIGISGQEGRQAVMASDFAMGQFRFLVDLLLVHGHWNYQRMGYMILYNFYRNATFVFVLFWYVLNTGFTLTTAITEWSSVLYSVIYTAVPTIVVAILDKDLSRRTLLKYPQLYGAGQREESYNLRLFIFVMLDSIWQSLAVFFIPYLAYRKSTIDGASLGDLWTLAVVILVNIHLAIDVIRWNWITHAAIWGSIVATLICVMVIDSIPILPGFWAIYKVMGTGLFWALLLAVIVVGMIPHFVAKAIREHFLPNDIQIAREMEKSQDSHDVTHPEIQMSTVARA

SEQ ID NO: 429 - protein, 1124 aa, Brachypodium distachyon
MAEDHGSSRNMSMSMSQKELGDEDARAVRVGDAARTNERLEFAGNAVRTAKYSPFTFLPRNLFEQFHRLAYVYFLAIAVLNQLPQLAVFGRGASVMPLAFVLTVTAVKDAYEDWRRHRADRAENNRLAAVLSTVPGAGAAEYVPTKWKDVRVGDIVRVAANESPPADMVLLATSDTTGVAYVQTLNLDGESNLKTRYAKQETLTTRVEHLAGAAVIRCERPNRNIYGFQANLELQEESRRIPLGPSNIVLRGCDLKNTAWAVGVVVYAGRETKAMLNNAGTPTKRSRLETHMNRETLFLSGILIVLCSLVAALSGVWLRTHATQLELAQFFHKKDYLNSDKENSNYNYYGIAAQIVFNFLMAVIVFQIMIPISLYISMELVRLGQAYFMIRDARLYDASSDSRFQCRALNINEDLGQVKCIFSDKTGTLTQNKMEFRCASIDGVDYSDITRQRPVEGDLAWVPKVPVNVDREVMALVRNVGATEQGRYTREFFIALATCNTIVPLILDGPDPKKKVIDYQGESPDEQALVSAAAAYGFVLVERTSGHIVIDVLGEKQRFDVLGLHEFDSDRKRMSVIIGCPDKTVKLFVKGADSSMFGIIDKTLNPDVVQATEKHLHSYSSVGLRTLVIGVRELTQTEFLEWQMAYERASTALLGRGNLLRSVAANIERNMRLLGASGIEDKLQDGVPEAIEKLRQAEIKVWVLTGDKQETAISIGYSCKLLTQDMTQIVINSNSRESCRRSLDDAISMVHKLRSLSTDSQSRVPLALIIDGNSLVYIFDDTEREEKLFEVAIACDVVLCCRVAPLQKAGIVDLIKKRTSDMTLAIGDGANDVSMIQMADVGIGISGQEGRQAVMASDFAMGQFRFLVPLLLVHGHWNYQRMGYMILYNFYRNATFVFVLFWYVLYTGFTLTTAITEWSSVLYSVIYTAVPTIVVAILDKDLSRRTLLKYPQLYGAGQREENYNLRLFIYIMMDSVWQSLAVFFIPYLAYRKSAIDSASLGDLWTLSVVILVNIHLAMDVIRWTWITHAAIWGSIVATWICVIVIDSIPILPGFWAIYKVMGTGLFWALLLAVIVVGMIPHFAAKAIREHFIPNDIQIAREMEKLKHSHELTHPEVQMSTFAQS

SEQ ID NO: 430 - protein, 1121 aa, Triticum aestivum
MAEDHGSSRHMSSMSMSHKELGDDDARVVHVGDAERTNERLQFAGNAVRTAKYSPLTFLPRNLFEQFHRLAYVYFLVIAVLNQLPQLAVFGRGASVMPLAFVLAVTAVKDAYEDWRRHRSDRAENNRIAAVLSPGVGAQFVPIEWKHVRVGDVVRVGANESPPADMVLLATSDTTGVAYVQTLNLDGESNLKTRYAKQETLTTPLEHLAGAVVRCERPNRNIYGFQANLELQGEGRRIPLGPSNIVLRGCDLKNTSWAVGVVVYAGRETKAMLNNAGTPTKRSRLETHMNRETLFLSGILIVLCSAVATLSGVWLRTHQTDLELAQFFHKKDYLKVGKEDNENYNYYGIAAQIVFNFLMAVIVFQIMIPISLYISMELVRLGQAYFMIRDAKLYDASSDSRFQCRALNINEDLGQVKCVFSDKTGTLTQNKMEFRCASIDGVDYSDVARQRPVEGEPAWAPKMPVKVDREVMELVRNGGATEQGMNAGEFFLALATCNTIVPLIIDGPDPKKKVIDYQGESPDEQALVSAAAAYGFVLVERSSGHIVIDVLGQKQRFDVLGLHEFDSDRKRMSVIIGCPDKTIKLFVKGADSSMFGIIDKTLNPDVVQATEKHLHSYSSVGLRTLVIGVRELSQSEFQEWQMAYEKASTALLGRGNLLRSVAANIERNMRLLGASGVEDKLQDGVPEAIEKLREAGIKVWVLTGDKQETAISIGYSCKLLTRDMTQIVINSNSRESCRKSLDDAISMVNKLRSLSTDSQSRVPLALIIDGNSLVYIFDTDREEKLFEVAIACDVVLCCRVAPLQKAGIVDLIKKRTSDMTLAIGDGANDVSMIQMADVGIGISGQEGRQAVMASDFAMGQFRFLVPLLLVHGHWNYQRMSYMILYNFYRNATFVFVLFWYVLYTGYTLSTAINEWSSVLYSVVYTSAPTVIVAILDKDLSRRTLLKYPQLYGAGQREESYNLRLFIFIMVDSVWQSVAVFFIPYLAYKNSAIDSASLGDLWTLSVVILVNIHLAMDVIRWTWITHAAIWGSIVATWICVIIIDSIPTLPGFWAIYEVMGTALFWALLLAVIVVGMIPHFAAKAIREHFMPNDIQIAREMEKSRDSRDANHPEVQMSTSTRA

SEQ ID NO: 431 - protein, 1122 aa, Secale cereale
MAEDHGSSRHMSSMSMSHKELGDDDARVVHVGDADRTNERLQFAGNAVRTAKYSPLTFLPRNLFEQFHRLAYVYFLVIAVLNQLPQLAVFGRGASVMPLAFVLAVTAVKDAYEDWRRHRSDRAENNRLAAVLSPGAGAQFVPTEWKHVRVGDVVRVGANESPPADMVLLATSDTTGVAYVQTLNLDGESNLKTRYAKQETLTTPLEHLAGAVVRCERPNRNIYGFHANLELPGESRRIPLGPSNIVLRGCDLKNTSWAVGVVVYAGRETKAMLNNAGTPTKRSRLETHMNRETLFLSGILIVLCSVVATLSGVWLRTHQTDLELAQFFHKKDYLKVGKEGNENYNYYGIAAQIVFNFLMAVIVFQIMIPISLYISMELVRLGQAYFMIRDAKLYDASSDSRFQCRALNINEDLGQVKCVFSDKTGTLTQNKMEFRCASIDGVDYSDVARQRPVEGEPAWVPKVPVKVDRQVLELVRNGGATEQAMNAGEFFLALATCNTIVPLILDDGPDLKKKVIDYQGESPDEQALVSAAAAYGFVLVERSSGHIVIDVLGQKQRFDVLGLHEFDSDRKRMSVIIGCPDKTIKLFVKGADSSMFGIIDKTLNPDVVQATEKHLHSYSSVGLRTLVIGVRELSQSEFQEWQMAYEKASTALLGRGNLLRSVAANIERNMRLLGASGVEDKLQDGVPEAIEKLREAGIKVWVLTGDKQETAISIGYSCKLLTRDMTQIIINSNSRESCRKSLDDAISMVNKLRSLSTDSQSRVPLALIIDGNSLVYIFDTDREEKLFEVAIACDVVLCCRVAPLQKAGIVDLIKKRTSDMTLAIGDGANDVSMIQMADVGIGISGQEGRQAVMASDFAMGQFRFLVPLLLVHGHWNYQRMSYMILYNFYRNATFVFVLFWYVLYTGYTLSTAINEWSSVLYSVVYTSAPTVIVAILDKDLSRRTLLKYPQLYGAGQREESYNLRLFIFIMVDSVWQSVAVFFIPYLAYKNSAIDSASLGDLWTLSVVILVNIHLAMDVIRWTWITHAAIWGSIVATWICVIIIDSIPTLPGFWAIYEVMGTALFWALLLAVIVVGMIPHFAAKAIREHFMPNDIQIAREMEKSQDSGDAYHPEVQMSTSTRA

SEQ ID NO: 432 - protein, 1121 aa, Hordeum vulgare
MAEDHGSSRHMSSMSMSHKELGDDDARVVHVGDADRTNERLEFAGNAVRTAKYSPLTFLPRNLFEQFHRLAYIYFLVIAVLNQLPQLAVFGRGASVMPLALVLAVTAVKDAYEDWRRHRSDRAENNRLAAVLSPGAGAQFVPTEWKHVRVGDVVRVGANESPPADMVLLATSDTTGVAYVQTLNLDGESNLKTRYAKQETLTTPLEHLAGTVVRCERPNRNIYGFQANLELQGESRRIPLGPSNILLRGCDLKNTSWAVGVVVYAGRETKAMLNNAGTPTKRSRVETQMNRETLFLSGILIVLCSAVATLTGVWLRTHQADLELAQFFHKKDYLKVGKDGNENYNYYGIAAQIVFNFLMAVIVFQIMIPISLYISMELVRLGQAYFMIRDAKLYDASTDSRFQCRALNINEDLGQVKCVFSDKTGTLTQNKMEFRCASIDGVDYSDVARQRPVEGEPAWVPKVPVNVDREVMELVRNGGATEQGMNAGEFFLALATCNTIVPLIVDGPDPKKKVIDYQGESPDEQALVSAAAAYGFVLVERSSGHIVIDVLGQKQRFDVLGLHEFDSDRKRMSVIIGCPDKTVKLFVKGADSSMFGIIDKTLNPDVVQATEKHLHSYSSVGLRTLVIGVRELSQAEFQEWQMAYEKASTALLGRGNLLRSVAANIERNMRLLGASGVEDKLQDGVPEAIEKLREAGIKVWVLTGDKQETAISIGYSCKLLTRDMTQIVINSNSRESCRKSLDDAISMVNKLRSLSSDSQSRVPLALIIDGNSLVYIFDTDREEKLFEVAIACDVVLCCRVAPLQKAGIVDLIKKRTSDMTLAIGDGANDVSMIQMADVGIGISGQEGRQAVMASDFAMGQFRFLVPLLLVHGHWNYQRMSYMILYNFYRNATFVFVLFWYVLYTGYTLSTAINEWSSVLYSVVYTSAPTVIVAILDKDLSRRTLLKYPQLYGAGQREESYNLRLFIFIMVDSVWQSVAVFFIPYLAYKNSAIDSGSLGDLWTLSVVILVNIHLAMDVIRWTWVTHAAIWGSIVATWICVIIIDSIPTLPGFWAIYKVMGTALFWALLLAVIVVGMMPHFAAKAIREHFMPNDIQIAREMEKSQDSRDVYHPEVQMSTSTRA

SEQ ID NO: 433 - protein, 589 aa, Panicum virgatum
MGKQLSMAASILCMAIVALAVVGDGEAAVVEHTFVVHEMNMTHLCNTTKVYVVNGQLPGPQLDVTDGDTVVVHLVNQLPHGVTIHWHGVRQLRSCWADGAGYVTECPVPPGGNRTYRFDVAGQVGTLWWHAHVTCLRASIHGAIVVRPKDGRYPFPTPAKDVPIVIGEWWQLDLVELDRRNLDGNFEDDPLSATINGKLGDLSNCSGVPEESFVLDVERGKSYLLRFINAALFSEYFFKVAGHTFTVVGADANYLTPFRTDMVTIAPGETIDVLMIADAPPGHYHMTAVANQPPPPDLQIRALSTRGLVRYAGVRADNNGLPVPAPLMPGQYDTLPSYYFRGNFTGLAFPGRHRVPARVDERLFVTLGLGSICRGGKKDCKLRRSNETITVATMNNVSFHHQTAASLLERYYDGAGEGVYTEDFPDNPPRPYNYTDMDLIPVGPLEEVLEPTTKAIRLRRFKYNSSVEIVFQSTALLQSDPNPMHLHGYDFFVLAQGLGNFDPKRDVKKFNYYNPQLRNTVHVPRVGWVAIRFVTDNPGMWYLHCHFEFHIVMGMATAFIVEDGPTPETSLPPPPPDFQRCGTNGFSKP

SEQ ID NO: 434 - protein, 589 aa, Panicum virgatum
MAAMAAPVLCMALVIALAATVAPVGEAAVVKHTFVVHEMNVTHLCNTTKIYVVNGQFPGPTLDVTDGDTVVVRVVNRLDHGLTIHWHGVRQLRSCWADGAGFVTECPIPPGGNHTYRFNLTGQVGTLWWHAHVTCLRATINGAIVVRPKDGRYPFPTPAGDVPVLIGEWWQLDLVELDRRMADGNFDDNPLSATINGKLGDLSNCSGVPEESFVLDVERGKSYLLRIVNTALFSEYYFKVAGHKFTVVGADANYLTPFETDMVTIAPGEAIDLLMTADAPPGHYHMIALANQPPEPDPQIPLFVSRGLVRYAGVRADNNGLPVPAPLMPDQHNTMPSYYFHGNLTGLAYPGRHRVPAHVDERLFVTLGLGSLCRGGGKVCKRRRSNETIVVATMNNVSFHHPTTTSLLERYYDGAGEGVYTEDFPANPPHPYNYTNRDLIPPGPLEEALEPTVKATRLRRFRYNTSVEIVFQSTALLQSDSNPMHLHGYDFFVLAQGLGNFNPKRDVKKFNYHNPQLRNTVQVPRTGWAAVRFVTDNPGMWYLHCHFEFHIVMGMATAFIVEDGPTPETSLPPPPPEFKRCGANGLTQP

SEQ ID NO: 435 - protein, 434 aa, Triticum aestivum
MEVKVLGSKLVKPAYNAGAAPAPSTEYIPLSIFDKVTFNMQMAIIYAFAAPAPSTAAIENGLATVLAQYRAFAGQLGEAPDGTPSFILNDRGARLVEATVDAELIDMAPAKPTPELLKLHPDLEAEHEEVVLLQLTRFRCGSLAVGFTSNHVVADGHATSNFLIAWGRATRGLPIGLPPVHHHKDLFKPRSSPRVEHDHRNREYYLPSPTDVVGHHGDAADNIVIHKAHFSKDFIAGLRAKASEGRGRPFSRFETILAHLWRTMTRARDLSPEETTKIRLSVDGRHRLGQPAEYFGNMVLWAFPRSTVGDLLNRPLKHAAQVIHDEVAKVDGAYFQSFVDFASSGAAEKEGLARSAVCKDAQCPDVEVDSWLTFPFYELDFGTGSPSYFMPAYFPTEGMLFLVPSNFGDGSVDAFVPLFQENLQAFKECCYSME

SEQ ID NO: 436 - protein, 434 aa, Secale cereale
MEVKVLGSRLVKPARNAGPAPAPSTEYIPLSVFDKVTFNMQMAIIYAFAAPAPTTAAIENGLATVLAQYRAFAGQLGEGPDGTPSFVLNDRGARLVEATVDADLIDMAPSKPTPELLKLHPDLEGEHEEVVLLQLTRFRCGSLAVGFTSNHVVADGHATSNFLVAWGRATRGLPIGLPPVHHHKDLFKPRSPPRVEHDHRNREYYLPSPTDVVGHHGDAADNIVIHKAHFSKDFIAGLRAKASEGRGRPFSRFETILAHLWRTMTRARDLSPEETSKIRLSVDGRHRLGQPAEYFGNMVLWAFPRSTVGDLLNRPLKHAAQVIHDEVAKVDGAYFQSFVDFASSGAAEKEGLARSAVCKDAQCPDVEVDSWLTFPFYELDFGTGSPSYFMPAYFPTEGMLFLAPSNFGDGSVDAFVPLFQENLQAFKECCYSME

SEQ ID NO: 437 - protein, 408 aa, Secale cereale
ARSSRPYCKVTFNMQMAIIYAFAAPAPTTAAIENGLATVLAQYRAFAGQLGEAPDGTPSFVLNDRGARLVEATVDADLIDMAPSKPTPELLKLHPDLEGEHEEVVLLQLTRFRCGSLAVGFTSNHVVADGHATSNFLVAWGRATRGLPIGLPPVHHHKDLFKPRSPPRVEHDHRNREYYLPSPTDVVGHHGDAADNIVIHKAHFSKDFIAGLRAKASEGRGRPFSRFETILAHLWRTMTRARDLSPEETSKIRLSVDGRHRLGQPAEYFGNMVLWAFPRSTVGDLLNRPLKHAAQVIHDEVAKVDGAYFQSFVDFASSGAAEKEGLARSAVCKDAQCPDVEVDSWLTFPFYELDFGTGSPSYFMPAYFPTEGMLFLAPSNFGDGSVDAFVPLFQENLQAFKECCYSME

SEQ ID NO: 438 - protein, 434 aa, Setaria italica
MEVKVLSSKLVRPAYNAGAAPPAGGEYIPLSVFDRVTYKMQMAIIYAFPPPAPSTAAIEKGLATVLSEYRAFAGQLGSAPDGTPAVLLNDRGARFVEAAVDADLVDMAPAKPTPELLRLHPDLEGEELQEVVLLQLTRFRCGSLAVGFTSNHVAADGHATSNFLVAWGRATRGLPTGPSPVYHQAGLFKPRASPRVEHDHRRREYRPAGGEPDHGHGEGAENIVIHKAHFTKDFIASLRGRASEGRGRPFSRFETILAHLWRTMTRARGLNPDETSQIRLSVDGRHRLGLPAEYFGNLVLWAFPTATVADLLGRPLKHAAQVIHDEVARVDGAYFRSFIDFASSGAVEREGLMPSAVCKDVLCPDVEVDSWLTFPFYELDFGTGSPTYFMPSYFPTEGMLFLVPSYIGDGSVDAFVPVFQHNLEAFKECCYAME

SEQ ID NO: 439 - protein, 367 aa, Hordeum vulgare
MTTSQDVVVSEMGIGAGGAAMPGSGGAGLFACRSAASAGAMSMRQTYLDLAAAAARSANCTWAELEVMRAASPTRSRPGADVDDLTAWMRKHPSALAKFEQIASASKGKKIVMFLDYDGTLSPIVANPDAAYMSDAMREAVRDVAKHFPTAIVSGRCREKVHNFVGLSELYYAGSHGMDIKGPSSNPESVVCQPAREFLPVIEEVYKVLVEKTKSTPGAKVENNKFCLSVHFRCVDEKRWNFLAEQVKAVMKDYPMLKLTQGRKVFELRPSIMWDKGKALEFLLESLGFASCSDVLPVYIGDDRTDEDAFKVLRKRGQGVGILVSKSAKETSASYSLQDPAEVMEFLLRLVEWKRRSATPPMVRPRV

SEQ ID NO: 440 - protein, 360 aa, Secale cereale
MTTSQDVVVSEMGIGAGGAAMPGSGAAGLYACRSAASAGAMSMRQTYLDFAAAAARSASCTWVELEAMRASSPPRSRAGADVDELTAWMRKHPSALGKFEQIASASKGKKIVMFLDYDGTLSPIVANPDAAYMSDAMREAVRDVAKHFPTAIVSGRCRDKVHNFVGLSELYYAGSHGMDIKGPGSNPESVLCQPASEFLPMIDEVYKVLVEKTKSTPGAKVENNKFCLSVHFRCVDEKRWNFLAEQVKAVIKDYPMLKLTQGRKVFELRPSIMWDKGKALEFLLESLGFASCSDVLPVYIGDDRTDEDAFKVLRKRGQGVGILVSKCAKETSASYSLQDPADGPVGSSRGLRARWSGTRS

SEQ ID NO: 441 - protein, 396 aa, Aegilops tauschii
MTTSQDVVVSEMSIGAGGAAMPGSGAAGLFACRSAASAGAMSMRQTYRDLAAAAARSANCTWAELEAMRAASPTRSRPGADVDELTAWMRKHPSALSKFEQIASASKGKKIVMFLDYDGTLSPIVANPDAAYMSDAMREAVRDVAKHFPTAIVSGRCRDKVHNFVGLSELYYAGSHGMDIKGPGSNPESVLCQPASEFLPMIDEVYKVLVEKTKSTPGAKVENNKFCLSVHFRCVDEKRWNFLAEQVKAVIKDFPMLKLTQGRKVFELRPSIMWDKGKALEFLLESLGFASCSDVLPVYIGDDRTDEDAFKVLRKRGQGVGILVSKCAKETSASYSLQDPAEVMEFLLRLVEWKRRSSTAAPPQGRPAEVMEFLLRLVEWKRRSSTAAPPMVRPRV

SEQ ID NO: 442 - protein, 366 aa, Brachypodium distachyon
MTSQDVVVPEMGIGAGAAMPGSGGTAGLFACRSAAAGVMSMRQTYHLAAARSAPASCTWLEAMRACSPPRSRGGAGADVDELSAWMRKHPSALGKFEQIAGACKGKKVVMFLDYDGTLSPIVANPDAAYITDAMRAAVRDVAKHFPTAIVSGRCRDKVHNFVGLSELYYAGSHGMDIKGPTSSPESVLCQPASEFLPMIEEVYKVLVEKTKSTPGAMVENNKFCLSVHFRCVDEKRWNFLAEQVKAVIKDYPMLKLTQGRKVFELRPSIMWDKGKALEFLLESLGFADCSDVLPVYIGDDRTDEDAFKVLRKRGQGVGILVSKCPKETSASYSLQDPTEVMEFLLRLVEWNRKSSSSPAMLRPRVL

SEQ ID NO: 443 - protein, 359 aa, Panicum virgatum
MTNQDVVVSEMGIAAGAALPGPSPALLACRGAAAGAMSLRYLDLAAAAARSASCTWADAMRASSPTRSRAAGDVDEFTAWMRKHPSALGKFDQIASASKGKKIVMFLDYDGTLSPIVADPDEAYMSDAMRAAVRDVAKHFPTAIVSGRCRDKVRNFVGLSELYYAGSHGMDIKGPSSNPESVLCQPASEFLPVIDEVYKALVEKTKSTPGAKVENNKFCLSVHFRCVDEKRWNALAEQVKAVIKDYPKLKLTQGRKVLEIRPSIMWDKGKALEFLLESLGFASCSDVLPVYIGDDRTDEDAFKVLRKRGQGIGILVSKCPKETNASYSLQDPSEVMDFLLRLVEWKRKSPPPPMIRPRV

SEQ ID NO: 444 - protein, 359 aa, Sorghum bicolor
MTNQDVVVSEMGIAAGAALPGASPALLACRGAAAGAMSLRYLDLAAAAARSASCTWVDAMRASSPTRSRAAADVDEFTAWMRKHPSALAKFEQIASASKGKKVVMFLDYDGTLSPIVADPDAAYMSDAMRAAVRDVAKHFPTAIVSGRCRDKVRNFVDLSELYYAGSHGMDIKGPSSNPESVLCQPASEFLPVIDEVYKALVEKTKSTPGAKVENNKFCLSVHFRCVDEKRWNALAEQVKAVIKDYPKLKLTQGRKVLEIRPSIMWDKGKALEFLLESLGFANCSDVLPVYIGDDRTDEDAFKVLRKRGQGIGILVSKCPKETNASYSLQDPGEVMDFLLRLAEWKRKSSAPPMIRPRV

SEQ ID NO: 445 - protein, 363 aa, Setaria italica
MTNQDVVVSEMGIAAGAALPGPRPALLACRGAAAGAMSHRYLDLAAAAARSASCTWADAMRASSPTRSRAAADVDEFTAWMRKHPSALGKFEQIASSSKGKKIVMFLDYDGTLSPIVADPDAAYMSDAMRSAVRDVAKYFPTAIVSGRCRDKVRNFVGLSELYYAGSHGMDIKGPSSNPESVLCQPASEFLPVIDEVYKLLVEKTKSTPGAKVENNKFCLSVHFRCVDEKRWNALAEQVKAVIKDYPKLKLTQGRKVLEIRPSIMWDKGKALEFLLESLGFANCSDVLPVYIGDDRTDEDAFKVLRKRGQGLGILVSKCPKETNASYSLQDPGEVMDFLLRLVEWKRKSSPPPPPPIMIRPRV

SEQ ID NO: 446 - protein, 359 aa, Zea mays
MTNQQDVVVSEMGIAAGAALPGPSPALLACRGAAAGAMSLRYLDLAAAAARSASGTGTWADAMRASSPTRSRAADEFTAWVRKHPSALGKFEQIASASKGKKVVMFLDYDGTLSPIVADPDAAYMSDAMRAAVRDVAKHFPTSIVSGRCRDKVRNFVALSELYYAGSHGMDIKGPSSNPESVLCQPASEFLPVMDEVYKALVEKTKSTPGAKVEHNKFCLSVHFRCVDEKRWNGLAEQVKAVTKDYPKLKLTHGRKVLEIRPSIMWDKGKALEFLLESLGFANRSDVLPVYIGDDRTDEDAFKVLRKRGQGIGILVSKCPKETNASYSLQDPGEVMDFLLRLVEWKRKSSAAPMVRPRV

SEQ ID NO: 447 - protein, 497 aa, Zea mays
MQTTTTTSSVVAELEGALLRSADTFPYFMLVAFEASGLPRFALLLALWPLLRLLELAGRRGLALRAAAFVATAGVPRAEVEAVSRAVLPKFMADDVDPAAWAAFGSCEGTRVVVTRMPRVMVDRFAREHLGAHAVVGCDLEYSRLRRSTGLLRGASYEDVATRVRALFAGDGCRPALGIGGSKMARSFLTFCEEQLRQPFPAPNETNAPPFRPVIFHDGRLVCRPTPFMSLVILLWLPLGVLVAFVRIAVGLMVPIWTVPYIAPVFGGAVITHGRAPPPAKLGGGSPSGVLFVCTHRTLMDPVVLAAVLGRRVAAVTYSISRLSEVLSPIPTVRLTRDRDADAARMRAELARGGDVAVCPEGTTCREPFLLRFSKLFAELSDSIVPVAMNYRVGLFHPTTARGWKAMDPIFFFMNPRPVYEVTFLNQLPAESTCAAGKSPVDVANYVQRILAATLGFECTTLTRKDKYTVLAGNDGVVNAKPAWQSRVKDVLGFLLH

SEQ ID NO: 448 - protein, 922 aa, Secale cereale
MAEEKAVGAPALDTNIETGGFDEKRGQAPATHNPKAPVAEDEEPDEDMDALIEDLESEDGHEIDDDEEATPGGGRVVPEDQLQTDSRVGLTEAEVIARRKKWGLNAMKEEQENMILKFLMFFVGPIQFVMEAAAVLAAGLEDWIDFGVICALLLLNACVGFIQEYQAGSIVEELKKTLALKAVVLRDGTLKEIEAPEVVPGDILQVEEGTIIPADGRFVTEGCFCQVDQSAITGESLAVDKHHGDNCYASSAVKRGEAFVIVTATGDNTFVGRAAALVSQSAGGTGHFTEVLNGIGTILLVLVVATLLIVWVSSFYRSNGIVDILRFTLAITIVGVPVGLPAVVTTTMAVGAAYLAKKQAIVQKLSAIESLAGVEILCSDKTGTLTKNKLSLAEPFCVAGVEPDDLMLTACLAASRKKKGIDAIDKAFLKALKFYPRAKGVLSKYKVLDFHPFDPVSKKVQAVVESPQGERIICVKGAPLFVLKTVEEDHPIPEEVDSAYKNCVAEFATRGFRSLGVARKRGEGAWEILGIMPCSDPPRHDTARTINEAKRLGLSIKMLTGDAVGIARETSRQLGLGTNVYNAERLGLGGGGDMPGSEVYDFVEAADGFAEVFPQHKYNVVEILQQRGYLVAMTGDGVNDAPSLKKADTGIAVEGASDAARSASDIVFLAPGLGAIIDALKTSRQIFHRMYAYVVYRIALSLHMEIFLGLWIAILNRSLNIELVVFIAIFADIATLAIAYDNAPFSQTPVKWNLPKLWGMSVLLGVVLAVGTWIALTTMLANSEDGGIVQNFGKIDEVLFLEISLTENWLIFITRANGPFWSSIPSWQLSGAILIVDILATLFCIFGWFVGGQTSIVAVVRIWIFSFGVFCVMGGLYYFMQGSTGFDNLMHGKSPKQNQKQRSLEDFVVSLQRVSTQHEKSQ

SEQ ID NO: 449 - protein, 875 aa, Triticum aestivum
MDALIEDLESEDGHAFDDEEETQPGGGRVVPEDQLQTDSRVGLTEAEVLNRRRKWGLNQMKEERENMILKFLMFFVGPIQFVMEAAAVLAAGLEDWIDFGVICALLLLNACVGFIQEFQAGSIVEELKKTLALKAVVLRDGTLKEVEAPEVVPGDILQVEEGTIIPADGRFVTEGCFVQVDQSAITGESLAVDKHAGDNCYASSAVKRGEAFVIVTATGDNTFVGRAAALVSQSAGGTGHFTEVLNGIGTILLVLVVATLLVVWVSSFYRSNGIVDILRFTLAITIVGVPVGLPAVVTTTMAVGAAYLAKKQAIVQKLSAIESLAGVEILCSDKTGTLTKNKLSLAEPFCVAGVEPDDLMLTACLAASRKKKGIDAIDKAFLKALKYYPRAKSVLSKYKVLDFHPFDPVSKKVQAVVESPQGERIICVKGAPLFVLKTVEEDHPIPEEIDAAYKNTVAEFATRGFRSLGVARKRGEGAWEILGIMPCSDPPRHDTARTINEAKRLGLSIKMLTGDAVGIARETSRQLGLGTNVYNAERLGLGGGGDMPGSEVYDFVEAADGFAEVFPQHKYNVVEILQQRGYLVAMTGDGVNDAPSLKKADTGIAVEGASDAARSASDIVFLAPGLGAIIDALKTSRQIFHRMYAYVVYRIALSLHMEIFLGLWIAILNKSLNIELVVFIAIFADIATLAIAYDNAPFSQTPVKWNLPKLWGMSVLLGVVLAVGTWIALTTMYANSEDGGIVQNFGKIDEVLFLEISLTENWLIFITRANGPFWSSIPSWQLSGAILIVDILATLFCIFGWFVGGQTSIVAVVRIWIFSFGVFCVMGGLYYFMQGSTGFDNLMHGKSPKQNQKQRSLEDFVVSLQRVSTQHEKSQ

SEQ ID NO: 450 - protein, 337 aa, Hordeum vulgare
MAFSSPPHVVEDVPPFLQLLSDGTVIRFTDGYPLPIPSPPPGQPVVDWKDVVYDASHSLKLRIYRPAAASSSGNKLPVVVYFHGGGYTIGSFDMPNFHACCVRLAGELPAVVVSADYRLAPEHRFPAGLDDAANVVSWVRAQAAAVAAAEDSADPWLSETANFGQVFVAGDSAGGGVVHHTAVRLASGRIGPLDPVCVAGCAMLCPLFGGEARTASEAEFPPGPFLSLPAVDQAWRLVLPAGSTRDHPLANPFGPDSPVLDGVALPPMLVVTAEHDLLRDRAADYAARLKAIGKPMELVEFEGQHHGFFAVEPYGDAGSEVVRLVKRFVYGNGGASD

SEQ ID NO: 451 - protein, 336 aa, Secale cereale
MASSSPPHVVEDVPPFLQLLSDGTVIRFTDGYPLPIPSPPPGQPVVEWKDVVYDASHGLKLRIYRPPASSDEKKLPVIVYFHGGGYTIGSFDMPNFHACCVRLAGELPAVVLSADYRLAPEHRFPAGLDDAANVVSWVRAQAAAVSAAEDCADPWLSETADFGRVFVAGDSAGGGVVHHTAVRLASGQLGPLDPVCVAGCMMLCPLFGGEERTASEAEFPPGPFLSLPAVDQVWRLVLPPGSTRDHPLANPFGPESPALDGVALPPMLVVTAERDLLRDRAADYVARLKAMGKPVELEEFEGQHHGFFSVEPYGDAGSEVVRLVKRFVYGNGGASG

SEQ ID NO: 452 - protein, 278 aa, Triticum aestivum
HGLKLRIYRPAAASSSGNKLPVIVYFHGGGYSIGSFDMPNFHACCVRLAGELPALVLSADYRLAPEHRFPAGLDDAANVVSWVRGQAAAVGDNADPWLSETADFGRVFIAGDSAGGGVVHHTAVRLASGRLGPLDPVRVAGCAMLCPMFGGEERTASEAEFPPGPFLSLPAVDQAWRLVLPPGSTRDHPLANPFGPDSPALDGVALPPMLVVAAARDLLRDRSVDYAARLKAMGKPVELVEFEGQHHGFFAVEPYGDAGSEVVRLVKRFVYGNGGASD

SEQ ID NO: 453 - protein, 474 aa, Hordeum vulgare
METMSYPCSPLLSLPTHEESNFFIWSPQVALHENATIHVDHSTDQQHDNVFLDTAAQHYANDWQQQDASDVGVFTYCGERILGQESGNLVAIQEELMEENSLTDLLLTGAEAVEAGDPRFALAVFSRLDGLLLGTPENAAAGSFDRLAYHFSQGLRSRISSASTSCSPPEPLASDRMSVQQIIQELSPFAKFAHFTANQAILDATKGDAHVHVVDLNIGEGIQWPSLMSDLARHGGISFHLTAVTADADYSDAVHHASARWLSEFAESLNLPFQYSSLCLHSDEDLHEFSKNSKGSVIFSCDTTSMPYKLLSKLPALLPACVELLQPKLMVIIEEELVRIGKEVSLCKASFVDFFFEALHHFTTVFESLASCFAGGNQGVCLRLVEREMVGPRIQDFVGQYGSVTAEVNAPVVLERYGACDLSGCNVAQARMLVGLFNRGFEIVHEKGRLMLCWKSRPLTSVSVWAPILKERSS

SEQ ID NO: 454 - protein, 364 aa, Panicum virgatum
MRNMAEKRRHGGGHHVHGVGFGAGVGHAEHDEKRMEPKKLDMSGMSMDTIPHLSMPLGSITTLDLSNNNLQSIPESIIARLLNVVVLDVRSNQLTSLPNSIGCLSKLKVLNVSGNLLRDLPATIEECRALEELNANFNQLTKLPDTLGFELHGLRRLSVNSNKLAYLPSSTSHMTALRSLDARLNCLRALPDGLENLGGLEALNVSQNFQYLRELPYGIGLLTSLRELDVSYNSIAALPDSMGCLTKLSRFSAAGNPLVSPPMDVVEQSLDAMRAYLSARMNGTDKQDRRKKKSWVPKLVKYSTFSAGMMTPGRATKVHGSGAEGLLMSDYRSLDGGGIASPGFLSMLSPRRLFSPRRNSPKHH

SEQ ID NO: 455 - protein, 363 aa, Panicum virgatum
MRGMGEKRRHGGGHHVHGVGFGAGGGVGHAEQDEKRREPKKLDMSGMSLDSIPHLSMPLGNITTLDLSNNNLQSIPESIIARLLNVVVLDVRSNQLTSLPNSIGCLSKLKVLNVSGNLLRDLPATIEECRALEELNANFNQLTKLPDTLGFELHGLRRLSVNSNKLAYLPSSTSHMTALRSLDARLNCLRALPDGLENLGGLETLNVSQNFQYLRELPYGIGLLVSLRELDVSYNSIAALPDSMGCLTKLARFSAAGNPLVCPPMDVVEQSLDAMRAYLSARMNGTDKDRRRKKCWVPKLVKFNTFSAGMMTPGRATKVHGNAEGLLISDYRSLDGGIASPGFLSMLSPRRLFSPRRNSPKHH

SEQ ID NO: 456 - protein, 363 aa, Zea mays
MRDMGEKRRHGHGHGHGHLVGFGAGGVVGHAAEHEEKRMEQKKLDMSSMSMDTLPHLTTPLGNITTLDLSNNNLQSIPESIIARLLNVVVLDVRSNQLKSLPNSIGCLSKLKVLNVSGNLLQELPATIEECRALEELNANFNQLTRLPDTLGFELHGLRRLSVNSNKLAYLPSSTSHMTALRSLDARLNCLRALPDGLENLGGLEALNVSQNFQYLRELPYGIGLLVSLRELDVSYNSIAALPDSMGCLTKLARFSAAGNPLVCPPMDVVEQSLDAMRAYLSARMNGTAKAKKKSWVPKLVKYSTFSAGMMTPGRTKVHGNNTDGLHMSDYRSLDGGGVASSAFLSMLSPRRLFSPRRNSAKH

SEQ ID NO: 457 - protein, 363 aa, Sorghum bicolor
MRDMGEKRRHGHGHGHGHGHGHLVGFGVGGVGHAEHEEKRMEQKKLDMSGMCMDTLPHLTTPLGNITTLDLSNNNLQSIPESIIARLLNVVVLDVRSNQLKSLPNSIGCLSKLKVLNVSGNLLQELPATIEECRALEELNANFNQLTRLPDTLGFELHGLRRLSVNSNKLAYLPSSTSHMTALRSLDARLNCLRALPDGLENLGGLETLNVSQNFQYLRELPYGIGLLVSLRELDVSYNSIAALPDSMGCLTKLARFSAAGNPLVCPPMDVVEQSLDAMRAYLSARMNGTAKAKKKSWVPKLVKYSTFSAGMMTPGRTKNNSTDGLHMSDYQSLHGGGIASPGFLSMLSPRRLFSPRRNSTKH

SEQ ID NO: 458 - protein, 352 aa, Oryza sativa
MREMGEKRRRGHLNPAGFAGGLHDHEEKKNEEHKLDMSGMSMDALPHLTMSLGQVTILDLSNNNLESIPESIIARLLNVVVLDVRSNQLKSLPNSIGCLSKLKVLNVSGNLLESLPNTIEECRALEELHANFNELTKLPDTLGFELHSLRKLSVNSNKLAQLPSSTSHMTALRALDARLNCLRALPDGLENLANLEALNVSQNFQFLRELPYAVGLLASLRELDVSYNSIAALPDSMGCLTKLARFSAVGNPLVSPPMDVVEQGLDAMRAYLTARMNGGDGKRKKKAWLPKLVKYSTFTARMTPGRTRVHENTEGLLMSDYRSLNGIASPRFLTMLSPRRLFSPRRNSPKHC

SEQ ID NO: 459 - protein, 176 aa, Triticum aestivum
MAAMKIALLAVAAMAVLLGTASAVTYNVGDQGGWTLSTDYSSWVSGKKFNVGDEIVFKYSTPTHDVVEVSKAGYDSCSIDGAINTLASGNDVITLNATGTRYFICGVPNHCSPTAAASMKVVINVASGSSSPSSPMPAAGPGASNSPPAPPSNAATSVGATAGFGLVALLAAGLMA

SEQ ID NO: 460 - protein, 606 aa, Triticum aestivum
MGTYKCCLVFKRRYRWTDAPPPDDVRALFAVHSGGAATMGADGLRRYLESSDPDAADDAEGEADRLLDQIRLQGHQHQRAGPRLPRLGRGQLLGLDDFHRFLFSADLNPPVRRPQVHHDMSQPLSHYYVYTGHNSYLTGNQLSSDCSDVPIIKALQRGVRVIELDMWPNSAKDDISILHGRTLTTPVSLLKCLKSIKEYAFVASPYPVIITLEDHLTPELQDKVAKMVLEVFGTILYYPEEEHPKELPSPESLKGRVLLSTKPPKEYLEAKDGGAAKDGDAEQNPGKGTDDDAAWGTEVPDFKTEIQSAKQEDDASENRRDGDEDDDDEDEQKMQQHLAPQYKRLITIRAGKPKGGTTSDALKCDPNKVRRLSLSEQQLAKAVVNHGTEIVRFTQRNLLRIYPKGTRVTSSNYNPFIGWVHGAQMVAFNMQGYGRALWLMHGFYKANGGCGYVKKPDFLMQSEPEVFDPKKPQPVKKTLKVKVYMGDGWRMDFKQTHFDQYSPPDFYARVGIAGVPADSVMKKTKAVEDNWVPVWGEEFSFDLTVPELALLRVEAHEYDMSEKDDFAGQTVLPVSELQPGIRAVALFDRKGNKLPNVKLLMRFEFV

SEQ ID NO: 461 - protein, 610 aa, Secale cereale
MGTYKCCLIFKRRYRWTDAPPPDDVRALFAEHSGGAATMGADGLRRYLESSAGGDHDAADADAEGEADRLLDQIRLQGHQQRAGPRLPRLGRGQLLSLDDFHRFLFSADLNPPVRRAQVHHDMSAPLSHYYIYTGHNSYLTGNQLSSDCSDVPIIKALQRGVRVIELDMWPNSAKDDISILHGRTLTTPVSLLKCLRSIKEYAFVASPYPVIITLEDHLTPELQGKVAKMVLEVFGGILYYPEEEHPKELPSPEFLKGRVLLSTKPPKEYLEAKDGGAVKDGDAEQNPGKGGTDDDAAWGTEVPDFKTEIQSAKEDDAAEHHKDDDEDDDDDEDEQKMQQHLAPQYKHLITIRAGKPKGGTTSDALKCDPNKVRRLSLSEQQLAKAVVNHGTEIVRFTQRNLLRIYPKGTRVTSSNYNPFIGWLHGAQMVAFNMQGYGRALWLMHGFYKANGGCGYVKKPDFLMQSEPEVFDPKKPQPVKKTLKVKVYMGDGWRMDFKQTHFDQYSPPDFYARVGIAGVPADSVMKKTKAVEDNWVPVWGEEFLFDLTVPELALLRVEAHEYDMSEKDDFAGQTVLPVSELQPGIRAVALFDRKGNKLPNVKLLMRFEFV

SEQ ID NO: 462 - protein, 596 aa, Lolium multiflorum
MGTYKCCLIFKRRYRWTDAPPPEDVRSLFAQHSGGTATMGADGLRRYLESTGTDPDFDGDAEAERLLDQIRQAQRVRVPRVGRPLLGIDDFHRFLFSDDLNPPLRRPQVHHDMAAPLSHYYVYTGHNSYLTGNQLSSDCSDVPIIKALQRGVRVIELDMWPNSAEDDINILHGRTLTTPVSLLKCLRSIKEYAFVASPYPVIITLEDHLPPELQDKVAKMVLEVFGNILYYPEEEHPKELPSPEELKGRVLLSTKPPKEYLEAKAGGTIKDGDTEANPGKGGTDDDAAWGKEVPDFKTEIQFAKQEDDALDDDDEEEDEQQIQQHLAPQYKHLITIRAGKPKGGTTSDALKSDPNKVRRLSLSEQQLAKAVVNHGTEIVRFTQRNLLRIYPKGTRITSSNYNPFIGWVHGAQMVAFNMQGYGRALWLMHGFYKANGACGYVKKPDFLMQSEPEVFDPKKTQPVKKILKVKVYMGDGWRMDFKQTHFDQYSPPDFYARVGIAGVPADSIMMKTKAIEDNWVPVWGEEFSFELTVPELALLRVEVHEYDMSEKDDFAGQTVLPVSELQPGIRAVALCDRKGNKYPNVKLLMRFEFESV

SEQ ID NO: 463 - protein, 595 aa, Lolium multiflorum
MGTYKCCLIFKRRYRWTDAPPPEDVRSLFAQHSGGTATMGADGLRRYLESTGTDPDLDGDAEAERLLDQIRQAQRVRVPRVGRPLLGIDDFHRFLFSDDLNPPLRRPQVHHDMAAPLSHYYVYTGHNSYLTGNQLSSDCSDVPIIKALQRGVRVIELDMWPNSAEDDINILHGRTLTTPVSLLKCLRSIKEYAFVASPYPVIITLEDHLPPELQDKVAKMVLEVFGNILYYPQEEHPKELPSPEDLKGRVLLSTKPPKEYLEAKAGGTIKDGDAEANPGKGGTDDDAAWGKEVPDFKTEIQFAKEDDDEDDDEEEEDEQKIQQHLAPQYKHLITIRAGKPKGGSTSDALKSDPNKVRRLSLSEQQLAKAVVNHGTEIVRFTQRNLLRIYPKGTRITSSNYNPFIGWVHGAQMVAFNMQGYGRALWLMHGFYKANGACGYVKKPDFLMQSEPEVFDPKKQQPVKKILKVKVYMGDGWRMDFKQTHFDQYSPPDFYARVGIAGVPADSIMMKTKAIEDNWVPVWGEEFSFELTVPELALLRVEVHEYDMSEKDDFAGQTVLPVSELQPGIRAVALCDRKGNKYPNVKLLMRFEFESV

SEQ ID NO: 464 - protein, 600 aa, Brachypodium distachyon
MGTYKCCFCFRRRYRWTDAPPPDDVRSLFAHHSGGAATMGADGLRRYLESKGTGAEDDNSEAAADRLLDQIRHGQRGARIPRVGRPLIALEEFHRFLFSDDLNPPIRRPQVHHDMTAPLSHYFIYTGHNSYLTGNQLSSDCSDIPIIKALQKGVRVIELDMWPNSTRDDINILHGRTLTTPVSLLKCLRSIKEYAFVVSSYPVIITLEDHLPPDLQDKVAKMVLEVFASILYYPDTEHIKELPSPEDLKGRVLLSTKPPKEYLEAKAGGTIKDGDADPNLGKGAGEDAAWGKEVPDFKTEIQSAKQEDDVSEHHRDDDDEDDDDDEEEQKMQQHLAPQYKHLITIKAGKPKGTTADALRCDPDRVRRLSLSEQELAKAVVHHGTEIVRFTQRNLLRIYPKGTRVTSSNYNPFLGWVHGAQMVAFNMQGYGRALWLMHGFYKANGGCGYVKKPDFLMQSDVFDPKKRQPVKKTLKVKIYMGDGWRMDFKHTHFDQYSPPDFYARVGIAGVPADSVMKKTRTIEDNWVPVWEEEFAFDLTVPEIALLRVEVHEYDMSEKDDFGGQTVLPVSELQPGIRAVALFDRKGNKFNNVKLLMRFEFV

SEQ ID NO: 465 - protein, 601 aa, Setaria italica
MGTTYKCCLIFKRRFQSRDAAPPDDVRALFNLHSGGGTHMGADGLRRYLDATEDALDDGEVDRLLDQIRIQQQQGRARLPRLSRPLLALDDFHRYLFSHDLNPPIRRPQVHHDMSHPLSHYFIYTGHNSYLTGNQLSSDCSDVPIIKALQRGVRVIELDMWPNSAKDDINILHGRTLTTPVSLIKCLRSIKEYAFVASPYPVIITLEDHLPADLQAKVAEMVLEVFGNTLFYPGTDHFKEFPSPEELKGRVLLSTKPPKEYLEAKVGTMKEGDADPHPGKGAADDAAWGKEVPDFQTEIQSANKHDDDGSDHQRDDEEDDDDDDDEEQIMHPHSAPQYKQLITIRAGKPKGSLAAALNSDPDKVRRLSLSEQQLAKLAEDHGTEIVRFTQRNILRIYPKGTRVTSSNYNPFLGWVHGAQMVAFNMQGYGRALWLMHGFYKANGGCGYVKKPDFLMQTEPEVFDPRERQPVKKTLKVKVYLGDGWRMDFKQTHFDQYSPPDFYARVGIAGVPADSMMKKTRAIEDNWVPVWEEEFTFPLTVPEIALLRVEVHEYDMSEKDDFGGQTVLPVSELRPGIRAVALFDRKGNQYNHVKLLMRFEFV

SEQ ID NO: 466 - protein, 500 aa, Setaria italica
METVLASIAAGGMVAAAALAAGASRVAGQKDRLNAPPAVPGLPIIGNLHQLKEKKPHQTFARWAQVYGPIYTIRSGASSMAIVNSTEVAKEAMVAKFQSISTRKLPAAISVLSRDKKMVATSDHGDFHKIAKRYIMLSVLGASGQKQFRGIRDMVIGNMLSTFHALVANDPKAPVNFREVFKDELFRLSLIQALGEDVSSIYVEEFGKIISKEEIYQIAVVDPMMCALEVDWREFFPYLGWIPNQSFDTTVSTTEARRTAVVRALIDQQKKRIARGEARVSYLDFLLAQNTLTDEQVTSLIWEAIIEAADTTLSTTEWAMYELSKNQEKQERLYEEIQEVCGNETVTEDDLPRLPYLNAVFHETLRRHPSVSVVPPRFVHEDTNLAGYDIPAGTEVIVNLYGCNMNKNDWDEPEEWKPERFLDGRFERADKFKTMAFGAGRRVCAGATQATNISCTAMARFVQDFAWRLKEGDEGKDGTIQFTTNRLYPLHVYLTPRGRK

SEQ ID NO: 467 - protein, 510 aa, Setaria italica
MESLVAALPLGGAAAAAAAVGGLLAAAALAGRAGLVGPKNNGSNAPPAVPGLPLIGNLLQLKEKKPHQTFTKWAETYGPIYTIKTGASSVVVLNSTQVAKEAMIAKFSSISTRKLSKALSVLTCDKTMVATSDYGDFHKMVKRYVMTSMLGTSGQKQFRDTRNMMVDNMLSTFHTLLNDDPNAPLNFREVFKNELFRLSLIQALGEDVSSVYVEEFGKVISKEEIYQATVVDMMMCAIEVDWRDFFPYLSWVPNRSFETRVLTTEGRRTAVMRALIDQQRKRIARGEARISYLDFLLAENTLTDEQLLMLVWEAVIEAADTTLVTTEWAMFEIAKHPEKQDRLYQEIQEVCSNEIVTEDHLPRLPYLNAVFHETLRRHSPVPLVPPRFVHENTNLASYDIPAGTEMIINLFGCNMNKRDWDEPEEWKPERFLDGRFESADMYKTMAFGAGRRACAGSMQAMNISCTAIARFVQEFTWRLKEGDEEKADTIQLTTNRLYPLYVYLTPRGRK

SEQ ID NO: 468 - protein, 508 aa, Sorghum bicolor
MESLVAALPAGGAAAAAAVGGLVAAAALAGKAGLVGPKKHLNAPPAVPGLPMIGNLHQLKEKKPHQTFTKWAEIYGPLYTIRTGASSVVVLNSAQVAKEAMIAKFSSISTRKLSKALSVLTRDKTMVATSDYGDFHKMVKRYVMTSMLGTSAQKQFRDTRNMMVDNMLNTFHTLLTDDPNSPLNFREVFKNELFRLSLIQALGEDVSSVYVEEYGKVISQEEIYQATVADMMMCAIEVDWRDFFPYLSWIPNRSFETRVLTTEARRTTVMQALINQQKIRIARGETRISYLDFLLAENTLTDEQLLMLVWEAVIEAADTTLVTTEWAMYEIAKHPEKQEYLYQEIQKVCGNKTVTEDHLPELPYLNAVFHETLRRHSPVPLVPPRFVHENTNLAGYEVPAGTEMIINLYGCNMNKSDWAEPEEWKPERFLDGRFEAADMYKTMAFGAGRRACAGSMQAMNISCTAIARFVQEFSWRLKEGDEDKADTIQLTTNRLYPLHVYLTPRGRK

SEQ ID NO: 469 - protein, 362 aa, Triticum aestivum
MAEVGNGAGSGGRGVRVCVTGGAGFIGSWLVRKLLEAGYTVHATLRSVADEGKAGLLRRLVPGGAPPDRLVLFEADLYDAASFAPAIAGCQFIFLVANPSAHEAAASKYKTSAEAAADGVCVILRLCAQSKTVKRVIHTASVTAASPLTKSSSAAAAVYSDFISESCWTLLDVDYPLRSVHFDKYIESKVLSEKELLSYNDGESPAFEVVTLSLGLVGGDTVLSHLPETVESMVAPVTKQEPYFMLPRILQRLLGSVPLVHVDDVCAALIFCMEQPALSGRFLCAAAYPTIHDILDHYSSKYPHLEVLRETDEVARVHPERSKLWELGFRYKYGVEEILDESIDCAVRLGSLDASKLIVQQE

SEQ ID NO: 470 - protein, 360 aa, Secale cereale
WRKRRRARAVAALGCASPAAPGSSAPGSSGSCWRQATPSTPPCGAIGDEGKAGLLRRLVPGGASPERLVLFEADLYDAASFAPAIAGCQFVFLVANPSAHEAAASKYKTSAEAAADGVRVMLRLCAESKTVKRVIHTASVTAASPLTKSSSAAAAVYGDFISESCWTLLDVDYPLRSVHFDKYIESKVVSEKELLSYNDDESPAFEVVTLPLGLVGGDTVLSHLPETVESMVAPVTKQEPYFMLPKILQRLLGSLPLVHVDDVCSALIFCMEQPSISGRFLCAAAYPTTHDILDHYSSKYPHLEVLRETDEVARVQPERNKLGELGFRYKYGVKEILDESIDCAVRLGSLDASKLIVQQE

SEQ ID NO: 471 - protein, 356 aa, Brachypodium distachyon
MAEAGSSGGGVRTCVTGGAGFIGSWLVRKLLERGYTVHATLRSIGDEGKAGLLRRLVPGGVPPERLVLFEADLYDAASFAPAIAGCQFVFLVATPSAHEAAGSKFKNSADAAADAVRVILRLCAESKTVKRVIHTASVSAASPLLDASSAAAAMYKGFITESCWTRLDIDYPLRSVHFDKYIESKILSEKELLSYNVRESPAFEVVTLPCGLVGGDTVLGHVPETVESVVSPVTKQELYFMLPRILQGLLGSVPLVHVDDVCAALIFCMEQPSLSGRFLCAAAYPTVHDIVDHYGRKYPHLDLLKENDEAVKVQSERNKLGELGFRYKYGMEAILGDSIGCAVRLGYIDASKLSGQ

SEQ ID NO: 472 - protein, 611 aa, Secale cereale
MGTYKCCLIFKRRYRWTDAPPPDDVRALFAEHSGGAATMGADGLRRYLESSAGGDHDAADADAEGEADRLLDQIRLQGHQQRAGPRLPRLGRGQLLSLDDFHRFLFSADLNPPVRRAQVHHDMSAPLSHYYIYTGHNSYLTGNQLSSDCSDVPIIKALQRGVRVIELDMWPNSAKDDISILHGRTLTTPVSLLKCLRSIKEYAFVASPYPVIITLEDHLTPELQGKVAKMVLEVFGGILYYPEEEHPKELPSPESLKGRVLLSTKPPKEYLEAKDGGAAKDGDAEQNPGKGGTDDDAAWGTEVPDFKTEIQSAKQEEDAAEHHKDDDEDDDDDEDEQKMQQHLAPQYKHLITIRAGKPKGGTTSDALKCDPNKVRRLSLSEQQLAKAVVNHGTEIVRFTQRNLLRIYPKGTRVTSSNYNPFIGWLHGAQMVAFNMQGYGRALWLMHGFYKANGGCGYVKKPDFLMQSEPEVFDPKKPQPVKKTLKVKVYMGDGWRMDFKQTHFDQYSPPDFYARVGIAGVPADSVMKKTKAVEDNWVPVWGEEFLFDLTVPELALLRVEAHEYDMSEKDDFAGQTVLPVSELQPGIRAVALFDRKGNKLPNVKLLMRFEFV

SEQ ID NO: 473 - protein, 666 aa, Aegilops tauschii
MGHILMSAICVPTVSFNPHSPHSSPSLRPFRLPLSLPPLFLSIPVSPTDTSPTTQASKATQQQTNPTLAAETAGAMGTYKCCLIFKRRFRWTDAPPPDDVRALFAEHSGGAATMGADGLRRYLESTGGDPDAADADAEGEADRLLDQIRLPPPPPPPPPPPPPLSADLNPPLRRPQVHHDMSQPISHYYVYTGHNSYLTGNQLSSDCSDVPIIKALQRGVRVIELDMWPNSAKDDISILHGRTLTTPVSLLKCLKSIKEYAFVASPYPVIITLEDHLTPELQDKVAKMVLEVFGDILYYPQEEHPKELPSPEFLKGRVLLSTKPPKEYLEAKDGGAVKDGDAEQNPGNGLDDDAAWGTEVPDFKTEIQSAKEEDASEHRRDDDEDDDDEDEQKMQQHLAPQYKHLITIRAGKPKGGTTSDALKCDPNKVRRLSLSEQQLAKAVVNHGTEIVRFTQRNLLRIYPKGTRVTSSNYNPFIGWVHGAQMVAFNMQGYGRALWLMHGFYKANGGCGYVKKPDFLMQSEPEVFDPKKPQPVKKTLKVKVYMGDGWRMDFKQTHFDQYSPPDFYARVGIAGVPADSVMKKTKAVEDNWVPVWGEEFSFDLTVPELALLRVEAHEYDMSEKDDFAGQTVLPVSELQPGIRAVALFDRKGNKFPNVKLLMRFEFV

SEQ ID NO: 474 - protein, 607 aa, Sorghum bicolor
MGTTYKCCLIFKRRFHARDAPPPEDVRALFSLHTGGGTHMGADGLRRYLDATQEEASRLDDAEVERLLEQIRLQQHQGGHRARLPRLARPLLALDDFHRYLFSHDLNPPLRHHQVHHDMTRPLSHYFIYTGHNSYLTGNQLSSDCSDVPIIKALQRGVRVIELDMWPNSTKDDINILHGRTLTTPVSLIKCLISIKEYAFVASPYPVIITLEDHLPSELQEKVAKMVLDVFGDILYYPPDSDHLKEFPSPEQLKGRVLLSTKPPKEYLEAKADDTMKEGDADLHLAKGANDDAAWGKEVPDFQTEIQSAKKHDDDAPGHQREDDDDDDDEEEEQKMQPHLAPQYKHLITIRAGKPKGSLADALKSDPEKVRRLSLSEQQLAKVAEDHATEIVRFTQRNILRIYPKGTRVTSSNYNPFIGWVHGAQMVAFNMQGYGRALWLMHGFYKANGGCGYVKKPDFLMQTEPQVFDPREPQPVKKTLKVKVYMGDGWRMDFKQTHFDQYSPPDFYTRVGIAGVPADSVMKKTKAIEDNWMPVWEEEFSFPLTVPEIALLRVEVHEYDMSEKDDFGGQTVLPVSELRPGIRAVALFDRKGNKYNNVKLLMRFEFA

SEQ ID NO: 475 - protein, 497 aa, Triticum aestivum
PPLRRPQVHHDMSQPISHYYVYTGHNSYLTGNQLSSDCSDVPIIKALQRGVRVIELDMWPNSAKDDISILHGRTLTTPVSLLKCLRSIKEYAFVASPYPVIITLEDHLTPELQDKVAKMVLEVFGDILYYPQEEHPKELPSPEFLKGRVLLSTKPPKEYLEAKDGGAVKDGDAEQNPGKGTDDDAAWGTEVPDFKTEIQSAKEEDASEHRRDDDEDDDDEDEQKMQQHLAPQYKHLITIRAGKPKGGTTSDALKCDPNKVRRLSLSEQQLAKAVVNHGTEIVRFTQRNLLRIYPKGTRVTSSNYNPFIGWVHGAQMVAFNMQGYGRALWLMHGFYKANGGCGYVKKPDFLMQSEPEVFDPKKPQPVKKTLKVKVYMGDGWRMDFKQTHFDQYSPPDFYARVGIAGVPADSVMKKTKAVEDNWVPVWGEEFSFGLTVPELALLRVEAHEYDMSEKDDFAGQTVLPVSELQPGIRAVALFDRKGNKFPNVKLLMRFEFV

SEQ ID NO: 476 - protein, 224 aa, Triticum aestivum
MASTGVSRRSSIMASRLSASAEAVRASEGRKQRHAVVARRVEYDEESLAGEPQYDVFINHRGVDTKRTVARLLYDRLAQSGIRGFLDNMSMRPGDRLKETISAGISECSVAVAIFSPSYFDSEYCLWELATLVESRKTIIPIFYNIKPSDLVLPEALAASDDYLPQDVERYKYALREAKNTVGLTYDSATGDIAELVSAATDAVLYHIEKMERVQRRETIVSRL

SEQ ID NO: 477 - protein, 224 aa, Hordeum vulgare
MASTGVSRRSSIMASRLSASAEAVRASEGRKKQQAVVARRVEYDEESLAGEPQYDVFINHRGADTKRTVARLLYDRLAQGGIRGFLDNMSMRPGDRLRDTIRAGIRECSIAVAIFSPSYCDSEYCLWELAMLVESRKTIIPIFYNIKPSDLVLPEAVAASEGYLPEDVERYKYALREAKNTVGLTYDSATGDMAELVSAAADAVLYNIEKMERVQRRETIVSRL

SEQ ID NO: 478 - protein, 911 aa, Hordeum vulgare
MPPMELLGRSFLQAAGSASTAAPRGGRERGLCFASLGGRPSRRTVRSKAPVGALAERVVLTSAPAERVARPEAHPQSVAARAVVTVRRKRKVEVKEQVAEQMDAYADRVGRSVLLELISTETDPRKGDPKKSNKSGLVGWFEKRDVKAELVVYTAEFTVDAAFGEPGAVTVLNRHQREFFIESILVEGFPSGPAHFTCNSWVQPSRIDPAPRVFFTNKPYLPSQTPPGLRDVRRRELKELRGSGTGVRKTTDRAYDYDVYNDLGNPDKGAGFERPVLGGDKLPYPRRMRTARPSTVTDEGAESRVEYPEPIYVSRDEEFEEGKNEMLSEGAIKALLHNFMPLLVSSVSPDSRDFAGFHDVDNLFKEGLRLKQALHDQLFQKIPFVRKIQENSEGLLRYDTPDIIKKDKFAWLRDDEFARQALAGINPVNIERLQVFPPVSKLDPAVYGPPESAITEEHIIGNLDGMSVQQALEENKLYMLDYHDIFMPFLDRINSLDGRKAYGTRTLFFLTAGGTLKPIAIELCLPPMTDDCKRAKRVFTPPADATSIWLWQLAKAHVCSNDAGVHQLINHWLRTHACMEPFIIAAHRQMSAMHPIFKLLKPHMRYTLKINALARQILINGDGVIESGFTPGRYCMEMSSFAYDNLWRLDQEGLPADLIRRGMAVEDASQLHGLRLLIEDYPYATDGLLLWSAIARWCQAYVAAYYPSDEAVQDDYELQSWYTEAVQVGHPDKCDAPWWPRLTTAGDLASLLTTLVWLCSAQHAALNFGQYPLGGYIPNRPPLMRRLVPAEGDPEYEHLVADPHRFYLSALPSLTQTTTFMTVIDTLSTHSADEQYLGERPNEEWTADPAALAAAQEFAAEVRRAEEEIERRNADPARRNRCGAGVLPYELMAPSSGPGITCRGVPNSVTI

SEQ ID NO: 479 - protein, 905 aa, Secale cereale
IALAGSRLCQHRGAARRPGARERRALLREPGREAVEEDGAVQGAGGRPGRAGRPHPGAGGEGGPAGGAPAERGGEGRGHRAPEAQGGGQGAGRRADGRLRRQGRPERPARAHQHGDGPEKGRPQEEQEVEAGGVVREAGRQGGAGGVHGGVHRRRRLRRAGRGHRAQPPPARVFIESILVEGFSSGPAHFTCNSWVQPTRVDPAPRVFFTNKPYLPSETPPGLRELRRRELKELRGSGTGVRKTTDRAYDYDVYNDLGNPDKGAGFERPVLGGDKLPYPRRMRTARPSTVTDEGAESRVEYPEPIYVSRDEEFEEGKNEMLSEGAIKALLHNFMPLLVSSVSPDSRDFAGFHDVDNLFKEGLRLKQALHDQLFQKIPFVRKIQENSEGLLRYDTPDIIKKDKFAWLRDDEFARQALAGINPVNIERLQVFPPVSKLDPAVYGPPESAITEEHIIGNLDGMSVQQALEENKLYMLDYHDIFMPFLDRINSLDGRKAYGTRTLFFLTAGGTLKPIAIELCLPPMTDDCKRAKRVFTPPADATNIWLWQLAKAHVCSNDAGVHQLINHWLRTHACMEPFIIAAHRQMSAMHPIFKLLKPHMRYTLKINALARQILINGDGVIESGFTPGRYCMEMSSFAYDNLWRLDQEGLPADLIRRGMAVEDASQPHGLRLLIEDYPYATDGLLLWSAIARWCEAYVAAYYPSDEAVQDDYELQSWYTEAVQVGHPDKCDAPWWPRLTTAGDLASLLTTLVWLCSAQHAALNFGQYPLGGYIPNRPPLMRRLVPAEGDPEYEHLVADPHRFYLSALPSLTQTTTFMTVIDTLSTHSADEQYLGERPNEEWTADPAALAAASEFAAEVRRAEEEIEQRNADPARRNRCGAGVLPYELMAPSSGPGITCRGVPNSVTI

SEQ ID NO: 480 - protein, 86 aa, Triticum aestivum
MAMERFFTALVFCEAPLDGYGTSVLTAGTVKRLVSGGGHATKPAVANKPDSEKAQGYFTGKPTAQRRPGFELAFDGLNCFDTIVMH

SEQ ID NO: 481 - protein, 493 aa, Triticum aestivum
MFPVTGSPKCVAFRSKHTRKYLGSVHVGSEESAVGGGRFFEELSDGADDVDVLASPYTRFYLEPSKEHDGLLHVRCCHNNKYWVAKHGGEGSGHWIIGIVNEPNDDLSKPSCTLFEPVPLTDGDNNLSIRFFRPQQTTSSESEMVMEKETAEEAYLRLGTGGHEKTVDQVKSLHDFSAIDLSKQLVLPKYVAFKGDNDMYLRARIIQKYNYLEFSSSDIADSTVVNTIFPNYANGNVRIKSNHFNRFWRLSPNWIWADSADSSSRDRDTLFRVVMLPDYIGLQNLGNSRYCKRLTADRKTSCLNAAVDTITLEARLRVEEAVLSREIYGVEFKLSEARIYGEKPITFPSMTSTNDTNEPHAKTLTLKYEETQAKTWSSTVSLKIGVTAKLRAGIPVIAEGKVEVSTEFNSEYEWGSSIHTTASQEASYHAVVPPMTKVTVRAAVTQGSVDVPFSYTQRDILTTGEVVTYKMDDGLFTGMNNYNFQFEATQEPI

SEQ ID NO: 482 - protein, 492 aa, Triticum aestivum
FPVTGSPKCVAFRSKHTRKYLGSVHVGSEESAVGGGRFFEELSDGADDVDVLASPYTRFYLEPSKEHDGLLHVRCCHNNKYWVAKHGGEGSGHWIIGIVNEPNDDLSKPSCTLFEPVPLTDGDNNLSIRFFRPQQTTSSESEMVMEKETAEEAYLRLGTGGHEKTVDQVKSLHDFSAIDLSKQLVLPKYVAFKGDNDMYLRARIIQKYNYLEFSSSDIADSTVVNTIFPNYANGNVRIKSNHFNRFWRLSPNWIWADSADTSSRDRDTLFRVVMLPDYIGLQNLGNSRYCKRLTADKKTSCLNAAVDTITLEARLRVEEAVLSREVYGVEFKLSEARIYGEKPLTFPSMTSTNDTNETHAKTLTLKYEETQAKTWSSTVSLKIGVTAKLRAGIPVIAEGKVEVSTEFNSEYEWGSSIQTTTSQEASYQAVVPPMTKVTIRAAATQGSIDVPFSYTQKDILTTGEVVTYKMDDGLFTGMNNYNFQFEATQEPI

SEQ ID NO: 483 - protein, 492 aa, Triticum aestivum
MFPVTGSPKCVAFRSKHTRKYLGSVQAGSEESAGGGKFFEELSHGADDVDVLASPYTRFYLEPSKEHDGLLHVRCCHNNKYWVAKHVGEGSGHWIIGIVNEPEDDLSKPSCTLFEPIPLADTDNNLSIRFFRPQQTTSSESDMTKEKGTTEEAYLFLGIGGHEKAVDQVKSLHDFSAIDLSKQLVLPKYVAFKGDNDMYLRARIIQKRNYLEFSSSDIADSTVVNTIFPNYANGNVRIKSNHFNRFWRLSPNWIWADSADTSSRDRDTLFRVVMLPDYIGLQNLGNSRYCKRLTADRKTSCLNAAVDTITLEARLRVEEAVLSRKIYGVEFKLSEARIYGEKPITFPSMTSTNDTNEPHAKTLTLKYEETQAKTWSSTVSLKIGVTAKLRAGIPVIAEGKVEVSTEFNSEYEWGSSIHTTASQEASYHAVVPPMTKVTVRAAVTQGSVDVPFSYTQRDILTTGEVVTYKMDDGLFTGMNNYNFQFEATQEPI

SEQ ID NO: 484 - protein, 492 aa, Triticum aestivum
MFPVTGSPKCVAFRSKHTRKYLGSVQAGSEESAGGGKFFEELSHGADDVDVLASPYTRFYLEPSKEHDGLLHVRCCHNNKYWVAKHVGEGSGHWIIGIVNEPEDDLSKPSCTLFEPIPLADTDNNLSIRFFRPQQTTSSESDMTKEKGTTEEAYLFLGIGGHEKTVDQVKSLHDFSAIDLSKQLVLPKYVAFKGDNDMYLRARIIQKRNYLEFSSSDIADSTVVNTIFPNYANGNVRIKSNHFNRFWRLSPNWIWADSADTSSRDRDTLFRVVMLPDYIGLQNLGNSRYCKRLTADKKTSCLNAAVDTITLEARLRVEEAVLSREVYGVEFKLSEARIYGEKPLTFPSMTSTNDTNETHAKTLTLKYEETQAKTWSSTVSLKIGVTAKLRAGIPVIAEGKVEVSTEFNSEYEWGSSIQTTTSQEASYQAVVPPMTKVTIRAAATQGSIDVPFSYTQRDILTTGEVVTYKMDDGLFTGMNNYNFQFEATQEPI

SEQ ID NO: 485 - protein, 492 aa, Triticum aestivum
MFPVTGSPKSVAFRSKHTRKYLGSVQAGSEESAGGGKFFEELSHGADDVDVLASPYTRFYLEPSKEHDGLLHVRCCHNNKYWVAKHVGEGSGHWIIGIVNEPEDDLSKPSCTLFEPIPLADTDNNLSIRFFRPQQTTSSESDMTKEKGTTEEAYLFLGTGGHEKAVDQVKSLHDFSAIDLSKQLVLPKYVAFKGDNDMYLRARIIQKRNYLEFSSSDIADSTVVNTIFPNYANGNVRIKSNHFNRFWRLSPNWIWADSADTSSRDRDTLFRVVMLPDYIGLQNLGNSRYCKRLTADKKTSCLNAAVDTITLEARLRVEEAVLSREVYGVEFKLSEARIYGEKPLTFPSMTSTNDTNETHAKTLTLKYEETQAKTWSSTVSLKIGVTAKLRAGIPVIAEGKVEVSTEFNSEYEWGSSIQTTTSQEASYQAVVPPMTKVTIRAAATQGSIDVPFSYTQRDILTTGEVVTYKMDDGLFTGMNNYNFQFEATQEPI

SEQ ID NO: 486 - protein, 98 aa, Zea mays
MVNQKPLFPGDSEIDELFKIFRVLGTPNEQSWPGVSCLPDFKTAFPRWQSQDLATIVPNLEPAGLDLLSKMLRYEPSKRITARQALEHEYFKDLEMVQ

SEQ ID NO: 487 - protein, 912 aa, Brachypodium distachyon
MELLGRSFLKGSAGPATAAAPRGGLCFASVGGRRQGRSTRKTLRSKPPVGALAERVVLTPAPTERVGRPEAHSQSVAARAVVTVRRKRKEDVKERVAEQMDAYADRVGRSVLLELVSTETDPRKGGPKKSKKSRLVGWFEKRDVKAELVVYTAEFTVDAAFGEPGAVTVLNRHQREFFIESIVVEGFPSGPAHFTCNSWVQPTRVSGGVTPRVFFTNKPYLPSKTPAGLRELRRRELKELRGSGTGERRITDRAYDYDVYNDLGNPDKGAGFERPVLGGEAMPYPRRMRTARPSTITDEGAESRVEYPEPIYVSRDEEFEEGKNEMLSEGAIKALLHNFMPLLVSSVSPGSRDFAGFHDVDNLFKEGLRLKQALHDQLFQKIPFVRKIQENSEGLLRYDTPDIIKKDKFAWLRDDEFARQALAGINPVNIERLQEFPPVSKLDPAVYGPPESAITEEHIIGNLDGMTVQQALEENKLYMLDYHDIFMPFLDRINSLDGRKAYGTRTLFFLTAGGTLKPIAIELCLPPMKEDCKRAKRVFTPPADATSIWLWQLAKAHVCSNDAGVHQLINHWLRTHACMEPFIISAHRQMSAMHPVFKLLKPHMRYTLKINALARQILINGDGVIESGFTPGRYCMEMSSFAYDNLWRLDQEGLPADLIRRGMAVEDASQPHGLRLLIEDYPYATDGLLLWSAISRWCEAYVAAYYASDEAVQSDYELQSWYAEAVRSGHPDKRDAPWWPRLSTPGDLASLLTTLVWLCSAQHAALNFGQYPLGGYIPNRPPLMRRLVPAEGDPEHAHLVADPHRFYLSALPSLTQTTTFMTVIDTLSTHSADEQYLGERPDEDDWTADPAALAAAREFAAEVRRAEEEIERRNADPARRNRCGAGVLPYELMAPSSGPGITCRGVPNSVTI

SEQ ID NO: 488 - protein, 917 aa, Setaria italica
MELLGRSFLPGPAAGAAGRERGGGPCFAAVGREGRRGRRPLRSAAPVGALAERVVVTPAPAERAGAAPPEEQPPQHPQSVAARAVVTVRRRRKEDTKRRVAEQLDAYADRVGRSVLLELVSTETDPRKGGPKKSKRSALVGWFEKKDVKAERVVYTAEFTVDASFGEPGAVTVLNRHQREFFIESIVVEGFPTGPAHFTCNSWVQPTRVDRNPRVFFTNKPYLPAETPPGLQELRQKELSDLRGESAADAAGERKLTDRVWDYDVYNDLGNPDKGAEFARPVLGGEQLPYPRRMRTGRPKTVTDERAESRVEYPEPTYVSRDEEFEEGKNEMLSEGALKALLHNFMPLLVSSVSPDIRDFAGFHDVDNLFKEGLRLKQALQDQLFQKIPFVRKIQENSEGLLRYDTPDIIKKDKFAWLRDDEFARQALAGINPVNIERLQAFPPVSKLDPAVYGPKESAITEEHIIGQLDGMSVAQALEDNRLYMLDYHDIFLPFLDRINSLDGRKAYGTRTLFFLTAAGTLKPIAIELSLPPMTEGCKRAKRVFTPPADATSNWLWQLAKAHVCSNDAGVHQLINHWLRTHACMEPFIIAAHRQMSAMHPIFKLLKPHMRYTLKINALARQILIAGDGVIESGFTPGRYCMEMSAFAYRELWRLDQEGLPADLIRRGMAVEDPTKPHGLRLLIEDYPYATDGLLLWSAIERWCDAYVATYYPSDESVRGDAELQAWYDEAVRVGHADKRDAPWWPRLSTPADLASLLTTLLWLTSAQHAALNFGQYPLGGYIPNRPPLMRRLVPAEGDPEHAHLVADPHRFFLSALPSLTQTTTFMTVIDTLSTHSADEQYLGERPDEAWTADPAALAAAREFAEEVRRAEEEIERRNADTGRRNRCGAGVLPYELMAPTSGPGITCRGVPNSVTI

SEQ ID NO: 489 - protein, 924 aa, Sorghum bicolor
MASAMELVGRSFLPGSAAAASPAGRERRRGGPCFAAVGREGSAHKRRPSLRSTAPVGALAERVVVTPAPPEERAGTAPPEPHPQSVAARAVVTVRRRRKEDAKRRVAEQLDAYADRVGRSVLLELISTETDPRKGGPKKSRRSALVGWFEKKDVKAERVVYTADFTVDGCFGEPGAVTVLNRHQREFFIESIVVEGFPSGPAHFTCNSWVQPTRVDRNPRVFFTNKPYLPAETPPGLQELRRQELSDLRGEGGADTTGERRITDRVWEYDVYNDLGNPDKGAEFARPILGGEQQLPYPRRMRTGRPKTFTDDRAESRVEYPEPIYVSRDEEFEEGKNEMLSEGALKALLHNFMPLLVSSVSPDIRDFAGFHDVDNLFKEGLRLKQALQDQLFQKIPFVRKIQENSEGLLRYDTPDIIKKDKFAWLRDDEFARQALAGINPVNIERLQAFPPMSKLDPAVYGPPESAITEEHIIGQLDGMSVRQALQDNRLYMLDYHDIFLPFLDRINAQDGRKAYGTRTLFFLTAAGTLKPIAIELCLPPMTDGCARAKRVFTPPADATSNWLWQLAKAHVCSNDAGVHQLINHWLRTHACMEPFIISAHRQLSAMHPIFKLLKPHMRYTLKINALARQILINGDGVIESGFTPGRYCMEMSSFAYQELWRLDQEGLPADLIRRGMAVEDPTQPHGLRLLIEDYPYATDGLLLWDAITRWCDAYVAMYYPSDQAVQGDTELQSWYREAVQTGHADKRGAPWWPRLSTPGDLASLLTTLLWLTSAQHAALNFGQYPLGGYIPNRPPLMRRLVPADGDPEYAHLVADPHRFFLSALPSLTQTTTFMTVIDTLSTHSADEQYLGERPDEAWTADPAALAAAREFADEVRRAEEEIDRRNADTGRRNRCGAGVLPYELMAPTSGPGITCRGIPNSVTI

SEQ ID NO: 490 - protein, 941 aa, Zea mays
MASAMKLLGRSSLASPAAAAPGRERRGGPCFAAVGREGSAHRRRSSLRSTAPVGALAERVVVTPAPPERAGAGPPEPHPQSVAARAVVTVRRRRKEDAKRRVAEQLDAYADRVGRSVLLELISTETDPRKGGPKKSRRSALVGWFEKKDVKTERVVYTADFTVDGSFGEPGAVTVLNRHQREFFIESIVVEGFPSGPAHFTCNSWVQPTRVDRNPRVFFTNKPYLPAETPPGLQELRRQQLSDLRGEGADTGERRITDRVWEYDVYNDLGNPDKGAEFARPVLGGEQQLPYPRRMRTGRPKTITGKPPLSHDRAESRVEYPEPIYVSRDEEFEDGKNEMLSEGALKALLHNFMPLLVSSVSPDIRDFAGFHDVDNLFKEGLRLKQALQDQLFQKIPFVRKIQENSEGLLRYDTPDIIKSKPAPMRLPPPPSMIHGEDKFAWLRDDEFARQALAGINPVNIERLQAFPPMSKLDPAVYGPPESAITEEHIIGQLDGMSVQQALQDDRLYMLDYHDIFMPFLDRINAQDGRKAYGTRTLFFLTAAGTLKPIAIELCLPPMTDGCARAKRVFTPPADATSNWLWQLAKAHVCSNDAGVHQLINHWLRTHAAMEPFIIAAHRHLSAMHPIFKLLKPHMRYTLKINALARQILINGDGVIESGFTPGRYCMEMSSFAYRELWRLDQEGLPADLIRRGMAVEDPTQPHGLRLLIEDYPYATDGLLLWSAITRWCDAYVAMYYPSDESVQGDTELQSWYREAVQTGHADKRDAPWWPRLSTPADLASLLTTLLWLTSAQHAALNFGQYPLGGYIPNRPPLMRRLVPAEGDPEYAHLVADPHRFFLSALPSLTQTTTFMTVIDTLSTHSADEQYLGERPDEAWTADPAALAAAREFADEVRRAEEEIERRNADTGRRNRCGAGVLPYELMAPTSGPGITCRGVPNSVTI

SEQ ID NO: 491 - protein, 975 aa, Oryza sativa
MASLELLGRRMSSCSWGGGSAAAMRGGAGMCFASMEAAGSRGMGKGASRRRTARSTAPVGALVERVVVAPAPVEQQRGAGRPEAHPQSVAARAVVTVRRRRKEDAKDRFAEQLDALADRVGRSVLLELVSTETDPRKGTPKKSKPSALVGWFDKKDVKAERVVYTAEFAVDAGFGEPGAVTVLNRHQREFYIESIVVEGFPTGPAHFTCNSWVQPTRVSRDRRVFFSNRPYLPSETPPGLRELRLRELADLRGDGTGERRITDRVYDYDVYNDLGNPDKGVASARPVLGGEQMPYPRRMRTGRPSTATDASAESRVEYPEPIYVSRDEEFEEGKNEMLSEGAIKALLHNFMPLLVSSVSPDIRDFAGFHDVDNLFKEGLRLKQALHDQLFQKIPFVRKIQENSEGLLRYDTPDIIKKDKFAWLRDDEFARQALAGINPVNIERLQVRRRAHDQHGKTLQLPKQSSHEFVVLAVAVHVQHSGADWWSPFFFFFYSLRAQAFPPVSKLDPAVYGPPESAITEEHIIGHLDGMSVQEAVEGSRLYMLDYHDIFLPFLDRINAQDGRKAYGTRAVFFLTAAGTLKPIAIELCLPPMTDGCKRAKRVFTPPADATSNWLWQLAKAHVCSNDAGVHQLINHWLRTHACMEPFIIAAHRQMSAMHPIFKLLKPHMRYTLKINALARQILINGDGVIESGFTPGNVCMEMSAFAYRELWRLDQEGLPADLIRRGMAVEDPSQPHGLRLLIEDYPYAADGLLLWSAISRWCEAYVAAYYPSDEAVQADYELQSWYAEAVQSGHADKRGAPWWPRLSTPGDLASLLTTLVWLCSAQHAALNFGQYPLGGYIPNRPPLMRRLVPAEGDPEYAHLVADPHRFFLSALPSLTQTTTFMTVIDTLSTHSADEEYLGERPDEAWTADPAALAAAREFAADVRRAEEEIERRNADPSRRNRCGAGVLPYELMAPSSGPGITCRGVPNSVTI

SEQ ID NO: 492 - protein, 274 aa, Panicum virgatum
MASRALAALLTVLAFVGFASVPRALATDPTQLQDFCVADNNNKAVLVNGLVCKNPNVVTANDFFFKIMPATPNAQGSGVAGVAADVLPGLNTLGISLARIDFVPGGQNPPHTHPRASEILTVMQGTLLVGFVTSNQLLNNTLFTKQLVVGDVFVFPQGLIHFQLNNGKAPAVAIAALSSQNPGTVTIANAVFGSKPPILDAILAKAFMLEKDTVDWVQQAFGAAPVAGGGGGMPGGGGYPGGGYPGNGTGGGYPGGGYPGNGTGGGYPGVPGYP

SEQ ID NO: 493 - protein, 263 aa, Sorghum bicolor
MASRFATLLAVLAVVGFASVPRGGLATDPTQLQDFCVADNNNLAVLVNGVVCKNPKVVKANDFFFHIEPMAANAQGSAVTPVAVTEIPGLNTLGISLARIDFVPGGQNPPHTHPRGSEILTVIQGTLLVGFVTSNQLLNNTLFTKQLVMGDVFVFPQGLIHFQLNNGKTPAVAIAALSSQNPGTITIANAVFGAKPPILDEILARAFMLEKATVDWVQQAFGAAPVAGGGGGGGYPGGGLPGGGGYPGGNGTGGGYPGYPGRG

SEQ ID NO: 494 - protein, 243 aa, Panicum virgatum
MASRALAALPITVLAFVGLASVPRALATDPTQLQDFLLVNGVVCKNPNVVTANDFFFKIMPAAPNAQGSGVAGVAVDMLPGLNTLGISLARIDFVPGGQNPPHTHPRASEILTVIQGTLLVGFVTSNQLLSNTLFTKQLAVGDVFVFPQGLIHFQLNNGKAPAVAIAALSSQNPGTVTIANAVFGSKPPILDEILAKAFMLEKATVDWVQQAFGAAPVAGGGGGYPGNGTGGGYPGVPGYGYP

SEQ ID NO: 495 - protein, 263 aa, Zea mays
MAYRAFATLLAVLAFVGFASVPRGLATDPTQLQDFCVADNKNPVLVNGVVCKNPNMVKATDFFSTIVPVAPNGQGSAVTPVAVNEIPGLNTLGISLARIDFVPGGQNPPHTHPRGSEILTVIQGTLLVGFVTSNQLLNNTLFTMQLNMGDVFVFPQGLIHFQLNNGKTPAVAIAALSSQNPGTVTIANAVFGAKPPILDDILARAFMLEKATVDWVQQAFGAAPVAGGGGGLPGGGGYPGSGGGLPGGGGYPGSGFPGYPGRS

SEQ ID NO: 496 - protein, 520 aa, Panicum virgatum
MVTMPAAASPGARRSVVAELEGGLLRGADTFPYFMLVAFEASGLPRFAALLALWPLLRLLELAGRGGLALRAAALVATAGVPRAEVEAVSRAVLPKFMADDVDPRAWAAFGACEGRRVVVATRLPRVMVERFAREHLGAHEVVGCELEYSRLRRCTGLLRGGGAEAVAGRVRALFAGGDHPDLGIGRSEMARSFLPFCKEQLEPPFTAGAATTSAAAPPFRPVIFHDGRLVCRPTALMSLVILLWLPLGALVAFVRIAVGLMVPIWTIPYIAPIFGGAVITHGRAPPPVRRASDAAAAEDGGSPSGVLFVCTHRTLMDPVVLATVLGRRVAAVTYSISRLSEVLSPIPTVQLTRDRVVDAARMRAELARGDVAVCPEGTTCREPFLLRFSALFAELSDRIVPVAMNYRVGLFHPTTARGWKAMDPIFFFMNPRPVYEVTFLNQLPAEATCAAGRSPVDVANYVQRMLAATLGFECTSLTRKDKYRVLAGNDGIVSAAKPAAPGKAAWQSRVKEVLGFLLH

SEQ ID NO: 497 - protein, 519 aa, Panicum virgatum
MVTMPAAPPRARRSVVAELEGALLRGADTFPYFMLVAFEASGLPRFAALLALWPLLRLLELAGRGGLALRVAALVATAGVSRAEVEAVSRAVLPKFMADDVDPRAWAAFGACEGRRVVVATRLPRVMVERFAREHLGAHEVVGCDLEYSRLRRCTGLLRGGGGEAVAGRVRALFAGGDRPDLGIGRSEMARSFLPLCKEQLEPPFTAGAATPSAAAPPFRPVIFHDGRLVCRPTALMSLVILLWLPLGALVAFVRIAVGLMVPIWTIPYIAPIFGGAVITHGRAPPPVRRGSDAAVEDSGGSPSGVLFVCTHRTLMDPVVLATVLGRRVAAVTYSISRLSEVLSPIPTVRLTRDRGVDAARIRAELARGDVAVCPEGTTCREPFLLRFSALFAELSDRIVPVAMNYRVGLFHPTTARGWKAMDPIFFFMNPRPVYEVTFLNQLPAEATCAAGKSPVDVANYVQRILAATLGFECTSLTRKDKYRVLAGNDGIVTAAKPAALGKAAWQSRVKEVLGFLLH

SEQ ID NO: 498 - protein, 512 aa, Zea mays
MTPASQAAPPRARRSVVAELEGALLRSADTLPYFMLVAFEASGLPRFALLLALCPLLRLLELAGRGGLALRAAAFVATAGVTRAELEAVSRAVLPKFMADDVDPAAWAAFGSCEGRRVVVTRMPRVMVERFAKEHLGAHAVVGSDLEYSRLRRSTGLLKGACHEAVASRARALFAGDDLPDLAIAGSEMARSFTFCEEQISPPFTGDHGMNAAPPFRPVIFHDGRLVCRPTPFMSLVILLWLPLGVLVAFVRIAVGLMVPIWSIPYIAPVFGGAVIIHGRAPPPVRPSDAADVGSPPSGVLFVCTHRTLMDPVVLATVLGRRVAAVTYSISRLSEILSPIPTVRLTRDREVDAARMRAELASGDVAVCPEGTTCREPFLLRFSKLFAELSDRIVPVAMNYRVGLFHPTTARGWKAMDPIFFFMNPRPVYEVTFLNQLPAEATCAAGKSPVDVANYVQRILAATLGFECTTLTRKDKYTVLAGNDGVLNAKPAAAGKPAWQSRVKEVLGFLLH

SEQ ID NO: 499 - protein, 522 aa, Sorghum bicolor
MTMPTTSSAAAPASPPRARRSRSVVAELEGALLRSADTFPYFMLVAFEASGLPRFVLLLALWPLLRLLELGAGRRDLALRAAAFVATVGVPRADVEAVSRAVLPKFMADDVDPAAWASFGSCEGKRVVVTRMPRVMVERFAKEHLGAHAVVGCDLEYSRLRRSTGLLKGAGHDAVATRVRALFAGDDRPDLGIGASEMASSFLTFCQEQLRPPFTADHDTNAPPFRPVIFHDGRLVCRPTPFMSLVILFWLPLGVLVAFVRIAVGLMVPIWTIPYIAPVFGGAVIIHGRAPPPVRVSDDAAAAAGSPSGVLFVCTHRTLMDPVVLATVLGRRVAAVTYSISRLSEILSPIPTVRLTRDRGVDAARMRAELARGDVAVCPEGTTCREPFLLRFSKLFAELSDSIVPVAMNYRVGLFHPTTARGWKAMDPIFFFMNPRPVYEVTFLNQLPAEATCAAGKSPVDVANYVQRILAATLGFECTTLTRKDKYTVLAGNDGSVNAKPPAAGKPAWQSRVKEVLGFLLH

SEQ ID NO: 500 - protein, 522 aa, Oryza sativa
MVTMSASAEAKSRRERRSVVAELEGALLRDAATFPYFMLVAFEASGLPRFAALLALWPLLWALERALGRGDLALRAAAFVATAGVPRAEVEAVARAVLPKFMADDVDPAAWAAFGSCGGRRVVVTRMPRVMVERFAREHLGAHEVVGCDLEYSRLRRSTGFVRGGGGGERAVAERVRALFADGDRPDVGIARSESATRSFLPFCKKQLRPPFCEDDGDDVAAAGEQHKCPPFRPVIFHDGRLVCRPTPLMSLVILLWLPLGALVAFVRIAVGISVPIQIIPRIAPYFGGAVVVHGAPPPAAASGPASGVLFVCTHRTLMDPVVLATVLGRRVAAVTYSISRLSEVLSPIPTVRLTRDRGVDAAQMRAELSRGDVAVCPEGTTCREPFLLRFSALFAELSDRIVPVAMNYRVGLFHPTTARGWKAMDPIFFFMNPRPVYEVTFLNQLPAEETCAAGKSAVDVANYVQRILAAKLGFECTTFTRKDKYRVLAGNDGIVNVKPPAAADPAPWQRRLKEVLGFLLH

SEQ ID NO: 501 - protein, 352 aa, Hordeum vulgare
MWPMEEFFMAVKRTEHVEVTSRSLAASATGMEGFGGGVEQPKMVRVFCDDFDATDSSSDEEDGERRRVKRYVQEIRLQPAVQVKVEESAPVAKAASATATATRPRVMVPVRKRKAEAGGERRFRGVRRRPWGKYAAEIRDPWRRVRVWLGTFDTAEEAAKVYDSAAIKLRGPDATVNFQQSEDGEDMEVPAEVAERLPQPPAGSKNSSTSATSYDSCEESHVAAASPTSVLRSFPQSTLPAAVDGDTAKKPSSSSSTAETDESSGVFGCSFSGDDFAGELAPLYSDFDLLSDFAEPPMDFLSNLPEPAFAFTSDCSSSAFQPCPPSPAALQQADEFFQDITDLFQIDPLPVI

SEQ ID NO: 502 - protein, 412 aa, Setaria italica
MGSAPAANFREICRARRADGPAAVLAIGTANPGNCVLQEDFPDFYFRATKSEHLTGLKEKFKRVCQKLGVQRRYLHHTEELLSAHPEFLDLVCSPSLDERLDIVKTAVPELAAAASRKAIAEWGRPAADITHLVVTTNSGAHIPGVDFQLVPLLGLRPTVRRTMLYLNGCFAGAAALRVAKDLAENNRGARVLVVCAELTVLVFTRPVEGYFQTLVKQALFGDGAGAVIVGADPVMTIPAERPLFEIVSAAQTIISESEDAITMHLTKGGCGGNISTRQVPVLIGHNIERCLLDAFQPLGIGAGWNDLFWDVHPGSSAILDQVDTVLHLKPEKLAASRRVLSEYGNMQGVTVIFVLDELRRRMEKGEEEGEPEWGVMVAFGPGLTVETMVLHRCAAQATGAPTEEGLTVFCG

SEQ ID NO: 503 - protein, 404 aa, Sorghum bicolor
MGSSAAPANVREICRAQRADGPAAVLAIGTANPANCVPQDEFPDFYFRATKSDHLTGLKEKFKRVCQKLGVQKRYLHHTEELLSAHPEFLDHSSPSLDARLDIVKTAVPELAAQASRKAIAEWGRPAADITHLVVTTNSGAHIPGVDFRLVPLLGLRPTVRRTMLYLNGCFAGAAALRLARDLAENNSGARVLVVCAEITVLLFNGPEEGCFQTLVNQGLFGDGAGAVIVGADPLAAERPLFEIVSAAQAIIPESEDVITMHLTRGGYGGNISTRQVPVLIGDNIERCLTDAFAPLGGVIGAEWNDLFWDVHPGSSAILDQVDAVLKLKPEKLAASRRVLSEYGNMFGVTVIFVLDELRRRMEKGEEEGAPEWGVMVAFGPGLTVETMVLHRSGTPAEKKLAEA

SEQ ID NO: 504 - protein, 402 aa, Zea mays
MGSAWANVREICRAQRADGPAAVLAIGTANPANCVPQDEFPDFYFRATKSDHLTGLKEKFKRVCQKLGVQKRYLHHTEELLSAHPEFLDRSSPSLDARLDIVKTAVPELAAQACRKAIAEWGRPAADVTHLVVATNSGAHIPGVDFQLVSLLGLRPTVRRTMLYLNGCSAGAAALRLARDLAENNRGARVLVACAEITVLLFDGPEEGCFQTLVNQGLFGDGAGAVVVGADPAAPAERPLFEIVSAAQTVIPDSEGVITMHLTKGGYGGNISTRQVPVLIGDHIERCLTDAFAPLGVGAGWNDLFWDVHPGSSAILDQVDAVLKLKPEKLAASRRVLSEYGNMFGVTVIFVLDELRRRMTNGEEEGAPAEWGVMVAFGPGLTVETMVLHRSGTPAETKLGEA

SEQ ID NO: 505 - protein, 412 aa, Panicum virgatum
MGSAPANVREICRARRADGPAGVLAIGTANPANCVLQDEFPDFYFRATKSEHLTGLKDKFRRVCQKMGVRKRYLHHTEELLGAHPEFLDPHTPSLDARLDIAKAAVPELAAEASRRAIAEWGRPAADITHLVVTTNSGAHMPGVDFRLVPLLGLRPTVRRTMLYLNGCFAGAAALRVAKDLAENNRGARVLVVCAEITVQLFTRPEDGCFQTLVNQGLFGDGAGAVVVGADPVMIRTPAVVRERPIFEIVSAAQTIVPDSEDVITMHLTKGGYGGDISTRQVLVLMGDNIELCLLDAFEPLGIGTGWNDLFWAVHPGSSPVLDQVDAVLHLKPEKLAASRRVLSEYGNMFGVTVIFVLDELRRRMQNGEEGAPEWGAMLAFGPGLTVETMVLHRCVAQGTGAAPPEDKLAAA

SEQ ID NO: 506 - protein, 412 aa, Panicum virgatum
MGSAPANVREICRARRADGPAAILAIGTANPANCVLQDEFPDFYFGATKSEHLTGLQDKFTRLCQKLGVRKRYLHHTEELLGAHPEFLDPHAPSLDARLDIAKAAVPELAAEASRRAIAEWGRPAADITHLVVTTNSGAHMPGVDFRLVPLLGLRPTVRRTMLYLNGCFAGAAALRIAKDVAENNRGARVLVVSAEITVQLFTRPEEGCFQTLVNQGLFGDGAGAVVIGADPVMIRTPAVVRERPIFEIVSAAQAIVPDSEDVITMHVTKGGYGGDISTRQVLVLIGDNIERCLLDAFEPLGIGAGWNDLFWAVHPGSSPVLDQVDAVLRLKPEKLAASRRVLSEYGNMFGVTVIFVLDELRRRMEKEEEEGAPEWGALMAFGPGLTVETMVLHRCVAQGTGAAPPDKLAAA

SEQ ID NO: 507 - protein, 617 aa, Aegilops tauschii
MMMDLGAARATPPSAQEAAEAAVRAVGCGYDLADDLRLFRAKDRLLDLGGGGERDLCLPGGAVVTSVPAGVVADKGERARFRSDVLSFTQMAEHVNQSLSLTGKIPSGPFNAMFDYRGCWHRDAAATRSLCFDARLVELYAVEAPRGARLALRDHVARDVPTSWDPPALAAFIDTHGTHVVVGVRMGGKDVVCVKQLRGSALEPRDVQARLKKLADATFSQSQDRRQSSAGAKGRGSSSRRPPGPGSAAWRAFRSPVIHNKDDVVGIHVRRGGVDDGQGHDDWLTTIAASPDVISMAFVPITSLLTGVPGRGFLNHAVNLYLRYKPPIEELEQFLEFQVPRQWAPEFGELPLALGPQRKKKKDSLPSLQFTLMGPKLRVNTAKVDSGGRPVTGIRLFLEGKKNSRLGVHLQHLSATPRAVPIVVGEAVTTAVGDAVNERAYFEPVRSSLLTHACTAPVQHAGARIDDCAAVVTAAWLEVREACLKKVLFLRLGFSGVARTKIRRSEWDGPLATTRKSGSLSAMLSAALSGTAAVPPQGEPMEGKVEVNSAVFPKGPPVPLPVQKMAKYIDTTEVTRGPDDLPGYWVVTGAKLCVEGGKVALKAKYSLLISAPEDDEV

SEQ ID NO: 508 - protein, 619 aa, Hordeum vulgare
MMMMDLGAARATPPSAQEAAEAAVRAVGCGYDLADDLRLFRAKDRLLDLGGGGGERDMCLPGGAVVTGVPAGVSADKGERARFRSDVLSFAQMAEHVNQSLSLTGKIPSGPFNAMFDYRGCWHRDAAATRSLCFDARLVELYAVEAPRGARLALLAHVARDVPTSWDPPALAAFIDRHGTHVVVGVRMGGKDVVCVKQLKGSALAPSDVQARLKKLADATFSQSQDRRQSSSGSKSRGSSSRRPLGPGSAAWRAFRSPVIHNKDDVVGIHVRRGGVDDGQGHDEWLTTVAGSPDVISMAFVPITSLLTGVPGRGFLNHAVNLYLRYKPPIEELEQFLEFQVPRQWAPEFGELPLALGPQRKKKKDSLPSLQFTLMGPKLRVNTAKVDSGGRPVTGIRLFLEGKKNSRLGVHLQHLSATPRAVPVVVGEAVTATGGDAVNERAYFEPVRSSLLTHACTAPVQHNGARIDDCAAVVTAAWLEVREACLKKVLFLRLGFSGVARTKIRRSEWDGPLATTRKSGSLSAMLSAALSGTAAIPPQAEPMEGKVEVNSAVFPKGPPVPLPVQKMAKYIDTTEVTRGPDDLPGYWVVTGAKLCVEGGKVALKAKYSLLISAPEDDDV

SEQ ID NO: 509 - protein, 618 aa, Triticum aestivum
MMMDLGAARATPPSAQEAAEAAVRAVGCGYDLADDLRLFRAKDRLLDLGGGGERDLCLPGGAVVAGVPAGVVADKGERARFRSDVLSFTQMAEHVNQSLSLTGKIPSGPFNAMFDYRGCWHRDAAATRSLCFDARLVELYAVEAPRGARLALRDHVARDVPTSWDPPALAAFIDTHGTHVVVGVRMGGKDVVCVKQLRGSALEPRDVQARLKKLADATFSQSQQDRRQSSAGAKGRGSSSRRPPGPGSAAWRAFRSPVIHNKDDVVGIHVRRGGVDDGQGHDDWLTTIAASPDVISMAFVPITSLLTGVPGRGFLNHAVNLYLRYKPPIEELEQFLEFQVPRQWAPEFGELPLALGPQRKKKKDSLPSLQFTLMGPKLRVNTAKVDSGGRPVTGIRLFLEGKKNSRLGVHLQHLSATPRAVPIVVGEAVTTAVGDAVNERAYFEPVRSSLLTHACTAPVQHAGARIDDCAAVVTAAWFEVREACLTKVLFLRLGFSGVARTKIRRSEWDGPLATTRKSGSLSAMLSAALSGTAAVPPQGEPMEGKVEVNSAVFPKGPPVPLPVQKMAKYIDTTEVTRGPDDLPGYWVVTGAKLCVEGGKVALKAKYSLLISAPEDDEV

SEQ ID NO: 510 - protein, 586 aa, Aegilops tauschii
MGTVKAWVAGKYAEPMGPMHDSLRVAYVVFSFCAAFLLGGIKAMVVGPVAAALMILGNVGVILVLFPAHVWWTIYSLIKTDRINAGLKLAVAIALPVLFGLWLGLGIFGSALVALGYGFFTPWISTFEAFRQESEAKKFVHGIVDGTWGTIKGSCTVVRDFADMCFHSYPVYLKELRECAQDREPLSIRLLDVPSCILVGLLGLIVDIPLYTVIALIKSPYMLFKGWQRLLHDLISREGPFLEPVCVPIAGLAILFWPLVVVGSVLLAVVSSIFVGLYGAVIVYQEKSFRRGASYVVTMVAEFDEYTNDWLYLREGTVLPKPSYRKRKLSDSAEFSVRPNVSVRGGEHPSSSSEAPAMLVPTLVPARSVREAIQEVKMVQIWENVMKSCEQRGRDLLNLNVITSVDLTEWLRTKDGGNETINLGLPSYDMLCTVLQSIKAGSAGLLLGNGVEVDQQNRPQDLLLDWFFHPVLVLKDQIQVLKMTEQEVRFLEKSTLFVGGSSAAATADAWDNGAETPRDPVRTAQIQAISRRMVGIVRSMSKFPTYRRRYRHVVKLLVAYAVEREGSFGSSASGPSVSFEITRLEV

SEQ ID NO: 511 - DNA, 32 bp, Artificial Sequence
  Primer
aaagtcgaccacacacacacacagttgaagag

SEQ ID NO: 512 - DNA, 32 bp, Artificial Sequence
  Primer
aaaaagaattcactccacagcaggttcatctc

SEQ ID NO: 513 - DNA, 27 bp, Artificial Sequence
  Primer
aaaggatcctcgacgggcatggacatc

SEQ ID NO: 514 - DNA, 30 bp, Artificial Sequence
  Primer
aaaggatcccgatcaaacttggtcaacgtc

SEQ ID NO: 515 - DNA, 32 bp, Artificial Sequence
  Primer
aaaggatcccacaccacatagacaaatcaacg

SEQ ID NO: 516 - DNA, 30 bp, Artificial Sequence
  Primer
aaaggatccagcagaggcatctatgcgaag

SEQ ID NO: 517 - DNA, 31 bp, Artificial Sequence
  Primer
aaaggatccctgcttggaaggttcaaatctc

SEQ ID NO: 518 - DNA, 31 bp, Artificial Sequence
  Primer
aaaggatcccataaataggctagcccgacga

SEQ ID NO: 519 - DNA, 33 bp, Artificial Sequence
  Primer
aaaaagaattctcttccttcgttctaccagcag

SEQ ID NO: 520 - DNA, 31 bp, Artificial Sequence
  Primer
aaaggatccggcgcttgcttctatttaaagg

SEQ ID NO: 521 - DNA, 29 bp, Artificial Sequence
  Primer
aaaggatccatcgatccacgcacatacac

SEQ ID NO: 522 - DNA, 28 bp, Artificial Sequence
  Primer
aaaggatcctgctttgacccatttcgtg

SEQ ID NO: 523 - DNA, 31 bp, Artificial Sequence
  Primer
aaaggatccggttgcaagaaagctaaggttg

SEQ ID NO: 524 - DNA, 29 bp, Artificial Sequence
  Primer
aaacccggggagtcacgacggaccaaatc

SEQ ID NO: 525 - DNA, 32 bp, Artificial Sequence
  Primer
aaaggtaccgccaagaagaagcataggcatag

SEQ ID NO: 526 - DNA, 36 bp, Artificial Sequence
  Primer
aaaaagaattcgctagcttaaccttaatatcggtgg

SEQ ID NO: 527 - DNA, 28 bp, Artificial Sequence
  Primer
aaaggatccgacgcagcaaaggtgtctc

SEQ ID NO: 528 - DNA, 30 bp, Artificial Sequence
  Primer
aaaggatcccctccgtactgtgactcgttg

SEQ ID NO: 529 - DNA, 31 bp, Artificial Sequence
  Primer
aaaggatcctctcaacagcacctccctaatc

SEQ ID NO: 530 - DNA, 29 bp, Artificial Sequence
  Primer
tttttgaattcgacgtgatcgatcgccac

SEQ ID NO: 531 - DNA, 36 bp, Artificial Sequence
  Primer
aaagtcgactcatctttaggaggagatacagagaga

SEQ ID NO: 532 - DNA, 28 bp, Artificial Sequence
  Primer
aaaggatcccgctcgtttctcactcgct

SEQ ID NO: 533 - DNA, 26 bp, Artificial Sequence
  Primer
aaaggatccacgcacaccagccacag

SEQ ID NO: 534 - DNA, 36 bp, Artificial Sequence
  Primer
aaaggatcctatagcaacataattgctcattgttgg

SEQ ID NO: 535 - DNA, 26 bp, Artificial Sequence
  Primer
aaaggatccggaacgcgggagctgag

SEQ ID NO: 536 - DNA, 32 bp, Artificial Sequence
  Primer
aaaaagaattcccctgtttctccctctaccag

SEQ ID NO: 537 - DNA, 32 bp, Artificial Sequence
  Primer
tttcccggggtcacaacacaccatcaaatcac

SEQ ID NO: 538 - DNA, 31 bp, Artificial Sequence
  Primer
aaaaggccttgccagtaaataacaaagcagc

SEQ ID NO: 539 - DNA, 36 bp, Artificial Sequence
  Primer
aaaaagaattcctaaagccagccatcaggtcttctg

SEQ ID NO: 540 - DNA, 29 bp, Artificial Sequence
  Primer
aaaaagaattcaacacacgggtcctttcg

SEQ ID NO: 541 - DNA, 34 bp, Artificial Sequence
  Primer
aaaaagaattcgttcataaacaatgttccgactc

SEQ ID NO: 542 - DNA, 33 bp, Artificial Sequence
  Primer
aaaaagaattctactgttccgcgtataacatgg

SEQ ID NO: 543 - DNA, 35 bp, Artificial Sequence
  Primer
aaaaagaattcctaattgttgctcgaagttcctgg

SEQ ID NO: 544 - DNA, 36 bp, Artificial Sequence
  Primer
tttgaattcttaactcacactcatgactcatgcaag

SEQ ID NO: 545 - DNA, 32 bp, Artificial Sequence
  Primer
aaaaggccttattgaagcttatgcaccagtcg

SEQ ID NO: 546 - DNA, 33 bp, Artificial Sequence
  Primer
aaaaagaattcgacatgaaggcctgcagattac

SEQ ID NO: 547 - DNA, 33 bp, Artificial Sequence
  Primer
aaaaagaattcaccgacaaagaatcaaccaaag

SEQ ID NO: 548 - DNA, 36 bp, Artificial Sequence
  Primer
aaaaagaattcctaccacggtcccttgaatttactc

SEQ ID NO: 549 - DNA, 33 bp, Artificial Sequence
  Primer
aaaaagaattctgtattgctgatgcttgttcag

SEQ ID NO: 550 - DNA, 36 bp, Artificial Sequence
  Primer
aaaaagaattcctacaggaagaagagcagaggtacg

SEQ ID NO: 551 - DNA, 30 bp, Artificial Sequence
  Primer
aaaggtaccgcccagctgaactaaacaacc

SEQ ID NO: 552 - DNA, 32 bp, Artificial Sequence
  Primer
aaaaggcctcgaaatctgatgctctccttatg

SEQ ID NO: 553 - DNA, 36 bp, Artificial Sequence
  Primer
aaaaagaattcctaaaggcagcgatacaaactgaac

SEQ ID NO: 554 - DNA, 33 bp, Artificial Sequence
  Primer
aaaaagaattcatgtacgtacgctcatgcttcc

SEQ ID NO: 555 - DNA, 31 bp, Artificial Sequence
  Primer
aaaaagaattccgcctaatccggtgttttac

SEQ ID NO: 556 - DNA, 31 bp, Artificial Sequence
  Primer
aaaaggcctcctctctggacctaattcatcg

SEQ ID NO: 557 - DNA, 31 bp, Artificial Sequence
  Primer
aaaaggccttcgtagtaatggctgtagcggt

SEQ ID NO: 558 - DNA, 33 bp, Artificial Sequence
  Primer
aaaaagaattcaactgtttgatgagggagcaac

SEQ ID NO: 559 - DNA, 33 bp, Artificial Sequence
  Primer
aaaaagaattctgctaagttggtgcttcctgac

SEQ ID NO: 560 - DNA, 33 bp, Artificial Sequence
  Primer
aaaaagaattcggacgataatgctgccttcatc

SEQ ID NO: 561 - DNA, 35 bp, Artificial Sequence
  Primer
tttggtacctcaaaatttggctggtggatacacag

SEQ ID NO: 562 - DNA, 31 bp, Artificial Sequence
  Primer
aaaaggcctacaggatgaacaaagaatgcac

SEQ ID NO: 563 - DNA, 33 bp, Artificial Sequence
  Primer
aaagtcgacacacacagttgaagagatgtttcc

SEQ ID NO: 564 - DNA, 29 bp, Artificial Sequence
  Primer
aaaggatccaactacacccagctgcaagg

SEQ ID NO: 565 - DNA, 31 bp, Artificial Sequence
  Primer
aaaggatcctcgcctatataacacaccaacg

SEQ ID NO: 566 - DNA, 31 bp, Artificial Sequence
  Primer
aaaggatccctcccagcactacttggtcttg

SEQ ID NO: 567 - DNA, 27 bp, Artificial Sequence
  Primer
aaaggatccaagatcgacatggccgac

SEQ ID NO: 568 - DNA, 34 bp, Artificial Sequence
  Primer
aaaaagaattctctaccagcagcagcaagtaatc

SEQ ID NO: 569 - DNA, 29 bp, Artificial Sequence
  Primer
aaaggatcctatttaaagggcatggcagc

SEQ ID NO: 570 - DNA, 31 bp, Artificial Sequence
  Primer
aaaaagaattctgttcgatttcactccatcg

SEQ ID NO: 571 - DNA, 31 bp, Artificial Sequence
  Primer
aaaggatcctacgagcagtcccatcactagc

SEQ ID NO: 572 - DNA, 30 bp, Artificial Sequence
  Primer
aaaggatccctgggtagctgagcggataag

SEQ ID NO: 573 - DNA, 28 bp, Artificial Sequence
  Primer
aaaaagaattcccacgacggtttccaac

SEQ ID NO: 574 - DNA, 23 bp, Artificial Sequence
  Primer
aaaggatccctcgcccggccatg

SEQ ID NO: 575 - DNA, 28 bp, Artificial Sequence
  Primer
aaaaagaattccgccagcagcaacaaac

SEQ ID NO: 576 - DNA, 31 bp, Artificial Sequence
  Primer
aaacccgggacaccatcaaatcaccacacag

SEQ ID NO: 577 - DNA, 45 bp, Artificial Sequence
  Primer
aaaaagaattctacgttataatctaaaatccatctaactgttcag

SEQ ID NO: 578 - DNA, 35 bp, Artificial Sequence
  Primer
aaaaagaattcctacgaagttcctggcactaattg

SEQ ID NO: 579 - DNA, 31 bp, Artificial Sequence
  Primer
tttgaattctcatcatgcaagagcaaccagc

SEQ ID NO: 580 - DNA, 31 bp, Artificial Sequence
  Primer
aaaaggcctcaccagtcgaacagtacaatcg

SEQ ID NO: 581 - DNA, 35 bp, Artificial Sequence
  Primer
aaaaagaattcgcctgcagattacatatagacgtg

SEQ ID NO: 582 - DNA, 33 bp, Artificial Sequence
  Primer
aaaaagaattccttcgctgaatagtagccgttg

SEQ ID NO: 583 - DNA, 31 bp, Artificial Sequence
  Primer
aaaaggcctgtaaggaacgatcacgatcacg

SEQ ID NO: 584 - DNA, 35 bp, Artificial Sequence
  Primer
aaaaagaattcctagaacagctttgctcgatctcc

SEQ ID NO: 585 - DNA, 33 bp, Artificial Sequence
  Primer
aaaaagaattccaatattccaaacggctgaaac

SEQ ID NO: 586 - DNA, 37 bp, Artificial Sequence
  Primer
aaaaggcctggacctaattcatcggtaattcttaatg

SEQ ID NO: 587 - DNA, 33 bp, Artificial Sequence
  Primer
aaaaggcctggctgtagcggtacaagtatgtaa

SEQ ID NO: 588 - DNA, 40 bp, Artificial Sequence
  Primer
tttggtacctcagtgtaaccccctaccctaagctctactc

SEQ ID NO: 589 - DNA, 32 bp, Artificial Sequence
  Primer
aaaaggcctaaagaatgcacagagtaccaacc

SEQ ID NO: 590 - DNA, 27 bp, Artificial Sequence
  Primer
aaaggatcccctggacgtgaaggagcc

SEQ ID NO: 591 - DNA, 29 bp, Artificial Sequence
  Primer
aaaaagaattcaaaaacggcgtgcgatac

SEQ ID NO: 592 - DNA, 378 bp, Streptomyces sp.
atgaccaagccgtccatccgcaggtgcttcggcgtcgccgccgcgaccatggccgcgctggccgccacggtcgttccggcgtcggccgcgtccagcgatgtgtccatactcatcaaccgcacgaactgcaatcagaacgactacttcgagatacacaacaacaatggccgtgacacgctctgcttcgccaacgccggttcgatgcccgtcgccatctatggcgtcaactggatcgagtcggggaacaacgtggtgaccttcgagttccagcggaacctgagcgagccccggctggagaccgtcaccctcgacaagtggcgttcgtggcagcccggtcagccgtccattcaccgggtcacttggatcagaatccactga

SEQ ID NO: 593 - DNA, 981 bp, unknown
  environmental sample
atgtcaaatcaaggcgctttcattgcactcaaccagaccctatctaccaatgattatctggtgtcaaacaacaatgcattttttgccattatgcagggtgatggcaacctgtgcgtttaccggggttctgcaccagatgccaaccaaggtttcctatggggcgcgctgggtcaaagccaacccaatggtaactactttagcatcatgcagggcgatgggaatttatgcgtttataaaggaactggcccaagcgacaaccagggctttgtctggggcgcgctgaaccaaagccagccggatcgcgcttattttgcagtactacaggatgacggcaacctgtgcgtgtacaagggcaccagccccagtgacaatcagggcggcgtctggtgtagcactgctattgatccagtggtggatattgaaatctccagcattaattatgacgtggcggcggcaaaaatcattaaatccaccccggctgacctgtatcgccagagcgtcaccaacaacaccgcacagtcgcaaaccagcagcattagtggttctgaatcagtttcagaaacctcaggctggtcagattcgctggccgtcaaagttggggtcagcaccacctttaaaaccggcattccttttctggcggaaggcaaaatcagcgtgtcgctggacgtgaccaatacctatacctggaatggttcaaccacccgaaccaagacatggtcatttaacacgcccgtgactgtaccggccaactccacctatgtggcgctgattgctgccacagtaagtaccattagtgtgccctatacactagcaggaacattaatcttaaaatcaggcgcacgggtgccgggcattgtacgcggcatgtacaccggttcaaactcccacgacctgactgttacctacatcaagcaggacgccaccaccctaaatattgaatccattacccagccggttgaatacgcaaaactggtggcttaa

SEQ ID NO: 594 - DNA, 3288 bp, unknown
  environmental sample
atgaagttttttaagttgaaaaaggttgttatattctttcttgtgggaagttttttatgtcctgtaactggatacggtcaggaaatgcaggaagtcgctccttctgtttctacgagtgactcagaagttggcacttctgaatctaggtcggatgtttcaggagaaatgactgaaacgacgaccaatgcgtcatctgaacaggccagccaaggtgaagaaaccatgatgaattcggagctggtttccgctagtactgatatgagtttgttttttgacaaaaaaatacgattacgatcggtacggtcagagtccgcatatctcacttgggatggaaatgggcagtttctaatggatgctttacaatcaacaatgaatcaatccttcctgatcaatgggactgttgaggacggctatactattcaaaatagtgaaacatcagcaaatctacatgtactttctaaagaggcttttgctcaaagggaagaaaagatagaacaaaaatggttttttgagttattagaaaatggcagctacacagtacagacagctgatggtttgtatttgtcttcaaatgataaaaatgaactgatcttgtcggctgatgcagaggatgaggcggctcgttggcaggttgaagtcattgaggaaccacaaaaacttcctatggaggctcctttaacgaaaataccactatcagagatcagtatcgctaatgggacgtatcagattcaaagcagcggtctatcaatgttcctatctattggtgagttggataaaacgttgagaaaacaattagtcgtttcttctgaagggtatagcttaagtagtaaatttcaaatcacgcgacagactgatggctggtatactatcaagaataaatactccttattggcggcagatatcgctgggggtatcggaaaacctcaagtggcagtccagcaatatcaggataaccaatcagctgcgcaaaggtttcgatttcttgatgccggtaacggtgatgtagtgatcgagtcaaaattaggcaccgtgatcgaaagaactggcgggcaatcaaacgaaagcacaccagtgcagacctatactttcaacaatagcgctgcgcaaaagtggcgggtcgtttctgagactgtggcaaatgaagtgaatattgccgacgggatctataatattgccggaagtggcatcaataaaaatctttctttggctaataagtcaaagagtgaccggatcggtatcgtgttggatcggaatgtttctgaccaggtgcagcaacagtttgacataaaaaaagaagctgacggctggtacacgatcactaacaatttttctaagaaggtattggatatcagtggtggctctgccggtagtagggtagctgtccaacaatattttgctaataaatcagactcgcaaaaattcaagtttatcgatggcggggcaggcaatgtcttcattttatcaaagttgggtaccgtgcttgatcgtactggtggtaaaactgacaatggaacagcgatccaaacttatcgattaaataagactatttcgcaattgtggcgattgtctgccccccagagtcctaagacggtggatatcaaagacggcgagtatcagatcaaaggaaacagtaccactagagtcttttccatcggtgatctgacaactgcagatgctgttttgctgcgattgcgagattcgacttacagtaagatcgacaattttgtgattaataagcaggtagatggatggtatcaaatcaaaaataaattctctaataaagtactggatattcaatcaggttccagtaaaaatggtgtacaggtccaacaatacttcgcgaataattctgaagcgcaaaagtttagatttatcgatgctggtaatggagaagtatatatccagtctatgcttggatcagtattagaaagacctggtggtgggacttctgaaggactggccatcaagaccaacgatcttacgaatagtgctgcacaaaaatggaagatcgaaaaacaggcaagtccgaatttagtgaaaccagtcaatggccagcgatatctgctggaggctggtaacaacacaaatgcggtgctagatatcaatggtggcagtaccgctaatggtgcggtggcacatatctggacagaagcggtagcaccgcagcaaaaatttattcctcgtgatctagggaatggttggtatcgactggagaatgaaaaatctaagaaagtattagatgttgccggtggatccagcagtgctaaagttgcggtccaacaatatgcttggaatggttctgatgcacaacaattcagattcgtggatgcaggtggcggctatgtttatgttcaaagtaaacttggaagttatttggacatggtgggtggtgcttctagtaatggcaccaggatccaaacatacagtctcaataaatccgcagcccagaaattcaaactgcaaaatatcagcaaggccaatgcgcttcgcacaacagtcaccaccaataatcaagcgaagataaccgtatataatccaaacggtggaaaagtcgacagtgttcgtttcccaacttggagcagagaaaagggtcaagatgatatcaaatggctgattggcaagaaaaatattgacggctcttggactgcagaagtcaatgctgccgagtttaagaatggcgggacttttgatactcatgtttatgtgaaaagtggtggcaaagaatccggtgtggggactactagttacaagctggataaaccggccccaccggcaccgccaaaaccaacagcaccaccttattactattctcagtgggatggtcgttggagtggactgacttatggttattatcgattcggtcctaccggttgtgtcccaacaagtatggcaatggtgttaaggggttcttacggcgtgaatgttacaccagtagacaccgcaaaccgcattagaagctatggtggtttcaatgtccaatatatgggggcatcttctacggatctggttcgtgggatgaactcttatggccggtcagtgtatgctgcaaaaagcgaggcggatttgactgatcatctggtgcaaggttacccagtgatcatgtacgtcaatgtggggatcggacatgctatcgtggctcatggttattcgaatggcaaaacttatatctctgatccatacaataatcaattttatagtggttgggtctctattagtcatctatggagcgtgccaaccaaggatccacaggattggaactatggttatccttactttattatcaagtag

SEQ ID NO: 595 - DNA, 858 bp, unknown
  environmental sample
atgggacttcaatttttagataaaagatatattgctgccattataatagatgcatggcaaagtaatcttaataccgaaatggatcctgctgatggacaatggtttactaatggaccggataataatggcgggttatatgggtatttagtggataagatcgcgactaaattagtttttgatcaaagccaaaaagtatttgaagtacatcaaaaagcggccgttaccggaattgcggataatcgaaacggtcttactcctaatatgactgtatcattaaaatatgcttatcaaaactcatcaaccacttcacacaccaaaagccacagtattaaagtgggaactggtgtagatattaaatctaaagctgaatttctggggtgcgggggagaagtgacattcaaattcagttttgagtattcacactcctggtctgatacaaccagtacctcaaagacggaaacgcttgagtttagcgataccgttcctattagcattcccgttggtcacgtaatgaaagtgcttctgatgtgtaatgaacagcagttagaagtaccttattttgcagatattcaccttagtggaaactcaaccactaattttcgttccccggtgaatggaaaaaaaatctggtcaaccgatgcaggaacgctttgccaatggattagccaatataagtccagtagtgatgataacctgatattttgtcgggatccggatgacccaaccaaaggtttgatccgagttaaagggatgctgacggcaactcaaacggtaaactttcatgtagctaccgaagacattaccaaaagttttgatggttatattccggaaggaatagcacaagccgtggcggtatag

SEQ ID NO: 596 - DNA, 1431 bp, Actinosporangium sp.
gtgatcgaatcgcgtacacctcggtggcgccgcaggctctccctccttctcgccgctgtcgccggcccggcgctgctggccggagtgttcaccgcaacgccggcgcacgccgcgacggccgacgacatccgtctcaacgaggtggtgaccaccggaagcaccaacgattcgatcgagctccacaacaagggcgcgggcacggtcgacctgtcgggctggatcctcaaggactccaacagcagttccaagtacacgatcggttcggggaccacgctcgccccgggcgggttccgggcgttcgacgtccacgacgcgttcgggctcggctcgagcgacaaggcgcggctgtatctggcggacggatccaccctcgtcgacagcttcagctggtcgagccactccagcgcttcgtggtcgcgctgccccgacggcagcggttccttcggccaggccgcgaccttgacgctgggcgccgcgaacaactgcggcggcgggggtggcgggggtgtcaccccgtcggcgtggccgggcagcagcacggtcaccaccgccgacgcgtcgaacgtcttcggctccgacctcagcggcctccaccaggagggcggggtgctgtgggcagcgcagaacagcggcaagctgtggcggctcgtgtcgaacggctccggcggctggcagccggacaccgcgagcgggtggagtgccggcaagacgctgcgcttcaccggcggttcgggtgcccccgacagcgagggcgtcacggtcaccggggccgggtccgggtccgcgggcggtgtgttcgtggccagcgagcgcaacggtgacgcgtcgggaacgagccggctgtcggttctgcgttacgacgtgaccgggacgaacagcacgctgagcgccacccgggaatggaacctgacctcgaatctgccgtcggtcggctccaacgccggtttcgaagcgatcacttggatacccgacagcgccctgacctcggccggcttcaaggacgagtcgaccggcgcggcctacgacccgagccggtacaccgcgcacaccggcggggtgttcttcgtcggcgtcgaaggcaccgggtcgctctacggttacgtcctcacggacacgggcgcctacacgcgcgtcgcctcgctcagcagcggcatggcgggcgtcatggaactgcagtgggagccgcagacctcacgcctgtggctcgtctgcgacgacaactgcagcgggcagcaccgcacgatgaagatcgacacgaccggtgccttcgccaccaccgccgcctacaaccgtcccggcggcatgtccaacctcaacaacgaaggcttcgccctggccggcgagtgcgtcgccggcgccaaatccgtcgtctggtccgacgacggcaacaccggcggacatgccctgcgcgcgggcaccatcggctgctga

SEQ ID NO: 597 - DNA, 351 bp, Actinosynnema sp.
atgcgctccagttcgaagaagttcaccctggccgccgccaccgccgtcgcggcgctcgtcgcgatcccggcaggccccgcgttcgcgatcgaccaggtcgcctgcgggaaccgcaccgacttcgccaagctcgacatcagggtcggccagaacctgggcaccaaccggtgcttcgccaacagcggcgtcgtggccgtcgaggtccccaacgtctaccgggcgtcctccggcaacaacaagctgacggtcaactaccagtcgggcagccagtactacacgaggacgctgacccccggcacccacatcaacttcgcctcggtcgtgcgggtctacgaagtccgcatctggtga

SEQ ID NO: 598 - DNA, 2301 bp, Ammonifex sp.
ttgataaaggcgcgcaagaggtggctctccgtactgctgaccgtagccatgctggcggcgctcctggtaccgctggctcagccggcccaggcggcctgcacgtacagcatgacctacatccagaaagttaaggccgggggtacatatgacataggcaccctggtcgtcaccgtggatccggtgagcgcggaagcctcggtgggcaggtacgtggttctaagcctgcccggttccccgagtgggtatgaactcttcccggggctgtcagaaaatgagatcgcagcaaagataaccggcaccaactatttcaataccgctaacggtgccaccttcaaggtcgagcggctttcggccagggaggtaaggctgtgggtgggtagcatcgccacggccggtatagctcccggtgatgacagccgcattctgatcccactgaggatcaccgtgccctccggagtttccggcgacatcatcctgactgtttctgctccttcgacctccgctttcctcaacggctctctggtcatcgcgcgggcggacgcaaatttacccgattgggtgttcgctgtttatatggcggctgataacgatttgtctcgttttgccctggccgatctaagggagatgctcagtgttccagggctaggcgggaatgtggtggtggtgcttctcgacctgcccggaagtgagaatgatggggtttacctggttcagcgtggcacgctgcagcctgtgccggggtggccacaaggccaggaactgaacactggcgatcccagcctactggcggcttttctcgactttgtgcgcaacaaattccccgccggcaggtacgccctcatcttgtgggaccacggtgccggctggaggaaactgcagccgcgcggtgtttgcttcgacgacctatcccgggacttcctcatggttcccgaactcaggcaggctttagtccgggcaagggtgccccttgaccttgtcgggttcgacgcctgctttatgggcatggtggaagtggcctatgaacttgagggtctggcttcggtcatggttgcttcggaagaaggggagccaggggatgggtggccttacgacaagatcttgacgtggcttgtggcgaacgcgtccacggccgatggcaaagccctgggtcgggcgatcgtgtctgcgtacacacaggcgtatcaaggctatggtgctctgaccatgtcggctatagacctcggttgcataaaggacgtccgggaaaagacggactccctggccgttgccctcctgcgcaatttcgacagcgacaagacccagatctcccaggcggtacagaacgccagatcctaccatagagaggagtttcgcgacctttacgactacgcctctctcctgacgagctactgctcctcctcggtggagattcgggccgccgcacaggacctccagaagagcatagagagggcggttctggcgaacggaaccacgcagtacgacgacaggtcccgggggttgtccatctggctcccgccggaaagtcaagcttaccttgaactcctcagttactatggcgtggatttcgccagcatgttcaactggtactccaacctcagatttgccaaagagagcaggtggggccactttataaagaagtggatccttgatgaatccacgccgatcgccaccgcgtttggtgtagaatctacggatcctgccgacggagccactgatgtcccggtggacaagaccattacgctcacttacaacacgccggtgaggcccggtccggcctacggcaagatcgctctcctggacgcgagcgggaggaaggtgagtatcaggaagaagctcgccggaaccgtcttcaccatcgacccggtgaagaacctgagctacggaaccacctacaccctggtgttgcctgcgggcgcggtgaaggacggagccgggaatctgtcggaggagttcgttctcagcttcactacagagccgccggacgtgacgccgccggcggtggtagaaaccgatcctcctgctgggggtgtggtcgactctttgaagccggtgctcaaggtccggtttagcgagcaggtttacaccgggaggaactacagcaggattgcgatttatgacgagagcgggaggcgcgtggccgtctccaagcggataagcggtgaccttctggaggttcggccggtgggggcgctcaagcccggtatggcgtaccggctttacctgcctgcgggcgcggtaaaggacaaagccgggaatctgtcggaggagttcgagctcgtgttcgttgcgccgggtccctag

SEQ ID NO: 599 - DNA, 351 bp, Amycolatopsis sp.
atgcgaaagagtctcaagaggctttcggtcgtcggcgcggccgccctcggtctgctcgtcgcggttccggcgagccccgccttcgccatcggtgaggtcgcctgcggcaacagggacgacttcgtgaagctggacatctcgttcggcaatgggatgggcaccaacaagtgcttcgcgaacgccggcgtcaccggcacgaacatcggcggtgtctacaacgtcttctcgggcaacaacaaggtgaccgtcaactacgaacgcaacggccggtacgagacgtcgaccctcggctactggcagggtgtgggcttctccggcaccgtccgggtgtacgaggtgcgcatctggtga

SEQ ID NO: 600 - DNA, 354 bp, Amycolatopsis sp.
gtgatctcgagcaagaagagcgcgggccggatcgcggccatggcggccgccgctgccgccatgttctcgatggtcgtcccgaccgggacgtcgttcgccatcgaccacatcccctgccgcgccggggagaacttcctgaagatctggtcgcatctcgacggccgggacagcgtggactgctacgccaaccgcggcaggatcgggttcggcggctggtgggtggacaagatcgagacgggcaacaacgacctgatctacagcgacgccaacggcgattcggtgagagtcaaccggtggacgatcatcacgtacccgaaccgcccgccgcgggtcaactacatcgagatcctctga

SEQ ID NO: 601 - DNA, 354 bp, Amycolatopsis sp.
atgatctcgaccaagaagaaggcgcggcgtgtcctggccgcggcggccgccgctgccgccgcgttcagcctgctcgtaccgaccgggacctcgttcgccatcgaccacatcccttgccgggacggcgagaacttcctgaagatctggtcccacctcggcgggagcagcagtgtcgactgctacgccaacaagggaaggatcagtttcgggggctggtggatcgaccggatctacaccggcaacaacgacctgatctactacgacagcaatggctcggacgtcagaatcaatagatggaccgatatcagtttcccgaatcgtccgccgaaggtccgcgtcatcgaaatcctctga

SEQ ID NO: 602 - DNA, 555 bp, Arthrobacter sp.
atgaaaaaactgtccatctggctcgcggctatcctcatggccgtcgggttgggaatcctggttccggggcccgcctcggcaaccacatcgtattgcggcctggtctggggatcgttggcggaaaccgaccagcgcttcagcaagacaaccgtcaccaacgtccggaccgggcagcactactgctttgaccggatggtgctggacctcaagggcccggctaccggttacaacgtgcgttacgtaccccgtgtggtccaggacgggtccgggttcacggtccctgtccgtggcggcgcgcgcctgcaggtcaccctgcatgcgccgtcctatgacccctacagcggcgagcccacgtacaaccctcctgccaaccaggctgaactctccaacgttgccaattaccagacgttccgccaggtggcctgggccggcagctacgaggggtacaccaacattggcctgggcgtccgggcccgccttccgttccgggttttcaccctggacggaccgggttccaactcgcgccttgtgattgacgtggcccacttctggtga

SEQ ID NO: 603 - DNA, 783 bp, Arthrobacter sp.
atgcggtcggctcgacctctgattttcttcctctcggttacagcatcagcctcgttctgcctgagcggctgcatggtcaacgcctcggccgaaaaccgggagacgggaaccgccccggccactcagccgccctcagccagcgctccgccggccaacccatcggcgaaaccgacgacgaccgaaacgctgccgccgccaaccactgcaccagcggagccgctcccgtcggccgtcccgccgtcgtcctccgatcctgcacctgccgccgaccctgtaacttttaccttcgctgacggccggctgtcctttacccacccggccggctggcgggtggagcacagccagactgtggcgtcaccctctgttcaaaacgcgaccgtgtatgacaccagcggaaacgagcagatcgggatcttctacagcgaggtggggggtggtgttgccggtccccacaccaggaccgtgttcttctcagagccagtcccgggattgcagggccattccggtcctgcctccggtcctgcaaccgcccatgtctccttctatgtcgaccatatttacggtgagccgcattactcgctgtcgctcacgcacagagaagccctctcgccggatggcacggaaggcgctgacgttgtcatcgtcggcggcaaccgcgtgctggccgcaaacgtcgtcttcaccggcggaccgtttgcaagtgacgaggcggccaaggcctggttcgcggggactgaaggccaggccctgaaggcgattctgatgagcttttcctaccgctga

SEQ ID NO: 604 - DNA, 546 bp, Arthrobacter sp.
atgaaaaaactcctactctggctcacggtgcttctggcggccgtcgggctaggcatcctggctccggggcccgcttcggcagccacctcctattgcgggctcgcatggggatctcaggacaagacagcgcccgagatgagctcagcatccgtcaccaacgtccggaccgggcagcaaccctgctttgaccggatggtggtcgaccttaacggccccgtcaagggctacacggtccggtacgtaccggagatcatccaggacggcaccggcttcacgatcccggtctacggcaacgcacgcctgcaggtcgtcgtgaatgcaccctcctatgacagcaatggcgtcacctacaacccggccgcaaaggctgagctgtccaacgtggccggctaccaaaccttccggcaagtggtctatgcgaatagctttgaaggttccaccagcatcggcctgggcgtccgtgcccggcttcccttccgggtcttcaccctcgacgggccagggtccggttcccggctgatcgtggacgtggcccacttctggtga

SEQ ID NO: 605 - DNA, 3096 bp, Arthrobacter sp.
atggaacagtccacagcccggaatttatcccaacgcctgctgcgaggcaggaagctgaccacaatcgtggccgctgctgccttggctgtcgccggaatgaccgctgtcgtttccagcaccccggcctatgccgaccaacaacgacaggtggtaggcacaggcctcaccaagcctgccggaacggtagtcgatcccgtcggtaaagtgtgggtctccgacagcgtggcaggcttctgccgcatgagcgatccagtcaatggccagcccggcaccgtggaaaaggatacctgcctgggcggatccctggccggatcccaacaaggcccgaaagtaccgggcgtcgccaccatccttgatcccacgccttcctcggcaggcagtggagacgagacggcgttcatcccggattcatcggtgggaagctcgcatgtggtgcgtgccgtatggagtcccgcactggatctcttcgagtacagcagcacgctgaccatcctggatggcgacgtcaggccgaatgccgtcagcgacggccctgacggcaacatctacctttcgtttgcgaatgcccgttcgatcatcaagattgttgatccaaccatcaagcatcccagcatcgaatccatcgcctcggtcaccacgaaagccctggggctggtagcggctggttgggacagcaacggacacgtcagcgtatacgtcctggaaaccaccgggatgcgggccttctcggctcccgacgacggcgacatgaccaactacgtgccactggcctcctacaatgtcggtgtcgcatcgtcgatcttctacgactacgatgcccacatcatctacacgggcacaagcagcggagccactgccgccgatgcaggcaaggacaaggtttcccgcctcaatctcagcaccgggaccgtggacaattcctgggctttgggcttcagcaagatcagcggcctgggcatgcgtgccggacagttgctggtactggatgatgcaggacagctgaacaacccaccggccaccggccaaggaaagatgagcctcctgggtggagtcgtagcccagattacctccggcccaacgcttgccaacggtagccaatcgcctaatccggcgttcaccaacgacaccacacccaccttcggtgtcagcgcagaccccagtggcagtgccctggaatgctcagtcggcggcgcttggacagattgcaccagcggcacctacacctcagctgttctggcaaatgggccacagacgttctccgtccggcctgcaccaggaggcgttcccgtgtcccgcacgtttaccgtagacacagtggcacccgccgctcctgtcttcacagcaccgaacagcggacaggtggtcaacggcaaacccgttctcggcgcgacgttcgaacccggaacgacactgagttgctccgttgattccacggctgacgctgacttcaaggcttgcgtgccgggcgataccttcacgctgaccacggagggtgcacacacgttgcggatcaggagcacggaccccgccgggaacgtcggccctgctgctgctttgaccgtgacagtggatctgacggctccgcaggttgcgatcaccgctcccgccagtggtgccacggtgggtgccgggtaccagttccagtttgcttccacttcgccggacattgccggattccgttgccggttgggaacagatgccttcactgaatgcacctcccccaaggtttacgcggacatcgccaatggcccgaacaggttcgaagttgaagccagggacaaggccggaaacacgacggtggccggtgtgaactttacggtcttcgtcgccgacacgacaccgccaaccgtgacagcagatcccgtcgcgggcacctacggtccttccagcaagatcgctctcaccgcaagtgaggcggacgcaaagatctactacacagaggatggcagcacacctaccactgccagcactctgtacacggctccgattgcgatgggcagcaagaccctcaagtacatcgcagtggatgcagcgaacaacgcctccgcaccccagacacaggtgtacgtgctggataacgttgcgccggctgttacggccaacccgaccggaggcaatctggccctgggacagagcgtcactttgacgacggagtccggagcaaagatctactacacgacggataacaccactccgacagttgccagccaggtagccaccacgacagtcacgatcacaccggctgcaaccaccacggtgaagtactttgccgttgatgctgcagggaaccaatcggcagtagcctcgcagacctacaccttgcctgcagctcccgccaacacttggaaggactacaactccgatgccaagaacgatgtcctggcccgcgattcagccggaacactgtggctctacccgggcaatggcacaggtggatggttgggcaaggtcaacaccggtaccgcatggaacaactacaacctgatcgttccaacccgggacttcagcggcgatggacgaagcgatgtcctcgccagggatggcgccggacagctgtggctcttcaagggcaacggaaccggcggttggcagccggccgtgtcagtaggaagtggctggagcggaatgacggcgatcgttgcccccggagatttcaacggtgatggcaaatccgacgtcctcgccagggatgcggcaggcgtgctgtggctctacaagggcgacggcctcggtaaattcacagcaggttcgacccaggtcggggccggctggaacgtcatgaatacccttttcagcaccggcgacttcaacggagatgccaagaccgacgtgattgcacgcgataccagcggcgggctttggctctatcccggcaatggcactggcggctggggcacccgcacccagatcggcagcggttggggcggcatgacggcgctcctcggaccaggcgatttcaatggcaacggcaagtccgatgtcctcgcccgggatgccagcggcaacctctggatctatccgggtaatggcaccggcgggtggcttgcctggagccaggtaggcaacggttggcagggattcacctccctcccatag

SEQ ID NO: 606 - DNA, 2919 bp, Arthrobacter sp.
atggttgtggaccgtccaaaatacgctcggcgtcatactcattccaccctgtacagcacccgttcccttttccggaaaatccttgttttcctgctgggttccgctgttgccttttctgccctgacccttggtgtggcggcgcctgccgctgctgcggtcccgccgtgcccaggcacaggcggcgccatgcagatagtggcccacaccgatgatgacctgattttcatcagtccggatttcatgcgtgacatccagtccaagcgctgcgtgcagaccgtgtacgcaacggcgggtgaagccggtgaaggggctgcatactggaacagcctggaagcgggaatcagggcaagctacgcgaaaatggcgggcgtagccgatgcctggaccacctccgacgcgggcgttccgggccgacccctcacccttcagaccttgaatgcggcacccaacgtatccgtcgttttcatgcggcttccggatggcttcccggatgggaggggcagcagccgctacaacggccagagcatcctgaaactgtgggacggccggctcagctccatccgcccggttgacggtgccgcagcgtttaccaaggcgcaattccagacgacgttgaaccagctggtggccaattaccaacccaccaccttccggacccaggattggacgggaaattaccaggacccctacgaccacagcgatcactgggccacggcaaagtttgcccagctggccagcagggcctacacgggaccccatacggcatctgcatacgacgcctatgtaatcgatgaatacgcccagaatgtgacgggcgcggacctgaccaacaaagtcaacacctttgtgcgcttcgccgatttcgataaatacctctgcgacactccctgcccggcgccgccttacagcgactggctcaaacggcagtacatcacggccatcgagtggacgggcaatgctgccaaatcagcaggcacaacagtgagcgcttcttcgcagaaggcctcggggcagagccccgagaaggcccgcgacgggtacgcatggggtacgcccatggacgccaaccgcgaatgggtcaccaacggcggcaaggcaggcagctggatccagtacaacttctcccctgcccggaccatcaacgccgtgacgctttttgaccggccgatcctcagcgaccaggtaaccggcggcaacctggccttcccggatggcagcaccgtgccagtgggcgccctgcctaacaacggttcgggactcacagtgaatttcccggcacggacagtcagttcggtccgcttcaacatcacctccgtgagcggctccaccacgaacatcggcttgtccgagttcgaggcccacatcacggccgacgtcgttgcacccgaagtgacggcgacaccgcccggcggcacctatgacatcgggcaaaaggtcaccctgtccgcgaacgaacctgcgacaatcttctacacgctggacgggacgacccccaccaccgcgagtgccaaatatgccacgccgatcaccgtgaatggtccactgacgctgaagtacttcgccgtggacgctgcgaacaatccgtcggccgtcgtgacgcagagctactccaccggcccggacgtgaccaagcctgtggtgacggccaacccgctgggcggcgcctacgccccgggcaccagcatcacgcttacgtccaacgaggcaaactccgtgatcaagtacaccaaggacagcagcgatcccctcactgcaggattggtctactccacgccgattgtcttcgcaggtccggatccgatgaccctgaaattcttcgccacggatcctgccggaaacgtgtccgacgtcgtcacgcagacctacaacgttccgcctgacacgcgggcgcctgtggtgacggcgaatccaaccagccgtgcgctggccagcggggcaaccatcacgctttccgccgatgaaccaggcgcaagcatctactacaccacagacggcagcagccccacggctacggagtctgccaccaacttcaagtattcggctccgcttgtcatggggacatcacagctgaccctgaagtacatcggtgtggacgctgcagggaacacctcacccattggaacccagacgtacagcgttcccgcagccgggccgccgtcgtcccatgacttcaacggcgacggcaaggccgacgtcttgtcctccgatactgccggcaacctgtacctctacccgggcaatggcggaggcggtctggggccgcggcaaacggccttggcggcacctgcatggtccacgatcaccgacaccataacccccggcgacttcaaccgggacggcaaaccggacctgctggcccgtgcaggtgacgtcctgtggttctacccgggcgacggcgccggcagcttcggcgccagggtccaggtgagcaccggatggagcaccatgagccagttgttctccccgggcgacttcagtggcgacggaatccctgacctgatcgccaggcggagcaccggcgatctgcgcctttacgaaggcaacggcagcggcgggctccggacgccaatcacgattggaaccggctggaatgttatgaatgcaattctgagcaccggggactttaatggagatggtacgggagacgtgctggccaggcgttcggatactggcgccctctggctctaccccggcgatggaacccgcggatggctcgcatggaagcaaatctccacgggttgggacaaccgaacatcgatcgcaggcccccgggacctcgacggcgataacaagaacgacgtcatcggccgcatcggagacaccctgtggctctacccaggcagcggcaacgggactctcagcaacgtcccgcccactagcctcggcaccggttggcaggccatgaagatcatcggctag

SEQ ID NO: 607 - DNA, 2745 bp, Arthrobacter sp.
atgatgaaacgtaaatttttggacccggtcggacgcatccccatggtgcgggcagggctggcgctcaccgtcgcccttacggcaggcagtttcctttgcgcgcccgcatgggcacagacttccggtccgcagccggcgcccacttctgaggctcctggcggcggatcatctcagggcccccagccggctgggaatggcccggcttcacctccggttgaaagcaccccacggcaaggaaagctgcctgaccagcaagcgccgatcaccggcgtcgaacttacacccggtgtagcgtcccaacctgcgcctgaccctgccggcaaagccgaagcgcaggccacaaaacccaagtccatgcctggtgacgcacccgacgccgagagtatgaaggccgccatgcgcgccgccatcccggccggcggcgcggaaatgggccagcgctccccgagggtcgtgacgaacaaacaggacaaagaggcggcggcaccggcccgaggcaaggccgtaggagcagcggtcaaggccacggtaccgatggcggcagacacaggccactggcggcccaccattggaatccaagggcaggacgtgagcgcacaccagggcaacgtcgactggcaaagccaatggagccaaggctcccggtgggcctacgtcaaggcttccgagggaaactactacctcaacgagaactacacccagcaatacaacggttcacggaatgttggcatggttcgcggcgcgtatcacttcgccatcccgaactggtcatccggagcagaccaagccaggtacttcgtagcgaatggaggtggctggtcggccgacggctacactcttcctccggtgcttgacatcgagtacaacccctacgcgggccggaccatcaacggcttctatttcggcaacacgtgctacgacatgtccaaggcccaactgggtcagtgggcagccgacttcggcaacaccgtcaaggccttgaccggtcgattccccgtcatctacagcacgaccgactggtggaatacctgcgtaggcaacagcacctttgggagctacccgttgtggattgcttcctattggaacaatcccaccaattcgccgggctcgctgccggccagttggaacgactactcaatgtggcagtacagcagcacgggccccttcgaaggcgactcgaacatcttcaacggcacctttgatgagctccgtacctttgcccggggtgttccgaccccttcgaatccctccatccgttccggagcggatgtgcttgcggtgatgccttcgggacgactcgataattttccagccgacggccagggacgtatctccgggcccgtgaccatcggctccggctggggcaacgccctctccgtccacgtcgttgactggaaccaggacggagtccaggacatcctggcccaatgggccgacggaacactccaggttttccgcggcacttccggcggcggcttcagcacgcccatccaagtgggcagcggctggcaggaaatgtcgcttgccaccggatggtggaactcgaaggatgccttccctggagtcattggccaggacggcagcggcaacctgtaccgataccagaacgcctcgggcggtgctctgggcggcggtgtcctgataggtaccggattcagtgggcaccagttcaatctcctggactttgacggcgatggcagccaggacctcgtctccagaacaggcgacggaacgatgcggttgttccgcagcaacgggctcgggtccttccttacagagccggcacgggtcatcggaaacggatggtccgccatgacttcagtcagctccgcagcgggcttcaacggctccggctcgcaaggactgcaggcacgtgccgccaacggcgatctctactattaccctgcggtgaacggctcgtggggtaaccgcttcctcactggtctcggctggaacgatgccctgctcattggtggtgccccggtcaacgtcgaggcaacactgggcgtggatgaacccgatgtccttgccatccggcaggacggcaatctttaccggtatgcgggctcaggttccggcggactcacctctcccgaactgatcgggaaacaatggacgggattgaaggcgggcttccttactgattggaatggcgacggcgcattggacatccttgcccagtggagtgacggccggctgacactctacccgggcttcaagggggccggcttcggctctcccatcagtctgggtacaggctggcaggactggacgctgaccgtcgggacgtggaagaagtccgatccccggccaagcattgtgggatacgaccccgcaggccggttgttccagatcggcaatccatcaggcggggcacttggaacgcgcacccagatcgggaccggctggtcagggctggacatagtccagatggatttcgacaaggactcaaacgccgatctcctggctaaaaccgcttccggagacctcatgctttaccggtcgaccggtaccgggagtttcatcccggaagctccggcagccatcggtacagggtggaatgtcattaacagctttggagcaatccgaggatttgctggagcgggttcaaccggcatcataggtcgaacaactggcggggagctccgctattaccccgttgggcaaaaccgtgcatggggtccaaccagcgtcatcggatccggctggacagggctgaagatcctctcccccgcatccaggtag

SEQ ID NO: 608 - DNA, 1566 bp, Arthrobacter sp.
atgcaggttcaagaccgaccgggaacaccaagaaacgcccgacgccgggtggcggcttgcgctgtattcctcgccctggtgctggcggccgccctcgctcccgcggccgccgcggcagccccggccagcgcggcacccacggctcaggcgacccggtacgtttccgaagccggagtcacggcccaccgcgccgccgtcgtgaacgccgccgccgtaaaagcgcaggtgccttcgaccgccaatccgctgcctggcctcgatcccgcgggtgatcctgccaacttgtccgtccttgtgaacaagtcccgccccctgaaccctgccacctacgccccggcagatctggtgaatgcccgtggctcaggacagtatctccgggccgaagctgcagcgtggctcaacgggcttttccagggtgcggcggatgccgggaccggcgggctggcggtcgtgagtggctatcgttcttacgcccagcaacaacaggtgtactcgtcctatgtgaacctttacggccaggcgcaggcggacctgatctcggcaaggccgggctacagtgagcaccaaaccggtcttgccgtcgatgtcggaaatgccaacggttcgtgtgggctcagcacctgctttggtgacactgccgccggcatgtgggtggcagcgaacgcgtacaaatacggtttcatcgtccggtaccccaacggctacaccaacatcaccgggtacagctacgaaccgtggcacctgcgctacgtcggagtggatctggcaacggatatgaagcgccgtggctttgccactttggaacagtatttctccggaaaccccagcgtccatgccagcatcacctcgggcgcggacctggtggccgcggacgctgccgggcggctgcttcgctaccccgcgctgccgagcggcggctacggcgttcctgtacagattggctccaactggacgggactgaagcaggcgttcgtggtggattgggattcggacggcgtctatgaccttctggcgcaatggaacaacggcaccctgggcctgttcaagggatggcccggcggcgctttctcgacccagatcgtggtgggcacgggcgactgggacgccatgaccatcactgtgggcaagtggtccagcgaccagggttacccgggcgtcgtggggtatttccctgacggcggcctgcgctattaccccaacacctccggccgggcgttgacttaccgggtggacatcggaaccggctgggcgggactggggctgaccatggccgattgggacgcggacggcgccaacgacatcctggccaccacatcctccggacttctgctcagttacccaggcaatggagttggcggcttcaaaggtcagccaagcatcatcggctcggggtggggaaccatgaaggccttggtgcctggcttcggcttgtcaggtccaggtacacgcagcattaccgcccagaccgtggacgggtacttggtggactacggattgggactcggagtctggggtccgcaacgccaagtgggcaacggctggggctcaatgaagctgttcaaatga

SEQ ID NO: 609 - DNA, 468 bp, Bacillus sp.
atgtcaatcgaagtaggcagcaagttacagggaaaggtaacaggtattacgaactttggagcttttgttgagctaccaggaggttcaacaggcttggttcatatcagtgaagtagctgataattacgtaaaggacattaacgaccatttaaaagtgggcgacgaagttgaagtcaaagtaattaacgttgagaaagatggtaaaattggtctttcaattaagaaagcggtagacaaaccagaacgtccagaaagaccagagcgtcctgcaagagcgccacgctcagaccgtccacgtgattcacgcccacaacgtaataacaatcgtggtggcggtaatgatttccgtacaaaagaaacattcgaacaaaaaatgaatcgtttcttaaaagacagtgaagaacgtttatcttccctaaaacgccataccgaatcaaaacgcggtggacgcggtgcaaaacgcggttaa

SEQ ID NO: 610 - DNA, 1014 bp, Bacillus sp.
atgaatataaaacgttggcttttgacggcaacaacagttattttagctacatctggagtcagttcagttccttctgttcatgcttccgaagaaaaagaaactgcctatatagatgtcgcagcagctactctatggacagcaccaaacatcttgcgtgaagtggacgccccgtcagctaccaatccggtagatatgaaaaagtggaccacatcgatggatttgaagcagaagcagcagttatcaagcgatggaatgcttgagacacaagcgttatatggaaacaaagtaacggttttagagagacaaggagactgggtaaaagtagctgtagacggacagcctacttctcgaaatgaattaggatatcccggatggatgcctaataagcagctaacctatagcaaaaggtacgaccagtatgcaaaggatccttttgtaatggtgacagctcccactacttatttatatcattcgccttatttaaaaaagaaaggcattgaagttagctataacacacgcttacctcttttgacaaaatcaaagcgtgcatataaagtattaaaaccaaatggaaagacagcatggatttctgcaaaagcagggaaaatctacgcgtctcaaaaagatattcctgtaccaactggcacggagcttgttgaaagtggaaaggcatttttaaaccttccatatttatgggctggcatgagcggttttggatttgactgctctggatttacgtttacgatgtaccagtcccatggtattacgattccacgcgactcagggccacagtctcgagcagggaaaccagtagatatgaacaaccttcaacctggagacttattattctttgcctataaccaaggaaaaggaagcgtccaccatgtagcaatgtatgcgggagatggcatgatgattcattcgccgaactccgagcggacagtagagattattcctttaaacacgaagggatatattgaagagtatgcaggtgcacgtcgttatttaccttaa

SEQ ID NO: 611 - DNA, 330 bp, Bacillus sp.
atgcaccaattcttacattctatgaaacattacgctattttttttgcagttatcgctgcacttacatatgtattgacgctggttttaggagcggataaagtagatttagacaaatattcaaccgttactattacaaaaggagatacgctttgggaattgtccaacaagtatcataatcaccatcatttgaccaccaacgaatttgtcaaatgggttgaagacgtcaatgatttaaactcagacactgcccagtctttatctcctggagataaattatatattcctgttttaaaaaaagagttacataatcaagtggcaattgaacagtag

SEQ ID NO: 612 - DNA, 1281 bp, Bacillus sp.
atgcaaaatcgatacagacatataattggtgcgattctccttgtttcgttcatttttgtaggatttattccagttgtgcaacaatatatacacattccaaaacaaatcgtcttatttgaacagcaaaaagaaaaaattaatacgacattaccgcttagcgtagaagcttcatcacctgtttacgatgtaacaagtaacaaggcgaagctgaccgtagcaggcaaacaggtaggcaaagaagagttgatgcttcatttggccggtattcctgtaaagcgtgtagacgtgcaggtattatctgattttaaagtcattccaggtggacaatcaatcggtgtgaaattaaattcaaagggtgttcttgttgtaggctatcatcaggtagatacagcaaaaggtaaaaaatcccctggcgagattgcgggtattcaagttggagatatgattacgaagattaatggtaaaaccattgaaaaaatgagtgatattacaccgtttattcagcaggcagggaaaacgggtgaaccattaaatctgcatattttaagagaaaaaaagcagtttgacactaagctgtatccgttaaaagataagcaggattatgcttacagaatcggtttatacatccgtgattcagctgcaggaattggcacaatgactttttatgatccaaaatctaaaaaatacggcgctttaggccacgttatttcggatatggatacaaaaaagccaatcgtagtagaagatggacaaattgtccgttcgactgtgacatcaattgagaaaggttcgaacggcgttcccggtgaaaagctagcgaggttttctgaagatagacaaatcattggaaatattacacgaaatagtccttttggtatttttggaaaattgtcttcaacgatggaaaacggaataatggataaagcgatgccaattgctctatctcatcaagtaaaagaaggaccggctaaaattctaacggtagtagatgatgatcaagtggaagaatttgatattgaaattatgagtactatacctcaaaagtttccggctactaaaggaatggttattaaaattacagatcctaaattgttaaagaaaacaggtggaattgttcaaggaatgagcgggagtccgattattcaaaacggtaaagtcgttggagcagttacccatgtttttgtaaatgatcctacctcgggttacggtgtccatattgaatggatgcttaacgaagcaggaatcgatatttataaaaataatcgaaaaaaagcgagctaa

SEQ ID NO: 613 - DNA, 414 bp, Bacillus sp.
atgatacgaaaatgggttgctgtatgcgtcgtatttgctgcttttatttttccgcaggcagtaagcgccgaacagccaaaagtagaggtatttcaaattgaaacaggcaaagttgttcggtcaacgcccaaacctccaagtgttcaaaaagaagctgaaaaaagtattacgtccattactggtttatataaaaaggcaagtccgcttcctaaaaaaggctatcttgttaaagtacctcttgatccagccgtaaaaattgaaaatagtgcggtcaacacgctggcaagtgaagttatttttgttcttgagccaaatcaaaagccaatcatgatggtatttgacaatgaaaatagaacctatttttttgaatttactcatgatttaactcttctcagaaaagcattacagctataa

SEQ ID NO: 614 - DNA, 1506 bp, Bacillus sp.
atgaaaaaaatatgtatgagcctgattattctctgtcttttcagtggaggattggccccgatgagtaaaggagccgctgcttcttcagtgggcactgtcaaaggtgacaacgtaaacgtatatcgttctccttccttacattcttctattgtgcagacagtgaaaaaaggagaagaatttcctgtcatttcatctgaagctggagatgcagctcaagttactactcatacggtagtgccgggaaatacactatggctattagctaagcaatacggtgtaacagtcagtgatctgataaaacaaaatcagctaaaaaagacggagctgattccagggcaaacgttaaaaataccagcaaaaggcttgttacataaagtagtatcaggagatacgctttggaaaatctccgtaaagtacggtgtaaaagcgaatgaattaacaaagttaaatcagctatcatcaacaaatattaagccgggacaaatgcttattattcctgattactatgtacaagtacagcttttggaagggaaaaagggctggatcaaaaaatctgatttagcgcaaaagaagcatcagcccgtagttatgggttggagctttaatgaaaaagcagcaggctacacagaatcgatgaagcaaaaaaatttagacgttgtttcacctcgttggtttacgctaacgtcaaatgacaaagttgtttcatcttctataaatgaatcatatgttcagacggctcataaaaacggcaaaaaagtctggccgcttattggtaacaattttgatgatgtgcttacaagtgatgtgctaagtaacaaagcaaagcggcaaaaacttgtatcgtcagtagaaagttcgctagtgaaaacaaagagtgacggtattaacgttgactttgaaaatattaatatcaaaaacaaacaagattttgttttatttattaaagaattaaaagcagcgttaaagtctcatggtatgactgtttcagtagacgtaacaagagaaaataatgatccgttttggtcgggaagctttgatagaaaacagattggtcaagtggcagactatgtcattatgatgggatatgaagaacactggggaggaagtcaggttccaggatctgttgcttcgctgccttgggtgaaagaaggaacacaacttcttatgaaagatgtaccagcacataaaatcctgctgggagttcctttttatacgcgagaatggaaaacggacttatcaaccaaaaaagttgtcacaaaagacttaacgatgaaagaagcggaagcagttatctcttctaaaaagttaactaaaaaatgggatagccaaacctcgcagtactatgtagaatacaccgaaaatggtacgaagcatcaaatatggctcgaagacaaagcatctatgcagcgccgagttaatttgattaaggactatcatttaggcggggcggcagcttggtatattggttcagaaacctcagatatatgggagttatacaacttttaa

SEQ ID NO: 615 - DNA, 102 bp, Bacillus sp.
atggccaacaaacagcaaaaatcacagcctaaaaataagcctgaaacaaaaacctacggtgatcctaaaaagttaaacggtcctaaccagccttctacttaa

SEQ ID NO: 616 - DNA, 768 bp, Bacillus sp.
gtgaaatggtgcttttcaattatcattattgtttccattaatttctatggtattcaagcggatgctgcaaagaagagcagattttattatgaaaaaaaaggagatatcgtgtgggaagttcccatgaaagatgagaagttaattgcgcttacatttgatgatggaccagatcctaaatatacgccgaccattttaaatttattgcaaaagtacggtgccaaagcaactttttttgtagtcggcgatcgaataacgtcttttcccaagcttgctcaaagagaagttcgtgaaggtcatgaacttgctaatcatacatatagccatttgaaagtaaggggccaggaagtagagagaattgaacaagaaattgaaaaagcggatgaacgtatacaagctattacaggaataaaaccttacctgtttcgtccacctactggctattatgacgatcgggtagtaaaagctgctaaaaatcagcagtatactattattctctggtcttggcatcaagatacatttgattggagaaatccaggcgtaggtaaaattgtaagtcaagtgcttaaccatgccaggtcaggagatattgtattgtttcatgatactggaggagatcgaacccaaaccattgaagcattaaaacaaattttaccaaagttaaaggaagaggggtataaatttgtaacggtctcagaacttttaaaacatcaccccaattataaatctctttatttgatgcagcagcaaaaacagcactccgttcaataa

SEQ ID NO: 617 - DNA, 576 bp, Bacillus sp.
atgtttaagaaactagtaattattggagcactagcagttcctatgttcggcatgagtcacggggcaaatgctgctgaaacaacccatcgcgtaaaagccggcgagactctttacaagattggcgctgaatacggcgttacggttcaacagttaaaagaagcgaatcacaaatctaccgactctattaatgcaaatgaaacattaacaatccctaactctattagcgaaagcgataaagaattgttagctcgccttgtacaagctgaagcaaaaggcgaaccttacgctggcaaagtggctgtagcaacagtcgttttaaaccgcgtggatagcgattctttcccaaactctattcatgatgttatttatcaaggcacacagtttacacctgtacaaaacggtgaaattaataaagcagcggatgctgaagcaaaaaaagctgtaaatgaagcactagcgtttaggggtcaaggaaaaggttcgttattcttctttaatccagataaaacaagcgaccaatggcttcgtcaaaaacaggttacgattacaatcggaaatcacgtttttgcaaaataa

SEQ ID NO: 618 - DNA, 1305 bp, Bacillus sp.
ttgggacaagtacgtgttgacccagataaattagaatcagctgcaaattccatgtcacgaaatagagagtctatggaaagtataattcgagagcttttacaagtcacgttcgaattacagatgtcttgggaagggatggcatatcaacggtttttcgatgaatttttctcaaaaaagaggagtatggatgatttagttaagcatttacatcatactgaactcgaactaaagaaagctgcgaaaacattccgtgaagcggatgagaaagcgtttggggattttaatcagatgggcaagctatgggacgcctttcagcgaggaagcgggaaggctgcaggggacactatttttgatccattaaaaaaagggtggaaccaaacatccgactttttcggaaacttggtggataatccaatggacgcattggaagatgcaaaatatggacttacggactttgtggagagttctattgatgatacgaaagaggaatttagagataaatacgaatttatgaaagatatgtggaataatcctattggaacattaaaacatgagttggacgaggaagtccaagagatgtatgctatacgaaatgttttatcagattggtatgtggagaacataaaatatggagatgcagaaagtatcacggaatcagtagcatacggagcgactaatttagctttctttggacttgtcacaagaggtgccagtgccgtaggtaatggtgcaagatggggaaaaaatttatcatctatatccaagcttcagttagaaaatcgtttagaaccagctttcgcttatggtaagatagattataaagttgatactattaaaccatcagatacatatatgtttgcaaaaacttcaagtgcggtaaaaagaaagaccccaggtacagtgacctcaagttttaacctcgaacgaagtttaggtacccaaaagaagttaatgtataatgattgtgctattggtattattccgcaagaagttcgagaaaaattagtaggaagagaattcaaatcttttgacgattttagagaagaattttggaaaacactttctgattcgagctatgctaaagaatttagtcctatgaatataaaacttatgaagcagggtaaggcaccttactcaccacgagcagaacattatgggaaccataataaatatatactacatcataaacagcctattgataaaggtggagatgtctataatcttgataatctaataattgtatctcctaaaatgcatcaaaacgttttagatcccgcataccatttcgggaccaaagggctataa

SEQ ID NO: 619 - DNA, 1002 bp, Bacillus sp.
atgattaggaagatcgtgccgtttctagcggttctacttgtaatgtcgacattgtttaatgttgcaccagccgaagctagcactaagcaagatcaactcgtcactgaagccaagaagcatataggagtaccatatagatggggcggaacgacaactagcggatttgattgttcaggttacatgcaatatgtatttaaccaaattggaataaaccttccgcgaacaacaagtcagatgtataacacaggtacttctgtttcaaaatcaaacttacaagttggagacttagtcttctttaatacatcaggttctggcgtatctcacgcaggaatttttattggaaataaccagtttattcattcagcatcatctagaggtgtatcaatttcttctattaatgaccctcactattggggttcacgttacatcggagctaagcgtgtgatgactaacacaccagttcgctcattaggttctggagagttttatgatgttgcaacaaaccactgggcattcagcgaaattcgtcaattaagcaataacggaattatcggaggcgttggcaacagcaacttcgctccaacagatcaattaacacgtgctcaaatcgctgcattagtggttcgtgcgacaaacacaccgctaacaacaacagctaatggatttaatgatgtatctcaatctcactgggcagcagctgatatttcagcagctgatcgcgctgggttcttcgatcacattcaaggagacagcttcaacccaaatgcaaacgtatcacgtgcagagatcgcggttattttctctaaagcatttgatcttcaagcaaatggttcaagcgcaagcgcgttctctgatattaattcttctaactgggcttacaatgaaattaatgctcttcactcaaatggacttgtacaagggttcactgatggtacatatcgtccatcaagctcgatctctcgtgcagaattcgcgaagattttacacggagcattatactaa

SEQ ID NO: 620 - DNA, 336 bp, Bacillus sp.
atggggaaggaacgtggttactacgatgtcgtatatcaccaattctcagtagaagcagatgattcgcctataattactaattcaataaatgtatttgttggaaagacaactttaactaatgatacagatctagagcaaacattgtcaaccaatagttttgaaaaaatatttgtaaatactattactaattctaccacaagtgggtacaatcttggagtaacagcttcagcaaagttttctattctttcaatatttgaaacaggaatagaaatgtcaactgaatatgatttttcaaatacatctgtcacagaaaaaaagacgaatataaatatatag

SEQ ID NO: 621 - DNA, 390 bp, Bacillus sp.
gtgtattcgacaacattcaatattggtcaaatcaataaagcttttgtcttctttctcgcggcagccgttttatgcggatgcggcaaagcggatgattccgccgccaaaaaagcactgcccgttacgctccatgttgagaatgcagacggttcaccggcggccggtgtgacggttaccgtgatgaaagcggcggagtcagatcatcagccgaatatagaccgcggagagataataggcaagactgatcaccacggtgagatgacatggaaaagcggcgcgaaaggaacctatgccgttgtttttgaaaaagacggggtaccggaaacccggaatatttccttagctgagagcgataaacatacggtgatcagcattacgttgaaacattga

SEQ ID NO: 622 - DNA, 894 bp, Bacillus sp.
atggcgaaaagaatatttctgtttattttaacgaaccttttggtcattacgacaatcggaattgtgcttacgattattacaagcgttaccggtgtcggctcgtatatacaaaatggccgcattgatctgatggcattgctcgtgttcagtcttgtcgtcggttttgtcggttcttttatttctctcggaatgtccagatggatggccaaaacgatgatgggcgtccgggtgttaaatccgaagaaacagtcactcagctatgaagaacagcaattggttgaccgtgtgcacagattgtcccgtgccgcagggatgacgaaaatgcctgaagtcggcatttatcattccccggaagtcaatgcttttgcgaccggaccttctaagcgccgttcgcttgtcgcggtttcttcaggtttattgcagcagatggatgatgctgcggtggaaggggttcttgcccatgaagtcgcacacatcacaaacggtgatatggtcacgatgacgctgctgcagggaatcgtcaatacgttcgtcgtattcctttcccgaatcgcggcatgggttgcaagccgctttgtcaaagaagacctcgcaccggtcgtgcattttatcgcgatgatcgtgtttcagattatcttttccattctcggcagtcttgtcgtcttcgcctactcgcgccacagagagtttcacgctgaccgcggcggtgcagaccttgccggcaaggataaaatgattcacgccctgcgtacgctgaagtcttattcaggacatgtgaatgaagaagaccagacggcggtgcagacgttaaaaattaacggcaaaaagcattcgtcactgttctctacacaccctgatctcgatgagcgcatccgcaggctggaagcaaaataa

SEQ ID NO: 623 - DNA, 1263 bp, Bacillus sp.
gtgaatacagttatcgcgtttattattattttcggaacgctcgtttttttccatgagctcgggcacttattgctcgcccaaagagcgggaatcctttgccgtgaatttgcgatcggcttcggccctaaaatcttttcatttaaaaagaatgaaaccgtgtatacgatcagactccttccggtcggagggttcgtccgcatggccggtgaagacccggagatgatcgaagtcaaacccggttataccgtcgggcttctttttaataaagaggacgaagtggaaaaagtcatcattaatcaaaaggaaaaatatcccgacgctttaattatcgaggtggagacggctgatcttgagcacgaaatgaagattaccgggtacgagcaggggaaagaagatgaactggcgggctttactgtcagtcagacctctttttttatcgtagacggagaagaagtgcagattgcgccttacaatcgacaattcgggtctaaacccgtatggaagcggattaaggcgattgctgccggtccgataatgaacttcatcttagcgtatgtcattctcgtcatgctcggattcattcaaggcgtgccttcaaatcagcctgagctcgggaagctgacagacaatggacgcgcagctgctgccggtttaaaagaaggcgactatatccagagcattaacggtgaaaaaatgaggtcatggaccgacatcgtgacagcggtaaaagaaaatcccgggaaaaaaatcgatgtcgccgtcaaacgggacggcaaatcgtttcatatctcggttacacctgaagctgtaaaagatgaaaataaaaaaacaatcggccgcttcggctcttatgcgccgactgaaaaaggagcgcttgcagcgattgcttacggcgcgacatctaccgttgatgtcacaaaagcgatcctgaccaatctgagcaaacttgtgacaggccagtttaagcttgatatgctttcgggtcctgtcggcatttatgatatgacggatcaagttgcaaaaaccggtattatcaacctattccagtttgcggcgtttttaagcatcaacctgggaatcgtcaacctgctgccgataccggcgcttgacggcggacggctgctgtttttattcatagaagcaatccgcggcaagccgattaaccgtgacaaggaagcatttgtcgtatttatcggcgtagctttcttaatgcttcttatgctggttgtcacatggaacgatatccagcgtttattcttataa

SEQ ID NO: 624 - DNA, 312 bp, Bacillus sp.
atggcgaaagaatctatcatatttgtcgggctgtttactgcgattttaagtgccgctattttacttgtttcatgtgcgggaaatgatcagtccctcagccaatatgttaaaataaaggttcaggacggcgatacactctggtcacttgcagatcatgtagcagaaaagaaacacattaataaagaagatttcattgagtgggtgacggagaataatcatctccagactgctgatataaagcccggagacgaacttattctaccggttaagaagaagcatccggccgtatatcagctggccattgtcaattag

SEQ ID NO: 625 - DNA, 648 bp, Bradyrhizobium sp.
atgccgtcatcgcagccgatccgccaggcgcgaccatggctcgtattcctgctgctactggcgggtagcggggctgcgcccgcagcaccattgccgacggcgtcgttgcatgtcggcacgacgtacgcacggtggctttggcctgtacaagcggtgcgcgggcagaccaatgccgcgagtgtgtcccttcagatcctgccgagccagaccgtcaacgtcggcggaaaggtctcgttcggcgtcaccgccaggaggactggatatctcattttggtcgacgtcgacgcggaaggacggatgtcccagatctttccgacccctgagctattggcgcagtcgaacgaacgcgacatcaatctcgtcaagccgggtgtcgaatttgttgttcccgccccggcggcgcgacagcgtggttttgaatatgtcgtcgcaccgccggcggggtccgcagtgatgatcgccatcctcagcgagcgacgcgtgcaattgctcgatttgccggacatgccccgcaagctggaaggtcaggccgacgcgttgagctatctatcggcctggaccagcgagctgcgcgtgccggacaacagcagcggaaagctggtgacgaacaactggtcgttcgacgtcaaatcttattccatcaagtga

SEQ ID NO: 626 - DNA, 249 bp, Bradyrhizobium sp.
atgatcacgaagacagtcttggccgcagccggcgtcgtatgcctgctggcggcgccggcaatggcgcagaccacggacaaggaaaagaacggccaccattacagcggcggaccgaagacggaagtgcctcaccacatgggcaagaaggacacgaccggcagctcgacgaaagcgacgtcaggcggccatcattacaccggcggccccaatacctcgacgcctcaccacatgggcgaaaagaccaagtaa

SEQ ID NO: 627 - DNA, 342 bp, Brevibacillus sp.
atgttttataatccgtatgattataatccgcattatgatgacccgtatcattatgtagaagttcagcatcgtgtgaatcgtttttttgaacatatagacggaaaaggtgcttctttcactctgaactcgggagaaagattgtcatacgtgggggatgcttggaacgacagaatttcgtctgtacgtgtcgcacctaaaacgcttgttgttttatatgagcatataaattttacaggtagaaaaaagctgcttgaaaattcaagtaatcgttcccatctcttcaacattcacgaagattttaatgatatcacttcttctattaaaacttttcgactctgctaa

SEQ ID NO: 628 - DNA, 417 bp, Brevibacillus sp.
atgtcgtggagaaaatctacacaatttggcggcgacggcggtagcccctttagtgatgatctcactaacgtaaaaagattagcaggcttctatatccgtcacggcagtagaatcgatgctattcaggggatttatgagtattcagacgggagaagaaccccacaaggcttccatgggggatacggaggctctcataacattgttttctttgaaaatgatgagtatatcatccaaattaccgggcgtaccgatagacgagtagatcaacttacctttacgacaaataagcgtacgtatggtccttacggcggggatgggggcaatccctttgagattgacgccgcacatataagcggcttcttcggaagatctgctagtgagcttgatgcgataggcttttttatacctacagtctaa

SEQ ID NO: 629 - DNA, 954 bp, Brevibacillus sp.
atgaaaaaatttgcaagtttaattcttataagtgtgttccttttttcgagtacgcaatttgttcatgcgtcatccacagatgttcaagaaagattacgggacttggcaagagaaaatgaagctggaacccttaatgaagcatggaatactaacttcaaacccagtgatgaacaacaattctcttatagtccaactgaaggtattgttttcttaacaccacctaaaaatgttattggcgaaagaagaatttcacagtataaagtaaataatgcatgggctacattagaaggaagtccaaccgaagtatcggggacacctttatatgcgggaaaaaacgtattagataactcaaaaggaacaagcgatcaagagctgttaacacccgagtttaactatacctatacggaaagcacttcaaatacaacaactcatggattaaaattaggagtcaaaaccactgctaccatgaaattcccgattgctcagggtagcatggaagcttctactgaatataactttcaagattcttccactgatactacaactaaaacagtatcatataaaagcccatcacaaaagattaaagtaccagcaggtaaaacctttagagtattagcatacctaaatactggatctatttcaggtgaagctaacctttacgcaaatgttgggggtatagcttggggagttttaccaggttatcccaatggcggaggagtaaatataggtgctgtacttaccaaatgccaacaaaaaggatggggagatttcagaaactttcaacctagtggaagagatgtaatcgttaaaggccaaggtactttcaaatctaattatggaacggacttcattttaaaaattgaagacatcacagattcaaagttacgaaacaataacgggagtggaactgtcgttcaagagattaaagttccactaattagaactgaaatatag

SEQ ID NO: 630 - DNA, 2511 bp, Burkholderia sp.
atgaaccgaacgctgctcctgaaggccgccctgatcgcggccgccgtgctaccggccgccgccggcgcgcaatccgcccagaccttcaacgcgccgatgccgggcgcacctgccacgcccgacgcgcaggccaggccgccaggcggcatcctcagcccgttcctgctgtcggcccagctcggccgcgacctgatgctgcattacgcgatcgacaacaacaacgcgaacgcggccggcgtgccctgcgccgatctcggcgccgattcggcgagctgcgccaccggccggctgatcctcgagaatcgcggccaggcgcgcatcagcggcgacggctggaagctctacctgcacagcatccggcgcctgctgcgcatcgaccatcccggcttcacgctgcgccacctgacgggcgacctctacgagctgacgcccaagcccggcgcgctcacgctcgcgcccggcgcgcgcctgaccgtgcccttcgtggccgaatactggttcctgcgctacagcgatctgctgccgcgcccctacgtgatcgtcccgggcgcgctgccgaccgtgctgcgccacaacgacaccgacgacgagacgcgctacgtcgattcgctgccggccgacgcgcagagcagctcgaccggcaacgcgccgcccgccgcggtccagccggtggcgtcgcgcgccctgccgagcgtgaagcgcgagcgcctcggcaacgacacggtggagctgcgcggcgtgcagctggcactcaccggcctcgcggccaaccacgtggcggccctgcgcgagcgcgccggcgagctgggcctgggcggctcgggcctgccggtgcgcggcagcatcgtgccgcaacaactgcccgccgatatcgcgatccccggcggctaccggctctcgatcacgcgtcagggcgcgaacatcgaggcctacgaccagaccggcctctactacggcgtgcagacgctgttctcgctgacgccggccggcggcggtcggatcccggccatgcaggtggaggacgcgccgcgcttcccgcatcgcggcatgcacgccgacctggcgcgcaacttcaagcacgccgacacgctgcgcaagctgatcgaccagatgagcgcctacaagctcaaccgcctgcacctgcacctgtccgacgacgagggctggcgcatcgagatccccggcctgcccgagctgacggcggtgggctcgcgccgctgccacgatccgagcgagacgctgtgcctgctgccgcagctcggctcggggccggacaaccgctcgggcggcggctacctgcgccgcgacgaatacgtttcgctgctgcgctacgcggccgagcgcttcgtcgacgtgatccccgagatcgacatgccggcccacgcgcgcgccgcggtgcagtcgatggaggtgcgctatcggctgttccacgcgctcggccgcgagcgcgaggccagcgaataccggctgatcgatccgcaggacacctcgaacacgctgtcggtgcagttctacgaccgccgcagctacctcaacccctgcgcgcccggctcgctgaagttcgccaccaaggtgatccgcgagatcgccgcgatgtacgccgatgcgcaggcgccgctgccgatctggcacttcggcggcgacgaggccaagaacatcctgctcggcgccggcttccagccgctcaacggcaccgacccgaacaagggccgcgtcgaccaggccgcgcaggacctgccctgggcccgctcgccgatgtgcaccgccctgctgcagcgcggcgagatcaagtcgaccgaggagttgccgacgcgcttcgcgcagcaggtcagcgcgcaggtcgcggccaacggcatcggcaccatggcggcctggcaggacggcctcaagcatgccaacggcccgcaggacttcagcacccgcaacaccatggtgacgctgtgggacacgctgttctggggcgccgccgacagcgcgcgggactggagcgcgaagggctatcgcaccgtgctggcgctgcccgactacctctacttcgacttcccctacaccaccaacccgcgtgagcgcggctactactggggctcgcacgcgaccgacgagtacaaggtgttctcgttcgcgccggagaacctgccgcagaacgccgaggtgatcggcgaccgcgacggcaatccgttcgaggtgaccggcaccggcgccgcgccgcgcctggaaggcatgcagggccaggcctggggcgaggtgatgcgcaacgacggcgagttcgagtacatggtgtacccgcgcctgctggcgctggccgaacgcgcctggcatcgcgccgactgggagcgcccgtacgcggccggcgtgcgctacaagctcggcgacacgcacctggttgacaaggacgcgctgaacaaggactgggccggcttcgccaccgtgctcgagcagcgcgagctgccgaagctgggtcgcgccgggatcggctaccgcccgccgaccttcagcctgtccggcagttga

SEQ ID NO: 631 - DNA, 753 bp, Burkholderia sp.
atgtcgatccaatcgttttccaagcaagcgaaacacgccagattcgtccggatgtttgcactgctgccgatctgcgcggccgcgctcacggccggcgtgcaggaagcctgcgcgcacggcgcgatcggtacgccgatcgcgcgtcagtatcaatgccggctcgagggcggctactgggatccggccgacggcagcggcatcccgcataccgattgtcgcgccgcctaccagaacggcggcaactcggcctatccgttcacgcagtggaacgagttctcggccaacccgatcggccagggcgacgacctggagaagttgcagcaagccgtgcccgacggcctgctctgcgcgggcggcgacaagaagaaatccggcatcgacgtgccggccgtggcctggcgcaagacccgcgtgacgccggtgggcggcaagatcgacgtgacctgggaaaacacccagagccacacaccgtcggtgatgcgcatctacctgagcaagcccggctacaacccgcaacagccgctgcgctgggccgatctcgacaagatctacgacgcaccggcaccggctccgcagccggccgacggcggcggccgcctgcccggcaccgtcacctcgttctacaagctgagcgtgccgctgccggccggccgcaccggcgacgccgtgctgtacagctactggcaacgccgcgatgcgggcaacgagggcttcttcaactgcagcgacatcacgatcctgccggggcgctga

SEQ ID NO: 632 - DNA, 420 bp, Burkholderia sp.
atgcaacaacaacacgtttcgaaattcctgcttgcggccgcgctggccttgggcctggcgggcggtgcctatgcgcagtccgggctgcccgacgtcaagcagcagggcgacgtgagctacgtgtcgggcggcgtcggcctcgacgagtcgaatgccttccagcgcgccgagcaccagtggccgctgtcgatccgcttcaccggcgcgggcggcgaatacctctcgggcgtgcacgtctcgatcatgagccacgacggcgaggtgctgaaggccgatacgcgcggcccctacatgctggtgcggctcgcgccgggcgcctacaaggtgagcgcgaattacaacggcaagaccgagatgcgcaacgtgacggtgcctgccaagggcgacgcgaagctcgctttttcctgggccgcacagtaa

SEQ ID NO: 633 - DNA, 1857 bp, Burkholderia sp.
atgcgtacccgcttaccgcgcctcgcatcgagcgcgctgctcgccctgccgctctgcctgaacctgccggcccatgccgataccgtggctgccaataccagcacgccgctggcggcgaccccgccgatgggcttcaacaactgggcccgcttccagtgcacggcccaggcgcccaccgacggcagcgcgcgcgccaattattcgttccagcatttcatgctcgaccaggccgaggcgatgcgcgcgacggggctggtcgcgtcgggctataccctgctgtgggtcgacgattgctggatgtcgcgcatcggcagcgggcagatccagggcgccgcgcgctggggcggctcccagcagcccggcttcgatcccgacctgggcgcctacgtgagcgcggtccatgccaagggcatgctcgccgccctgtacaacacctccggcgcgaagacgtgccagggcgtggcggccggcgaacagggccatcagctgcaggacgcgcagacctacgtggcctggggcgtggatgccctgaagctcgacaattgcggcgcgatcgacaatgccacgccgcagcagctcttcaagcagatggccgatgcgctgggccaggccagcgccggttcggcgcgcaagatcctgttcaacgaatccgcgccggccggctacgggcccaccgggtccgccaagtacgctacgctggactgggtgcggccgctcggccagatgtggcgcaccggcccggacatccggaccacctcgatgaccgcgggcggccaggcggccagcgatccatgggactactacaacgccaatgcctaccaggaaggcgtctatcagagctacaacgagacgatcgcgctgtcgcgctacgtgtcgccgggcaactggaacgatcccgaccagctcctgatcggcgacaacgggctcacgccggccgaggagcgcagccagatggcgctctggtcggcgatggccgcgccgctcatcctcagcaccgacgttcgcaagttcgcggccaatccggccgatccccgctggcagcagtcgctcgccacgctgaacaacgccgaggtcgtcgcggtcgaccaggaccggctcggcatcggcgggtaccgcgtctcgcgcgacgatccctcgagcagcgccggcatcgaggtggtggcgaaaccgctcgccgaccatgcgctggccgtggtggtgctgaacaagggcgccgcgtcggccagcccgacgctgtcgttctcgaacctgggctaccgcaacggcgcggacggcacgccctgcacgctggcggtgcgcgatctgtgggcgcattcgggctcgcagctcgccgcgcaggtgcccctgacgatcggcgcccatgacaacgcgatgctgaaactgagcggcacatgcggcggttgggcgccgaccggcgagatcgagacggtcggcgactggggcgcgacgccgttgtgcatcgccgccggcagcgcggcgcccggcgcggcgctcgccctcgccaactgcgacgcgggaccgaagcagcgctggagccgcaaggccgatcgcaccgtggagctggcgggcaccggtctgtgcctgagttcgacggcgcccggcgccacgctcggcggcgccgccggccagtgggccacgctcgccagctgcaatgcgcaggacacgaagcagcaattcagctaccggcgcaatggccagctcgcggcggccgccgacgggacctgcctcgacatctatcgcggtgtggtggacggcacgctcggcaaacccggcacgccgctcgacctgtatgcctgcacggccaaccaggtcaaccagatctgggccgcgccgcatgccgatgtcctgaacgactag

SEQ ID NO: 634 - DNA, 1707 bp, Burkholderia sp.
atgcagacagcacgcaaggcattgccgctcgcattgagcatcgcactgggtctcggcatggtgcatggcgtcgcggcacagtcgaagaccggcaacccgcaggccgagaacctgcgcgagagcctgacgcgcggcgtggccaagcccgccgccggcggcgaggccgcgccgagcagcaccggcgcggtgtcggtcacgctcgcgaatccggcttaccgcgtgaagaagaccgcctcgacgcccgaggcgaccgcccgcgatttcctggccacgcaggccaggcagctcggcctggacgcgaccgcgctggccggcctcgagctggtctcgcagcgccaggacccggatttcacggtggtgcggctgcggcaggtggcggcgggactgcccgtctacggcagcgagatcgccgtgacgatcggcaaggacggcagcgtgctgtacgtcgccagcaatgcgatcggcggcgtggcgcccaaggcgtccaagacgcaggcggtggaccagcagcaggcgctcgatcgcgcgcgcagctatctcggcatcggcgagctgcgcaacgccgaggcgcaactggtggcgttccgcgacgcggccggcacgcacacggcctggaaggtgcgcggccggcccgacggcggccccaagggcgattgggaactgctgatcgacgcgaccagcggcgaggtgctgcgcgccgaggacaaggccttctatgccaccgacggctcgggttacgtgtttcgcccggatccgctgtcctccaccaagagcagctacggcagcaccggctacaaggacaacaacgacgcggattcggcccagctcacggccgcgcgcgtgcgcgtcacgctgaaggacctgaagcagtcgggtgcgagctattcgctgtcggggccgttcgcctcctgcatcgatttcgacgcgccgcgcgacaacgcctgcccggtgcagccctcgccagccttcgagttcacgcgcggcaacctctattttgaagccgtcaacgcctattaccacatcgataccttcctgcgctacgtgaaccagacgctgggcatcaaggcgctgccctaccagtacacgggcggcgtgcaatacgatccgcacggcgaatcgggcgacgacaattcttcgtactcgtcgagcagcggccggctcaccttcggccagggcggcgtggacgacgccgaggacgccgacgtggtgatccacgaactgggccatggcatccacgactgggtcaccaatggcgggctgtcgcaatcggaaggcctgtcggaaggcgtgggcgactacctggcggcaggctacagccgtgacttcaaccagtggagcccgtccgacgcgcagtacaactgggtctacaactgggacggccacaacgaattctggccgggccgcgtgaccaactacaacgtcggccgcacctatgcgcagatccgcagctccgagatccacacggccggtcagtactgggcctcgtgcaacctggtggcgcgcgacgcgatcggcggccaggcgatggacaaggccttcctgaagggcctgtccatgaccaacggctcgaccaaccagaaggcggccgcgcaggccgtgatcacggcggcttcggcgctcggctacagcagcacgcagatcaacgcgatcgcgaacgcctacaacaagagctgcacctacgccgtgacggtgccgcagaagtcctga

SEQ ID NO: 635 - DNA, 777 bp, Burkholderia sp.
ttgagaagaacgatcttcactgaaaccaccacgtatcgtcgcgccgtctcgcgcgcgaccctgttcgccgtcggtgccgcgctggtcggcggctgcacgatgacgccgtggacggactcgtggcagccgacgagcacgccgcaacccagccgccagaaccagggcggcgtgctggccggctactaccgcgtcaaccccggcgatacgctgccgtccatcgcggccggcttcggccagcgcagccaggacgtcgcgagctggaaccacatcgcgccgaccgacatgctcacgcccggccaggtgctgcgcgtcgcgccgccgccgggcaataccgcgatcacctcgccggtgccgtcctcgggccagccgtcctcgtccgcgctgcccggcgctacggcggccgagccaccggcgctggcctggccggcgcagggcaccgtcacctcgcgcttcatccccggcaagacgcgcggcatcacgatcacctcgaccggcgacaagaccgtgcgcgccgcggccgcgggacgggtggtgtatgccggcaccggcgtggcgaaatacggcccgctggtgatcctcaagcacgagagcggcctgatcaccgcctacggccacaacggcaagctgctggtcaacgacggcgacgccgtcgcggcgggccaggcgatcgccgagatggccaccgatccggatggccgttcctcgttcgacttcgaggtccggcaggacggcaagccggtcgacccgatcggtttcctgccgcgcaacggcggctga

SEQ ID NO: 636 - DNA, 726 bp, Cellulosimicrobium sp.
atgaccagatccgcgctgcgcgtcctgtccgccgcgctcgtcgccggacttgccctcggtgcggccgccacggcgcccgccctcgcgacggagccggacctgcgggtcgtgacctgggaccgcggccccgaccccgccgccgacgcccaggtctcgacgggcgagagctgtgcggtcgaggcgcagcccctcctgcccggccaggaccccggcgcgctcccgccggcgcccgaggtgtgcttcggctcgctcgaggaggcgctcgagttcgtctcgggcggcgacgtcgcctcgtcgcggctcgccgacgtgacggcggcggaggtggagggcctggtctcggacctcaacgcgtcggcgtcgtcggccgcggccgggcagcggctcgccgggacggagcgcgcgacgaccgccgcggcgagctcgctggtcctgggtgtgctgtggcgcgacgccaactacaagggcacgtccaaggtgctctacgggtcgggcaccaacgggtgctacaccggctcgacctacggtttccccaacctcgcgaacctgctcatgaacaacgtcgtcacctccgcgacgacctacgcgggctgctgggtgaccctgtacgactcgtacggctacgcgggcgcgaagaagaactgcacgccgcactgcgcgacgctgggcacgttcgacaacaaggcgtcctcggtcgtctaccgccccgtgggccagctcggctga

SEQ ID NO: 637 - DNA, 1113 bp, Collimonas sp.
atggagaacttaatgagattgacacgtcactcccgatggcagggagtcaagcgttatgcagcagtgacattaccagtgctgttcctggcggcctgcgcgacgcaagaaccaactacatccggcacgcaaaatgccgctagcaccggcaagccgatactggccccaaagccagccgcgccagcggtaacgccacagcaggcggagttgaagagcctggtcgcactgcaagaccgcttatacgacgtagcagctccactgctggtgaataacgccgtcctgtgccgcaacaacgcgcgcaacctgctcggcttcaccgccaagacaaaattctcttacaccgccgaattcatcgacgccgccacttcactcggactgaccgatcaattgcaagtgaccggcgtactgaccggcagcggcgcggccaaagtcggcttgcaacgcggcgacctgctggtggcgatccaggacaaaccggtgccgaccggcgccgatgccgagcgccaaaccgcactgatgctcggaccgttggttaacggccgcagtaacatcaaggtgacgatcgcacgcaacggcagcaaccagaccctgaacgtcccgctgacccgcgcttgcgcattcggcatcgaactgggcaacaccgacaacgtgatcagctatgctgacggtcgtcgcgtcctgatcagcgcgggcatgatgaaattcgtgcgtagcgacgatgaactggcctacgtgatcgccaaggaaatggcgcataacacgctgacccatccagccaggcaacgcctcaccgccacgctgtccggcgtgatcgacaacctggtccgcctgcgtccggataacgcgccattaagcggcgccgccggcgtcaagccatatccgcagcagcttgatgcagcagccgacaagctggccttgtacatggtagcgcgcgccggctacaaggtcgacgatgcctcggcattctggcaacgcctggccacgcaatatccagctacggtactcaacgggtacacggcgatccatcctgccaccacctaccgcatcgctgccatcgagcaagccgtctcggatatccaagccaagcaagcgagcggcagcactgtcctgccctaa

SEQ ID NO: 638 - DNA, 1962 bp, Collimonas sp.
atgtcaaacagaaatcaaaagatgtcgcgttacgttggaatctcgctactaaccttcagttgctttgttttcatacccgctgcgggagccggtcaacctctagcaacgacatatccaaatggagaaatatataactacccgattcggtccatcatcagtttcgcttcgtcggttgatgtgatcggatcaaagttggcccaatcattgtcttcatctgtttttcagggagagtcattagacgagaaaaccttgggtagcagtttcggcggccgccataatacaacgctgacttacttggatggggccacgattctttcaaacgtcaattccttgaagaggtcaaaaatcctgctagatgcaggcgttccgctgttaattagagtcgatcgcaaccaacttgaagtgggaaagcaagtagcagctttatttggcgtatcaatacgctcaggctatatgttactcagcaaagacggcccggcaaaattgacggtattcaatttacaggcgccggacaacacagcaatcccgaacggactgatgcaagcgcttggtgcggtgaaacaaaaaaatgtcctgcccagtctgcgtgcgaatatccgggctctggaaacagatcaggttggtatccccaaagtcacgctgaatttgaattcagctgatgtaaccggccaaatagtatcgatagtcaatctagatttaatcagaagtgcatccagaggcaacgacaaaaaatttatcgtggtaaaagcgacgccaacggtcagatcaacgcgtaatggtgtggtgataggctcggcgcccaataataatctctggggggcatacctgcctcatcaatatagtatttcccatgaagtaagcggaacagcgctcacgcctattcttgtcagctctgatccgccaagcgattctcgcactgaatttacctataccgagaccaagacacatggattcactatcggaggatcatttggtgccgagggtggcggagaacacactgataaatggaaatatattgccaagaccccatttaatatcaatgcaggaatctcttacaccaacaccaagacgctgaccaatattttcaaggactattctttgttggccgcgccagcaattggcaaaatcaagtgggatttgtttatcgatcccaagctgaaattcgttttggtggaacgtgaaacggcaggactcccaaccttgaatgaaaaccgaatgacaccaatgatgagatcagcatctatggaaacctattccacgtgggagctacctggaaactatgagggattggcgaccctgaaaatcggaggcggctatattcttgatcgacgtgaatggtggtacgaccgatcggacgtaaaacgtcgatacgagacagacaccttcgagactctggacgatatcatattggatttcggtagcccgtatctcacgcgcgagatgacggtgcttattcgttcggctgacggacatggcaagtgtgtcggcgatcaatctggtcaagcgaaactgcttagctgtagtcccgcagataaaagccaattatggggcctggactccgaaagccgatatgtcaaccgactcagcggaaaatgtcttaccgcggacgttcaatccggagagttaaaaacggccgcatgcggcatcgacaatgcacagcaatgggattggcgagccgatcgcatacattcccgttatgaccgcaattggcggctttactcaaccgccgatatgctcaaagttatccctgatagctcaatgctattcgaagacattccactgaattccttcaatagactcaatatcccctgggcaagttatcctggcgccccgtctgccaacgatgtcatgcccaatctcaatggcccgtcgcctcagatcagccccgattggattggaaaatatcatgccgcagatgctcgtcaaagatggaatatagagatactgcgtgacggtatttga

SEQ ID NO: 639 - DNA, 627 bp, Collimonas sp.
atgaaacagatatcgtccagcctgctcgttctgctggcgctggcgtcgccgctgacggctcaggcgcacggctacgtcgatgcgccgaaatcgcgcgctttcatgtgcaaggcacaggagaatactgcttgcggtgcgattcaatatgagccacaaagcgtggagggggcgaaaggctttcccgatgccggcccggctgatggcgcgattgcagcaggcggcctggcgcaatttgccgaattgaatgagcagacgcctacgcgttggaaaaaagtggcgttaacgaccggcgccaacgacttcaactggtactttaccgccggccacatgacgcaagactggcgttactacattaccaagcaaggctggaatccgagtcagaaactgagccgggaagcgttcgacctgcaaccgttctgcgtgatcaaaggcggtttcgcgccgggcagcaatacccacgcaaaacaccggtgcaatattcccgccgatcgcagcggttaccacgtcatcctgagcacctggaatattgccgataccggcaatgcgttctatcaggtcattgacgcccagattcaggccggagcgacgatgaacccgcagaaggtcattatcaatccattcaagtga

SEQ ID NO: 640 - DNA, 999 bp, Collimonas sp.
atgcttgggctggcgctggccgtcgcatgctttttcttctcccatctggcggcggccagttgccttgacgggaaccggatgaccggcgtcaatctcagcggagccgagttcgcggcggacaaattgcccgggacgatctttaaggattacgtttatcccgatccggccgatatgcgccattttcaatccttgggcatgaacaccttccggctaccgtttctgtgggaacggatacagccccaattgttgggtccgctagatgaagccgaggtgcaccgcatagaagaaacggttgctgccgcacggtcgctggggacctgcgtgatccttgatgtccacaactacggcgaatatcggggcaagccgatcggctctactgaggtgccgcgcgccgcgctggccgacttgtggacgcggctactggcgcggttcaaggaccctgagaacaccgctttcggcttgatgaacgaaccaagcaaactgcctgtcgccgaatgggcggcggtggcgcaggaaaccctgaacatactgcgaaaaaagggatcacgccatttgatcctggttcccggcggcagctggagtggggcgcattcctggtttgcaaaagacaacggggtatcgaacgccgacgctttccgccggtttcacgatcctgccgataactacatgatcgaagtgcatcagtatgcggatgcggatttttccgggaccagcaacacctgtgtcgacccggcgcgcttgggcgccatcatggccgatatcgcggtatgggcaaattcgaccaggcgacgcctgtttctcggtgagttcggcgtgcccgccaatcagcaatgtctgcaagcactggccgccatcatggatggcatgaaaggcaactccgcctggggtggctggacttattggaccagcggcaagtggcttggtaattatccgtttagcttgcagcccgacagcaatggcgacaagccgcaaatgacaattttgaaaaccggcatgtga

SEQ ID NO: 641 - DNA, 276 bp, Dactylosporangium sp.
atgaacacccaccgaagaaggcgccgtttcggcctcgccgtcgccaccgtggtgaccgcgctggtcggcaccggtgtcgccgtgctgaacatgacgtcggcctccgcggcgaccgtcgacaccagcgcgacctacgtcctggtcaaccgcaacagcggcaaggcgctggacgtgtacaacttctccaccgccgacggtgcgcgcatcacccagtggacgcgcagcgacgccaacaaccagcagtggcagttcgtcgactccggcggcggctactac

SEQ ID NO: 642 - DNA, 864 bp, Dickeya sp.
atgtcaataaaagttgatatcactgcatcatctgacaaccatcaaacgatagccacggctacaggaaatgatatttccgttatcagcaatgaagaaagaggtacttttcagctaaacgatcaacaattaaagagggcggttgaagtttattttggcaaaaaaccaaatgatgcatacctttctagccctacgccctggggggatttatataagacctacaattggcagcaggttatgagaaccttacagccggtaagcacaagggtcataagccaaaactcaacaccggtcattgttatggaacaggattttgttaataacagttctgttcctgctgtttataatgtaaaaatctcacaaagtgttcagaacacagtaaaatccagctggaatactggaggaaagctaactgtaggtcagaaagttaagtatggcatatcctttctgggaacaggtggcgggggcgagtcatctatatcgtatgaacagtcgtggggaattggcggtgaacaatctacgacgataacgttaggaactgaatccggcttgcaggttactctgcagccaggccaggccgttacagcagagctggtcgcatccagaggatcgatgaaagttcaggtagattatcaggcgtctctttctggaatcagtgcggttaattataaccccacctataaagaccatcatttttggggacttcccatcactcagatcatgagaagttcaaacataagtaatgcgatagtttcatctgaaataatcgatatcggattttacgctgattcaaaagttattcttcgcgacaaaaataccggtggggttttcagaacatttaatcttttcgacaaacacacagactag

SEQ ID NO: 643 - DNA, 336 bp, Duganella sp.
atgaagcgaatactgggccttgcgctgctgggcgccgccgcggcggcgcaggccggcgacatcacgctgtacacccgcgcgcacttcggcggcccggccctgcagctgcacggctcggagcccgacctggacaagctgggcttcaacgaccgcacctccagcgtgatcgtgcagaacggcacctgggaagtgtgcgagaacaagcactacaagggcaagtgcctgatcctggaaaagggcgaatacgccgagctcaagaactttaacgacatgatgtcgtcggtgcgcgaaatcgaggccaggccggccgccaaggacaagcccgagcataaatga

SEQ ID NO: 644 - DNA, 1365 bp, Duganella sp.
atgcattgcaagccactcatcctgactgccctgagcgtgctggccgtcgcgccagccatcgcggccggccctgacaccagccgtcaccaggcccagatcgaccagatcgtcaaggacatctcgccggtccgcatcgagggctatatcaacaagctggtcggcttccgcacgcgccacacgatgtcggacacggtctccgaaaccgaaggcataggcgcggcgcggcgctggatcaagagcgagctggagcgatgcggcgcggcccagggcggacgcctgcaagtggcgttcgacagccacatcgcgccggtctccgcgcgcatcagccgtccgaccgagatcgtcaacgtggtggcgaccctgccgggcacgcaggccgcttcggtggaccgcatgtacgtggtcagcggccactacgactcgcgcaacaccgacgtcatggacgccaagggcgacgcgcccggcgccaacgacgacgcctccggcaccgccgccgtgatggaaatggcgtgcgtgatggccaagtacaaattcgacgccacgctggtcttcatgacggtggcggcggaagagcagggcttgctgggcgcggcgcactgggccgagctggccaggcagaagaacctgaacatcgccggcatgttcaccaacgacatcatcggcagctcgcgtgacgagcacggcaaggtcgacaacacgcaagtgcgtttgttcgccgaaggcttgccggtgcaaaaggaaaacagcgacgccgtgcgcacgctgatccagaccggcggcgagaacgattcgctgtcgcgccagctggcgcgggcggtgaaggaggcgggcgagcgttatgtgcccaagttcaaggtcaacgtcatccagcgccgcgaccgctacctgcgcggcggcgaccacatgccgttcctggagcgcggctatgcggccctgcgcttcaccgagccggcggaagacttcaaccaccagcaccagaacatccgcaccgagaatggcgtgctgatcggcgacctgccgcagtacgacgatttcaactacatcgcccaggtggcgcgggtgaacgcggcggccttgtcgtcgctgtcgctggcgccggccgcgccggccaaggtgcaggtgcgcaccgccaaattgcagaacgataccgagctggtgtggcaagccaacgccgagccggacctggcgggctaccgcatcgtctggcgcgacacctcggccgccgaatggcagggcagccagttcgtcggcaaggccaccgagttcacggtgccgctgtcgaaggacaactactacttcggcgtccaagccatcgacaccgaaggcaacgccagcccggccagctacccgacgccgctgcgttaa

SEQ ID NO: 645 - DNA, 1227 bp, Duganella sp.
atgacaacaaccacagcacccaaactggcgctggccgccgccatcctgctggcctacagcgcacccagcctggccgcatccacctgcgatcgctacgcgtcctacccggtgaagggcgggacctataccgtcattaccaacttctggaacgacaaggccagcggttcgcaatgcgtcaacgtcaaccaggacaacggcgagtggagcgtgagcagtgcgccgtcgtcgccggacagcacgccggccgcctatcccgccatctacaagggctgccactgggcctcgtgcaccaaggacagcggcctgccattgcaggccaaggccatcacctacgcaccgacgcgctggcgcgtcacgcccggcgccggcggcgactgggacatcgcctatgacatctggttctcgtccggccgggaggcgccgcccagcggccagcccgacggcgccgagatcatgatctggattaaccacagcggctcggtgcaaccggccggcagcaagaccgccaacgtcaacatcaacggcatgaactgggatgtgtggaccgcctggaacaacccgtccggctggccgcgctggaacatcgtctcctacgtcgccacctcgccggtcaacgccgtcaacttcgacctggtgccgttcttccgcgactcggtcgggcgcaaggcggtcgacaacaactggtacctgctggacgtggaagcgggcaccgaactctggcgcaacggcgccggcttcgccagcggcgatttcgacgtgcagttccacaccgatccggtcaaggggatcgatccgaacaagtggtacagcgtcgtcaacaagaacagcggctcctgcgtcgacgacgccgatttctcgaccagtaacggcgccgtggtccatcaatgggcgtgcgacagccggggcgcggccaaccagcagtggaagttcacgcccaccgacagcggcaactaccgcgtcagcacccagcaggcgccggggctggcctgggatgtcgcgggctggggcacggccaacggctcgctggtccagctgtggacctacggcggcggcagcaaccagcaatggcaggcggtggacctgggcgacggctactacaagttcgtcggccgcggcagcggcaagtgcctcgacgtgccggccgcttccacctccaacggcgtgcagctgcaggtctacgactgcaatggcacgccggcgcaatccttcaagctgatcgcccagtaa

SEQ ID NO: 646 - DNA, 813 bp, Duganella sp.
atgaacaagcccctcaacatcgcaatggccatcgccacgctgacgctggcgtcgcaagccatggcgcaaatcacgttttacgagaatgacggctggcgcggccgcaccttcaccgccaaccagcaggtacgcgacttcacacgcaacggcttcaacgaccgcgcctcttccgtcgtggtcgaccgcggccagtgggaagtctgcgacgacgccaacttccgcggcaactgcatggtgctgcgccgcggcagctacgagtcgctgcgcggcatgggcatgaacgaccgcatctcgtcggtgcgcccggtgggcaagcgtaacagctacgccaacgaagcgccggcgccgctgccgcaaccgacctatgaataccgccgccgcccaagcgagcgcctggtcgaagtgcctgtcacctcggtacgcgccgtggtcggcacgccggaacagcgctgctgggtcgaaagccagcaagtggccgaacctgcccgtaacggcaccaacgtcggcggcgtcatcgctggcgccctgatcggcggcatcctggggcaccaggttggcggcggcacgggtcgcgatgtggcgacggccggcggcgcggtggctggtgcggccatcggcaacaacatggccaacaacagtggccagcaaagctatgcgcgcgacgtgcgccgctgtgaaaacgtcagcaatcccaagcctgaatactgggatgtgacgtataactaccggggccaggaacatcgcgtgcagatgagcacgcctccaggccagtccatcgccgtcaacagcaataccggcgaaccacgcatgtaa

SEQ ID NO: 647 - DNA, 711 bp, Duganella sp.
atgaagaataccctgactgccgctttcctgctggctgcttccattgttggccaggccgcttcggccggagaattgctgctgttttcgcatgaagacttccgcggcgaacgcgtcacgatcgccgacggcgccgccagcaacttcaccgatttcggttttaacgatcgcgcttccagtatcgtcgtgcgttccggtacctgggaactgtgcgagcacaaggacttcggcggccagtgcgccgtgttcgagcgcggcgaatatccgaacctgcgccagttcaacaatcaattctcgtccgcacgtgaaatccagggcggccgccgcgatcgcggcaactcgggctacgggtatggccgcgatgaccgcgattaccgcgattaccgcgacgagcgccgcgaagagcgtcgcgacggccgctggatggaagaccgccgtgaagaacgccgcgactaccgcgaacgcggcgacgccgtcgaaatgtataacgacgtaggcttccgtggccgccacgtggttatcaataacgacatgcataccctgcgcgacgtcggcttcaacgacaacgccaactcgctggtgattaattacggtacctggcaggtttgcgaacatgccgactacggcggccagtgccgtacctatggtccgggccgctatccgaacctggaagacttcatcgaccgcatttcttcgatccgccgcgtacgctga

SEQ ID NO: 648 - DNA, 426 bp, Erwinia sp.
atgcggaaggtgatcgtgatgaggaagaggctctccatgccgctcgtggcggtggccgccgcggtcgccaccgtcgtgccggcctccgcggcgcacgcggccgacgggtacgaccggtgccccgacggctactactgcatgttctcgggcctcgacgggaccggggacatgatcgcgctcagggaagacaccccggacctcgcggcgctcggcatgaacgaccgggccaagtcggactggaaccgcactgcctcgaccatctacctctggtccgacgcgcagtacaccggctgtacggccgtgacctccgcaggaccgacgggcaagggcaacttcttccccacgtaccaggacttcttcagctcggtgcagttcgacggtcctggcggtccgagctgcggcacgccgccgggcgagggccgctga

SEQ ID NO: 649 - DNA, 1809 bp, Erwinia sp.
atggcgatattcgactacaagggccaagacggccgcgtgctcatttcagatgcctggaaccttgccacctacaccagcggtgtagcgacggtaggggcgctctacaacctgcccggggcagtcctgggcgaaggcaacacctttgtcctgcccaagggctggcgcgagatcagcgccagcgacctgggcatcgacggcagccacctcgacctgacaggcagcttcaagggcgagaacgtatccggctcccaggccaaggtattcggccaatacgacgagagcggcaagctggtcaaaatgggcttttcgattgccggcaccaactcgccgatggacctgctgggctacccggcgatgatcgacaactcctatatccacggctacgactacctgctcgactcgatcaagaactacgccactaaccataacctgacaggcaaggatgtactggtcaccggctacagccagggcggctccgtgaccaacagcatgtacctgggcagggacaccctggccgacggctttttcaaggattcggactacttcggcatggcctcgccaaaggccagcaacagtgacggcatcttcaacttcggcttcgaaaacgacatcgtgcatcggctcatcggcgaacagaccgacctgagcggcgccattctcgcggccctcaaaggcagtgacgccaactacacctcgaccaccgacaacatcgtgctgttcgacacggtctacgccctgcccacctggcccaacggccccttctccgtagtcaatcccaacggctgggtggcgcacctcgaaggcatcttcatcaaccctatccagcgcatcggccagtcgacgttctacgactacatcgagcgcgacagcaccatcatcatcagcaacctcgacccggtcagccgcagctttacctgggtcagcgacaaatactccgccacctccaaccacttcggcactccggcctttctcctcggcacggacagcgcggacaagctgcaggacggccgcaacgatgacttcctggacggcttcgccggtaacgacagcttcaaggtcagcaccggtaccgacatcgtcgcgggcggggtgggcgacgacaaagtcttcctgcagggtacggtctccagctacgaagccgtgcgcctgagcgatggcagcctgtttctcaacgacaccggcgggcgttatggcctcaaggagctgcacgacgtcgaacatgtcgagttcgaaggcctcctcggccaggccttgaccccggcctataccgtgaccagcagcaagctcaacttcgaaggcctgttcggatcggacaagagctacgccaaggccaccgaaggcacgcagttggcagacctcctgaagggtaccgccggccgcgacctgatcttcggccagggcggtgacgatcttattgaaggcggtgcgggccatgatctgctgcacggtggaagtggcaacgacaccttgctcggcggcaatggcaacgatgccctctacggtggcgcccacaacgacatcctggtcggcggcctgggcaacgacaccctcagtggtggcgtgggcagcgatctgtttgtcttcgaccagggcggcttcggccatgacctgatcagcgacttcaacgttcaccagaacggattcgatcagttggtgttctccaaatccctgttcgcctccgcggctgcggtcatcagcgccaccagccagcaaggcagcgacagcctgatcgtggcgggagacagcagcatcaccctggtagggttcaacgccgcgcaactcagtgcggacatgatcagcctggtctga

SEQ ID NO: 650 - DNA, 1068 bp, Erwinia sp.
atgagcacgggaagcccggtagtaaaattacgccgtattgcggcggtttcactcgttggtttttggttagctggctgttccagcgataacgcacaggcgccaatcagctcggtaggcggcaatggcagcgccaacagcggcgggggattaatcagccagccaccgccgatcgtttccggttctggccgcgccgcgcccgcagcgagcggcggcagaagtgaaaatgttgttacgcaaaatgggcgtatcatctataaccgctcgtatgggaatattccgaaaggtagctacagcggcgaaacttacaccgttaaacgcggcgatacgctgttctatattgcctggattaccggcaacgatttccgtgatttagccgaacgaaataacgtctctgcgccttacagcctcaatgtgggccagcagttgcaggttagtaacggctccggcggcaccctgaccggcggcaatgccatcaccgcagcggatgcaacggcgggcggcgtgcccactcagccgaccactgcgcaaatgaagagcacaacggttgcacgtcagccggttattacgtattctgaggattcaggtaaaccaagtgaaggcaaaatgttaccttcagccggtacaaatactgtcgcaacgacgacagcgccggtaagtgctccgaccgtcagcagcacaacgaacagctctactccggtaggcagctggcgttggccgaccgacgggaagattatcgataacttttctgcttccgaaggcggcaacaaaggtatcgatatcgcgggatcgcgaggacagcccgttgtatcaaccgcctcagggcgcgttgtgtatgccgggaatgcgctgcgcggttatggcaacttgattatcatcaaacataatgatgactacctgagtgcatatgcccataacgacacgatgctggtccgcgagcagcaggaagtaaaagcgggtcagaagattgcgacaatgggcagtaccggcaccagttcggttagattgcattttgaaattcgttacaaggggaaatccgtaaacccgttgcgctatttgccgcagcgataa

SEQ ID NO: 651 - DNA, 1632 bp, Erwinia sp.
atgatcaagctgggactgctgctggctgctttactgagtacgttttccactctggccgctaatttatcggatatacaggtttcaaacggcaacgacagggcctcgatcacgctgagcttcggtggtcaaccggtgtatggcttctttccgctgcacaatccggaacgggtggtgctggatattcgccagagcggcgtgatcaaaggcctgccgttgacgttcagcggcgataatatggtgaagcgtattcgcgccagcacgccaaaggataagcagagcatccggctggtgttcgagctgacgcagccgggaaaaacgcgcgccgtgacccagcgtaacggcagcacctataacgtggttttcaccatcaacggcacgcgtccggctccgcgatctgccgccgtcagcagcgtttcgcggcccgttccggcagacaatccgtttaagggcaacgccgttacggcggtcagcaacggcaacgaagtcgcggtgccgggcagaacggtgcgtgccgttgacgaagctattatcgtggcgatagatgccggacacggcggccaggatccgggtgctatcggcgcgaacgggctgaaagagaaaaatgtgactatcgccatagcgcgcaaattaaaagcgttgctgaatgccgatcctatgtttaaaggcgtgatgacccgcgacggcgactattttatctccgtgatgggccgctcggacgtggcgcgcaagcagaacgctaatctgctggtgtctgtccatgccgatgccgcgccgaaccgtagcgcgtccggcgcgtccgtctgggtactctctaaccgccgcgccaacagcgaaatggcgggatggctggagcagcacgagaaacagtcggagctgttgggcggcgcgggcgatctactggctaacagccaggccgatccctatctcagccaggcggtgctcgatttgcagttcggccactcgcagcgcgttggctatgacgtagcggttaaggttatcgcccagctacagcgcgttggctcgctgcacaaacgacgcccggaacacgccagcctgggggtattacgctcgccggatatcccttcgctgctggtggaaaccggctttatcagtaacccttcggaggagcgactgctcggcagtagcgcttaccagcagaagattgccgagtcgatttataaaggcctgcgcaactacttcctggcgcacccgctgcaatccatcccaaaggaggaaaaccgaccgttgcagtccgcaacggcggttgatgttcagcctaatcccgccccggtcagcacgcgctatgccggtgcggtaacgcgccacgtggtgaaaagaggcgagacgctttccgggattgccgaccactacggcgtcagcatggcgatgctgcgttcgatgaatacgttgaagaaggatgtcgtttgggtcggccagcggctgaaagtgccggcttccggcgcgcagagcgtgagcgccagccggccgcagcggcataaagtggtgcgcggtgactcgctgaccgccattgccgcacactatggcgtcagcccgaaagcgatacagcaggcgaataatatgaaatcgcaaaatgttatgctggggcagacgttaactattccaacctcgtaa

SEQ ID NO: 652 - DNA, 987 bp, Geobacillus sp.
atgcgcaggcaattggtcctggctctgttgctcggcgggagcgttttcgcggcaggcgctcgcgccgagcaagcagaagcgagcgtgaactacgatcacatcgttccggcggcaaagcagtacatcggcgtcccataccggtggggcggcacgacggctaagggtttcgactgctcgggatttatccggcatgtctaccagtcgatcggcattgatacgccaaggacggcgaccgatatgtaccggatgggcaaacgtgtcgacaaaagcgctttgcgcgtcggtgatctcgtctttttcaatacgagcggaaaaggagtttcccatgcgggaatatacataggaaacaaccggtttattcattcttcttcttccaaaggtgtgacgatttcatcactgaatgattcatattggaaaaaaacatatatcggggcaaagcgggtgctggcgtaccgcttagcgccggggcagtttcaagatgtttccccgtcccattgggcgttcgatgaggtgcgcaccctgtcggaacaagagcttgtcatcggatatgaagacagctactttaagccggacgagccgattacccgcgcggaagtcgccgcgtatttggcagagtatctggatttgaatttgtctgaccgctcggtcccgtttaatgatgtgccggacgactactgggcgcttggagcgattcgggcggtgcaaaaacaagggattatgaacggaagcaatggaaaatttcatccggaagacacgttgacgcgcgcgcagctggccgcggtgctgacgagagcatttcgcttacagccgccagctgcggcgaaatcatttaccgatgtgccgccaagcttttgggcgtttcgcgacattcaagcactggcggcagcgggaattgcgacggggcgcacggatggctcgtttggcccgaacgagcctgtcacccgcgtgcaattcgccgcctttttgtaccgcgctatgcatcagtag

SEQ ID NO: 653 - DNA, 1095 bp, Janthinobacterium sp.
atggctacgggctggctgcttcttggtacggcacaggcccagtcgtatgtttataaaaatctgagtctgcccgacgtcgacggggttgcgagggcgattaacaaccagggccagattgtaggctccagctacttcgaaggcgctggcaaccatgcgaccctgtggagcggatcgacgactactgatctcggctcgctcggcccatccagcagcgccgcgagagcgatcaatggcagcggccagaccgtgggctattccttgtacagcagcacctcgataacggccacctcctggaatgctgccagcggcagtccactcgcgctctcacccggcactcaaagcaatgcgagagcgattaataatgcaggccagatcgccggctatacaaccgcggcgccgggctcctcaagggcgacgatctggaacggcaacagcacgacctacctgcctacccttggcggcaacgactacgccctcggcatcaataaccacggcgtggtggtcggcgatgcctactttaccggcagtgaggcatcgcacgccatggtatgggacggcggcggcgtgcgcggactggacgcactgggaggcgtcggcagcagcgcggcagcggtgaatgacaacggtgcgatagtcggctcctcccagctggccaatggcacctggcaagcgacgctatggaatggcgacaccatcagcaacctgggagcgcccggctacgatggcggacaggcttgggcgatcaacaatcgcaaccaggtcgtaggctacacatatacgggcaataacaacgacagcagcacatggcgcgcgacgctgtgggacggcgggcgcatggtcgatctcaccagctttgtcgatagcgacagcagagcggcaggctgggtgctgacgcaggcatacggcatcaacgacaaaggctggatcgtcggcgaagccaccaacatgcagaccttcagccggcacgccttcctgctgtcggtcagtgcggtacccgagccctccgcctacgcctcgctgctgatgggcctggcgtgcatgggcgtgctctacggccgccgcgtggggagtacgaaaaaaaacccgccggcctga

SEQ ID NO: 654 - DNA, 879 bp, Janthinobacterium sp.
atgaatcgcccgttcgcctttgctctgctgtgtgccagttcgctgtttgtccacctcgcggcgcaggccggcgagatccgcctgtacaccgatgacaatttcaagggcagggtggtggtcttgcgcgatacgacggacgacttgtcgcgcgttaatttcaatgacaccgtctcgagcatccaggtcgattcgggcagctgggaagtgtgcacgcatgccgatttcaagggcgattgcaagacgctggaacggggcgactaccgctcgatgccgggcatgaacgataaaatctcgtctgtgcgggaaaccggcgccgggcagggcagcggcagcggcagcggcggtggacgccgcgcggcgctggagttgttcgccgacggcggccagcgcggcgcgtcggccggcgtgaactcggaccgcgacgacctggtcgacatcagcttcaacgaccgcgccagcagcgcgcgtgtcgaatatggctactggcagttgtgcagcgattccaactaccgtggcagctgccgcgtgttcgggcctggcagccacgatgacctgggcagcctgaatggacgcgtgtcgtcggcgcgcctggtcgatccgcgcgaagagaatcgtccgcaaaatgacgagggcctggtggtgctgtatggccgcgcttttctgaagggaccagggctgcaggtgaaccgcgacgtcagcgacctggtgcgcctgaacttcaacgaccaggccgcatccctcgccatcaacgagggtacttgggaagtctgcacggactcgcagttcaacggcagctgcgagcgcatggggccgggcaagtatgaagtgctgaacacgacgctcgacaagcgtatttcctcgctgcgccggctgtactga

SEQ ID NO: 655 - DNA, 465 bp, Janthinobacterium sp.
atggcaccagacagacgcggtaccttgaacctggcggcggtaatgctggccgccgggctgttgctgggaagtgcggcgcaggcccaaaccgacagcgcactgccgcccgtgcagaaaagcggggcggtggaatacctgagcggcggcatcggcctcgacgagtcgacggccatccagagcgccagtccgcattggcccttgagtctcgtgttttccgtgcaggcggcgggcaaggcggaatttgcctccgacgtgaagctggagatacgcgacgccaagggtggcgtggcgctggaaacgacggccagcggaccgttcctgctggcaaagctgccgccaggcagctacagcctgcacgccacgctggccggcaaggcactggaacgaaaggtgcaggtcaaggcgggatcgtccgcgcgcgtggaactggtctggccggcgggaacgaaccagggccggccttga

SEQ ID NO: 656 - DNA, 4818 bp, Janthinobacterium sp.
atgaaccacatctaccggctggtctggagttccttggcacaagcatgggttgctgttgcagaaaatgcaagagcgcatggcaaagcaacacgggcgggcaagctgcctgcagcacttggaagtacactcatacttctgtccggagccatgcttatcgctcctaccgtccatgcggcgaatgctgccgatgcgacggtgacactgggtagcggcagcgtcagcacggtaggcaacaccaccaccatcaagcagaattcgcaaaacctcgccatcgactgggtcggtttgtcgacagccgccaacgaagcgctgatcttcaaccagcctaactcttccgccatcgcactcaatcgcattaccggctccagcccgagcaccttgctcggcagcctgacggcgaacggacaagtcttcatcctcaatcctaacggtgtgttgttcggcgcaggctcgcaagtcaacgtcggcggcctggtggcttcgacgctgggcatgagcaatgctgatctgcaggcggggcgcatggtctttgcgctggatggcaatacgaatggcagtgtggttaaccagggcaagatcaatgcagcggatggcggttacattgcgttgatcgccgctacggtacgtaatgaaggtgagatcaatgccaaactgggaacagccttgctggcggccggtaacaaagtcacactgaatatcaataatggcagcctgcttgcatacagcatagaccagggagcattgaatgctttagccgagaacaagcagttgatacaggccaatggcggtcaggtactgatgtcggccaaggcgctgaatacgctgacgacagcagtcgtcaacaataccggcctgatcgaagcgaagacgatcgagaaccgcaacggacgcatcatgttgatgggtgacatggaggtcggtacggtgaatgtggcaggtacgctggatgccagtgcgccgaccagcggcaacggcggcttcatcgaaaccagtgcggcgcacgtgaaaatcgctgacgatgcactcatcaccactagggcaaacagtggcaccagcggtagttggctgatagatccggtcgatttcacggtagccgccagcggtggcgatatcaccggcaaggcgctttcgacgcagctcgcgaataacggcctggtcactattatgaacacgcagggtgcgagtggcacggcaggcgatatcaatgtcaatgatacagtcagctggagcagcaacagcgtcctcgaactgatcgcgcagcgcgatatcaacttcaatgctgctgtgacagctaccggcacgactgcaggtttgaagttaacgtatgccggcgattacaaagtcaaagcgccgattactttaagtggcagcaactccacgctcaatatcaacggtaataattacaccctgatacgcagtatgtcacagctggacctgctggatggcagtaactccgtgacgaatacaggcacggcgcgccagctcaatggctactacgcgctggcgcaagacctggatgcggccggtacaacttatacaaagagcttgctgggtagcagtagcagtaccaccttcctcggcacctttgccggcatggggcataccatcagcaatctcaccatcaatgccgcaggtggcgcaggtttgtttggcttgataggtgcagggtctgtggtacgtgacctgggtatggtaggcggcagtatttatggtgcgaatggcgacgtcggcgcgatagcagggcgcaattctggcggcactatcaataatgtctatgcaaccgggatgatggtaggcgggacgactcgcatcggcggcatactgggttatctgaatggcggcacgctcagtaattcatactccaatgtgactgtcgtcggtggtaatagcagcagtggtggactggtaggtaccaatagcggcagtatctctaactcttatgccgagggtgagataagcggtggcgggctggtgggtggtttggtcggcaccaataatgccggtgcgtcgattacccaatcctatgcgagcggcaatgtcattggtaattttggcggtagccgtgccggtggactggtcggattgaattccggcgctatcagctacgcttatgcaagcggtgccgtatccggggatagcctggtaggtgggttggtagcctggaattaccctggcggatcgatcagcaatgcttatgccagcggcaatgtcacacttgttgtcaatccggccctttccggtacctatgccggtggtttgatcggttccgatagctcaacgactacaaatgcagtctgggatagcagtagctccgggcatgtaagctataccgggactatcggcagcgcaacgaacactaccgacgtcaatgcaggcaaccgttaccaacatagtgcgtatagcgcgctgggaagctggcaagaaactgcgaccggctccggtgtctggatcgcctatgacggcagcaacaatccgcaatgggtgatggtcgaaggttcgacccgtcctttcctctacagcgaatggtcgaccacggtgggcaatgcacatcagttgcaattgatggcagcgaacctctctgcaaactacacacttgcaaaaaacatagacctcagcgcggcacacggcagcaatgccagcggcatgtggaacgcaactggttttgcgtccatcggaaattcgctggcagctttcagtggaacgctggacgggaaaaattacaagatcagcaatttgcaaatcataaaacctacgtccgataatgtcggattgtttggtgtgacggcagttggcagcaaggtgcagaatgtcggcctggtgtcggcttctgttagcggccagacccaggttggtggcttggtcggatataaccggggcgagctaagcaatgtctcggtgcaaggccagatttcaggagggattagtgtcggcggcctggccggcctcaacatgggcactatcaatgccagttatggcaacgcggtagtgagttcacagtcgggctttgttggtggtctggtcggatcaaactccggaaggatcagcaattcatatgccgatggcaatgtgagcgctgatcgggatgtgggcggcctggttggcgctaacgaagcaactggcatcattgaaggtagttatgcggcaggccaggtaaacgtctatcaagcaggtggtggcctggtcggatcgaacaggggcaccatttcgaatagctatgccatggcaagtgtcagcggtgtggctattgccggcggtctggtcggggtgaacgacggcaccatttcgaatagctatgctaacggcgcggtgcttgttggcgttgcaggaggtggtttcattggtatgaacaatggcgctgtcaactcctcgttctggaatagcgacacgaatagcacaggtgtgggagcgggagtaaacaccggtgtgacgggtatcaatcatgcgcaggcacaactggcatccaccttcgtgagtgcaggttgggacatgggcacaactggcggtacctcaaccatctggcgtatctatgacggcctgagcggccccctgctgcgctccttcctgacaccggttacagtcagcgcaactgtcaatagcaagacttacgatggcagcgggacgatggcaaacggctacacgcctgtcgcaggcgtgacgctaagtggcagcctggttttcacgagttccaaaaatgccggcagctatagcagcagcgacggcaccctgcaacaaggcggcttgtcttcgacccagcagggttatgacatcagctatgccgatgccagcctgaccatcaacaaggctaacctgaccgtcaccgcgggtagcgcaagcaaaacctatgacggcaccaccacggcatccggcacgataaacgtgggcacactggccggtgccggtgacctggttaattccggcggatcgctagcctttgacgataagaatgcaggcagcggcaagaccgtcatcgccagcggcgtcaccatcaaggatgctgcaaacggcgatgttaccgacaactacaacatcagttacgtcaacaacactagcggttccatcgcgaaagcgaacgtgaccttgaatgtgacggatgtcactaaaacctacgatggcacgaacaatgcagcggccgcattggcagtgcagagcgggcagttgtacggcctggatgaagtgactgccggcagttttagtttcaacaacaaggatgccggtaacaacaaaacggtgagtgcgtccggcgtcacagtgaacgacggcaataacggcaacaactacaacgtcaccgtggtcgacagcagcaatagcacgatcaatcgcgccgcgctcacggtcacggcgaacgatgccaacaaagtgtttaacaacctggcttacgttggcggcaatggcgtgaccctgaacgggctggtgcatggtgaaaccatagccgatctgcagggtgcgctggcttatggtggtaccgcgcaaggtgcgacaggtgcggggaactacatcatttcagcaaacggcttgagcagttccaactatgcagtaacttttgtcgacggtacgcttgttatacgtccggccgtgtccgttccgaccggcgttgttcctggtgaactgctgccagcctaccaaacggccatacgtaacagcgatagtgatttgcgtcaaaacaatgacggcaaggatgaagacttgaaagtcgccgccttccagccgccaatagaaaaaaatgatgctgcagatgctgcacggccgacaccgcgcctgacgatttcttcttgcggcctgcaacttccggcagacgctggcaattcagtatgccaataa

SEQ ID NO: 657 - DNA, 1476 bp, Janthinobacterium sp.
atgggtgctgacgcagcaccagaatcggcggtattccagcataaaggaaaggcccgttttgcatccaaattcgtcagcaacccaaacatagccggctcattgaatgatgtattaaaaggaagtaatccggaagtaaaaaaagcggtatcacaaaatattctttccggatttgcagccgatgtattactcaaaaactgggacgttgttggtcttgaatttgacaacattttggtaacaaaagataagaaagccattcgcatcgataatggcagcgcattcttgtcgcgcgcgatgggagaaagaaaatccccggcaagtttgtctgaactcgatgaaatacaaggattattcaaaccgagcgttaatgcgtcttacgcaaaaatcgcggcccatgcgggatgcgcgtcaattcaagacattcctaactttccgcagcaagttaaaagcatcgtggacttgcgtaacagcggcggtacggatagttggcgaccacttgtgacggcttggactccgggcatggcgcgccgcgaccaagatgcaatcatcaacatgcttgatgtccgtactgagaaactcaaacaattagtggcatcgccttccactcagtcaactggaatatccgcgaaagacatgaaaaaagcaagcggcgacctggacgatggcataaagttaaaaactgtaattgacgaatatttgggtcccaaaccaaaaaaagaagacatgcagaaaataatgcaagtctataacggcatggtacagaaaataatacagcatcctgaagttgcaaacagtgatgttttcaaattaatatggaacaatccaaatctgttgaaagaaggtgatttcgaagaaataaatccgcatgacacaaatccgcatgacatcaatagcttattcaaggtcaccgataacctgaaagaatccagcgatggagaatttgacaactgcaacaaaggagaaatggtcagcaccctgctttataccacaggattaagcaacaaaatcaatacggcactttctaaaaatgatgttccaacattgaacaaattaagtccgatcctgaacggcgtttcatccatgattggcaagggaccaggttattccgggaagacatacagggtcaaggaacatgatggcgctgtattgcagggattttataatgcatacaaaaataatactgcaatcaatgtcccgtgcttcctgagcacgaccaaagataaaggattggcaaggcgctgggagaaaaacaaacccaatgaaagcgatttcacaggaaacacctgcttccacattacagtgcccgcgcaagtgcatgcgaatggaaacaaggcacgtgacattacaaagttaggcgaggaggaggaggaacaagaagtgttattcaatcatcataccaattttgtggtgacagatttcaaaaatattggcgataataaaatcggcaacaaatacttgatttccttgacagcggtttaa

SEQ ID NO: 658 - DNA, 1317 bp, Lysobacter sp.
atgagcaacaatccattgctggaactgatgtaccgcggcgaatccggcgcggccggctacaacgcatacaaccgcggcacctacaccgacgacgcgggcaaggagcgcatccgcggtcccaacggcccgatcgatttctcgcagatgacgctgggtcaggtcatggaccggcaggcgctgcctaacggcaacgacgatcgcgtgttcgcggtcggcaagtaccagatcattccgcagacgatgcgcggcgcggtggccgagatgggcctggaccgcaatcagccgttcaccccggccctgcaggacaaggtgttctccgaatacctgatcgtcgacaaacgccccgaaatcgccgactacatcaccggcaagcccggcgcgaccctggccgaggcgcagcacggtttgtccaaggaatgggcgagcttcggcgatccgaacaagaacggcgccagccattacggcggcgcgaaccacgcgagcatcaccctgcagcagtcggccgacgcgctcaaccagatgcgcaccgagtacaaggccaacatcgacaagggcctgtcgccggccgatgcgtggaaggcgaccaccggcgacgatccgaaccgcaccttgcccgcgtcgatcaccagcccgggttcgtcgcagcgcgcgccgcgcgacgcgatggccgacggcgtgctcaagcccgacgagcgcggcccggcggtgacctcgctgcaggaacagttgaacaaggccggtttccgcgacgcgcagggcaacgagctcaagcccgacggccactatggcaagcacaccaaggaagcggtcgaagccttccagcgcgccaacaatctggaagtcgacggcaaggccggtcccaagaccctggaagcgctgaagaacgcgcagccggccggtccgcagaccgagaagccggccgagaagcccggcgaggtgcaactgtccaatccggcgcatccggaccacgcgatgtacaagcaggccgtcgccggcctggagaagctcggcccgcaggccgggttcaaggaccacgccgcgctcgagcgcgcggccgggacgatgacctacgaggcgcgggtcagcggcatgaccaagatcgaccacgtcgtgcccaatgccagcggcaccggtctgttcgcggtgcagggcgaactgcgcgatccggccagccagcgcgtggtggtggacaaggcgcaggccagcagccagagcatcgagcagtcgacccagcagctcaagcaggacgcgccgactcagaaccagacccaggaaccggcgcaggaacgtcagcagcccaagacgatgatggcgtaa

SEQ ID NO: 659 - DNA, 372 bp, Paenibacillus sp.
atggacaacaaagcatatgtatctcaaacgtatccacgtcttacagtctacaacgaagaaaattttcggggttccaggagagtattcagaggaaacctaggcattcgtaataccgataacattctcgacggcatcgaaagtctgcgtttcttttctactagcagcaatgctacacttgtactctttactggcacgcggtttagaggcaacttccgtgtgtttagaggcaatcgcaacatcgccgacctggatgatctgattcgcgggaatgatgtggaatctattatctctaccaatcaacgtttgacgttgcagcaaatccgtaatatccgcagtagcggtagactgccatctggctatcgaatcatctaa

SEQ ID NO: 660 - DNA, 1047 bp, Paenibacillus sp.
atgttggctaccttctcggccgcgcttcaagtgaaaaagcggatggccaagcgagtcttaaaaatgtccggtgtccacggcattggcgtaggatacagggaccctgcccatcctaaaaagggagccgctgtcattgtgtatacggaccgtctagcgtcggcctctactggactcctgtcggccaccgccttaggaaagaaaacgaacgttccagtccgaattgtaaaaactggaaagatcagagccaatgccacggactacaaagtgcgcatacgcccggtcatcgccggctacagtgtcgggacgattgaaggctccggttcaaccggactcatcgttgccccaactggagcgccggcgacgcgttatctttttagcaataaccatgtcctcaatccctccaatacagacaatcgggaggctacaatacagccaggcggagccgatggggggacggttactcaggatcgtatgggaaggctgtatcgttacgtacgcttgaatcccaccggtataaacctgattgatgcggcgctttcgcttccgacccgcaacaacctgctcaatccgcgttacgctacggtaggagcgattccaggtcatgttaccgcatatcgcataggagaaagattgaagaaggttgggcgtacgaccggacgggtcaatggcacggtagagtccgtctatacggacctgcaaatcaattatggcggagagttgggcctgctgaccttcgaagatcagacggttattagaggtacgactcccgtatcactacctggggattctggctctgtatggctcagacagtcagataattatgcagctgcggtcaactatgcaggcacggcagatggtcgcttatctatagcctttccggtgcagtgggcgatgcaggtattcaacacacgggtagcccgccccaacggggcaggcagggtgctcagggtagatacaggttcttcccctcgctcctatactaggcagctcaccagtgaggaactggttcgcttaagaccaagaacgacacgcattagacgaagctaa

SEQ ID NO: 661 - DNA, 1038 bp, Paenibacillus sp.
atgagccgctttgctccgctgttcactgcacctgttgcccgtatgtctgccctgaacataggaacttgtgatgaggagggcgtcaatgtctccctacttgatcaggcagaccgtgaaatccaagccaagtttcctaaaatgcacagcttcctgctactacgccacggcaaactgatctgggaacgctattataacgggcatgaagtaagctctctgaacgatttgcgatccgcgaccaaaagcttcacttccacgctcatcggcatagctatggctcgcggtgatatgcccgggccagagacggctgtgcataagctgttgcctgagtatttacctaggcggaaggaaacactgctagagcagattacgattcgccatctgttgaccatgacatccggcttgtattggcaaacgggtaaaaagctcggagaagcttttatccaccgttttcatcgcagcaaaagctggccatcctttgctctacgcttacctgtacaggaggatcaactcggtgtattccaatatcgtagtgttgattcgcacctgttgtccgtgctgctgacccattgttgtgggattgacgcctatacgtacgctctccagtatctgttcgaacccttaggtttcgggagaagtggttgggcacaagatccagagggctacaccatgggacacatcgggctatatctgacatcgcgtgacatggctaaattcggcgattgctgccttcatcaaggcagctggaacggaacagaattgattccggccgattggctgcatcaagcgacacagcgacaggttgaaggttatccagaattcggagattacggattccaatggtggacaggacgactccacggcatcaactatgcgtgtgcgcacggacatggaggacagcaaatttatcttgtgccagaagcgaacgcagtcgcagtatttacagcagatagcaaggtgagccgctggaaaaatccgcgaacactgctggagcgctacgttttgccagccgtatcctccctcaacttggaacgttcctga

SEQ ID NO: 662 - DNA, 780 bp, Paenibacillus sp.
atgaaccatcgtacgaaccatagccctaaggataaaagaacagcacggcgtaacctttcccatgcggttccctccccccgtgttaacaaggagaaagcggcttcgacttccggcagtcataaatcgaaccagcgtggaacggcaacggtccctgcccccgtagagaaggacacatcggttcaagctatagaggaagcggcatggaagaagcataagctccccaaaacgctagaggaagcgatgcagatgaatcgagcatctgtactgctgttgtcagtgcctgagtcagatacggaatacaggttggataacgacaaaccgtctattacgacggaagatcaagcagagcaagattcgttactggattgttccataaccagtattcacattgctgaaggaagaccacgcccaaagcaacgcgtggtcttgtctgagcaagatatcgatcaagctttcgatacggcgaaagaattaaacttgaatgtcattcacgacggatcagcgaccagtgacgaggcttctgacgatcatatagcttcacctcaatatgggagcattccttttcacctccccgcacaagcggataggggtgaagtgagcgttgtatttgagaagccttttatagatacacagtatgtaatcactgccaatgcgagtatactgggagtgatggtatccgtcacacaacgtcagaggtattcagcagtacttactgtggaacgcatacactcaggtccgctatgtgaagggttggtcctttggattgcgatggggcaataa

SEQ ID NO: 663 - DNA, 1767 bp, Paenibacillus sp.
atgaagaagttattgtcgtgtttgatctcgttaggaatgcttgtgtatatattgccgaccatcattgtaagcgctaacaatgatggagttactaatctagcgcttgatccaacatcgtctgcccaatcggatattatttcagatgctgtttacaaaattacggcacagcatagcggaaaaaacttggaagttgaagggggatcaaaggatgacggagcgaatgttcaacaatggaccgataacggaaaggagcaacagaagtggagagtggtcgacgttggtgatggatattataagctgatctcgcaatctagtggtaaaacattagatgtagccggtggtaatacccatgacggagcaaacgttcaacaatggaccgacaacgggaacgctcagcagaagtggaaaatcattgacgctggtggtggatattataagctgatctcgcaatctagtggtaaagcattggatgttgtcggtggttatacccatgacggtgcaaacgttcaacaatgggccgacaacggtagcgctcagcaaaggtggagattcacgcagattgatacgacagcagatacgacaccaccaaccgccccaacaaacctccaaagctcatccaagacgagcacatctgtcactcttacatggacgacctcaaaagacaatgtaggtgtaactggctacgttatttataacggaacagatctggtagacacgagcaccacaacaagttatacagtgacggggctcactgcgaacacatcctacaatttcactgtaaaagcgaaagatgcagcaggcaatgtttcggaaccaagtaatgtcttaaaagtaacaacaagttccgactcctctcaaaatacaggattttatgttaaaggtacgacgctttatgatggaaagggaaatccctttgtcatgagaggaattaatcacgcgtacacttggtacaaaggtcaagagtcggttgcgatacctgcaattgccaaaacaggagcgaacacgattagaatcgtgctgtcagacggtcagcaatggacgaaagatgatttgtcagcgttgcaaaacctgatcactttatcagaacaaaacaaattggttgttatccttgaagtacacgatggtacgggaagtgataatgctgctgtgttgaataaaatcgcagattactggattgaaatgaagagcgcactgattggaaaagaaaatacagtcattctcaacattgcgaatgaatggtttggtacttgggatggaaacggctgggcacaggggtataaatcagttattccaaagctaagaaatgctggcatcaaaaataccattatggttgacgccgctggttggggtcaatatccgaagtcgatttttgactacggaacgcaagtgtttgatgccgatccgcttaaaaatacgatgttctccattcatatgtacgaatacgctggaggaaatgccgaaacagtaaaaagcaatattgacaatgtattaaacaaaaatctagctgtcatcattggagaattcggaatcaagcatacaaatggtgatgttgacgaggccaccattatgagttacgcccaacaaaaaggtgtaggttatctcgggtggtcttggaaaggaaatggatcgggtctagaatatttggatatgtcaaacgactggggaggatcgagttatactgaacaaggacgtgctattattgaaggtccgaatggcatcagagcaacatccaagttaagcacggtttatagtagcggtaaacagtaa

SEQ ID NO: 664 - DNA, 798 bp, Paenibacillus sp.
atgaagcgaatattcaccttgtggctatgcgttgcagttatagggatgttgacagttacggcagaacccgcatgggctactcagactgttgacggacagccttatcattttgggttcaaaaaaagtaagggaggggagctgccttccatcgcacaagaaggctttatgcaactaatcgaaagacaaggtggcatctttctgggggatacgactaaaaaagaactatttctcactttcgacaacggctatgagaatgggtatactcccaaagtgctggatgtattgaaggccaaaaaggttcccgccgccttttttgtgacagggcattttgtaaaagaccagcctgatttgatgcgacgcatggccagtgagggtcatattatcggaaaccattcatggagccatcctgatatgagcaccatttcttcgacagagatccggtctgaactagatcgggtacgaaatgcatcggcagagctaaccgggcaaaaagaaatgaaatacgtccggccacctcgcggcatttttagtgaaaaagcattggcttcctgtcgagaagccggatatacgagcgtattctggtccgtggcttacaaggactgggacacaaatatacagcaaggaacggactatgcctatcgtcaagtcattggtcagctccaccctggtgcggtcattctgctccattccgtatccaaggacaatgccgaggcacttggttctatcatcgacgaggctcgcaagcaagggtatgagtttaaaagtctagacgaccttaaggtgaaacattatcactaa

SEQ ID NO: 665 - DNA, 1494 bp, Paenibacillus sp.
atgaaaaagttaccatcagtatttttgttatccttacttcttttatttagttttaatcagaatacctacgccgcttcaataggtgaaagattaacttcccccgaagctggttggaaaagatttgatgataaagatccaaatattatatacaaaggagcatggagagacggcaacggagatatttattataatttaagtcggaaagttacaaatagatctggtgacacagccacactttcctttttcggggacaaaataaggatcattaccgattcagctacaggtcattcaaacaaattaaatattgagattgatgatgtcttggaaagcttccctctcaataaaggtgctgggagtcaatacctaacctatgaaaaaataaatctagacaatacatggcacaaagtggtgattacaactactgactcactgttttctactattgatgctattgatattagtgaaaatggatttttaggtaatcctactgtcatcgaaaaaataaaggttacatctggtgaggctagtgctgatttaaattggggacaagtggaattagcaacttcttacaaaatcaaaagatctactacttccaagggaccttatactacaatttctaataactcaacaggcttagaattcaatgatagcaacttggctaatgatacaacatattattatatagttgaagcttacgataaatcaggaaaattaatccatacgactaaagagtgcagtgttactcctccttattcttcaatggaaggtatggggggtatttctcctccagtaggaactacagctacggcgtctagcgatgataaaaatgctattaaagctctagatagagattttgattcaagatggaacgcagtaactccaattgcttcactcgagctaaaattcccaaaaccattgcatctgaattttgtacaattggcagctcaggtaacacctcaaactcaagttgattatacgatatttggactaaaagatggagaatggactcaaatcagtcctattacaactagagcaatagatgtaagcacccaaatgagggtattagatcgtataaatattactgaaggcgtctatagttcgattaaaattaccgccaatgctcggtcatcttgggcgtctatccatgaaattactctcggcattgtaagtgccatacccgttaccccagactctcctggtagtgaaacgcctactccagaccaaacaccgaaccctgaaccttcacaaccaactggtgatcgtgccattctgagtgtaactttggacactgggttggagaaagaattcgacttgagtatgaaagaagtaaactcctttattgcatggtacgaaggtaagcaatctggatcaggtgcagcatcttatgccattaataagcacaataataacaaaggaccattcagcaaccgtaaagactatgtaatcttcaacaaaatccttacgtttgaagtaagtgagtactcaactaaataa

SEQ ID NO: 666 - DNA, 309 bp, Paenibacillus sp.
atgccaaatcaaggcggaagttctttcacgaaccaaggcttcaaggcaagcacaggaaatcagttcaaagcggaatttgcacaagacaatacggtaggtgtcgtttcacaaaaggtaaagcagtctgaacaaaataaaattcaagacaacttccagacaccaaatgagaagtatgacgaagaatttgcaacagatcaaggcggtacaggtgcagtagcgcaaaaagttcaaaactccagccgtaacaaaattcaaaacaatgctcaaacaccgaacgaaaagttcgacgaaaactttaacacgaaataa

SEQ ID NO: 667 - DNA, 2172 bp, Paenibacillus sp.
gtgaagcaattgaaaacaaagcaagtgcttcgtaaaagcatgaagtatgcttttgcgctatcactcgtcgcaagcagctttctaccaggtgcaggatttacggataaaatacatgcagaatcccatgtggacaatccttaccaaggggctacaaaatacattagccctgattacgcggctagtgtcgacacatcgattgccaaaattacggatgccaatctgaaagcaaaaatgcaaacggtcaaaacattcccgacagccgtatggcttgatcgtatcgctgctattaacggcggtggaggcaagcttggcctggaagcgcatttggaccaagtattggcgcaaaagaaaggcagcacaccgattacggcggaatttattgtgtatgatctgcccggacgggattgtcacgccttggcttccaatggtgaattgccgctgacccaggcaggtctggaaacctataaaaaggattatattgacaaaatagctgctatttttgcaaatcccaaatataaggatattcgtatcgtagcgatcattgaaccagacagtttgccaaatctggtaactaatctggatgatccgaaatgtgcacaagccaagtctacaggaatctatgaagctggcgtgaagtacacaatgaataagctgaacgagattccgaatgtgtacaaatacgtagatatcggtcactctggttggttaggttgggataacaaccgttcagcaacggtatccctgtttacaaccattttcaaagatactagcaaaggtctggccagtgtagatggctttatcacgaatacagccaacacttcaccgctgacagaacctaatttacctgatccaaatctgaatatcggcggacaaccgatcaaatcgtccaagtactatgaatggaatcctaatttcgatgaatcggatttcgcagaggcattgcatagagattttgtcagcgcaggctggccgagctcactcggtatgttaattgatacaggccgtaatggatggggaggacctaaccgtccgacttccgcagtcggcaatgatattaactcctatgtaaactcaggccgtgtagacaaacgctcacaccgtggtaactggtgtaataacagtggagcaggtatgggaacgccgccacaaacggctccagctggccatatcgatgcctatgtctgggcgaaacctccgggtgattccgatggttccagctcactcattccgaacgatgagggtaaaggctttgaccgtatgtgtgatcctacctatacaaccaaggatggcacattaacagatgctttaccgaatgcacctatttcaggagcatggttccatgatcagtttgtgatgctggtacaaaatgcgtaccctgctatcgtgccttccactggtggtgtggacccagcgcctacagctccggctgtaccgtcaggcttaaaggctgttgtgggcaatgctcaagtaacgctgacttggaatgcgtctacgggtgccgatagctacacggtcaaacgtgctactagcgaagcaggtccttttacagccgttgcgcctcttgtaacggaaagagagtacacggataagggactgacgaacggaacaacttacttctatgttgtaagtgctacgaatgcgaaaggaacaagtaaggattccgcagcggtaagcgctgaacctaaaggtacaccgactgatccaacagaccctacagatcctacagatcctacagaaccagcgggagatctggttgtaatgtaccgggccggggacactgatccagcgaataacgcagtcaagcctttctttaacttgaaaaataaaggaacaacacctgtgaagctgagtgagctgaaaattcgttactatttcacgaaagatggcagccaggagctgcaatctgcagtagactatgcgcaagtaggtaatgataacgtgctgcgtacctttactgacaactatattgaaattggtttcagtcctgctgccggtacgcttgctgccggagcgcaaacaggtgatattcagatccgcatgaacaatagcgactggtccaacctggacgaatccaatgattactccttcgatccaaccaaaacctcttatgcagaatggaacaaagcaacgttgttccacaatgataagctggtgtggggaatcgagccttag

SEQ ID NO: 668 - DNA, 1035 bp, Paenibacillus sp.
atgaagcaacgaaggcgaacatggacgagaattgtgtttcttatcatctcttgcttattgcttttcgtgatctctggatttgtgtatgagtggattgcatccaagaaggataaatcacaatacccacctccgggggaattggtcgatgccgggggctatcgacttcatattcgtaaactcggtaacggttctccaacaatattgcttgaatcagggagcggggaaagtagcctctcctggagagatattcccgaaaagctgtcatcattcgccaccgttgtatcctatgatcgggcaggctatgcatggagcgaggaggcaaatacaccacgcaccggggaaaacatcgttcgggagcttcatactgctctaaagaatgcggacatccgacctccttatatccttgtaggtcattccctcggggggatgtactcaagactgtacgcgcagacgtacagagacgaagtggcaggattggttctggtggatgccaggcctgagaatgacgcccgacggacaaataagatctatgccaaggaacggcctaaggccaatccctccccgttaatatccattctcctagaaaaatcaggggcttttcgcctgttccccaattttatgctgacgggtcgggtcgaatatcaagatagaaaatcttttgtgaatattgtcgcttcttctaaatactttcggtctgttgcagaggagggtgacctagcgagcactaccgaagatgccatacggggacagcatctgggtaatctccctgtacgtgtaattgctcggggcattcaacaagatttgactcagttcggtattagtaaacgcggaaatgatcagattgaacaaagctggcaaatgggacagcgcgagatgcttaacatctctacaaacagcaaattaattgttgccaagaagagcgagcatatgatcatccatgatcaaccgaagcttgtcatccaagtcatccgtgaactcatcaccgacaccagtcactttcagtcaaccacgtctaaagcattcacagatgattag

SEQ ID NO: 669 - DNA, 1602 bp, Paenibacillus sp.
ttgacacgtaacaaacgcttaagaagattgtccaccgccatgttaacggtgcctatgctcacgatgttcgcttcaggtgcaatggcagagcaggaattgaacaaacataagcctccggtttctactggaagcggcgtattttatgaaatttatatcaattctttttatgattcgaatggagacggacacggtgatttgaaaggaatcacacaaaaacttgattacttaaacgatggcaaaccccattcgggtaaggatttgcaggtcagcggcctctggcttatgcccctaaatccatctccaagctatcataaatatgatgtaactgattactatcaggtggacccgcagtatgggagtctaaatgatttccgcaccttgatgaaagaagcggaccgaaagggcgtcaaggtgatcatggaccttgttatcaatcattcgagcagcgagcacccatggtttaaggaggccagtgccaacccacaaagcaaataccataactattacgtatgggcggatgagaacacagatctggaagaaaagggctcgtggggtcagcaggtatggcataagaatccgaacggcgaaggatatttctactgtacattctggtcgggcatgccggatctgaactttgacaatcccgaagtccgcaaagaaatgatcaaagtcggcaagtattggctgcagcagggtgcagacggattccggcttgacgcggcgatgcatatttttagaggacagacgaaggatggtgcggataagaacatcgcctggtggaatgaattccgttccgagatggagaaggtgaatccaaatgtatatctggcaggagaggtatgggacaaaccggagaccatagctccttatttcggaccactccactccctatttaattttgacctgggtggaacgattttgaactccgtgaaaaacggccgagatcagggtatcgcgacattcgccgagaaaacgctgcaactgtacaaatcgtataataaggcggcactcgatgctccgttcctgagcaaccatgaccagacccgtgtcatgagcgaactgggcggggatgtacgaaaagccaagctggccgcttccattcttttgacgcttccgggtcagcctttcctgtattacggggaagaaatcggcatgaagggagagaagcctgatgagtatcttcgtgagcctatgcgctggtacaagggagatggccctggtcaaacgacgtgggagaaacccaaatacaacacaggcgaggtatcggtggaagcgcagctgagggacgatgattccttactggaaagctatcgcacactcatccgtttgagggaagaacatgaagctttacgtagcgacagtctgcaacctatacaagcaggttctgccagcgtgaccgcgtttaaacgtacttcaggcaaagaaacaatgtatgtatatcataacctgtctggagagtcggttaccttgcagataaaagatttcgataagggtaaatggaaagtgatcttttccacctcaaaggatgtaaaggtgaagaaaggaacagttacaattccggcttacagttctctaattaccgaagaagacagaaagagctga

SEQ ID NO: 670 - DNA, 249 bp, Paenibacillus sp.
atgttgaaaaaaatgaagataatggttgttgttgcattaatgatttcaagctttggagcggcagtagcatttgctgaaaacagtcaaaacaatatgggcacaaacgacaatggtagaacacaaatgctgactactaataataatgatgacgataatgataatgataattggggatggcttggtcttttggggttagttggattggcaggtttaaaacgtcgcgagcctgaaaaccacaagaaaagataa

SEQ ID NO: 671 - DNA, 1722 bp, Paenibacillus sp.
atgttaaaacgaagacccgtttcattgctgtcgttgacgcttgccatcaccctattgttatctacgttcgcatctgttgccgctgctgccgaatctgacggacaagcaccgcaaactgcggctgcgagcagcatgcaatcgtatgtggaagccatgcagcccggatggaatttaggaaactcgctggatgctgtcggagcggatgaaacagcctggggcaatccgcgcattacccaggcgttgatccagcaaatttctgcccaagggtacaaaagcatacgcatcccggtcacctgggataaacacattggagcagcaccgaactataccgttgagtctgcctacatgaatcgtgtagaagaggttgttcgctgggcactggatgccaatctgtacgtcatgatcaatgtccatcatgattcatggacgtgggtaagcagcatggagcccaagcatgatgaagtactagctcgttataacgcattatggacacaaattgcccagcgctttaaagaacaacctaacaagctgatgttcgaaagtattaacgaaccccgtttctctgaaggggggacaacggatgaagcgaaaatgaatcagatgctccaagaactgaatgtatccttccacaaaatcgtccgcgcctccggcggtaaaaatgccactcgcccccttgttctgcctggcttggatacatcacctgctcaggctaaaatcaacgagctgtacaatacgataaccaagctgaacgatcccaatctgattgccaccgtccactattatggttattggcctttcagtgtaaatattgcgggtcatactacttttgataaagatactaaaaacgatatcatccaaacctttgataacgtctataacacctttgtagccaaggggatcccggtcattatcggtgaatacggcctactcggcttcgataaaaatacaggcgttattgaacagggtgaaaagctaaaattcttcgagttcttgacttattatatgaaggagaagaaaataacaggtatgctctgggataacggccagcacttgaaccggacaacgtacaaatggtctgaccctgaactcttcaatgtcattaagtccagcctaaaaggacgttcctccaatgcagccagtgacctcattcacttgaagaagggcactcctgctcaggatgccaaggtcattttaaacctgaacggcaatcagctgaaaacactcagtgtgggcagcaagcaactgacacagggcaccgattatgcgctgagcggagacacattaaccttaaaggccagcttgctcactagcctgaccacttccggtaaatatggggagaatgccgtcattaccgctaagtttaacaagggggcggattggaattttagagtcgtcgtgtatgatactccaaaactaagtgctatcaaaggaactacacaagcctttagcattccaacggacttccacggtagccagcttgccacgatggaagctgtttatacgaatggtggcaatgccggtccacaggattggacaccttataaggaatttggcaatacctttgcgcctgcctatgatgccaatggcatcaaactgctgcctgaactttttaatagtgtaaaagatggtgacgtcacgctgaagttccatttttggagcggcgatgtggtgacatacaagatcaccaagagcggaacccgtgtgacgggaacgacatcttaa

SEQ ID NO: 672 - DNA, 1077 bp, Paenibacillus sp.
atgagtaaaaagttatccgtcttggtactcactatggtgttgcttttgacggtagccctggtaggttgtagcaagaagttagaaccaaaggaagctgttacgaccggtacagctaatgcaatgaagttgaactcttatgaatccaaaagtcaattcacgattaaggaactgaccattacatccgcttctgttccaagtgagcaaagtgcaatggtaactagcatgctgaaaaatgctgatattacgctggatggtgtataccaaaaagaacctttccaatctgaaatgacgctcggcattcatttgaaaggtgatctttccaccagcttcacgattccaatggtaatgactaaagataaactgtacgttaaaattcctaatattccattttacccacttccacaggatgttgtaggtaaattcctgatcattgatccacaagaactggctaaacaatcaggacaagaatttaatcctgcagccatggatcaggaaaaatcgcagaaatttgcgaatgaagtgattgctgctattatgaacgagtatgatcaagctacgtacttctttgatattgatcctaaagacgctaaattgccacaaggcgttgaagctaaacaagtcgttcaattcaaaattacgaacgacaatgtgaagcaagctaccaatacatttatcactaaggcgcttcctaaagtccttgatgtgatgtctaaagatgaatatgctggcatgcttcaagtgaagaaagaagagctggctgaagcgaagaaagaactgcaatccaacaccagcgaagttagcaaaaagctggatgagttgaaaaactacttgacagtgaaacagtttgacattaacacagctttgaacaaggataacattcctgtgtatcaagacctgaatgcgaatgtagagatgaatgatccggctacaaaagacaatgtaaaattgtccgtaacaggctacacgcagtacagcaaaatcaatgctaaagcagcatttaaagtgggtattccaacaggtgatcaagtcctgactatggaacagctgcaacaaaaaatgcaaactgttgctccttaa

SEQ ID NO: 673 - DNA, 1194 bp, Paenibacillus sp.
atgaagaaaaaaggaatgaaaaaaacatttttcgtcattgcctccctcgtaatgggcttcacactgtatagctatactcccgcttcagcagatgcagccagtgtgaaaggatattatcacacccaaggaaacaagattgtagacgaatccgggaaagaggcggcatttaacggtctgaactggttcggtttggaaacccctaattacaccttgcatggactgtggagccgctcaatggacgacatgctagatcaaatgaagaaagaaggctacaatctgattcgtctgccttacagcaatcagttgttcgattccagttctcgtccagacagtattgattatcacaaaaaccctgatctggtcggattaactccgattcaaattatggacaagctgatcgaaaaagctggacaacgcggcattcagattatccttgaccgtcaccgtccaagctcaggtgggcaatccgagctgtggtacacatcccagtaccctgagtctcgctggattagcgactggaaaatgttggctgatcgttataaaagcaaccctaccgtcattggtgcggatttacacaatgagccacacggtcaagcaagctggggcacaggcaatgcctccacagactggcgtctggcggcacaacgtgcagggaatgcgattctgtccgtgaatccgaattggcttattctcgtagaaggtgtagaccacaatgtacaaggcaacaatagccaatactggtggggtggcaacctgacaggtgtagccaactatcctgtcgttctggacgtaccgaaccgtgtcgtatattctccacatgattacggccctggtgtgtcttcgcagccatggttcaacgatccggccttcccgtccaacttgccagcgatctgggatcaaacctggggctacatcagcaagcaaaacatagctccggtgctggttggtgaattcggcggtcgtaatgttgatttgtcttcttctgaagggaaatggcaaaatgcactcgtagactatattggtgccaacaacctgtactttacgtactggtccctgaatccgaatagcggcgacacaggcggtctgctgctggatgactggactacctggaatcgtccgaagcaggacatgctgagtcgaattatgaagcctgttgttttcgtagcggaacaagcgaaagcgaccgccgaatag

SEQ ID NO: 674 - DNA, 843 bp, Paenibacillus sp.
atggaagtaaaattggtagtggattttgaagcttatgagaatggccaaacgatggctaaattgcttgaggaactggcagccaagccggagagcgcggaagttacggatctgatcattggagattggggtggagcctatgagagctcaccagatgatttcatcccagtgttagtgaagcttaaagatcatttccctaagttacgcaagctgtttattggtgatatggaatatgatgagtgtgaggtttcatggattaaccagacgaatctatccccgttattagaagcgtttccagcgttggagtcctttcatatcaaaggaagccaggacctgagtctggaaccacttcgtcataacaaccttcaggaattggttattatttgtggcggcctgccagtgagcgttcttcagcaaatacacaatgcagaactgcctgaactgcgcaagctggaactgtatttgggtgtcgataactatggttttgacggtaacctgaaagatgttttgccgtttttgaatagcaatcctttccccaaacttacatacttgggactgaaagatagtgaaatacaggatgaaattgcaattgcagcagctaatgcccctgtgattggacaactggaagtgctggatctctcacaaggtacgttgtctgataaaggtgcagaagcgctgctggctagtgaaagtataaaagggctgaagcatctggatttgagctatcattatatgtctagtgaaatgatgcaacgttggaaaagctcgggtctatctgtgaacgtggaagatcaacaagaagcggatgaggaagatgattggcgttatccatcactgactgagtaa

SEQ ID NO: 675 - DNA, 378 bp, Paenibacillus sp.
gtgaaaacatcttcatttttcctgggaatcgtcttgggcgctgtagcaagctctttgatctcccgcaaccgcgacatgttgggcttatccatggacatgggtggaaaaaaaagcggcaatttagtgcagaaagcccgtactaaaatgatggacgcggcattccccggaatgggcgagataacgctcaataaagaagacacccataaggatcaagaccatcattcaccaacagataaaaccgctcataacgcccatactgccaagaacaaagaagagaatatgaagttgattaaagacttcatcagaacaagtcccgatgttaagcgtgaggtcgagcaaattttgaaagaaactcatacagccgtaccgggattgtaa

SEQ ID NO: 676 - DNA, 1161 bp, Paenibacillus sp.
ttgaatttttactccaggatcaaattgctcggtcttttgcttgtttttcttatgtgttctatcggtaacgctcagcatgtgcaagctgcgctgcctccacaagcttctttggacttgttcggctctaaaagcatgaggacaacccaagaaagtgtagttcccgatttaaaagtatacccgggggggcagacgattggggtcaaagtaaaatcttcaggagtgcttgtcgtcggtcaccatatcattcaagaaagtaatgatcgtaaggtgtcacctggtgaaacagcggggattcgcctaggggatcggattacacacatgaacggcaaaccactcaatagcctggcaagggttgctgaggcagtagacgaagcaggtaagaataaaaagccgctcgacattacactttgtcgaggagagcagacgatttccacaaagttaacaccagcatatgatcaagatgataaagcgtggcggcttgggttgtacattagagactcggctgcaggtgtaggtacattaacgttttacgcaccggaccaaggtgtatacggggcattgggccacgtaattaccgatatgaatacccaaacccctattgtcgtggggagcggagagattgtgcagtccaatgtgacgtcaattgcgaaaagccaaagtggggaaccaggagaaaaacgcgctcattttctcaaagatcatcgggtattaggaaatattgaacgaaatacgaatttcggaatttttgggaaaatgtcagatgagccgcaatatggattgtattcaactcctattccggtggctcttgcgaatgaagtaaaggaaggaccggcagaaattttgactgtactggaaggtcaacaaattcagcggtttcaggcggaaattgtacacatttctcagcaggacaaaccagcaaccaaaggacttgtgattcgcattgtagatccaaagctgttggataagaccgggggaatcgtgcaaggaatgagcggtagtccgattattcaaaatggtaagcttatcggggctgtgacacatgtatttgtgaatgatcctaaatcaggttacggttgttttatcgaatggatgctgcgcgatgcaggaatcatgcagaataacgtaagcttgaaatcatcttctaatcttaaggcgagctag

SEQ ID NO: 677 - DNA, 1053 bp, Paenibacillus sp.
atgaaaacaggtaaccgcattatggtatttgcgatgttgatcttgttatccagcttattgtatccgttgggctctgtggggttaggtgcggcttcggccgcccctgctttcgccaaaggagcagatataagctgggtagcaggaatggaagcgcaaggtatgacttggaaggataaaaagggtgttcgtcgggatatactgcaaattttgcgggatgactatcagatcaactcggtacgtattcgtgtgtgggtaaaccctgacatgaaagattatgcaagcggatacatgaatgccgaaaaggcagcagaactggcacagcgagctaaaaaattgggcatgagcgttatgctgactctacattatagtgattcctgggcagatccagggcaacagaacaaaccttatgcgtggcgcaatttcacatttacacaacttatggatgcagtctggtctcatacggtctatgttatgaacacgatgaaaagcaagggggtaacaccggactgggtgcagatcggtaatgagacgaacaatggaatgctctgggaagacggcaaagcttcggtgaacatgaaaaactatgcctggctcgtcaatacaggtaataatgctgtaaaatcggttagcagcagtactaaaacgatcgtacatttagccaacggggataacggttccgtgttgaactggaatatcggtgggctgattgataatggagctcagtttgatctcatcgggctgtctctgtatccgtctccttctgactggcagggtaaggtggaccagacgattaccaatgccaataacctcattgccaaatacggcaaaggcattgtcatcagtgaaatcggaatggaatataacgaacctgctgcttccaaggcatttatttctgcaatcaaaacaaaggttcgtaacattggaggcggcaagggtacaggggtattttattgggagccggctgcaactccaggttacaatcaaggttataacaaaggtgcttggcaggctgacggtaaaccaacctcagctttggaaggatttataaattaa

SEQ ID NO: 678 - DNA, 1866 bp, Paenibacillus sp.
atgaacaaaaggtttcggtatgctgcgttgctctgtctcggtgtcatgttgagtggagtggtcaccccgatggatagccaggtctctgctgcctctacgaggcaaatggaaaagctaaaccgtggagccgtcgctgttaaggtgcctgagggtgtactggtgagctggcgcttgctgggcacggaagcggattcggtcggctttaatttgtacagagggacaagcaaggtaaacgatgcgccgattacatcgagaaccaactttttggacaaggcaggtacgacctcatcttcgtataccgttcgtgccgtggtcaatggagcagagcaggccgcttcccctgcggtgaaggtatggaacaacaactatctggatgttccgatccagcagcccgcgggaggcacgaccccggataatgtgaactacacgtaccacgccaatgatgccagcgtaggggatctcgatggagatggcgagtatgagattgtgttaaaatgggacccttccaatgccaaggataattcgcaatccggttatacgggaaatgtatttttggatggctacgagctggatggaacacgcaaatggcggatcgacctgggacgtaacatacgggctggagcccactacacacaatttctcgtctacgattttgatggagatggtaaagcagagatcgtatgtaaaacagcagacggcacggtagatggtgcaggtgtgaagattggtgacgcttcggctgatcatcgaaacacgagtggatatattttgaaaggtcccgagtttctaactgtgttctcaggtgatacaggcaaggctcttagtacgatcgactatgtgccaccgcgcggaacggtatcgaactggggagataattatggtaaccgtgtagatcgttttctcgccggggttgcttatctggatggcgtgagacccagcattgtgatggcacgtggttattacacccgcaccgttctagtcgcatatgattggcggaacgggaatctgagccgacgctggacctttgacagcaacagctccaccaatgctggaacggctggacaggggaaccacagtttgagcgtggcggatgtggatggagatgataaggatgagatcgtgtatggctcactggttgtagacgataacggagcgaagctggctaacacggggatgggacatggagatgcacttcatgttggcgatctggaccccgaccgttcaggttatgaagtgttcaaggtgaacgaggacaaaaatgccacctacggagctgccatgtacgacccgcgtaatggaaatattttatggggcgtaaatacaggcaaggatactggaagaggcatgtcggcagacattgacccgcggaccaaagggaacgagcagtgggcaccgggtattggtttgcgttcagccaaggggcagctcattaccaacacgctaccgtcttccattaattttggtatctggtgggatggggatctcctccgtgaactgctggatcatacctcatcaagcgctggaaaaatagacaagtggaactatatgaactcgactacttccaacttgcttacggcaacaggaacgagttccaataacggaaccaaaggaacgccgtccttgcaggccgatctgttcggtgactggcgtgaggaagtcatttggcgcaaaagtgataattcggcgctgcgtatctacacaacaccatacgagtcagaacatcgattctatacgcttatgcatgatccagtgtatcgcctgagtgttgcctggcagaacgtagcttataatcagccgccgcacaccgggttttatctgggagaagggatgtccaagcctcagcagccgaatatatatactccttga

SEQ ID NO: 679 - DNA, 462 bp, Paenibacillus sp.
atgaccattgcttttatcgtagtagctgcggttgcctttatttttttgctggtatttaatacaaagatgacgcgcaaatcctctcccaaaactcgccccgcggaagaggagtcacggcaaagaagcaaacgtccttatcctgtacaggtggaacccgaggtgcgtgaaaggatagattctacgcgagagatgccgcataaggatatcgacgtcgaagaacatcatgcggaggaacaacacaaggtgcctgatatccagacggataagaaggtagaaaaggatcgcgagaatatcaaagatgcttacggagatcaggattatcgtgcggctttacgtggttttgccaggaaggacgaagaaaaggatagacgttcccaaatatccaatggagagaaggagactcacaaaagtgaggacgaacagtatcgtgaagcactgcgctccatgaaccaaaaaaaatga

SEQ ID NO: 680 - DNA, 960 bp, Paenibacillus sp.
atggcaaatgcagctgtgtatcatgttatcatttctaaagggaagctgggcaacaaatcgttagcgattaccgcgtcagacaaggatgattccgtatttatttcatcgcatgagtatggcaacgaatatcaattgtgggaaaaacgatcggttcgcagcggtgatagcagcgcttatgcgctagtgaacaagaagacgggcaagtgcatcggcagaaggtcagtagcgaacggctcggagctttatctggaagctgcctcccaagcagatacaagcgacattatggtgtggaaagatgatagcgtggcgggtacctataacgcgatcaaaaactatgccgattgggagcaaaaaatcaatgtcccgcacagtagatttcatgagggccagaagcttgttacctgggagtggtcgaatgcggcggacaacgagctctggttatttttggccgagaagaaaaacatcaagatcaagcatatggacttccagctggagggtgtctcccctcaggtggatcaaccgcttgtaaccgataaacaaatcgtcaaaaatacgacggggatcgatcagacccaagttttgacgctttcttattccaaaggagtgtcgtatagcttcaatacggaacgctcgttgaagatttccgaaacgctcgagttcaaagcaggcctgccattactgggagagaccaaggtgaaaatcggcgtagaaggcacgcgcaaatattcggagacgaatgcgacggatgacaccgaagagcttacgctggaggttcccgttaccgtgccttccggcaaaacgatcgaagtatccgcaatcgtgatgcaagggaagctcgatgtgccttataccgcggtattcgagatttcatacccggatgttacggtggaagaaacggtttcaggcattttctccagcgtgaactcgtattcggtgtatacggagtttaagctgctgtaa

SEQ ID NO: 681 - DNA, 1548 bp, Paenibacillus sp.
ttgaaaaacttagctaatttacctgtcatgtctcaagcaaatgctcttgctcaaggtatgaatatctacggtacaagagatacatcatcatttatcaagttacttgtaactccaagcaaagcaccgaataaaacagttacttttcttggaaaggattatcagattccaagctatgttaacctactagagaatacggagacatattatgatgcaggagcctacaactcaagagaagaagttcaaaatagtcttggagctcatgtgggaattagcgggaaatacggagcgtttagtggcgagatggaggctgattattctcaggcatatcacaagaattcgcaatttgactatgcctaccgtaatttttatacccaagtcgccacattacaatatcaatatgacccccaatatctttccagtgagtttttaagtcgattgagtgacctcccctacgagtccgacacagacaatctcgatatattttcagagttctttaatgacttcggcgtattctttactagtaaggttgttcttggaggaaccttgcaattttacatatccgttgacaagcagagccagacaagcacaaacgaaatctctgcgatggtgaaagcacagtacgaagcattgtttagtagtggaagcctagatgcaaatatcaaaatcagtgatgcttggaaacgttactcaactaatagtaactcgacattgaaggctacaggaggcgaccccgagaaaatctctcgcatagttatgattgacaccttcgaaccatccaaggaaactgtagaagccttccatgaatgggtatcgagtattgcaagcgatcctgcaataatagattttagcttagaaggaatctggcaaatttgtggggataaacggcaagccgttcaatcagcatgggaaaaatattccgatatcatgcatccaagaatgaccattcgtacgagtagccaggtcatcgagtaccccattgaaatagaaccagttacaccgagtatctatattggaagccaatccttcaaaccaaacgatacaccggcttcaccggcgggctttcaagtcctcattctctcgggatctaatatctccgaggtgattttcaacaaatactatgctattccaccagttcaatactggtatcttccttctctagaggtgtgggatgattttgtaaaagatgtacaagggaagcatgattcttcgaataacatattgattcttgtcactttcggcttagacctaggaatgactccaagttccgatgctattgacgttctaagaagcgctggagcaggctcaggtttagtaaagtgggtaaaaggctgctcacctccaagccaagcaccgacgcctagttgggtttcttatcctgcaatgtactcgctaacaggcatcttcggtaatggaccagatactggagtcgagtacctcaaatatagtggttgggacggagtatattcagacttatccttagacttatccatttatttttatcgccagacattcagcggaaactacacatttggattaggagaactatag

SEQ ID NO: 682 - DNA, 648 bp, Pantoea sp.
atgaaaaacctgttgctgtgcccggtgcttgctgcactggtgctgagcgggtgttctgtgggccacactgagtacagtcgtacggcgatgcagcacgtagatatgagcgtgactggcattccgacgatcctcggtctcggcacactgggcaccagcattcctctgacgcctgaatatagcctgacggctgcgcacgtcgccaaaactgccgtgcagcgcgtcaagtcttatcacccttattgcgaccttgcgattatttatcacaagaatgacgccagcacgctgactaagttccgcaacagcgacatcggcgatccggttaaaatgtatggctacagctttatttcggcgatgccggttgaatcgacgggagttaatttagcccgcacggcaattcggaataactggaataaaagtccctgtatagccatggcctccaatgcaggtgttgttcaggggatgtcgggcggcggcgtttataaccgtgatgatacgctgggcggcgtgattgttggctattctgactcaattaaaaatgggcgtaataacaaagtgatcctgaaagatgtgtcactttatattccttacggccagttcaaaagctggttagagtcgaatctggcccagacaccgacacgcggtgcctga

SEQ ID NO: 683 - DNA, 267 bp, Pantoea sp.
atgaaaatgaaattagctatcgctgcactgagtctggcatccctgttctcagtgggtgctaacgccgccagcctggtgtccagcgaacaggctcagggtctgcagccaatgaatcagaccatcagcattggtggacgaaatggcgaccagacgcatatccgtcaggtgctgtcagagaaagcggatgcccagggcgcgagccactatcgcatcatcgaaaacaaccaggataacacctggcacgttaccgctgagctttataaataa

SEQ ID NO: 684 - DNA, 264 bp, Pantoea sp.
atgaatatcaaaacaaccatcgctacagtcagtctgctttccgtcatggcgttcggcgcatcagccgcacagctggtcaccggcgatcagacgcagaacctgcagcctgcgggcaccgtgaccatcagtggaaccgcgggatcgccaatggattaccgcgctgagctttctcagaaagcggatgaacagggtgccagcgcctataaagttattgaggcgcgcaccggcgataactatcacatcaccgcacagctttataagtaa

SEQ ID NO: 685 - DNA, 756 bp, Pantoea sp.
atgaaaatcaaaaaaatggtgttagcgcttggactgacgacgctgctgagtggctgtcagggtttagacaataatgcgctgatgcagtcgggcgcgcaggcgtatcaggcttataccctcagcgacgatcaggtaaagcagctgagcgataaatcctgtgagcagatggacaaagataatcagattgcgcctgctaacagtgattatcagcagcgtctgaacaagatcgcggcggcgctgggcgataacatcaacggcgtaccggctaactacaaggtttatcagaccaaagatgtcaacgcctgggcgatggcaaacggctgtattcgtgtttacagcggcctgatggatatgatgactgacaatgaagtggaaggcgtactgggccatgagatgggtcacgtcgcgttaggtcatacgcgcaaggcgatgcagctggcgtatgccacaaccgcggcccgcaccgcagccgcctcggttggcggcgtgattggttcactgtcgcagtcgcagctgggtgaaatgggtgaaaaactggtgaatgcgcagttctcccagacgcaggagtcacaggcggatgactactcttacgatctgatgaagaagcgcaatatcgatccaatgggcctggccaccagctttgaaaagctggcgaagatggaacagggacgtcagagttcgatgtttgactcgcatcccgcctctgaagcacgcgcagcgcatattcgtgagcgaattgctgccgacagcaagtaa

SEQ ID NO: 686 - DNA, 207 bp, Pantoea sp.
atgaaaacgttcgtcatcgccactttactgggtctcttcctgtctccacccgctcttgccagcaatgctgactgtgcgcagcagataagaagtcacagcagcgaagcggcatcgggttatatctacgttaatcggctggatgcgccacaaaagagcccggtcaacgcgcctgccagagcagcagaaaaatcgtctgcgcactggtaa

SEQ ID NO: 687 - DNA, 864 bp, Pantoea sp.
atgcgtatatctctgttcagtggcactcccacggtcattggtcatgacaaccgcggcctgaccgtacgcgatatcctgtataatcggcatcccggcttaccggaagcaactgacgagcgcatcacccgtcataggtatgacgcccgtggcttcctgacgcagagtgccgatccgcgtctgcatgaaagagggctggcaaacttcagttccgtgacggacgcggctggccgcgtcctgcgcgccagaggcgcagacaacggaactattgtgatgcttaacgacgccgcaggccgggcttttatgactgtcagtaatatccgcactactgaggacgacacggaagacctgagtcaggcggtgacccgcaactggcagtatgagggcgcaatactgccgggccgtccggttagcatgatggagcaggtaaccggcaaaaccgcccgaatcacggcacgcttcgtgtatgccggcaatgcaggtgaggagaaagcccttaacctggcgggatcctgcgtcagccattacgacacggccggtctggtgcagaccgacagcattgctctcaccggcgtaccgctctccgttatctgccgtctgccgaaggacgcggacaatcctgatgttatgactgactggcagggtgatgatgcctctctctggaacgacctgctggatagtgaatctcaagccactctgaccaccgccgacgccaccggggcggtgctgaccaccaccgatgcacggggcaacctgcagcgcgtggcgtacgacgtggcgggcctgctgtcgggcagctggctgaccgtgaagggcggcagggagcaggttatcgtcgcctccctgacgtactcggccgccgggcag

SEQ ID NO: 688 - DNA, 360 bp, Pantoea sp.
atgaactatttccgcatcgactctctggctggcgtgctgctgctctgcggctgccaggcacccacgcctgatcaggctcgtcagcagcagcctgtttttcagggtcaaagcacccgcaccgtccctcagctcagcgactgtatttatcgcggctggtccactaccagcgtcattgccagagataacaccactcacacccagcctgacggcagcgagattagcgttttcacctgggaagattcgatttttgcggatgtgtcgccccgccgaaaagggtctgatgtgaaatatttcacgactttccggatggcgcctcaggtgatggcggacagacaggcgattgttgagcgctgcctgtaa

SEQ ID NO: 689 - DNA, 399 bp, Pantoea sp.
atgaagttagtacatggattggctttagcggttttctctctttgcatcagcgcttcagcgctcgctgaagatacctgtgcaaaacagccttcagacggtgcgctatttcagtgtactgttcagcagaagaagctggcggaagatgagctgaacaaagagtaccagacggctaaaaaacgcattgtacagatgtacggcacgcagaaaaaactggctgatgactatgtcgccacgctggtggatactcagcgcagctggctcaggtatcgtgacggtcagtgcaagctggaagcctttgccgctgaagaaggcagcaatgcgaatgcggttgccaccaacctctgtgttatccgcatcgacaaagaacgcactgctattctgaagcaactgccttactga

SEQ ID NO: 690 - DNA, 306 bp, Pantoea sp.
atgtctaaagacacatcatcggaacatttgcgtgctgaactgaaaaaccttgccgataccctggaagaggtgctgagcagcagcactgaaaaatccaaaggcgagctggataaacttcgcaataaagcgcgtgtggcgctggatagctcacgtgaacgtctgggcgaatcaagcgagcgcattgctgcgaccacccgcgaagcggcgcaaaaagccgaaggctacgtgcgtgaaaatccatggcatggtgtgggtatcggtgcagcgattggcgtcgcactgggcatgctcatttcgcgtcgataa

SEQ ID NO: 691 - DNA, 570 bp, Pantoea sp.
atgaaactcaagctttttctgtttgccgctgcaggattaactgtcgctattccgtcattaacccaggcggcgacgacctcgggaaccatcaatgccacgttaaccctgaccaccggttgtctggtgaacggccagtcggctacggcgggtgttaacttcggtactctgaactttggtagcagcgcagccactttcgataccctgaacgccacactggtcggtgcggccggtaacggtatttttgtgcgctgcacaaccggtcaggactacaacgtggtggtcaccagcagcaatgctgcaccggcgaccatctatggcaccgcctctgcatcgccgcgttatctggtgctgggatcggataatgcacagggcatcgcctataccctctatagtgacgcctcctttaccacggcgatcgccaacaatacgcctatcgccgccagcggtaccaccgatccgacgctggggaccaactacgccatctatggccgggtagtcggcggcggctttaaccccctgatccctgccggaacctataccgacacgattaacgttgccgtgaactattaa

SEQ ID NO: 692 - DNA, 354 bp, Pantoea sp.
atgtgggatgtggatacaaccaaaagatttgatgagtggtttaaggctcagactgaggaactgaaggaggatatgctcgccgcgatagttatcctgtctgagtatgggccgcatttagcgaggccgtttgctgataccgtagacggctctgattttccgaatatgaaagaattaagagtgcagcatcaaggcaaaccgatacgagccttctttgcttttgatccttctcgccgcggcattgtgttgtgtgcaggcgataaaaccggggttaaggaaaagaaattctataaagacatgatcaaattggcagatgctgaattccgcaaatatttgaatggaggggataatggctaa

SEQ ID NO: 693 - DNA, 2553 bp, Pantoea sp.
atgcagaggtgtagtggcagcacgctgggcgcgggcggtaacctggccatcaccgccaccggcgcacagccgggcagcgcgggcgacatcctcgtgcagggcagccagcttcaggcgggcggcgacctcaggctgacggcgaaaaacgacatcagcctgctttcagcgcagaacagcgagcgcaccgacagcacgaacagcagcaagggtggcagcctgggtatcggcctgaccgccgggtcgggcggctacggcatcagcgtttcagccagcgtcaacgcgggcaaaggccgcgagaacggcaacgggctgacccataccgagactacgctcacggcgggcaacgggctgagcctgaacgccgggcgcgacaccatgctgaccggcgcacaggtgcgcggcgacagcgtgaaggtcgataccggccgcaacctgacgctgacctcagagcaggacagcgaccgctacgacagcaagcagcagaacgccagcgcgggcggcagcttcaccttcggttccatgaccggctccgcaagcgtcaacctcagccaggacaggatgcacagcaactggcagagcgtggccgagcagaccggcatctttgccgggaagggcggctttgacgtgacggcgggtgagcacacccaactgaacggcgcggtcatcagttccaccgccaccgccgataagaaccgtctcgacaccggcacgctgggcttcagcaacatagagaaccacgcggactataaaaccgagcaccagagcgtgggcatgagccccgccggcagcaccggcagccagttcgaaggcaacatggcgaacggcctgctggcggggctgaacggcagcggcagcgcctcgtcggtgacgaaggcggcggtgagcgacggcaccctcattatccgggataaggcgaagcagacgcaggacgtgtcggcgctgagccgcgacgcggcgggtgcgaatccggggctggataaaatcttcgataaggagaaagagcagcggcggatggagacggcgcagctgctggcggaaatcggcagtcaggcaggcgacattgcgcggacctatggtcagattgaggcgacgaaagcggccactgagaagatgaagacggtgacgccggaccagaagaaggatgccgaagcgcagtggcgcaaagcgaacccgggtcaggagccgaccgcggccgacatcaccggacaggtctatcagacgctgtacaaccgggagatgctggccggcggaatgggaaccggcggttcggtgcagcagggcatcagcgcggcgacggcggcgatacagggactggcgggcggcaacattgcccaggcgatgagcggggcggccgcaccttatctggcggagcagatacacaagctgacgaccacgaaaggcccggacggcaaagaggtggtgaacgttcaggcaaacctgattgcgcacgcggtagtgggcgcggtgacgtcatacgcgtcgggtaatcctgcacttgcgggtgcttctggcgcggcgatgggcgaatatattgcgcagcagatgtatccgggagttaagcgcgaagacctgagtgaggagcagcggcagaccatcagtgcactggggacgctggcggcgggacttgcgggcggcgtggccggagacagcacgggcggtgcggtggcaggtgcgcaggcgggtaaaaatgcggttgagaataatgcgctgcatgcaccagatgaaaagaagcgtcaggatgcgaagtggtcgttaccgtatctggaaggagaaaagaaacagcaggcagaacagttaatcagtgacctggatgcgaaagataaggcattcgatgtagcgttagactcagcctgtaaaggactgtcttcagcagcctgccagggtatgaggcaggaactggcggcaatgggtaaaagttatagcgaacagcttgatggtcagtacatcggcaatatgggaagtgtctataaggaaggtaaaggccaggtcgatgcactgatatggcagtatgctacggcggatgcgaaagcagagcgtgatgctaacgtcaaccgcattgctgaaaactggggtgtgagtaaagaaaccgcggacggcctttataccacaatggctggtgttcatactgctgcagcgattggtggtgctctgtggggattgaaaggtccaggcaccgtaactgtttatcgtgtagagggaacaccaaatacacgtgttgtgataggagacaacggacaggttagtattactggcaatacaacgctatatttgaattttggtgacaaagccagggcactagagtttttcgaaaaacgtggctctcagaatatggatggtgcagcgataaaaacgtttgaggtaccccactctgttctggatgatttaagaaacactgttgtgaaagaaagcgtggctcgattgccagaaaataaagggaagcctgttattgcagatccaactaaagctaaggatcaatatggtataaggccagaaaagctggaagaattaaaagacaagattatccaggggacaggaagaaatgcaagtaagtga

SEQ ID NO: 694 - DNA, 1242 bp, Pedobacter sp.
atggtaatgatcattaaacttaaaaccatgaataagataaatttaacatcaatacttttaagtgctttgatattcctgtctggctgcaataaggatgttttagtggatctggatattccccaagctggtaattatgctcaattatacatgccacaagccacaagcaatccgattggtatgggcattagcataaccgatcaggattatcaggtaccctacgcggctcatctcggtggctccttagcagcacaaacagatatttccgtaacttttaaggtttcaccggaactggttacccaatacaatcagaaaaataatacgacatatcaactactgcctgaaggaagttatgccctgcagactgagaatgcaatgattcccaaaggagcacaaggaacaggtattctgaaattggtgattaaaactaaaggattcctgcaggcatttgagtcttatctgcttccagtaagtgtttctgcaccttcaggggtaaccttaaataaagaactaagtactacttactttgtgatcacaggttcttatgccccgggcgaagtcccacgggagaaagtgctttctatgggagctgatgcaggtgattttttgatagattttaatggcgattttatacgcaaggctccgctaacgggggatcttatcttatataaggctgatgccgctaccgggcaatttactgccccacctaaaacaatcggtttcggctggaatgtaatggataagattttatcgtatggcggtaaccgtttgattgcaaggtttggcagtggagcgggtgatatcaaccagtacttccttagtcaggacggggcatttggcgcccagcgaggcgttggccagggatggggagggctttctgcaatagtgccgtttaaaggattgttgttgggtattgccgcgaatggtgatatgactaaattccctttaaacggagatggggactttgattatggcaacatcaaacaaattggtactggctgggcaggtttagcccaaatcttttcttatcaaaactcgctgattaccattgaaaacagtggagatatgtggcagtatccgttaacagacgacggtgttttcggtgccagaaaaaaaattggaacaggttgggatatgtacactaaagtaattacagcaggcaccgatctcctggctttggatgctaatggagatttgtggcgatataaatttaatccggatggtctgtggccgttaaaaaaatag

SEQ ID NO: 695 - DNA, 600 bp, Pseudogulbenkiania sp.
atgctctacttgcgcttgatgataagaggcttcctgctggcggttctgctggtggtgctgggcttcgcctatgtcgcgtggagcattgtcgactacggcagcggcgacgacgtgccggctgccgacgccgcgctggtgctgggcgccgccgcctggggcagcaagccttcgccggtgtttcgcgagcgcatcaaccacgcggtcaagctgtaccagagcggcaaggtgcgctggatcgtgttcaccggcggcacgcctgagccgggctatccagccgaggccgacgtcgggcgcgagttcgcagcccgtcagggtgtgccgatgacggcgatgctggtggaaaaccagtcgcgcaccacttggcagaacctgtccaatgctcgggatctgggcaatcagttcggcatccgctcctatcttttggtcagcgatccgctgcacatgcggcgcgcggtgctgatggccggcgatctgggcctgcgcgcctatccggcgcccactttgtccagccgcttccgcaccttggccagctggtcgcgcttcctcgcgcgcgagacctggctttatgtcggctaccgggtattccggcagctgtcatga

SEQ ID NO: 696 - DNA, 738 bp, Pseudomonas sp.
atgagcaaatcaatcgctgtcagccaacagagccagcagcttcacaatgatgtgcaagaagccgtcaagtcgatcatgggtgcaacgcagctgaaggcgtcggattacggccgggtactgaggtcggccctggcggcttcgcaaaaaaccgtcaccatcgaaatcgccgccggcgacctgacgctgctgaaaaagtccaactacaagctgtgctttgccaagaaggtgggtgacgccgactacaacgtggtctggcaatcctacgacgcctacctgagcaacaacgagttcagctggacgcctcaatatcagctgtttgcgtccaacctgttcaaggcaaatgtgcaggtcaaagtctcgaccaacatcgtcaatatcggcctggggcaaacatcgacgctcgatgagcacggtctgctgagttcggcggttaccggagggccgaacatttccatgacctttgtgaacgactatgcccccatccatccgggtatcaaccagctatctaccggcattgatggcaatcaggtcagcacccctatctacgttgcggtggatcaggtggtcaccggtgaaaccgtgctgacaccggtggaaaccatcctcgtgtggttcgaacagaacgtacagaccagcaccatgttcagtacctcacgctccaaggcgatcgaaatcgacttgacgttcgataacaccgcaggtcgcctttacgaaggcggtcaatggaaaaccgtgtaa

SEQ ID NO: 697 - DNA, 504 bp, Pseudomonas sp.
atgcgctggttgcttgccctgttctgtttgtcgtttgtcacggtgtcccaggcttctgccgtggaaaccctggacggcaaggtcatcgagaagatcctgattctcaagtcttcccatcaattgcaattgatcaatgacggcaggccgctcaagacctatcgcatttccctgggcaagcgtcccaagggacccaagctgatggaaggcgacaagcgcaccccggaaggcttctactgggtcgactggcgcaagatcagcgaccgcttcaacctggcgatgcacatttcctacccgaacatcagcgactctgcccgcgcccgccgtgaaggcgtcgagcccggcggcatgatcatgatccacggcaccccggacagcgaagacacccccgaagacctgttccacaccctggactggaccgacggctgcatcgccatgcgcaacatggacatgcgcgaagtctggaacctggtgccggacggcacgatgatcgaaatccgtccgtaa

SEQ ID NO: 698 - DNA, 522 bp, Pseudomonas sp.
atggaaaccccttacgtgaaatccctccttgcagtgctgtcccttatcgctctgccggtcatggccgccgagccgaccctctatggtcgttacgaatacatcgccttgccggaagtcggcgggcaggtcctcaaggcgaaaatggacaccggcgccctgaccgcgtcgctgtcggccaaggacatcgaaacctttacccgcgatggcgaagaatgggtgcgcttccgcttggccaccaagaacgcgagcaacaaggtctacgagcacaagatcgctcgcatcagcaagatcaagacccgctccgaagaggacgaggaggacagcgaagtgattgcacccaccaaacgtccggtggtcgatctggagctgtgcctgggtaacgtcaagcgcacggtcgaggtcaatttgacggatcgcagcagctttaactatccattgctgattggggccaaggcgttgcgtgagtttggcgcggcggtgaatccggctcggcggtttacggcggataagcccgattgctga

SEQ ID NO: 699 - DNA, 1425 bp, Pseudomonas sp.
atgtcgatacctcgcttgaagtcctacttttccattattgccaccgtgctggtgctcggtcaggcggtcaccgcccaagcggtcgaattgcctgactttacgcaactggtcgaacaggcctcgcctgcggtcgtgaacatcagtaccacgcaaaagctgccggatcgcaaagtcaaccagcaaatgcccgatctcgaaggcttgccgccgatgttgcgtgagttcttcgaacgaggcatgccgccacaatcgcgctcacctcgtgatcgtcagcgcgaggcaacttccctgggctcaggtttcatcatctcttccgatggttatatcctgaccaacaaccacgtgatcgccgatgctgacgaaatcctcgtccgcctggccgatcgcagcgaaatgaaagccaagctggtcggcaccgatccacgttccgacgtggcgctgctgaaaatcgaaggcaaggatctaccggtgctcaagctcggtaaatcccaggacctgaaggctggccaatgggtcgtcgcgatcggttcgccattcggctttgaccacaccgtgacccaaggcatcgtcagcgccgtcggtcgcagcctgccgaatgaaaattatgtgccgttcatccagaccgacgtgccgatcaacccgggtaactcgggcggcccgctgttcaacctcaacggtgaggtggtcgggatcaactcgcagatctatacccgctccggtggcttcatgggcgtgtcgtttgcaatcccgatcgacgtggccatggatgtttccaatcagctgaaatccggtggcaaggtcagccgtggctggctgggcgtcgtgattcaggaagtgagcaaggacctggccgagtcgttcggtctggagaaaccggccggtgcgctggtggctcaaatccaggacgatggtccggctgccaagggtggtctgcaagtgggggacgtgatcctgagcatgaacggtcagccgatcgtcatgtcggccgacctgccgcaccttgttggcgcgttgaaggctggtgcaaaagccgatctggaagtgattcgagacggcaagcgcaagaatgtcgagttgaccgtcggtgcgattccggaagaaggcaaggagatgggcgccgagcctaaatccagcgtcgagcgcagcagcaatcgcctgggtgtctccgtggtcgagttgactgacgagcagaagaaaacctacgaccttaaaggtggtgtggtcatcaaggaagtgcaggacggccctgccgcgctgatcggcttgcagccgggtgatgtgatcacccacctgaataaccaggccatcggctccaccaaggagttcgcggacatcgccaaggcgttgccaaagaaccgctcggtgtcgatgcgggtactgcgtcaggggcgtgcgagcttcatcaccttcaagctggctgaataa

SEQ ID NO: 700 - DNA, 1110 bp, Pseudomonas sp.
atggacgcaaacgataacgcgtttattctggataaacgcggtgtcctgaaggagcggtcttttcgagattcaagcagggcgggctccatctggatgccgcccttttttgtgcaagagattatgcaaagcagcagcaacctatttcctgtcgccctgatcagcgccgaacggcgcggtgatctgagcgaagatgtgtatcgtttgaaacccggtaacagccccgacttcaccgtcgagctggctgtgacacgccttggcatggccgatgagtcgtcctcccgtggcgtgccggtgatcttgctgcacggcagtttttccaatcgccgtttctggttttcccccaagggcctggggttgggcgcttacctggcccgccaggggttcgacgtctggattccggaaatgcgcggtcacggcctgtcccagcgtaaccacgactaccgcaagaaccgtgttgccgactacgcacgctatgacctgccggccatcggtgcatttgtccgcgagcagagcgggcaggtgccgcactggatcggtcactcgctgggcggtactacactggccgcagcgctgggtggcgagtacatcggtgagccggtcgtggcctcggcggcgtttttcggcactcaggtgagccgcacctactggccattgaagattccaccggtggagtggagcgggcgcttcattctcaagcgttttgcccagttgtcgggctcaaggctcaagcgcggcccggaggacgagcccatcggcctggccctggaaagcatgcgctggttcggcttgttcgggcgcttcggtgatgccgacaaggactggtgggcaggcctggccgaggtcaagttgccggtgcttgccgtcagcgctgccggcgatcatcaggatcctgcgtgggcttgtcgaaaactgttcgagcaattcggttccgagcacaagcaattcatcaacctggggcgcgagcagggcttcggcgacaatttcggtcacgtggaaatgctcgtcagcaaggcagcccaggctgaagtctggcctttggtgacgcgctggctggccgatcagcagacacctttgccgggcgcgcaacaggatttggtcgtggcagtctga

SEQ ID NO: 701 - DNA, 1026 bp, Pseudomonas sp.
atgaggaaatcactactcgccttgctgttcgtgggctgggtcggtttcggccaggcgcaggtgccgctccgggagggttacccacagcgctacaccgtggtggcgggcgataccttgtggagcatcgccaaccgctttctgcgcgatccctggcaatggccggcgctctggcaggccaattccagcctcgccgaccccgatctgatctaccccggcgactccctggcactggtacaggtcaatggcgaaccacgcctgaccctggagcgcggcgcttcccggggtacggtcaagctgtcgccccaggtgcgccgcacgccgctggccgaggcgatcccgaccattccactgcaggccatcgacagctttctgctgagcaaccgcatcctcgaccgggccgagaccttcgacagtgcgccctacatagtcgccggcgatgccgaacgggtgctcagcggcaccggcgaccggatcttcgcgcgcggccgcttcgacccggaacagtcggcctacggcatcttccgccagggcaagacctacaccgacccgcagagcggcgaactgctgggaatcaatgccgacgagatcggcggcggcgaggtggtcgcggtcgagggcgatatcgccaccctgcaattgcagcgcaccacccaggaagtgcgtctgggcgaccgtttgttcagcggcgagccgcgggtcatcaactcgacctttgtccccagcccgccgagccgggcggtcgagggcctgattatcgacgtgccacggggcgtcacccagatcggcgcgctggacgtggtgacgctgaacaaggggcggcgcgatggcctggctgaaggcaatgtgctggcggtgctgaaaaccggtgaaaccgtgcgcgatcgggtggccggcggccaggtgaagatgccggatgagggggccggtctgctgatggttttccgcacctacgacaagctcagctacggcctggtgctcaacgcttcccgctccctggcgatcatggacaaggtgcgtaacccgtaa

SEQ ID NO: 702 - DNA, 243 bp, Pseudomonas sp.
atgaatagcgcccttcttctatcgaatgccattgccatcgccgtactggtggtcttccactttcagcctgatggcagcgccgatcagagtaaccaatacagggcccactacgtgcaacaccaggccccgcaatgggctgtgatgagcagcacatcggagaatcctggcatggcgcaggtcgccgatgccccagaagccgttgttctacctgccaacccaagacccgaaagctgggtattttga

SEQ ID NO: 703 - DNA, 1080 bp, Pseudomonas sp.
atggcgaatgaggtctttgccaacaatatggagatttcctgcaaggcggccgacggcaaatccgtcgctgcgttcccggatgtctgtttcactccaccccaggctccgccgacaccgacaggggtgcccatcccctaccccaataccggcatggccaaggacaccaccaggggcagtcggacggtgaagatcacccgtaaagaggtgatgctcaagaacaagagttacttcaagaccagctatggcgacgaagccggttgcgcgccgaaaaagggcgtcatcaccagcaagatcaaaggcaaggtctacttcacttcctggtcgatggatgtgaagttcgaaggcgaaaacgtagtcagaaacctggatatgaccactcacaatcatgcgtcgcagccgggtaatagcccaacctggccctatattgacacggccgcggcggccaacagttcccatccctgccacaacgtagtgaaggggctgaaggataacaattgccagcgtcatgttgatgcaaacacctactccacagacgcgatcaatcgggccggagcatcagaggccttgtgtggcgatccaaaatgcaaaaaggcgatggagtgcgtgcttacaccctatgaaccatcgaactgctgcgacgggaaaacaccacaccatatagtgcctaaatcacaattcaaggagagaggaaaaggtggcaaggcgctcctgctcgatgcgcaaggagccaataagtacgaccccaacaaggcgccgtgcatttgcgaagatggccatagccattccactggaacgcacggcgacattcatgaagagacaaacctcctcacggtgaaccacccgacagttaagccaaaagtcaccggcaagaccattgcaccggatgcacgatggagtgttgccgaggccgaagcagttggagcggaagccgcccagaaaggggggagcaaatgcgataaggagtgcacgaaaagccaagtaagagaaagccatcaaaagatgaatatcggcccgaccgaccaaatccgtccgtcaacggccggacgcgttccagaaccttcaaatccgacaactttctga

SEQ ID NO: 704 - DNA, 1245 bp, Pseudomonas sp.
atgacgcagacttcccctcgctcattgctggccgcccgtatcggcctgaccctcgcccttggcctgctggccacccacgctagcgccgaaccccacccccaagtacagaacgatgcgcagcaataccagggcgatgccctgaaactgctggagcgcctggtgaacatcgactcgggctccggctacgaggcggggctgaaccaggtgagcgacatcgccatcgccgaactgaagaagcttggcgccagtatcgaaaaagtccccaacggcgctgccggcggcaaccatgtgctggccaccctcaagggcaccggcaaggccaggatcctgctgatggcgcacatggacacggtgttcaaggaaggcaccgcggccgagcggccgttccgcatccaggacggtcgcgcctacggccccggggtgatggacgacaagggcggcatcgtcgccgggatctatgcgctgaaggtcctggataacctcaagttcaaggattacgcacagatcactttcctgctcgacgccagcgaggaaaccggttccgagatcgctaccgacttgatcaagaaaactgccaaggcccacgatgtgaccttgaacttggaaccggggcgcccggccgacggcctggtggtgtggcgcaagggcagcgccacggcgctggtcgaggtcaagggcaaggccgcccacgccggcgtcgcgccggagctggggcgcaacgcggcgatggaagcggcgcaccagatcctgcaactgggcaagctgggggatgaagcgaagaaaaccaccattaacttcaccgtgctcaaggccggcgaccgcaccaacgtgattcccgaccaggccaccgccaaggcggatgtgcgggcggcggtgccggaggagttcgaccgcatcgagaaggacctggcgcgggtgtcggccaacaagctgatcgccgacaccgaagtcaagaccaccttgcaacgcggcttgccgccgatgccgcagaccgagcagtccgatgcgctggtggccatggcccagggcatctacggcgagctggggcgcaagctgaccatcgagggcagcggcggggcggcggactctagcctgtcggccggcgtcggtacgccgaccctggatggcttcggcatcgtcggcggcaatatccacacccccgaggaatacgccgaagtcgagagcgtggcgccgcggatctacctgctggcgcggatgatcatggagctgtcggccaagcactga

SEQ ID NO: 705 - DNA, 396 bp, Pseudomonas sp.
atgactgaatcacgacgtccctatggtgcgcctcaacccgagcccatcgacgacaacgaagaccgcatgggttccatggaagagctggacttcgatgaagaagaacccggcgccagggtcggcgaccctgcttccagctctgtggagcatcgtactccccaccggcacatccatggctccagcctgaccggcaacgccgaagacgaacccaacgacgatgacctgaccccggaaaacctgatccgcgaagacggcgcccgctccgcccatgaagccggtgaagaccagccggccgactgggacctgagcattgtcgatgaagacgatatcggcggcggcaatggcctggacgaagccgaactggcccagcgcgacccgttggacggcaaaccctga

SEQ ID NO: 706 - DNA, 2130 bp, Pseudomonas sp.
atggcatctgcgtccgagcggtccgcggtcaaaaagggcaaggttgcggctacagcaaaaaaagccgagaaaaaaaccacgaaaaaaaccgccgccgtcaaggctggcaaaaaggtcgccagccgcaagaccgccacggcccctgtgcgggtgttgaacgtacggccggacggcctggattttcgcgacaccatgtatatcccgaccctggtggaagtcccggtacgccgcgaactcagcgactaccgcgagaccagggtgccggtactcgaccagggccaggaaaacgcctgcaccggttacggcctggcgacagtggcgcattacctgctgcgcactcgtcgctatcagtccgacgccacgcttgtcagcccacacatgctgtacgacctggcccgccgttatgacgaatgggccggcgaggcggacgaaggttccagttgtcgtggagcgatgaagggctggtacaagcacggggtgtgcccggcgccgcagtggcaggccggtaaccaggccacgaccctgacccaggtgctggccgaagaggcggcgctgcgcccgctgggggcgtacttccgggtcaaccacaccgacatcgtcgccatgcacgcggcgattgccgaagtcggtgtgctgtacgccagcgccagtgtgcacgaagggtggcatgtggtcggtggggatggccatatccagccttcggcgaacattcttggcggccatgccttcgcgatcgttgcctatgaccaggacggtttctggattcagaactcctggggcgagacgtgggggtacgaggggtttgcccacctgcgctacgacgactggctggccaacggcgcggatgcctgggtcgcgcggctcggcgcgccgatcaccctgcgcgtgccgctgcaggcgagttcgcaggccaaggcggtggcggcagcttcgtccagcgagaccctgcgggagatccgcccgcatgtcatcagcctgggcaacgacggcgccttcgacccgcgtggcgacctggcgaccaccgcggccagcgtggaggaaatattcgccgtggacttcccgcgcatcaccgccggctgggcgaaaaaacgcatcgtggtgtatgcccacggcggcctggtggcgcaggccggggccatcgaaaccgtggccggctaccgcgcagccatgttgcaggccgagtgttatccgctggcgttcatctggaagaccgattactggagcacactgggcaacatgctggccgatgccgcccggcgccggcgctccgaaggggtgctggatgcgaccaaggacttcatgctcgaccgcctggacgacgcgctggagcccattgcccggctgctgaccggcaaggccgagtgggacgaaatgaaggaaaacggcctgcgtgccacggtcagtgccaacggcggggcgcgggtggtggccaaggccctggcgcgcctggctgcccagggggtggagatccacttcgtcggacacagcgcaggcagcatcctgctagcgccgatggtgcagtacctggtttccaggggggcgatgaacagcgggccgatggcgcgcagccaactgaagggactggaggtgaagatcgccagttgccacctgtgggcgccggcctgcaccgtcaagctgttccgcgagacgtacctggcgccgattcgcgacaaacgcatcgagaagttcggcctgttcaccctgaccgaccaggccgagcgcgatgatcactgtgcgcatatctacaacaagtccttgctgtacctggtctccgatgcgttcgaggacaaggtgcgtatcccgctgatccggcccgatggtgagccgattcttggcatggagcgcttcgtcaccggtgaaagcgatctggcgcagctgttcgccagcgcctcgaacgccgactgggtgcgcgcgcccaacgatttgccgatgggcaatcagaatgcctccggggcccgtcaccatggcgacttcgacaacgatgaaaccacggtccgcgcgaccctggcgcggattctcgggcaaggcggagcgcggcatgccctggtgctgtcgcaacccatcgccgagcgggcacaacggcggcgccaggtggacctggccagcagcatcgggcggcggcaaccatga

SEQ ID NO: 707 - DNA, 318 bp, Pseudomonas sp.
atgcgccgcctattactcgtttcttcgttgttgctctgtctgcccgcaggttcagccatggcccgtgtcgatgcgggtgatgtcgccacctcggcaggggtttccgcctcgctgtactcgacgttcaaggacgacaagatggtgattcccgcccgtgacgacgcctccagtttcgtcgccagcggtggcgccatccgtggtgtctacctggagtcggtgctgcagaaaatccgccaggaaaacccaggcctcaacgccagcgatgaagaactggccagggccatcctcactcaacaggcgcagcccgccgggcactaa

SEQ ID NO: 708 - DNA, 270 bp, Pseudomonas sp.
atgatcaaaaacacactggccgctgtcattgctaccgccaccttgctcagcgccggcgccgcgctggccgaccgtccgggggccggctgggtcactatcgaaaaagccatcgagacggccaagaccaaggccggctacatcgagatctacaagatcgaagccgacaacaacggctactgggaaggcgaaggccgcaagtccgacggcgtggtctatgaattccgtatcgacggtgcctcgggcaacgtagtgcgcgaccagaaagactga

SEQ ID NO: 709 - DNA, 366 bp, Pseudomonas sp.
atgaacaacctgcttcgcggtcttgccgctttcgcattgatgagttgggccagcaccgcggcgttcgctgcgccccaggcgcacgcggacagcagcccggcgcccgccatgctgctggcgcagagcctgcccggcagcagcaacaacaatccctacaacagcccgatacgccgggccaaccccaacagcatgcagggcacccagcccagtgcgccggctgtccgcggggttaatccggtaccggtgcaacgccctccgaccctggagaacggcggcatcggcaacggttacccgcgcaccatcacccagccgcggatcatcgacccgacacccgtgaccccaccgcgtaaccaacagcagcgataa

SEQ ID NO: 710 - DNA, 1935 bp, Pseudomonas sp.
atgttgaaagccggcctctatacgctcctggccctgctgagcctggccccgggcgcccacgccaactccatgcagtggtcgagcatccgcgacggcagcctgtacctgcgcaccgcccagccggaccggctgaagatcggctggagcccggcctggcagagcgacgccaatcgcgagcagctgtacctgctgcagcccgacggccagctgttcaagcaactggagatccgcgccgaccaggcctatggcgaacaggacatcgagctgccagcggccgcgggcgactatcgcctgcagattcccggctacagctttcgcggattcaccgtcagccaccgcggtagcacggcggcgcagttcgagccgaccaaggtgcatttcagcgccgaagtgcacagcggcgccgagctgtacttccgggtggcggccggcgagcaggcgatactggccggcaagtattacggcggcgtcagcgtcttgcaggccagccgcctgagcgatggcgccaaggttcgcctggaactgaaagaacatccggcctacgggcaattcgaccaggtggcgctgccgccggccgaacaggacgaagtctggcgcctgtccctgggcggctccggcaaggcggcgttctggctggacggcacggccaatctgtttgcccaggaggtccagcaactgcactcgctggaccagccccggggcgaggcccacctgcagctgaaagcccagatcctggggaccacgccgcgcctgggcatcgccctgccctatgcccagccgccgcagtccaccttcggcctgttgcaggcgattggcgcccgcgcggccaacttctacagcttcgtcgatgtgatcgagcaggagcccgagcgggaaatcggctttcgccggctgtaccgcgagcgcttcgggatcgaccgcgacatcaccctgctggccggcaccgggcgccgcgccgtgctcgcggcggacgcccagagtttcgccggccttgacgcctggctggccgacagcgtgcgcctggccggcaacggcctgcattacctggctttcgccgacgagcccaacctcaactacccggactacagcagctacgccctgtacttcgagcagatgctggcccgggccaaggccaaccccgaggcccgcgccgctggtgtgcggatcgccatgccggccagttcgcggctgctcgacgggccgttccggatcggcgccgggcaacgccgcggcatcgactgggcgcgccagctgctggagcggcacggcgaggacatcgacgccctggcctggcacgaatggatggtccgcgacctgctcgccacccgccgctaccgcgacagcgtgcgcgccgccgccgagctggtgggcctggatgccgcgggccggccgcgcaaggccctgctgctgagccagaccaatatctccagcggccgcgatctgagcccctaccagcaggacacccattacgccggcctgtggtgggcttcggtggtgatcaacgcctcggcggacggcctgctggacatgctcaactggttccaggccgccgacgagccggactaccccaagggcatgctcgcgcaacgcagcgccagccagttcagcctcaagccggtggccgtggcccagcagttcattgcccggcactggctggcccatgtgcaggccctggacaacccggcgttcgaggtcgatgccctggccatgagcgaggccggtcgccacagcctgctgggggtgaacaaggcgtcgcgggtgcaggcggtgagtctcgacggccccggcgacctgtgccaggccgcgccgctcaagctgagcctgctcggccccgacgaccagcctcgcgacgcgaccgttgaatgccgcgatggccgggtgcacttcgaactgcccggcgaaaccctgtttgccctgacctggaaagccttatga

SEQ ID NO: 711 - DNA, 1302 bp, Pseudomonas sp.
atggtggatatgcgcaaaggcgccttgatcagtggggattcagcgtcctattcggacctcaatcgcctcaaccagctcaaggtcggcgacaagaacagcgaaggcaacctgcgcaaagtggcgcaggaattcgagtcgctgttcctcggtgaaatgctcaagtccatgcgttcggccaccgaggccctgggcaaggacaacccgatgaacacgccggaagccaagcaataccaggaaatgtacgaccagcagttggccgtttccatgtcccgcgaaggcgggggtatcggcctggccgatgtgctgttgcgccagatgtcgaagaacaagccgctggcctcgggcgaggcggccaccttgtctgccgccaagcagcaagaggcgctggacaaggccaaggcgccagtgcctacgccagtggcggccggaacgctgcccgatgggcctttgtcgcgcagtaacggccagcgtccgctctgggcctcgcgggctgtgagcgcgccgcaaggggccgagggcattcaccgcaacgacatggaattgatcaaccagcgccgcctggccctgccgccgaaactggccgaccgcctgctcgccgggctggtgccttcggcgtcggtcaagcctgaggccgtggcgcagaacgtcttgccggatcgtgccgttgccgccgtcaagcctgccaccggtgagctggccaatggtgactggctggccgcgctcaaggctgccgagcccaaaggcgacatgcaggtttacggtcgcgccgtggcccagccaccgctggcaccggcgcgcaaggccttccgcgatgccgatgaattcgtcaacgccatgctcccaatggccaaggaagccgctgatcgcatcggggtcgacccacgttacctggtggcccaggccgccctggaaaccgggtggggcaaatcggtgatgcgtcagcccgatggcagcagcagccacaacctgttcggcatcaaggccagcaagaactggacgggcgattcggcgcgggcgatcaccagcgagtttcgcaatggcgagatggtcaaggagacggccgagttccgctcctacgcctcgtaccgcgacagttttcatgatctggtgaacctgctgcaaagcaacagtcgctatcaagatgtgctgaagtcggccgataacccggaacagtttgtacgcgagttgcagaaggccggttacgccaccgacccgaactacgccaacaagatttcgaacatagcccggcagatgacgagttaccaaaactacgcctcggctggtgccaccacgactttataa

SEQ ID NO: 712 - DNA, 657 bp, Pseudomonas sp.
atgattgacgtgactgtctggagcgtgaccctgccggtgcaaacgcccgcgcaggtggtggcaaccaaagccatgcccagtttgaacaacaagtatttcgacaacaacggccagcggatcatcttctgggcgcccgtcaccggctcccataccggtaacagcgactatccgcgttccgaactgcgggaaaccagccgggacgggaaacaccgcaactggcgctacaacagcggcatcaacacactcaagggcgaattgacggtcaaccaggtgccctcggaaggtcgtgtggtcgtggcgcagattcacgccaagaatgcgccgacgccgttattgaaactggtgtaccgctttgaaaagggcaccggcaatattgacgtggaatatagggtcaagcctaaggacaaaaagagcccggtgatctacaccgtgcccaaggtaccgctgaacaagtccttctcgtacacgctgcaaatggacaagcaaggccagctctcggtgctgattggtaaaaacggcaagcaggtcaagctggacaagtcctggcacggctacgatttctatttcaaggccggcgtctataccctggataacaagggctactccaatgaaggcgggaaagtgacctacaccaaactgagcgtcagtcacaagtga

SEQ ID NO: 713 - DNA, 5040 bp, Pseudomonas sp.
atgccagaacccattcttcgcccggtaatgcctgtcgcccgcgacctgcacctggatttgctcaaggcgcgtgtgcccggttggtacagcgcagccatcgtgcagcgccagcgggagctgagcgatcatacgcttgagctgccggactggtacgcaaaggccccctacgaaaccagggccagcctcaagagcagtcactcccgctaccgcgaaatcttgaatcaggtcgacaacgtcctgggcgatatccaggacatccgcgcctttgccgagccgctgctggagcaggcgatcaaggctgaattcaagcagacgctcgacgtcaaccaggtttatttcgtccgcaagtacggacggcaagtccgcggtgatttcttcggcgcactcgtgctggataagggcgatagccagttcaaccagtacgagtaccacggctcttcattgctggaggccgcgctggccaatttcgaacccgacgaagaaaaccggcccggttgtgccgattgcacgctgatcaccacccagcgtccgttctacggtggggaggtcatgccgtccaccagcgcctttcgggcgggggcgttgccgattgcgccgcaagccttcgccaggctatgccgcacattggacctggggcgtctctatcaagaacacatcaacgcgatcgtgcgaccgccaaacgaggcatcacgcaaccagttggatcgccaactgcgtgatcatcaccggcaaggtttggcgctgagcatggagatcgcccgggccaagggggatatcagtcaggcggcttttcgaatgttgcaacaggtcgtcggcgatcaggatgcgatcactttggacgaccgcgcggtgaccttcacgtcactgaaagtcttcgatatcgaactggtcggcccgttgctgatcggaccggagcgtgaaaacagccggcgagtcgagcggcttgtggcctaccttcccggtgatcccgagcagccgctgaaggagtttgcttccagcgccgacttcatggcgcaaacgcggcggcgcctgcgcggcatcggctatcggcgctttttcagccgttttgtcccgctgcgcaagcaaggcgtttttttcgagcagttcaaccggctctaccaaccttccgagcaggagaacagcctggtcgactacccgctcaaatcgaatctgcgacggctgcccatggacacttcgcccattcccgccccgttgtgggagtcgttgcggctacgccaggtccagaagatccagctcgacgcccgcgcggtagcggtgcccactggtgacgaagacaagaaagcccgcctggcgcgccaggagagttatctgaacgcggtcatcgacgtgctcaacctgggcgcgttcgtcgtgccagggttggggccgctgatgttgacggtaggggccgtgcagatgttcaacgaggcttttgaaggcatcgaagcgttcgagcgcggggagacccgggaaatgtgggcgcatttttccagcgtcgccctcaacaccgcgttcgtggccacgggcgccgcagtgctgccgcatatccaatggtccaacaccgtggaacagctggaaccgctccggttgaacaacggcgaggcacggctctggcgcccggacctggctccctaccggagcgatctcgtcccatccgctggcgcagtgccggacgcgcgaggcctgcaccgggtcaacggacgcccgatcctggcgctggatggccggcactatgaagtgcagttggaaccggcaacgcagcggtaccgcattcgccatccctcccggccggaagcctatcagcccaagctgacggacaatggcagcggcgcgtggcgtcatgaactggagcatccccatggctgggcgggtgcgaagttgatgaaacggctggggcatcgggtcgagcatttcagcacggcggagctggagcagatccgcatcgccagcggcaccggtgaggacgtgctgcggcgtatgcacatagagggcgcaccgatgccggcgttgctggcggatacgaccacgcgtttcgacatttgccgacaaatcgagacgttgaccgcgcaactgcaaagcgaggaggcgctggactacgacaaagccgagccgatgacccagctgcacttgctcacgcgctatggtccgtggccaaaaggcttgcaactggaggtggtcgatcgctcgggccggcgactatggcactacgcacctgatccgcaagctggcgccgcggcccgaggtgtcagcctcgccgaagcgaacgtgcgcacgccttcggtgttgaaaaacctgatcgaggcggtggatgccgccggcggcgacctgctggccgatgcgagcccggccatcgcgaaaaccgatatgccggctcgggttcgtcagttgcgcaagcagctcgccgagatcgtggtgcgcgaaaaagtcagtctgttcaacgattactatgccaagcaggacctctcgagcgacccgcgcgcgacgctgatcaaatcccgtttcccttcggtccccgccgcggcaatcgaccagatgctggcccttgccacatcggctgaaacacagcagatggacgcctgggatttcgccgatgccgcccagaccaaacccatcccgctgcgtatcgccgaagagctgcgtcatttccagcgcacggtgcggatgaaccgcgcctacgaggggctgtatcaagagccgctggccactgccgatacgccccgactggccctggcgacgctggaaaccttgtcgggatggagtgacacggtgcgcatcgagttgcgcgcagatgacctcacgggcgacttgatcggcgcgatcgggccacagggtgcgcagcagaccaaatacgtgatcaaggatggcggtgcctacaagtccttggacgaccaaggcaacgacctgagccactggggcagcctctacgatgcgttgcagcgtgccctgccggatgccgaacgccaggccatgggccgtccttcgattcatcagggcgatctgttgaaacaggccatcggtgctgcgccggcaagccgggattccctggcaagcctgttgaagctaccgccggtaatgccgtcgtataaatcgccgatgcgtctggcatccggccaggtcggctacccgctaggcggtttgcgcgaacggttggggttgagtcggtccccgcaaagtcgggttcttgagctgtacccggactacaccgagcaagaagtccaggccttgctggaggcatttggcgacggcgccgtcggtgaactgaagcgacgcaaggtcgagttgcagatgcttgatcgcgacctggacctctgggccaacacaccgggctggcgcgaggtgggtcgccagcgtcatcaactggtggaaccgcaggccaggcgcgcggtggctgagcggatcaagcgttgttggcggcgccaggtcccggtggtaacggcagtggacggcagcagggtgggttatgaactggtcttgagccaacaatatgtcggggagcttcccgacctgaccgccaatttcagccatgtggcgtcgctgaagttgaacgacatgggacttacgcgagagggcagcgaaagtttcctgaccggtttttcttcccttcgctggttggacatgaccctcaacaggctgaccgatgtacccgccgccctgggcgcaatgaatggcctgaccaggctccaattggggtcgaatcagatccgcttgaccagtcgcagcgtcgggacgctgcaagacctgacccagctcaagatcctcaatctggaaaacaacccgctggatcggttgccggatttcagccacttccccgccttgcgcggcctgtatctgaaaagcaccgatataagcgtttggccccgcggcctcggtgagctgcccctggagcgcgttgacttacgcgacaatcggttgaccgaagtcccggacgacctgattgatccaccgccagcgcgcgcgctcatcacggcgcgcctcaatggcgtgaccctgttgcagggaaatccgttgagcgaactgactcagcagcgcttgggtgagtactgggcgaacatctccctgacgcatccgcaatggatggctctgcgctcgcccggagcgtttggtcatgccctgcctggcaggccttcgaacgtgcagcagtggttgcgtaatttgccaagcaacgaactggaggcaagaaaggacttgtggcgaagcctggcgcgcgagccacagtccaaggagctgttcaggttattgaatcgattggcgggttcttatcagggcgaagaaaactacccggacctccaggcgcgcgtctggcagatgcttgaggcggccagggactctacgcagttgcgtcgtgagctgttcgagctggccggtgccccggcgtgcgaggaccgcgcggcgttgtcgttcagctacctggaaatcaggttgatgatccacaacgcccgggccctggctgggggaacggatgaggcggcggtgttggtccgcctggcgaaagggctgtttcgtctcgatgaggtggaacgcattgcgctgcaggatattcagcagcgtcgtgatgcgatcaatgcgcgtcgtgatcttacggcagcgcagaaggcccaacacctacagcagatcgaagaggtcgaggttcgcctggcctatcgtgtcgggctgaaggggcgactggaactgcccaaacagcccgcaggcggacgcttcctgatgctggccggtgtcacgcaagaggcgcttgatgcggctgccgagcaggtcctggccctggacgattcgcctgagcagtttcaatcgctggtgggacgggatttctggattgattacctgaaggaacaccatccgacgtccttccaggcattgacggatacgctgattgccaaccagattgaactggatgaggcaaaggccgcaggaaccctggaggcagccgattatgcctctcagtccgaggcgctggccttgcagttcaaagtcaaggaggcggagctgattcagtcattgactcaatcggagctggatgcgctaccggaaagtaccgagctgtag

SEQ ID NO: 714 - DNA, 549 bp, Pseudomonas sp.
gtgaacaagtcgatgctggttggtgcggtattaggtgccgtcgctgtgactgctgggggggctgttgccacctacaagctggtcaatagtggccctgagtatgcgcaggtgctggcagttcagccggtcaaacaacagatcaaaacaccgcgtgaagtgtgcaaggacgtcaccgtgacccgtcaggctccggtgaaggatcaacatcagatcgccggtacggtggtcggtgcactggccggcggccttctgggtaaccagatcggcggcggtacaggcaagaagatcgccacggtggccggtgcggtcggcggtggttacgccggtaacaaggtgcaggaaggcatgcaggagcgtgatacctacaccaccactcagactcgctgcaacacggtcaacgacatcagtgaaaaggtcgtgggttatgacgtgaagtacgagctgaatggcaagcaaggccaggtgcgtatggatcgtgatccaggcagccagattccggtcaacaaggaaggtcagctgatcctgggccagaaccagccggcgcaataa

SEQ ID NO: 715 - DNA, 207 bp, Pseudomonas sp.
atgaagatcgatccgcttataagcaccacacttgccagacttgagcccaatcaggtcggcgtcctggcctggtcactgctggcgcaccccagtgtggcaggcggcattcccggtcagcctgacccggataccccgcaacccgccgagccgaccgaaccaggcgagccgaccttgccggacgagcctcctcccgctcctgtcgcctga

SEQ ID NO: 716 - DNA, 222 bp, Pseudomonas sp.
atgaaagcctccacactcctgctcgccggtctgatgattgccagctcgggtgcagcgttcgccgaaggcggcgctgaacgcatgaagcactactgggacaacttccccatcagccagcagataccccgcaccgatagcgaacagacgtcctccgagagcgggaaaaaaccccaggcacccgtcgaggatccgagccgcacccctgcgcagccggacgcctga

SEQ ID NO: 717 - DNA, 288 bp, Pseudomonas sp.
atgcgcacactaaatcgcttgctgctggccagcctgattgcaatcgcgccgatggccgtgattgcggcggaggatgcgccatcggcggatccggaagtgaccattcgcacggaaggcgacaagaccatccaggagtaccgccagaacggtttcctgtacgccatcaaggtcacgccgaaggttggcaaaccctactttctggtgcgcgccgacggttccgatggcaacttcattcgttcggaccagccggatatgctgattccggcgtggaaaattttcgagtggtaa

SEQ ID NO: 718 - DNA, 1494 bp, Pseudomonas sp.
atgtttcctagcactcgcgtcagcgccatgcgcaagctcccgctggccatcaccctcggtctggtttcgttggccactcaacaagccttcgcccacgggtatgtcgaaagcccaaaatcccgtgccttcatgtgctccgcaaccggcggcaacctcaaccgcgattgcggccctgtcacttacgaaccgcaaagtgtcgagtactcgccatcggtccagcaccactatcccaaggattactgctcgggcgacttcactaaatgcggtccggcgaacggcaccatcccggcgggcggtatcaccagcttctcccaactcaacgagcagacggcgacccgctggcagaaaaccacgatcaagccgggcatgaatgaattcacctggcactactccgccggtcacgccagcgcctactaccagttctacatcaccaagaaagactggaacccgaaccagccgctgacccgcgactccttcgagatgaccccgctgctcaatgaaaacgccggtggcgtgcgtccgccagccggtggcaagaccaagcacaaggtcaacatcccggccgatcgcagcggttaccacgtgatcctggcgacctggaaaatcgccgacaccgccgccaccttctaccaggccatcgacgtcaacatcgacaacgatggcgcgccgattcctgactggaagaccctcggcgcggtgcagcctgaacaactgcgtgtcggcgacaaagtcagcacccgcgtgttcaccaatgccggcgagcaacagaaccgccagacccgcctgagcatcgagaccgcggaacaggcccaggccaatacctggccgttcctgttggcgcagcaggtcaacaaggccaatgccggctacgtaatgggcgaactcaacgccaataacgaagtcgtgcccaactacggcaagaacaccatctacgccaagaacaacagcgacgtggtacgcgtggaaatccagaaagagcagccgagcattcctggcgagctgaagctttccggcctgcaggccgagtacagcctgaaggacagcgccaccgacctgcacttcaacgccattgcccagggcggcaagtacaccatcgcctccaccgtgttcaacggcaaaggcgaaagcatcgcccaccagcaggcggaagccggcaacaacaccccgcacttctccatcccgctgcgtaacgtcagcgaaggcgaatacgacgtggtggtcgtggccaagccggaaaaaggcgagcagctgcaacaaagccagcgcatcaccctgaaagccgaggaagtgggcggtggcggcgactacgacttcgtcttccccaaaggcctgaccggctacaaggccggcaccaaggtcctggccaaggacggcaacgtctatgagtgcaagccgttcccttacagcggctactgcatccagtggaacgccggcgccactcagttcgagccaggcgttggcagcaactggaaagacgcctggattcgcaagtaa

SEQ ID NO: 719 - DNA, 351 bp, Pseudoxanthomonas sp.
atgcgcaagaacgccaccgtgctcgccgccacctttgccgccctgctgttctccggtgccgccatggccggcgacaacgatccgcagaagaagaaggccgccgacgccgattccagccagccggtgtccgacacctggatcaccaccaaggtcaagtccagcctgctggccgacagcgacgtgtccggcaccaagatcgaggtcgacaccgtcgacggcgtggtctacctgaccggcaccgtcggcagccaggcccaggccgacgaggccaagcgcatcgccggcgagatcgacggcgtggccaaggtcgacaccagccgcctgaaggtcgacgcccaggcctcgcgctga

SEQ ID NO: 720 - DNA, 684 bp, Rhodococcus sp.
atgtcgatcgaatcgcaaaacggcatatcccatcgtcgatcgagggccgcagtggggctcgcggcgtgtgcggttgccacactgtcgtctggggtggtcttcgcagggagcgcatcggcaacgccgacggcgttggcggacaaattcgcgagcacggtcaccgatgacggctggacgttggatcttgccgccaccaaactgtcggcgaatccggtgccgaatttggcgacgacggcgttcactcgtgaggggttcgtgtcggcgaaggtgaccggcacgatcggtggtcagggcgattcggcagtgaagaccggttatgtcgagcagggattgcagatcggctgccagatcgatgtctcctccggacttggcttggggcttggcttttcgctcggcccgtctgtcggtgtgagtatttcgggtgtcccgtcggcgaacgtgggtgtgaatgcgtcggtgaatccgagtattcagtcgacgattgcgccgggcacgatcacgacgattccgttggggaagaaggatctcgagtcgtcgaaggcgtcgatcacggcagagaacgtgcacgtgaaggttgatgcgtgcatggggccggtgacgatccgctcgtacgcacaactctcggtgtcgacggcgacgtccgacaacacattgttcgtgtactccgatcccacctggctctaa

SEQ ID NO: 721 - DNA, 693 bp, Salinibacillus sp.
atgaaacagattattgcgatgggcggcggaggtttttcaatggaaccagatcatctcgttcttgatcaatttatcattaatcagtcaaagcagccctcacctcgcatttgttttttgccaacggcaagcggggatgcggagaactatgttcagcggttttaccatgcttttcaaaagcttgattgtgacccatctcatttgtctttatttaagccgccgacaacagatttagcctcctttattatggagaaagatgtgatttatgtcggagggggaaatacaagaaatttgctggtgctgtggaaggagtggggactggatcacatattgaaaaaagcttgggagaacgggattattttagcgggattaagtgcaggtgcgatctgctggtttgaagaaggtgtgacggattctgccggaccgctgaccggtttgaaaagcttgggttttttgcaaggcagtttttgtcctcattatgatggagaaaaggatcggagacctgcatatcatcacatgatatcagcgaaagcgttgagcagcggttatgcggcggatgatggagcagctctgcattttattgatgatcagttttttcaggctgtgagttcaagatctgatgcaaatgcgtatcaggtggtgcttcatgaaaatgaaatctctgaaatagcattgccgattacatatttgtcttga

SEQ ID NO: 722 - DNA, 1455 bp, Salinibacillus sp.
atgaaaaagaaattagcagcagggctgacagcatccgcgattgtcagcacaacactagcgattacacccgctgaagcagcaacgattaaagtcaaaagcggagattccttatggaagctggcgcaaaactacaacacaagtgtagcggccatcacatccgccaaccatctttcgactaccgtcctgtcaatcggccagacgcttaccatcccaggcagcaattccggcacttcatcatcttcttcaggctcaacagcaaagaagagcggaaattctgtttacacagtgaaaagcggcgattcactatggctgattgccaatgagtttaagatgtcggtacaggaactgaaaaagttaaacggattgagcagcgacatgattcgtgcagggcaaaaattaaaagtatccggaaaagtttcttcaaattccagttccggcacttcaagcagctctaaatcatctaaatcatctaaatcgagctcaagctcttcagcttcgactggcacttacaaagtgcagctaggtgattcgctttggaaaatcgcgaacaaagtcaatatgtccatcgctgaattgaaggtattgaacaatttaaaatcagataccatttatgtgaatcaagtgttaaaaacaaaatcagcgggttctaattcgtcatccaaaaacaattcatccaaatcgaatcaatcagcgtcagcaacaacgaagtacaccgtaaaaagcggagactcactttggaagatcgcaaacaaatataacctgactgtacagcaaatccgaaacagcaacaatctgaaatcagacgttctgtacgtcggacaagtgctgaagctgaccggcaaatcaagttccagcacatcaacaacaccgtcttcgtcaaattcaagctccggcacaacgacgactacatatacggtgaagagcggtgattccttatgggtgatcgctcaaaagttcaatgtgacagcccagcagatccgggagaaaaacaacttgaaaaacgatgtcttacaaatcggccagaagctcacgattacaggcaaagcttcatcttcaaattcaagttccggatcttcaggcagcacgatctcaacaagcgcgaagattaacaaaatgatcgcggccgctaaggatcaccttggcgttccatatcgctggggaggaacaacaccggccggatttgactgcagcggattcatttactatgcgctaaacaaagtgacttctgtgtccagattaacggcggccggctactggaacaccatgaaacctgtcagccagcctgcagtcggagactttgtcttcttttcgacatacaaagccggcccttctcatgtcgggatttacctcggaaacggggaattcattaatgccaacgactcaggggttgtcatttcaaatatgaacaactcatactggaaacagcgctacctcggagcaaagcgttatttctaa

SEQ ID NO: 723 - DNA, 1929 bp, Salinibacillus sp.
atgaaacctgtcatttcgcttatcctttccaccgtcctttttctttcatgttttctcggcgtcagtcagacagctgaagcaaaaccccgcagctcagatgatgccaaacagatcgttgatcgtatgacgttagatgaaaaaattggccagatgctgatgccggatttcagaaactggaaaaaagaaggtgagtcttctccgcaagccttcacaaaaatgaatgaggaagtcgctggcctcatcaagaaatatcaattcggcggcgtcatactatttgcagaaaatgtaaaaacaactgagcaaacggtacggctgacagacgcatatcaaaaggccagccccaagattccgctcttactcagcattgatcaagaaggcgggatcgtgacgagattaggggagggcactaatttcccaggcaatatggcgcttggcgcaacaagaagcagaatcaatgcatatcagaccggcagcatgattggaaaagagctttctgtcttaggcatcaatacagatttcagcccagtcttggacattaataataaccctgataatcccgtgatcggtgtgagatcattcagttctgatcgtgaactgacagcacgactcggtttatattctatgaaaggtttgcaacggcaaaatattgcctctgctcttaaacatttcccgggacatggagacactgacgttgacagccattatggactgccgctcgtttctcataaccaggaacggcttcgtgaggttgaactctatccttttcaaaaagcgattgatgccggagcagatatggtgatgacagctcatgttcaattcccagcctttgacgacaccacatataaaagcaagcttgatggatcagatattatggttcccgctacactttcaaagaaagtaatgaccgggctgcttcgggaggaaatgggatttggcggtgtaatcgtcactgatgctctcaatatgaaagccatagcagatcatttcggtcaggaagaggcggtcgtcatggccataaaggccggtgttgatatcgcgctaatgcctgcctcagttacatctttgaaagatgaacaaaaattggcaagcgtaattgactccttaaaagaagctgttaaaaatggagacattcccttacagcaaatcaacaaatcggtggaaagaatcatttccctgaaaataaagcgcggtatttactccgctcagcatgacagcagcatagataaaaaggtgaagaaagcgctcaaaacagtgggaagcaaacaccatacaaagacagagcaaaaaatcgctgaaaaggcagtgacagtattaaaaaatgatcagcataccttgccgttcaaacccaaaaaaggcagccgaattttaattgccgcaccttacgaggaacaaacagcatccattgaaaaaaccattcacgatttaatgcagcggaaaaaaatcaaatctgtttctcttaacaaaatgaactttgcagaaaaggtatttaatgctgagcatgaaaaacaagtaaaagaagctgattatattattacaggctcttacgttgtaaaaaatgaccctgtcgtcaacgacggtgtcatcgacgacacggtaacagattcaagcaaatgggccaccgcttttccgagagctgtcatgaatgccgcactgcagcacaaaaagcagtttgtcttaatgagtctgcgcaatccatatgatgccgccaatttcgaagaagcaagagctttgattgccgtctatggttttaaagggtatgcaaacgggcgttatctccagccgaatattccggccggcgttaaagcaatcttcggacaatcaaagccaaagggcacgctgccagtcgacattccatccgtcacaaaaccgggagacatcctttatccatttggctatggagtaaacatcaaaacgggaaaaccgctttaa

SEQ ID NO: 724 - DNA, 1089 bp, Salinibacillus sp.
gtgttaaagaaacctatcatctgtttgttcatcttatttttatttgcgtctgccgttttggctgagccgatccaagcacatactgtgtcacctgttaatcctaaagcacagcagacaacaaaagatgtgatgaattggctcgcccacctgccgaatcgttctgaaaacagagtcctttccggtgcgtttggcggttacagtcatgacacattctccatggccgaagcagaaagaatccgaagctcagccggacaatcacctgccatttacggctgtgattacgctaggggatggcttgaaacctcaaacattgaagattctatagacgtaagctgcaacagtgatttaatttcgtattggaaaagcggagggattccgcagatcagtctgcatctagcgaatcctgcttatcagtcaggacactataaaacaccgattaccaacgatcagtataaaaaactgttagactcttctacaacagaggggaagcggctgaacgccatgctcagcaaaattgctgacgggcttcaagagctggaaaaccaaggcgtgcccgttctgttcaggccgctgcatgagatgaacggcgagtggttttggtgggggcttacgtcatataatcaaaaggatgatgaaagaatctacttatataaacagctctacatcaaaatctatcattatatgactggcgaaagaggattggatcatttattgtgggtttactctcccgacgctaatcgagattttaaaactgatttttaccctggagcttcatacgtagatatagttgggttagatgcatactttcaagatccatattcgataagcggatacgaccagctgacagcacttaataaaccatttgccttcacagaagttggtccgcaaacagcaaacggcaactttgattacagtctgtttatgagtgcgataaaacaaaaatatcctaaaaccacttattttctggcatggaatgatgaatggagtccggctgtgaacaaaggcgcttcatctctctacaatgataactggacattaaataagggagaagtgtggaacggtaatacattaacacctatagttgaataa

SEQ ID NO: 725 - DNA, 630 bp, Salinibacillus sp.
atgacgacaaaatttactgcgctagctgtttttcttctttgtttcatgcctgcttcgaaaattgaacatacacaagcttcactactgaacacaaagaagacaaaacatgaagaagctaagctgcttacccatataaatcatgacacagacacatctttctcttcactgtctgctgatgaggacaagaaaaaaataaagccgatcaggctatcagcgaacactgaaaaaaaagaaaacgaacaatcagagaaaacgaatgagaagaaagaaacttattctgagtctgaaaaagaattgctttcccgactcgttcacgcagaggcgaagggcgaatcatatgaaggcaaggtcgctgttgcaagcgttgtgctgaacaggacggataagaacggctttcccgatacaatcagaggagttatttatcagaaaaatgcctttgaacctgtcgcaaacggaagcattaatcaagagcctgacaaagaatcaattgaggctgttgaagaagcgatgtcatctaaggacagagaaacagaagcccttttcttttataacccgaaaacggcgtcagatgactggattcgctcaaggaaaatcattgaaaaaatcggcaggcatgtctttgccatataa

SEQ ID NO: 726 - DNA, 1008 bp, Salinibacillus sp.
atgaatgcaaaaagatggatcgcattagtgatcgcccttggaatttttggcgtgtccatcatcgtcagtatctcaatgagtttctttgaaagtgtcaagggtgctcaaacagaccttacgtcactgacagatgaatcccaggaagtgacgcttgaaaacggaagcctttccagcaaaatcgccgttttggaggtcagcggcactattcaggataatggtgattcaagcagtctgctcggttcagacgggtataaccaccgaacattcttaaaaaatcttgagcaggcaaaagaggatgatgcggttaaagggatcgtactcaaggtaaactctccgggaggcggagtgtatgaaagtgccgaaatacataaaaaactggaagaagtaaaaaaagaaacaaaaaaaccaatctatgtgtcaatgggatcgatggcagcttccggaggttattatatctcaacagctgccgataaaatttttgcgacaccggaaaccctgacaggatctcttggggttatcatggagagcgtgaattactcaaagctggctgataagctcggcatctcttttgagaccattaaaagcggggctcacaaggatattatgtctccttcccgtgagatgacaaaagaagaaaaaaatattatgcaatctatggttgataactcctatgaaggctttgtcgatgtcatttcagaaggccgcggcatatcgaaagcggaagtaaagaaaatcgcggacggacgcgtgtatgacgggcggcaggcgaaaaaactgaatcttgtggatgaactcggattttatgatgatacaattgcggccatgaaaaaagatcataaaaacttgaaaaacgcttctgtcgtctcttacgaggaaagcttcggattaggctctctgtttaccatgggagcgaacaaaatgtttaaaagtgaaattgattttctgaatatgagagaagttctttcacaatccggttcgccgagaatgatgtatctctatgcgaagtag

SEQ ID NO: 727 - DNA, 1623 bp, Salinibacillus sp.
ttgcgtacactgttcaaaacatctctgttcatggccggcttatgcatggcggctcaatgtgtttttgcatcaaatgcctcagcagatcaaagcatcaaatacgaccatacgtatcaaaccccttcatacatcatcgaaaaatcacagccatcatggcagccagctcaaaacctaacgcagaaagaagcgctattttcatatctggacaagcaacaaacccattttaagctcaaaggaaacgcgaacagccattttcgcatttcaaaaacaataaaggattcaaagacaaaacaaacattttttaaattagaggaagtgtataaagggattcctgtttacggttttggacaggcggtcgcgatgaaggaaaacaaacaagtgaaaagtttcttcgggaaagttcacccgcaaataaatgacatatctgtcacaccgtctgtatctaagaaaaaagccatacatacagcgcgccgtgcgcttgaggcctccattggaaaaatcgagtatgttgacggggaaccgaaagccgaattatatatttatccgcacgaaggcgcatatgatcttgcctaccttgtgagactttcgacgtctgaacctgaacctggatattggcattatttcatcaatgccaaaagcggaaaggtcattgattctttcaatgccattcatgaagcagccggtacagggatcggcgtatcaggcgaagaaaaaagctttgaagtaaccgaacagaatgggcgttattatttggctgacgaaacaaggggaaaagggataaatacttttgacgcaaagaacctgaacgaaaccttgtttacccttttgtctcaattgatcgggtatacaggcagtgaagtggtcagcggcacctccgtatttcatgacccggcggctgtagatgcccatgcaaacgcacaaaccgtttacgactattacagccgcacgttcggccgccattcttttgatcaaaacggagcgagaattacgtctaccgtacatgtgggaacacagtggaacaatgcggcgtggaacggtgtgcagatggtgtacggggatggtgacggcgctaggtttaagccgctgtccggatcgctcgacattgtggcgcatgaaatgacacacgcggtcacccagtattccgccggccttttatatcagggagaaccaggcgcgctaaacgaatccgtttctgacattatggcggcgatgacagaccgggatgactgggaaatcggcgaggatgtatatacgccggatgtacgcggggatgctttacgttcgttagaggatccttccaagcaggggaatccggatcattattcaaaccggtatacgggcacagaggattacggcggggtgcacatcaattcgtcgatccacaataaagcggcatatcttctcgcagaaggcggcgtgcaccatgatgtgcgggttgaggggatcgggcgtgaagcttgtgagcaaatttattaccgggctttgacatattatgtaacgccttcttcagacttcagcatgatgaagcaagcggctatcgaagccgccaatgatttatacggtgaagactcgaagcaatcagcttctgtcgaaaaggcatatgacgcagtcggaattcaataa

SEQ ID NO: 728 - DNA, 1149 bp, Salinibacillus sp.
atgcgcatttttaaaaaagctgtattaatcgtcatcatttcttttctatttgcaaatgtaaatgtgaacacagcacatgcagctataaatgtcagtgcgaagagcgccattgtcattgacggcacatcaggaagagtgttatttgccaagggcgagcatgaaaaaaggcggattgccagtattacaaagatcatgaccgctgttctcgccattgaatccggaaaaatggaagaaaccgtgactgtttctgcaaatgcggtcagaacagagggttcggccatttatttaaccgaagggcaaaaagtaaaattaaaggatcttgtgtatggcctgatgctgagatccgggaacgatgctgctgttgcgattgctgagtatgtcgggggaagcctcgatggatttgtctatatgatgaaccaaaaagcagaacaaatcggtatggagaatacccgttttcaaaacccgcacggattggatgaccatgaaaatcactactcaacagcttatgacatggctgttttaacgaaatacgccatgaagctcaaagactatcaaaccatctcaggcacaaaaatatacaaagcagaaacaatggaaagcgtatggaaaaacaaaaataaattgctgacgatgctgtatccatacagcactggggggaaaacaggctataccaagcttgcaaaacgcacactcgtttcaaccgcttcaaaggacggcgttaatctgatagccgttaccattaatgaccccgacgattgggatgatcatatgaatatgtttaactatgtatttgatcattatcaaacatatttaatcgcaaaaaaaggagatattccgaagctcaaaggtacattttatgagtctaaagctttcatcaaacgggacatcacctatttgcttaccgaagaagaaaaagaagatgtcaaaatcaacactaccctgctcaaaccgaaaaaagcctgggaaaaggatgtctcaaaaattccggatattgtaggacatatgaaagtcatgttcaacgatgaaaccatcgcaaaagtgccgatctattacgaaaacgaacgaaatcaaaaaccgaaaaaaaagttttttgaaacgtttcaatccatttttctgaatgcggctggcggggcaaaatggtcaatataa

SEQ ID NO: 729 - DNA, 981 bp, Salinibacillus sp.
gtgaaagttgtgttatctgcccttcttctccttttgtttgcatttgaaccttatgcgtctggaaaagagctttcagatccggtgctttccaaacggatggaattatatcataaagtcgaggctgtaacgcagattccttggtatgcgctcgccgctgttgatcaatacgaggagaatgtgcggagcaacagaaaggatctgcctgacaaaacgggaatcatcagcatctatgtaccggatgagatctggagcggaccagaaaacccgaacccgaaagacgatgcgccgttaagcataaaagtgtttgacggtatcggaatggacggtgacggcgacgggaaagccgaggtcagcaatgatgaagacattctgtatacattcgcacaatatctgctgtcgtacggcacagatgaggagaatatccgcatcgggctctggaactattaccgccgtgatcaaacggtgggaatcatatccgagttcatgaagctgtttaaggcttacggtcatattgatttgggcgagcatgcgtttccgcttccgatcagaacggattacagttaccgcagcacgtggggagacgcccgcggctttgggggaaggcggattcatgaaggaacagatctctttgcccactatggccttcctgttaaatccacctgttacggcgtcattgaaatgaaaggctggaaccgctttggaggatggagaatcggcatcagagatattaacaatacgtatcattatttcgcccatctcaatgggtttgcaaagggcattaaaacagggcagatcgttgagcccggccaagtaatcgggtcagtgggcagctcaggatacggcccgcctggcacggccggaaaattcccgccgcacctgcactatggcatgtataaggataatggaaaaactgaatggtcgtttgatccttatccacatttgagagcgtgggagcgctatgagtacaagaaaaagaaatga

SEQ ID NO: 730 - DNA, 2643 bp, Salinibacillus sp.
atgaaaaagagattaatcgcaccgatgcttctgtccgccgcgtcccttgccttttttaccataaccggctctgcacaggctgcagcgtatacggactactcgatttataaggtggagccggcaaaaacattcagcacagaaagccaagcctctcaggccgccgccaaattggaaaaagacacaggctgggatgcctcctatcaggcttcaggcacaacagcaacctaccaaattaccgctacaggcatacatagcgaagcacaagctaaaaccgtgctgagcggactgacaaaacagacagccattacaggcacatccagtccagtcggcagcaaacagccgtatatgaccatcacatccggcgcaatatcaagtgaaaaacaggccaacaccctgctggccaagcttaagcaggaaacaggggtatccggcgctgtgaagatgtccggcacagcccagttttacatgaacgtggttacctcggaaatagcagaagagacgaaggtcaaggagcttatccaaggcctgacaaagaaaacggggataaaaagcacgtaccagcccgttacacatgaagtgtctgtaacaagcattcaatcaggcgctattaccggggacagcaaggctgcccaagtcaaaaacgcattccaaaaagaatcaggactgaaggcatcattaaaagaaacagcgaaaggccaagcctattacacgtttacaacagcctctatatcaggtgaagcaaacgccaagactttgttacagcagctgaaacaaagtaccggaattacgggaagctacaagtcaatcaatcaaaaaacaacagcagacgtatacaatgtccaatcggcttatttcaaagggctgaatacagtgaaggatgccatcagccaaatcaagaaaaacactggggtgtccggatattatcaaaaggtcggcaaaagcacatcatatacggtaaacatgaagaatttgacaaaacagcagcttcaaaaggtcgacgcattcttcaaaaagaaaaaatggcattacacgtcatctgccgtgaaaaaaacggcaacgtcatctgcctatcaaattacgactgcacagattttaggtgagcagcaggccaacaaagctgcggccttcttcacacagaaaaaagtaaaggcaacgaaaaaagcgactggaaaaaaagccgaaaaccaatatcagctcatttctgaagaaacaacagaccaagcaaaagttacaaaaggtttgaacgttttaaagaaaaataagctaagtgctgcagcaaaaacagtaaaaaaacaaactgccaacacgtttaaaattacaactgaatctctgctggaagcggctaaagtcaatgaagccatcacgttctttaaatcgaatcagatttcagccgcaagcaaaaaaacgggtcagacagcagaaagtaaatatcaaatcaccactgaggcgatcattagccaagaggacatcgatcgtgtacttgcttttttcaaaaaaaataacgcctctggcacagctgtgaaaacaggcgcgacagcatatacacaatacaaaatcctgacatctcagctcagcagcaaaacagcattgaacaatggactgaactattttaaagctctacagttaagcgcgaactacacgaccaaaagcaacacgctttataaaattagccttaacgagcaattcacaggcaatagcgcagcttcagcggcatcagcgaagctgaaacaattatatggatggacatcatccactgtaaaaataaagaacggtccgcaaatcatgaaaacgaattataatctctcgcttcgtgatatggttcaaaaacaaatgaaagtcagcccgcaaaccgacggtgcagcttacgtatcactcacgtatatcaacacagcaacctcaacggttacagctgatgtactcaacatccggtcaacgccggcagtcagtccgacgaacgtcatcggccaattaaaaaaaggcgataaagtgaaaatcatcggccagacaaacgggtgggctaaaatcaatatggggtggagaaacgctagcagcgatgaagtaggacaatacgttgacccgaacaacttttccaaggacagcaaatactacttccaatttcttaagctgtcacagacagccggcctcagcgttgccgaagtcaatcagaaagtgcttgcgggcaaaggcatactgacagggaaagcaaaggcatttatcgatgccgcaactaagtacagcatcaacgagctatatttaatctcacacgctctccttgaaacaggcaacggaacatccgatttggccaatggtttaacctataacggaagaaccgtttataacatgtacggaatcggcgcatacgatagcaacccgaactactacggcgccaaatacgcatacgagcaaggctggttcacaccagaagccgccattatcgggggcgccaagttcataggctcatcctacattcataacacagcctacaatcaagacacgctatacaagatgagatggtcagccacagctgcacaccaatacgcaacagatatcggctgggcgtacaaacaagtaaaccgcatgtatagcctgtattcattactggatgggtacacactgtattatgatgttccggagtatcaataa

SEQ ID NO: 731 - DNA, 753 bp, Serratia sp.
atgaaaatccgtacttctttgattgcactgagcattactgctttattgagcggctgtcaaaaccttaataccgataccctactacaatccggcgctcaggcctaccaggcggcaacgctgagcgatagcgacgtcaaggcactcagtgataaatcctgtgcagagatggatagcaaggagcaaatcgcgccagcaagcagcgactataccaagcgcctgaacaagattgccgccgcgttgggggataacatcaacggtacccctgcaaactacaaggtttacgtgaccaaagacgtcaatgcctgggcgatggccaacggctgtatccgcgtctacagcggcctgatggacatgatggatgataacgaagtcgaaggcgtactgggccatgaaatgggccacgttgcgctgggccacactcgtaaagccatgcaggtcgcttatgggacagtagcattacgtaccgcagcatcttcagctggcggcgtagcagcctcactgtctcagtcgcagttggccgatctgggcgaaaaactggtcaatgcccagttctcacaaaaacaggaaagtgaagcggatgattactcgttcgatctgctgaagaaacgcggcatcaatccagaaggtctggctaccagtttcgataaactggcgaaattagacggtggtcatgaaagcagcatgtttgacagccatccaacttccgaagcccgtgccaagcacattcgcgatcgcatcgccgccggtaagtaa

SEQ ID NO: 732 - DNA, 2664 bp, Serratia sp.
atgaacaagtttaagatgagtgctctcgccgccctgacggctaccgttggactattgggcagcgtaggttctgccatggccaaccagcaggtggttgatcaactcagccagttgcaggtcaatctgaagatgttggacaaccgtgccgctgagaacggcgtggactgtgccaagctgggtgccgactgggcgtcctgccacaaggtgctgatcaccttgaccaacggcaatcaggaaatcaaagataaagactgggcgatctatttccacagcccgcgccaaacgttgaaggtcgataacgaccagttcaaaatcacccacattaccggcgatctgtataagctggaaccgacggacaaattcaccagcttcccggccaatcaggcggtggaaatcccgattatcgctgaatactggcagctgttccgcaccgacttcctgccgcgctggtatgccacttccggcgatgctcagccgaagatcctgtcaaataccgataccgaagatgttaaccagtttgtggccccgttcaccggtgaccagtggaagcgtaccaaggatgacaacaacattctgatggtgccagaaagccgcttcaccaagaaccaggatctgaaagtgttgccgatggcatcgctgcgtgggcaaatcatcccaaccccgatggaagttaaagtccatgcgaaggatattgacctgagcaaaggcgtggcgctggagctgagcgcgttgaccaagccagcggcagatgctgcagccgagcgttttgccttgctgggcattgagagccaggcgaacggttatccgatcaagacggatatcaagccagcggcattcaaaggcgatcaggccgtgccaggtgcctaccaactgaagattggcgagaaaggtgccgagatcgttggtttcgatcagaccggcgtgttctatggtctgcaatccatcctgtcgctgatcccatccgacggcagcaagaagatcgcgactctggatgccaaagatgcaccgcgcttccaataccgcggcattttcctggacgtagcgcgtaacttccaccaaaaagacgccgtattgcgcctgctggatcaaatggcagcctacaagctgaacaaattccacttccacctgacggatgacgaaggttggcgcattgagatccctggcctgccagagttgaccgaagtgggcggccagcgttgtcatgacctgagcgagaccacctgcctgatgccacaatacggctctggcccggcaccgcacggtggcttcttctcccgtcaggactatatcgacatcgttaaatatgctcaggcacgccagattgaagtgatccctgaaatcgacatgccggcgcacgcccgtgcggcgattacttccatggaagctcgctacaagaagctgctggccgaagggaaagagaaagaggccaacgagttccgcctggtggatccgaccgatacctccaataccacctctgtacagtacttcaaccgtcagagctacctgaacccatgcctggattcctccaagaacttcgtggacaaagtgattggcgaagtggctcagatgcacaaagaggccggtcagccgctgaaaacctggcactttggtggggacgaagcgaagaacatccgtctgggcgctggctataccgacgtgaaaaacccggaagcgggcaagggcatcctcgatctgagcaaagaagacaagccgtgggccaaatcgcaggtttgtcaggccatcatcaaagacggcaaagtggaagatatggaacacttgccaagctacttcggtctggaagtcagccagttggtgaaagcgcacggcattgacagaatgcaggcgtggcaggacggcctgaaagatgccaaagactcgaaggccttcgcgaccaagcatgtggcggtgaacttctgggataccctgtactggggtggtttcgactcggctaacgactgggcgaacaagggatatgacgtggtgatctctaacccggactacgtctacatggacttcccgtatgaagtcagcccggacgagcacggttactactggggcacccgtttcagcgacgagcagaagatcttcagctttgcgccgaacaacctgccgcagaacgccgaaacctcggttgaccgtgacggtaaccacttcaccgccaagagcgacaaaccatggccgggcgcatatggtctttccgcccaactgtggagcgaagtggtgcgtaccgaccagcagatggaatacatgatttacccacgtgctgtgtcgctggcagaacgtgcatggcaccgcgccagctgggagcaggattacaaagctggccgtgagtacaaaggtggcgaaacccatcaggtcgataccaaaactctggatcaggactggctgcgctttgccaacctgattggccaacgtgagctggccaagatggataaagcgggtgtgagctatcgcctgccggtcccaggtgcacgcatcatcggtggcaagttggaggcgaatatcgctctgccgggcctgggaattgaatattccaccgacggcggcaaacagtggcagcgttatgacgataaagcacgcccatccgtagcgggtgacgtgcaaatccgtgcaatcagcccggatggcaaacgcttcagccgtgccgagccagtgaaagcgtaa

SEQ ID NO: 733 - DNA, 369 bp, Stenotrophomonas sp.
gtgcagggtcatgaacccgcagcggctgtgcccaaagggccgtcgctcaacgatgcatcgcatccggaccacgcactgcacaacgctggccgcagcaagcttcccagcgtgttttccgaagaggctgcggccaatatcaccctgcatgcaaagcagaacggtatcgacgcggccgacaagctgcagagcatcaaggtgcaggatggcaagccgttcgtgatgggcacgacgcctggcttccgcaccgctgtcgatctggcccaggcgccgccgtcgctggagcagaccagtgccaagctgctggcagatccgtcgcaccagcagcaggtgcatgaggagcagcagcgggtcgcgatgggcggtcgctga

SEQ ID NO: 734 - DNA, 1371 bp, Stenotrophomonas sp.
atgtgtcgcagtatgctgtgggcgatgttgcttgtggtcgcaccgttggctgccactgcggcggcaccggaggcgcatgcctgcgaggatgacgcatcacccgctttacgcggatcgcagtgcgcattgatggatgtgccactgcgccatgccgacccatcaggcgagcacatatcgttgttcctgcggcgcatacccgccagcgccgacacgaccagacggggcgaggtctggctgctctctggcggtcccggcgagtcaggggcatccctgtacccgttgatccagacctaccagcgcgcgtttcccggatttgatcttgtgattcccgaccaccggggcacaggccgatcctcgcggatctgccctgtccaggaatcacccgaaagcccggaaggcacggggctggcgggaacggaatggggaccctgcatcggcgccatgtacgccaacctgcaacggacctcggccttctctattaccgaggccgcgcaggaccttggcatcctgatgtcagacgcagatcgcagcggcccggtgctcctgtatggcgtttcttacggcactcaactggcgttgcgcgcgctccaggtcaacgaccttcgcgtggatggcctcattcttgacggactggtgccgcccgaaaccactgaaacgttcgatctcagccggcgcacagcgcttgtcgaccaggtgggccgggacagcatggatgaacgtagcctcgagcgttatcggacgctgctggccgtgaaggatgcgggctggcagaaagaggtgccgggcggcgacgtgcgccgattcttcgccgcgctgctgagcttccctgcgttgcgcgatcgaatcccgaggatcgtgcaggatctttccgccggcgacgaccgctcgctggttgccacggtaaaagactggaacgttgcgctggcacagctgggacagggtggaaacaatcaaccggccttgccgctggtgatgctcattgccgcctcggagaacaacgcccggccggagctcggcatggccactgtcaacgaagaggccaaggacgcgctgttcgtcagccccattcccgatctgctggtgaatggcagcgttccgcgttacccgcgcgatgcatggttcggaacgagtccgcgcaccctcccgcggactctggtgattcagggaacactggacccgaataccgcgtacgccggcgccaaggaacacgctgccacgcttggcaggtcagggcctgtcacgttccacacggtggaccgcggcgcccatctgctggcactggtggcgcctcgctgctttgtagcggctgtcgacagcttcattgagggcgccgtgatcagcgagcgctgtgcagagcccacgccggagtga

SEQ ID NO: 735 - DNA, 2331 bp, Streptomyces sp.
atgtccttcccgagacgtgccttccgccggatgcggaccgtggccctgccactggtcctctccctggccgcaggcggactgatcacgacgaccgccgccaccgcacacgccgcgacgtacggcaccgtgcgcgaggcgttcaacaacacggcgatcagcccggacggcgaacccaaagcagccgacttcgacgccgcaggacgcagcctgtcggccaccgacctcgacaaagcgggctggcgccgcggtacccgggtcacggtcggcgcaacgacctacacacgggccgatgtcgcccccggccaacccgacaacgtgctggccacgggccagaccctcgcgatacagggcgctggcaacgcactcggcttcctggcatcggcgacatcgggccccgtcgccgcgcctgtcaccgtgacctacaccgacggcacttcggcgcagcagaccttggaggtccccgactggagcgcgggcacgacgaccacggcagccctcagcctggcccaccacaacaccccatccggacagcagacgtcccccgcccggctccacgcggtcaccgtgccactcgacccgcgcaagaccgtcacgtccgtgactctgccgaagaccggcagctccgccgcaccgggcgcccccgggctgcacgtcttcgacctctccgtacgcagcacaccctccgctccgggcggaaaattctgggccggcagctggggtgcctccttcgggtccgcccaaccggtggcccagccgggctgggcccagcagaccctgcgcatggtcgtgaacccccacaccagcggtggcaccgcccgtatccggttcgccaacaccttctccccgcagccgatccggctcggtcacgtgacggtcgcagcccaggccgggggcgcgaccgcggcccaggcgcccgtctccctgaccttcggcggcgcagcggagaccacccttccggccggcggggagatctacagcgatcccgtcaccttccccgtcaccgccggaaagaacctcttggtcagcatctacctccccgaccaggtcacgacggtgcccacgcacgactacgccctgacgacctccttcatcagcaaccgccagtcaggagaccacacggccgacaccgccgcgacggcattccccggcacgctctcccactggacgctggtcaacggcatcgacgtcgccgcaaccgagaacatcggaacggtcgtcaccctgggcgactcccagacggatggagcccattccaccccggaccgcaaccagcgctggcccgaccactacgccgcggcgctcaacgccacctcccggcccaccggcgtcgtcaacgcgggcatcagcgcgaaccggctgctgaccgaccgcgccgacatcgccggacccagcgccctgagcaggctggaccgggacgtcttcgcccagagcaacgtccgtacggtcgtcgtctacgagggcatcaacgacctcgcccacgacaacgcctccgcgcaggcggtgacggaggcgatccgccgcatctccgcacgggcgaaggcacgcggcattcgcgtcgtcgtcgccactctccccgcattcggcggctattccgcctacagcgacgccaaggagaccgcacgccagcaggtcaacgccgccatcaggacgatgacggaggccgacgcccccaccgacttcgacctcgccacccgtgaccccgacatgccgtcccagctcctgccaagcatgctgaagccgggcggcggtgaccacctccacttcggtgacgccggtaccaaggccctcgccgacaccctggtccgggcagccgacggacccagcgtcaccatgtcccagaccgcggccgccgacttcaacggtgacggagcccaggacctcgtcgcgcgcgaggactcgacgggcatcctcaagatgtggctcggacggggtaacggcaccttcgcctcctccaccgacgtgaccgccggctggcgagcgttctcccagaccgcggccgccgacttcacaggcgacggcaaggccgacctcatcgcccgcgactcctcgggcaccctgaagctctggaagggccatggcgacggcaccttcggctctgcgatcacggtgacgggtggctgggagttcacgcagacggctgctgcggacttcgacggtgacggcaaggccgacctgatcgcccgggactcctcggcgaacctgaagatcttcacaggcgacggcaaggccgacctcatcgcccgcgacgacaacacagccgacctccgcagctgggcaggccacaacgacgccaccttcgcacgccccaccaccgtcaccggcggctggtga

SEQ ID NO: 736 - DNA, 1083 bp, Streptomyces sp.
ttgaagcaccgacgcatacccagccaccgcatcgcgatcgccggagccggcgtcgcggccctcgtcgccggcgcgttcacgctgaacagcgccaacgcgaccaccgcggacccggccccggcccccgccaccctgtcggtcgcctcggccgacaagctcgccggcaccctcctctccgaactcggggacgaggccgccggcacgtactacgacgcgaaggagcggaagctcgtcgtcaacgtcgtggacgaggacgccgccgagggcgtccgcgagcggggcgccgtggccagagtcgtggagcactccctcgccgagctgaagtcggcccgcgccaccctgaaggccgaggccaccatcccgggcacctcctggtccgtcgacccggtgaccaacaaggtcgtcgtcacggccgacagcacggtcaagggcgcgaagctggagaagctcaacaaggtcgtcgacggactggacggccgggcggccgtcgagcgggtcgccggcgagttcaagcccttcgccgccggcggcgacgccatccacagcggcggcggacgctgctcgctcggcttcaacgtggtcaagggcggcgagccgtacttcatcaccgccggccactgcggcgagcagggcagcagctggtccgactccgccggcggcgccgcgatcggcaccatggaggagtccagcttcccgggcaacgactacgccctggtgaagtacgcctccggcgccgaccaccccagtgtggtgaatctctacaacggcagcacccaggagatcacccaggccggcgacgcgacggtgggccagcaggtccagcgcagcggcagcaccacccaggtgcacgacggtgaggtcaccggcctcaacgagaccgtcaactaccaggaggggtcggtctcgggtctgatcaagaccaccgtctgcgccgagcccggcgacagcggcggctcgctcttcgcgggcagcacggcgctcggtctgacctccggcggcagcggcgactgctcctccggcggcacgaccttcttccagccggtccccgaggcgctctccgcgttcggcgcctcgatcggctga

SEQ ID NO: 737 - DNA, 1290 bp, Streptomyces sp.
atgttcccgacgtccaagaagctccgcaccaccgtcgccggactcgccctgacggccgcctcgatgggcctcgtcaccgccaccggcgcgcagcccgccgtcgccgccgaggtctgcaccggcaccgcctccgtgtacgggatcctcggcgacgggcggctgacctactccgccatcaacaccaagggcgaccggctcaagacgctgatcggcccggacctgggcttcacgcccaaggcgatggccacgctgaacttcaacacgatcctggtgacctccaccgcgggcgccctctaccgcgtggatgttctgaccaacaacaacgccctggaactctccggcgtcgagaagatcgccgacagcggctggacccacgacaagctcgcctacgacggctacggccacctctacggcaccaccgccgccggaaacctgctccagtacctcgtctcccaggacaagccgcagggctcccagcacatcggccagcgcaaggagatcgggaccggcttcgtcctcaagaccctcaccgcgaccggcaaggaccggctgctggccaccgccgccgacggccgtctcctctcgtacaagatcatcggctccgcctggaagcgggacgacctgaagaacgacggctggtccgccttcgacgagctgacctcctccggcggcggcttctacttcggccggattccgaccacgggcgccatgtactggtacaaggacggcaatatctccgacggcagcggcagcgacatcgtctaccacaccaacgacccggtcgacacgtccggctggacccagaagctgctctccgccgcgcccgacaccacctcctgcaagcaggtcaacaccctcggccaggacatagccgccgacgccaaccgcgaggtcggcaacaacttcaacgacttcgacttcaaccacgcccgtgcctggtgcgccgagttcgtcgagtacatctgggcgggcaacagcgtcgaccactcccgtgagctggacgcccgagccatcagcctcaaggagtacggccagaggcacggcacctaccggaccagcggccccaaggtcggcgacgcggtgctctacgacgtcgaccgcaacctgaacgacggcgaggccgaccacgtcaacatcgtcgtcgcggtctcggcggacgggacgcagatccagaccgtcggcggcaacgagagcggcaaggtctccaaggccggctggttcaactgggacaccgcctccagcccggtcggcgccggacccgtcctcgcgttcgtctcccccaagggctga

SEQ ID NO: 738 - DNA, 987 bp, Streptomyces sp.
atgtccgtacagaagcccgccagtaacgcgaacgcgacccaggccgctgcctccccggacaccgcgcagtcgaccaccgctccgggcagctcggtcaccccggccgcggagaacgagcgcgccgcgcccaccgtggagtcctcatccgcccccggctccccctccgaggcggccacgacagccacgtccgccgccgagacgggcgggtcacaggcgagggagtcgggcgagtcggcggcggacgagcagcgcacggccgttgctgtggccgccgcgccggcgatccccgccaggaccgcgagcggcgtcgacagcgggcgtccgcgcaaacctgtcctcgccgtggccgggattgtcggagcggccctgatagccgtaccgctgctgctggcgggtggcgtggacgaggacaaacgaccggagggccccaaggagttggctgcgggagagtcggacaccgtactggatccgggctcggccggcgccgcccttgacgactacgtcgcggagaagcccaccccgacgccgaccgtggagaagccggagccgagcgcgccggtcaaggctgtcgctcccccgccggcgccgaaacccgagcccacgacgagcgcaccggcgaagaaggtcatgccgaagccgaaggccaagccgacccccaagcccgactggacggcctcgacagtccgtgccgtcagcaccttggaggtcagccaggcctggaccaccaaccgcatccgcatggtgatgcagcccgacggcaacctcgttgtctacaacgagaagaacaagcccacctgggcgtcgatgaccttcggcgagaaccaccgggccatcttccagtccgacggcaacctcgtcatccacaacggcgacgaccgaccgatctgggcctccgacacctggggcaacgaaggagccgagctgatcctgcgcgaggacggcaaggtggtcatcgcccgctccggcaaggtcctctggtcgacctga

SEQ ID NO: 739 - DNA, 366 bp, Streptomyces sp.
atgggtcgttcccttggcgtggccgcggcggccgtggccgcgctggccgccaccgccctgccggccgtggccgccaccgacgcggccgccgccgccccgatcaaccgcacgaactgcaaccagaacgactacctggaaatacacaacaacaacggccgcgacacgctttgcttcgccaatgccggcgagatgcccgtcgccatttacggcgtcaactgggtggagtccgggaacaacagcgtgaccttccagttccagcggaatgagagcgacccgcggatcgagaccgtcaccctcggcaagtggagccagtggaacccgggtcagccctacctccacaagatcctctggatcaagattcactga

SEQ ID NO: 740 - DNA, 1701 bp, Thalassobacter sp.
atgttggactttggcatggctcattatcaggccgcgttgggcggtgctttcttaacctttctgggatcgattcccgcagcggcggacatgaacccgaccgaagagcggcttttcctgctgttgaaatccaaacccagtttcatgcgtgcgatgccagcggggcgcgagatgcgggaactggtgtttaagggcagggctgtgccgggtccactggaatggggagagtcgccgaccgagatagggataaagcccattggactggtgacccatgtggcgcgaaattgctcgaatgacacggtcggcgttatcagcgacacgttcaaggccagctatgagcaaacacaatcttgggaagtgactgtaggcacggagctgaccaactctgtcgaggtgacggcgtccctgccgggcgttgtagaaacgacggcgggaacggcggtaaccctgaagttcgaaggctcgaagggcggagagacgaagtccaccaaatcgcatgacgcgggctactccataccggttaagccgggccgcgagctggatgtgcagtttcagatcaccgagcaggtgatcgaaggcaccccgttcagcatcgaaatggagcttctgggcaaggtcgaaatcactcatccaccgcaggggaactgggtgcgctacagagggtcagtgcccgcaaaagccgtcagtgccgggaaagaatggaacgccgccggaacaaaacggcgcgatctgtgggtatgtcgcgcggccggaagcccgcatatcggcaaggtgatcggccgcagatgtaactacggatatggcggccaggagaagacgaccaccaatttcgacgtccttgttgtggcagggctggagacgaactgggtcggtaagtcccagttcgaaagtggtgatgattatgatgaggacatcgtcgcggaaggaaaggcggaggttttctatggcgggcaggagagccgcccgacgaagcgatataaaggatggacattcgtttgccgcgccaagcacaaaggggacttccaccctggcaaggtggtgaccaacgattgcatgatcggttacggtggaaaggaattgcagaagggaagatacgaagtcctgatgcgcggcaaggaagttggcgatgtcacgcctgtggacttgcaagatcacctgccggacgcggcagagcgcaccttcgtcgtggagggcgtgttcgaagacgcgagatccttcggcgccactaccgtgttcggtacctcccgcccggttaaccgtactgtctgcccgggatatgtgccgccgcaaaacgatacctcgatccgggatgtcgaagtgcgaacgtccgagcctgttacatactccggtgattccgtggcaattccggccgcgtataacgatagccgtgagcagccgaaggagccgaaggcacagggggagcccgcgatcaacggcacggttcttgcgaagatttcctacggggaaaacggcgaagcccgtgccacgctggtctcccgcatcctgcgcgaccttcgcgcggatatgttcggggctgacgtcgtggctgtgcagcaagcgttgaacgatgccggggcggctttgcaggtggacggctatttcggcgccaagacagcccgcgctttgcgtgaattccagcgggcgcaaggcctgtccgtggacggggtgttcgggcctcaatcgcaaaatgcgttgggattgtga

SEQ ID NO: 741 - DNA, 672 bp, Virgibacillus sp.
atgccaacttcttatatggactatacaaaaccaggtgtagcgtttttttctgatgtaaacaaaaaccgcttatttactagaaatgatgaaaattacattaatcaattgggacgaaatgaattaaatacactaggtaatgtgtcgatgcttgatatctacttaagtaatggacgtgttgttgagcctcattatcatcaaaatgcttcagagcttgtatattgtatcagtgggtcagctgttgtctctctaattaatcctttcaataatgaagtttctaacatccctataacacctgggcaagtagcaaatatccctcaaggatggtggcattgggaggaagcaaccaataataatacgcatctttttgccatctttgatgcgccttatccagaatatattcttggatcggatatacttacaaaaacgcctgttgaaatcatggcacatacgtattgcttagatcctgaaacttggaaggaagcaatcgctcctattaacgaatccgttattattggaccaacggatgaatgcacaagagaaagagaagaccatcaaggttattcccagccatattaccctgaaactaatacaaattatccgtatactgttccacaatatggatacatgcaaccctaccctaattattattatctaggctacggataccaataa

SEQ ID NO: 742 - DNA, 2481 bp, Xanthomonas sp.
atgaatgactaccagagcgaaatcgcattaatcaggcagtccaatagcctggaagacatagcaagcatcgcacggcagcatgctgccacaacagaaaaagaaggtggaatcctctatagcaggcctatcggaaaggtctcctcggagggggcagcagtcagcctctcgaaggagactgggctgccaatcataaatgacacgccccgagcaaattttctttctgatgaagatgttcgcagttcaatcgaaaagaaagctagagaaatctttgaagatctgggccatgacccgaccacagcgaggaagtctgcaaactcgttcttatacggcgatccgaacgtcccgtcgcaggacccgacgtccctgtcgaggtgcctctggggcgaagcctctcaggagttcgcaagttccctgcgcggtgacatcaaagttgttgcttctgctgccaacctggagcgtgtcttcggtcaggtggaagtgccggccgtcctgaataacccgaatgtcacgtcgttaggcgggcaacctgtcccgaagttgcaggcgctgtatgcccaaggtggcgcaagtgccgtgctgccggaagtgcaaacgcaatttattcaggcagcacccaaaggaatctttacaacggcggaaagcattggaaacgaggtcaaagatgtcacgttttcacgtgagtttgctggaagctttgatctaaaggagacgcacttccggtcatccgcagaactcagtgcctccggtatggtccgcgcacctaccgggcttgatgtgccagccgcgaaccttgcagaaacagcgcttaccgcagaagcagcagcatcgcgcaggctctctcccggcaccgtccgtgggctgggcgttgtgggcgcggcggcggcggtatacgacctgggcggtacggtaaggaacaccgagcggctggacgcgcagggcaacagcactgcggccgatgcagaggtcactcgctatgccacacgaaatctgggcacatttggcggggccatgcttggcagtagcgtaggcgcagcgctcggcgtggagtctggcccgggcttgctagtcacaggtgcggttggcggcatcgttggcgcggtgggcggcgacaagctggccgatgtgatcaatgatcatcgcatttcccaccaacaagatgcgcaaggcaatacgtggcgccttgagaatcaccaagccggagaacggtgggcgcgggacgtcagcactggtgagatcgatcccgctgcagtcgccttcggcgaagccggtgtgccgctctacaagacgcggaccgaacttgccacgccggaagtcgcggacttactgaccttcaaagcatctcgtacgtctatcgagctggcactgggttcgccgccgcagaataaagatccctacacccaacccgccaaagagcacgacacgcgcagcctgcgcgagtcaccgtggctgcacaacgcgaatacgcagcagtggacgcgccaagtagccgatggcctgatcgatcgcacgatgagcacgcacaccgaaacggctagccctcagcgtgcgtcgcaactcgatgaagcttcgcggcaaatcatcaagcagaacgcgatgcacacgccagcagcgatggccgcgcactacaaggagacctacgagcagaatggctgggagcgtcacgcctacatgcccgccgcagtccatgacgcactgaagcatcccggccggatcgtcggctcagacggcgacctctacgaacgtggcaaagatggtcaatggacccatgacggtatgctctgggacagccaggccaagggaaatttaaagcaagagcttgatggaacctacgcagcccagaccctaggcacacagcgtacggctgcacagccggtggcacagactgctgccgaaccgatcaaaacgctagagacgatccatgtcactgcgccgcggatgcaaaaccacgacaacgcggacacctcttccaagaagactcaggaagacacagatgtacgcggccatagcgcccccacacgaccgcaagcatcggggccgcaagatccggatcatcccgatcaccccatgttgaagcagatccgcgaaggcgtggccaaaatcgatgagagcgtaggcaagccgtatgacgaaatgagcgagcgcgtcagccgctgcctgctggcggcgtgcaaggacaatcgcgagcgctatccagaagcaggcaacacctcgctggctgcgaacgcgctacaacgtgtggatcacgtactgatgggcaagaacggcaacctcgtcgcgatcgaggggcgcattgacgacccaacacacaagcgtgccgccatccccattgaccaagctatcaacatgcctttggagcagtcggacgcaaagctacaagcggccaaccaagccattgcccaggaacagacacaaacacgacagcaggaattggcacgaagccagcaacaagatactcagcaagcgccgcgtgtgagtttctga

SEQ ID NO: 743 - DNA, 2481 bp, Bacillus sp.
atggcgtttattcagcgatattcaaccacgactaacggggcggttacttttactggcaacacactgggtctaagtaatataaatatcagttatacagatattggtgcatttatcacattagatttgtctaagcaggtaccaggatatcctgcaggtaccacactagattggaaagaaaatgcttctgctgcacagcttcgcttaccaacgggaagcatagtattatatgcagagctaatttggggtggatcaacaaaaacgagtaccgaggatgtgacgagtgaaatagatcgggccataacgttaatctcaccaaaagggagcaccctcattacgccagatccgactacgagtcagcaagtagctcaggcgaaccaaatattttatgttcgctctgccaatgttactagttttatagatgcaggtggggctggtaattatactgtcagtggtgtaccagcgacagtacaaagatataaagggaacaacgtggggggatggactttatctgtggtttataaagatcctacactgcctcttcgaaatatgaacattcatgtcggaactgcatcgattgagaaaacgggatcagtaagccagaaaatttctggcttctctacgcctgaacttggtgatgtcaaagcaagattgttgctaaccgcaatggaaggagattcaaagattccaggagatcagttactttttggaaaagatgcctcttctttaaagcccatttcaggtcccaataatccgattgacaacttctttgcttcacaaattaatgatgatgcagggaatctagatacgagtggtacctatgggaatgtaaatgtcataccaggaagtgccggaccagcagttcgttataattgggatattaccaatgtggacgcttctacagctatggagaactcacaaacggaggcattagttcaactgacttcgaaatcagatggttatatagtgacaggtctgggtgtccaaattgatgtgaatagtccagaaatcaaaattaataaagaagtagataaagaagcagctatcgtgggtgaaatccttacttacactctattaattgaaaacagtggaatgaccgaagcacaaaaaactattttaaaagacactcttccaccagaattaaagtttgttgaagacagcttacagatcgatggcgttcctatacctggtggagatccgacaaaaggagtagacattggttccatatctatcgaaggcccgacggaagttacctttcaaaccttagtattaaaagtgccaccagacaatagagcggtgaataaagctactgtcgtgtatgatttccaaagtgccccaggcttaccggtctcttcaggtacagcagatagtaatgaagccattacggtcattcgaaaagtagaggtagaggtagtgaaacggcaagacatgtcagtttatgtcaaggcaggtaacattataacctataccattgaagttgctaatacaggtgatacacaactgaccgatgtcgtaattgaggatcaaattccaaatggaacgaagttggttacaggcagtttgcagatagatgggcgccctttctcaggcaatatagaaagtggcgtgaatattggtacggtagagcccgggacgacgacaagagtcaccttccaagtgttgattgataacccagtgcctaagaaagtgacaaacaaagcaaaagttgattataaatataagcttattcctgatggacaaatttatcgtaaagtagaaatgacgaatgaagtgacagctattcacgaaagcaattgtaaagaagcacagaagaaaatcgtgacaggtattggagaagctgagttagcggctgcaggagtaatcgtagcagaaaaattaaaaatacaagatgcaattcgggccttcaacgaagggaagcagagtgcagaagaattactcaatgagaatgaacagttgacccacaaactaacaaaaacaattttagacgaaaaattgcaacaagatacattgcaaaaagcaaaaatactttgttgcgatggtattgaagggattgactacagtggtgtctatatcatcaaaaataaaggaagtcaaaaagtattagatatatctagcgcctcaaaggataatggtgtaaacgtccaacaatgggattataacggcggagatcatcaaaaatgggaactagagaagatggcagatgggtattataaaatcaaagcagttcatagtggaaaattgcttactgtgtccggagcttcaaacagtgatggtgcgaatgtagaacaatgggaagacattggtggagatcatcaaaaatggaaaatcgaaaaaaattcggatggaacgcttaaattgatagctaagcatagcggccaattacttgatctgaagagtagtatacaaaacaatggtgctaatattcaacaatggccagacaatggtacagatgctcaatgttgggaattgacaaaattaaaataa

SEQ ID NO: 744 - DNA, 2436 bp, Bacillus sp.
atgaatcaaaattacaaaaacaatgagtatgagattttagataatggtaatgcaggctatcaaccaaggtatccgcttacgaaggcaccgtattctgaattacgaaatatgaattacaaagattggatgaataggtgtccaaatagaatcgctgttgttcctgcggaaggttacgatgtaaatataagagatgcagtcattacaagtatcaacatcctcacctcccttctttcacttgcaatcccagtagctggagtagcgggagggatcatcagtgcaatttttggttggctttggcctactaatacagaggaagtatggcaggcttttatgtcagcagtcgaagatctcgtggaccaaaagattgacgattttgcacgagagcaagctattgcccggttacgtggtatgcatggtgtcctagagttatatgaaactgcagtaagtaacttgcaaaaggatcctcaaaatgaaagactaaaagaaaatgtccgagatcaatttgtagccactaatacatttgttgttggttcgctgcccctgtttcgtgtccgtggatatgaagtacctatgttagtggcttatgcggaagcagctaatctccatcttcttctcctacgcgatgcggtaaagtttggaacaagttgggggatggatgcagccactgtaaatggctatcaaagaaaccttgagactgggataacagtttacacagatagttgtgtggagacatacaacaaaggtatagaaaaaactaagacattaaaagcaaatgtaaaggattatgatagatatccatgggcacaataccatgatttactcccatctttaggtggtagtcctgaaaaggattttcaaaatatagaaaattggaatttattgaatagtttccaaagagacatgacccttatggcattagatcttgtctccatatggccaacatataattcaaaagaatatccattgccagtaaaagcacagctcacacgagagatatataccgatttacgtggatgttatgcgggggacataaacagtacggaagctcaaatagtcagaccaccacatctgtttacattctttcaatcagctaccctatatacaggaaataatccttttactccgtatgttggtattcaacagagtggacattacactttaggaccaagtttcacaaccgcggtcaatggaatctctgaaggcgctcctaataccgttactgctaacccgtcagatgcgattatcaataaagttgatatcgataccgggaatgaactatatcgatttatgttttaccaagaaaattacactcaaccatttaaaaccgtgggagagaattctagtctcgggtatgtgagaaccataaatcgaattcctattgagggtgatcaaacgctagctaaccacagaatgtcatggattagcggttctttgcgtccagcatcgaccggtccaatgggaacccagattcctccttacatctcgtgtgcagctttaggttggactcatatcagtgcaaatcgagacaataggattgtttcggatagaatcactcaaattccggcggtgaaggcgtactggaatcgaggtgctttttcagttgtgaggggacctggttcgacaggaggggatttagttcgattaagctcttctggtgaagtgtcaattaaggtgagaccatcgcgtactggtatatttaactatcgtgttcgaattcgatatgcggctgtagcgagtggaaaacttaatgtcaaaaagtacgttaatcatatacatgcttctacaacgtatgattataaacaaacgactgctggtaatcttacgtattcatcgttccaatatttggaggtttacaacttcactctagcagaatctcaatttgaggtctggctcaccaatgagaccggcggtcctatctatatcgataaaatcgaatttataccgttaacgccaaaaccagaaccaaagccaatagtaccagatggtacctatcaaatcgttacggctttaaataatagtagtgttgtagacctggatcagagtcccactcctccaaattgggcttcacctcgaaatgttcaattatggggaaatggtaacgctactaatcaaaaatggaagttcgtatatgatgaaagtaaatatgcatatcaaattataaatctagcaaatccgaaggaagtattaacctggtctttcaatgtagagagactatccgaggtgaatgctgtaccaaaccagcaagataaccgccagtattggatacctgaacatgcaggaaatgggtatttttatttgaaaaatatggaagatgcaaacgaagcatacggagcattagatgtaagtaatgctagtactgcaaatggaacgaagattatatacaatggctttaatggtggcacgagtcaaaagttcaaactgaataggttgagttaa

SEQ ID NO: 745 - DNA, 3774 bp, Bacillus sp.
atggatcaaactattaccaaaatacgagcggcagtccattctttgttttccaatcataatttacaattgagtatcactgattatgacatagattatactgcatatcttgtggattgtatgtctagcgatatatgttcgcaagaaaagatggcattacttgatcaaatcaagtttgccaaacgtttgagccgaaaacgcaacttattaaatgacggagattttagattatccaattggtcagatgagaatggatggagaagaaatgctcatgtaattttcgcatcagactatcaaggacgatacgcaaacatgccagctgcgacaacagcggaaaatggaacaatcgtaccgacctatttgtatcaacaagtaagtgaatcaaagctaaaaccgtatacacaatatttggtacgaggggttgttgaaaacagccaagatttggaggtatttgtattacggtatgcgaaagaagtatccaaaaaaataaatatattaaatgataacagctaccccaatctattacatacgaatagagacgggcatcagtgctatgagaggtatccaaaacaaatcatgattcaaaattcgattgatagatataaaaaaccacatgaatttacatatcacattgatataggagaactgaatctaaacgaaggacctggcgtatgtgttggttttaaaattagaacgacagatgggatagcaacattagctaatatagaaatggtagaagtacagccgttaaagggagatgcgttagcacgtataaaaaagcgcgaacaaaaatggaaacaaaagtggattgagaaacgtatgaagattgaagaggcggtacaagtggcacaagatgctattcaacatttatttacatgtccacaacaaaatcgattgaaatggactacttccctgacggatattgaatatgcagagacactgatatctaagatcccatattcgtatgaccaactttctttgggggagttcccaatgttaccaagggaggcatatgacatccttcaacaactttcagcggcagtcacgaaagcacaagcgttgtatgcacaacgaaatatagtaagaaatggtaatttcagagatgaattatcaaattggaatgcgacaggtggcatagaagtacaaccgagtcagaacacaccatctatgttagtaataaaagattggagtgcaagtatttcacaagatgtgtgtgtgaatccagaacatagctatctcttacgtgtgaccgcaagaaaagaagggcttggaaaaggctatgtaacaatcagtgattgtatggaaaataatactgaaaccatgatatttgtatcagatgaagaaaagatggtatctactgaatcccttcgtgatacaactatagagagtgcgcgtataggagaaacgctagatacagggagtccaaatagaaattacccatcagagagctttggatttacgccatatgatgatcaaaatcaaatgatgaatcagtcacctaatcagtatgaaatgaatgtgtactcgaacaacgttaacacgacaaatggtcatgaattaggatgcggatgtcgtacaaatgctcactctagtgaatgtaagagcatgtatacatcatctaaccatgatgaaaggaacgcatatcttacaaacggaaatagcataactactaatgagacaatattgtcttcctctccaatcccagtacaaaacagctcattcctttctggctatgtaatgaaaacagtggaaatcttcccagaaaccaatcgtgtccgcatagaaatcggagaaacagaaggtacatttatagtgaacagtgtggaattgattcaaatagaacaaataaatgaaatgaacaatcaatctgtagatgttcaaaatgtagcttatgatacgaccattacacaatctaatcccgtttcttttacagaaatatcggcgagtcctaggcacactcattatgcatactctcatgattcaaatataggttatgaaaatcctaactggatggctgatattccagatgatactatgtttagtgatttatctatccctggtacacataatacaatggctctttatggaggagatgttacacaatgtcaaacgatgtcactgaatacacaattatatgcaggagttcgttacttagatatccgctgtaggcatatcgaaaatgtttttgcaattcatcatggacctgtgtatcaaaatgcgatgtttggagacgtttgtataatcgtaagggattttttgaggaaaaatcctagtgaaacagtatttatgcggataaaagaagagcatacaccggaaaacaatacaaggtctttttcggagacattcgcagattataagtctcaatatagcgaattattttggaattggtcaagtgataacccaaaattaagtggaataagaggaaaagttgttgttttgcaaaatttttctggggacagatttggtatctcttacaatacactaaatatacaagatcaatattctttaaatacaaactgggatttgtatgataaatggctatttgtcaaagatcatttgtatgccgctgacgcctcttataaaaatggccgtaaacaagcgtatttgaattatctaagcggatctggtggttcgtttccttattttgttgcaagtggacatagtagtcctggtacaaatgcctcaagattgtctacaggcctaacaacaccagcttttgcgagttggtatcctgacttccctcgggtaaattgttttatcgggatatgcacaattgcatttgaaggaacgaatatacttacaagcaattggatagaaggaagcgattttaaatatgtgggaatcatagctgctgattttccaggcggagggttaattgacaatattatttatctaaacataggaaaaggaacagtgcaggatggtacctatcaaatcattacagccttaaataatagtagtgttgtaaatcttgatcttaatcaaccgcatgacaatgttgtcttatggaataataacttcagcaataatcaaaagtggaagtttatatacgatactactaagtcagcatatcaaattaaaagcgtactaaatgaaaacctagtcttaacttgggcctacgatagtggtgacagagacaatgtagtcgctacttcaaatcaatataaaacttcgcagtattggaaacttaaatatatcggagggaattatcgctttataaatcttgttgaccttgaaggggcattagatgtaaataatggaaacactggaaacggtactcaccttctatattggaattttcaaaacagtagtaatcagaaatttagactcattgatactagcaagggaataattcaagatgggatctatcaaattgttaccgctttaaataatagtagtgttgtagatatgaatccagcagataaaaatgttcacttatggcaaaacggtaacgctaacaatcaaaaatggaggttcgtatatgatacgagtaaaggtgcatatcaaattagaaatctctcaaacgagaatttagtattagcttggaatgattttcaaggttcaaataatgtatttgctacacttaacttgttttatgatgagcatttttggataattgaaagttctggggatggatatttttatttgagaaatcgaaaaaatgttaataaagtattggatataactaatggaagttctgcgaatggaacaaatattatagtatggaattatcaaggaagtaataatcaaaaattcaggttgcaacaattaaattaa

SEQ ID NO: 746 - DNA, 4710 bp, Variovorax sp.
atgaagatccggtatttcctgatggcgttcctggccccgctcgtcacattgctgacgcatgcggccatcaccggggtcagtccgatgacgaccctcaacaacatggcaacggccgcagccgaagccgtcgccgacccgctcccgctgcaggggccgggcctgggcaatctcacctatacatcggcggaactcttcaagccggtgtcgatgatcacgagcctcgcgcacccgctcgatccggcgcacagcagcgcctacgagtcgcgcgaggtgcccgccacgtacccgggccgcaaggactacggcatgaacgcgggcatcatggtcaacggctacttcctcacttccttcgcgccggacagcggcctgggcccggggggcttcctgctgtacgacgtgtcgaacccgcgccagatccagctggtcaagaagatctacgaacccgaggcccgcaccaaggagttccgcgaaacgcactccttcggcacagcgaagatcggcggcaagacgtacgtggtgttgcccagcatctacggcgtcgagttctgggacttcaccgacatcaatgacatcaagcaggtgaagaagctggcgctgcccggcgtcaacgccggcgactacgaagacgtcagctggcagctctggtggcaggcgccctacctgtacgtggcctcggcgggccgcggcatcttcatcgtcgatgccggggaccccgtgaacgccgtggttgcgaaccgcggcgccggcaagcccaacccggtgcccacgggcgaactcggcaacttccggatcggtccgatcttcaccatgggcaaccacatggtgctgaccgcgatggaaagcaacggcggattcgcgagcctggatatctccgatccgctcaaccccaaggtgctcgattccatcgtgggcaccacgccgttctactacgccacctgcttcgacggcaggaacctgcacgcctcgacgcgcggcagcggcgccaggatgtacagctacgacctgagcgaccgctcgcgcttcgtggccgaggacaaccggctggtcatcgacgaacagctgtattgcgccacgcaggacaactatgtgatccagggcgcgcaaacgcgcatccacaaggtcgacgtgagcaatccgctcaatcacgtggaggtgggccgcggcagcatcctgcgcgaggacgacccgaacttctcgcattcggacaacggccaggtcgcgatgttcggcaacctcgtcttcgtgggcaacgaccacggctcgggcagcggcttcgtcgtgcatgcggtggaccccgacaccaccagacctgaagtgaaacaggtttcgccggccaacggcgcgaagcagcaggcgctgacctcgcgcatcggcctgggcatgaccgacagcatccggcccgagagcgtcaacgccaacaccttcatcgtgcgggcggtgggcggcaacacgctggcgggcacctacagcgtgcagctgggcatcatcaacttccaccccgagcagccgctgtcgccgggcaccagctatgaagtgttcctgcccgccaacggcgtgaaggactatgcgggcaacgccatcggcgcggactacaagtcgaccttcaacaccggcaacgcgaccgacatcaacctgatgcactactggacgctggcgggcaacctctccgaccagatcggcaacaacaacggcacgccggtctcgggcgacgcgttcgaaagcatcggcatgagcttcgcgaaccgcaccgccggtgtgccgctgaagaacgattcggtggccaccgtgctcggcggcaccgcctcgctgagcttctacatgaagaccacgcaggcgggcggcccgaactcctggaccgcgcccggcatcttcgggcgcgaccagtcgggcggcgcggacgacgtgttctggggctggctcgacggcaacgggcgcatcaagctgtcggtgggcaatgacgccggcaccacctccacggcggtggtgaacgacggcagctggcaccacgtggtgttgacgcgcgacgccgcctcgggtgcgcaggcggtatacgtcgatggcgtgaagaccacgtccaccgggctcacgggcaacaagggcctgtcgaacaagttccaggtgctgggccagatccagggcaacgctgcgctcttcaagggcacgctggcggaggtgcgcgtctacggccgcgtgctcaccgacagcgaggtgggcacgctgcgtgggcaggccatcatcggcgacccgggcattggcggcgggccgaagatcgtcaacggccagctggtcttcgacccggccacgctcggcagcagcggcgcgcagttccgctggaacttcggtgacggcacgcaaacggcctactccacccagccgcgctacacctatacctacacacggccggggcactacaccgtgacgctgacggtgcgcgacgcgagcggccgcgagaccttctacacctacaacctcacggtgatcgtcccggtcacggcgcgggcgcccacgcacacgaccaacatcgcaggcgatgcgaattcggtctactcgctcaaccccgacagcggcacggtcgccgccatcgatgcgcagaccctggcaaagcgctgggaagtacgcgtgggcgacgagccgaagacgctggccgtgggccccgatgggcgcatctgggtcacggtgcagggcgaggacaagctggtggcgctcagcgcggccgacggcagcctctcggccaccgtgccgctggcctacggcagcggcccctacggcgtggccttcacgcctgacggcgcgaagggcctgctgacgctggagagcaagtcggtgctgatgagtttcgacccgagcaacggcaccaccaccggcgcggtcgccctcgaaggcagcctgcgcggcattgccgtgagctccgacgcgcaggtggcctacgtcacccgcttcaagtcaaggatgacgggcggccagctgcacaaggtgaacctgcagagcatgagcgcgatgcccacgatcgcgctgccggtggacaccaccacggtggacaccgagagccgcgcgcgcggcgtggccaactacctgagccaagtggtgatctcgcccgacggcaggcgcgcggtgctgccttcgaagaaggacaacatcgtgcgcggccgcttccgtgacggtgtggacctgacgcacgaccagagcgtgcgctccatcctctcgcaggtcgacctgcaggcggccgcagaagtgttcgacgagcagatcgacttcgacgaccgcgcaccggcgcgcgcggcgctgttctctccgcccggggactacctcttcgtggcgcagatggaaggcaaccgcgtcgccatcgtcgacccgtacagccgggcggtgcgcggcgagatcaacgcgagcagcgcgccgcacggcctctacctggacgcagcgcgcaagcggctgttcgtcaacaactttctcgcgcgctcggtgtcggtgcacgacgtggcctcggtgctgtcgtcggaatccgccgccgcgatctttctccagaacgtctcgacggtggcgcaggagcccatggcggccgcggccttgcgcggcaagcaggtgttctacaacgcgtccgaccggcgcatgagcaaggacaactacatctcctgcgcgagctgccacgcggacgccggcgacgacggcatggtgtgggacttcacgcagcgcggcgaaggcttgcgccgcaccatcagcctcatgggccggcgcggcgcgggccacggcaagatgcactggaccgccaacttcgacgaagtgcaggacttcgagaatgacatccgcaacgaattcggcggcaccggcttcctgacgaatgcggatttcgccgccacggccgaccccttgggcgcgcccaaggccggcaagagtgcacaactcgacgatctcgcggcctacctgagttcgctgaacaagtacatgcgcagcccggcgcgtgcggcggacggcagcctgagcgtcgaagcggtgcgaggccagacggtgttcaacacggcacagtgcgccacctgccacaccggaggcactttccgcgacggtctgcggcacgacgtgggcacgatccagctctcctccggcaagggcatcaaccagccgctggcgggcctgggcttcgacacgccgacgctctcgggcacctggaacaccaccgccttcttccacaacgggcaggcggccaccttgcaggacgtgctgaacagcggccacggcaatgcatcgagcctgccggcgccggatgtggtggcgctgcgcgagtacgtgcgctcgctggacacggccccggcggtggtcacgcggatccgctcggacctcaacccgacgatgtgcgtgaacatcaagggcggggcgaccgcaagcggcaccgtggcggtgcagtggccctgcggcaccgcgagcaacgagaagttcacggtgacgtcgatcaccggcggctatgtgcagctcgtggccgagcacagcggcctgtgcctggcgcagaacggcaccgcgacgaccaacgcgccggtggtgcagctggcatgcacggcgggcagcacggcgcagtggagcctggtcggcggcaccctccgcaaccgcggctcgggctcgtgcctcgacgtgcccaatggctcgacgacgcaggacacggcgctgatcacgtggacctgcaatgggggcaacaaccagaactggacgcagctgccttag

SEQ ID NO: 747 - DNA, 207 bp, Actinomyces sp.
atggacaagttcacccgccgcaccaccaccctgagcgacagcgacttcagccaggccgtcagctccgagacccaggcccccatcgagggcaccgaagaccttagctgcccctgggccccatccgtatgtaaccgccactgccttagtcacggttacaggggaggctattgcgccggccccatcaagctcgtgtgtcactgctactga

SEQ ID NO: 748 - DNA, 1065 bp, Arthrobacter sp.
gtgaaaaaatccttggcaactttcaggaccctggccgtgtccggagtcctggggctggccgtcgtggcaggacctgcaccgctggccaacgctgtgggtgaaggccccaactacgacgggaacggccagatcaccacctcgaaactggccacctacgaccagatggtgtcgttcctgaaggaccaggatgcgcgccagtccgccatggagctggaggtcatcggccagaccgtcaaggggcgcgatatccacctggtcaagtacatctcggacccggccaagcccaccatcctctacttgacccaacagcacggcaacgagcagctcaccaccgagggtgcgctggaattcgtcaagcacctggggacgggcaagtccgcagacatcctggacggcgtgaacatcctgatcgttcccatgctcaacgcggacggcgccatgggggacgtgaacttcccgttggacgattacctggcaaagggtgaccgcaacatgacccgctacaacgccgaggaggtggacctcaaccgtgaccatgtagccaagatccagccggaaacgcaggcgctgcacaacaacgtcatgcgcaagtacaacatcgactacatgatcgatctccaccaccagggcacgcgcagcgaacgcgacggggaactggtatcaggctccatcctttaccccaccacgccgaacgccaaccctgctgttgtggagaagtcgaagcagctgggcgccgtcgtgttccacaacgttgattccaccggctggggccacctgggcaagtacgttggcggaagcgccgaaaccatcagccgcaacgggattgccgttgagtacggcatcgcaacgctgctgttcgagatgcgtggcatgtccgaccactacctggatggatacgccctggggctcaggagcaacggttatctgattaagcagacagtgactacgctgaccgccacagcggccgccatcgctgacggatcgattgccggcgcggacacctccttctgggacagcctggccacccagacctcccgcccgggcggggaagccgacgacgagtag

SEQ ID NO: 749 - DNA, 825 bp, Bacillus sp.
atgaaaaagcaacttgttacagcaacaacggcagtggttttggggacgactttgtttgcgggcgcggcgtctgcgcaaacgattaaggtaaaaaaaggcgatacattatggggactttcaaatcggtatggaacgtcaattaattccattaaatctgagaacaaattaaaatcggatatcatttacatcggtcagacgctttcgatcaacggtaaatcatcttcaggttcaaattcgggcagcaagtcatcatcgtctacatataaagtcgtaaaaggcgacagcctttggaaaattgcgaataaatataaaatgacggtaaaccaattaaaaagtttaaacggtttaaaaacggacctgatccgcatcggacaagtgcttaaagtaaaaggatcaacttccggttcagcgtcttcaggatcttcgtcatcaaagaagccttcatccagccataatattgcacagacgagcctgaatgtaaacaagctggtttctgatgcgcaatctttaatcggcacgccgtatgtatggggcggaacaacgacttccggctttgactgcagcggatttatctggtacctgttaaacaaacagacgagtgtcggcagaacaagcactgcgggatactggagctcaatgaagagcgtatccagcccgtcaagaggagacttcgtcttctttacaacatatcaagccggtccttcacacatgggtgtatacatcggaaacaacaagttcatccatgccggttctgacggcgtcacaacaagtgatctgaataacagctactggaaaccgcgctacctgggcgcgaaaagattctag

SEQ ID NO: 750 - DNA, 387 bp, Burkholderia sp.
atgccctctcccgcttcccttgcccgccttcgccccggcacgctgcgcgcggccggcctcgcgctgctgccgctgttgatcgccctgcccctggccgcccaggccgccagcttcgattgcaagcaagccaggcaggccgacgagcgcgcgatctgcgcctcgcgcgcgctcagcgagcaggatgtggagatgtcggtgcgctacgagatgctgatggggctggtggcgatgggcacccgcggcgacatgggcgaggcgcagcagcagtggctcaagcgccgcgcgcgttgcggcgcttcgcagtcctgcctggccaccgcctatcgcgagcggatcgacgcgctcaagcagcagtatcggcaattgcagagccgcgggccgttctga

SEQ ID NO: 751 - DNA, 492 bp, Collimonas sp.
atgaaaggtttcactccaggattgtttgaccggttgatgggcggcgacaacacgcctgcgcaatccgatctggtagtgcgattgtcgatggatgccttgaaagacacggtcgcccgcgaccttgaggccatgctcaatacgcgcaccgtgattcccgaagaattgctgaagaatttccccgaatgcagcaagtcgatactgacctacggcttgaacgatttttccggcatgagcctggccagcctggatgaccgggcgcatatctgccagtgcctggaacagggcattgcgcgccacgagccgcgcctgaggaacgtgcgcgcctcgctcgagctgcgcgaaggatcgatcaaccgcttgaattttgcgattgcagccatgctggtggtggggccggccaaggaagccgtgagcttcgacgccgtgctgcagccgtcgaccttgcaatattcaatcagcagagcacgccgcgcgatgcggatggacggttaa

SEQ ID NO: 752 - DNA, 2280 bp, Collimonas sp.
ttgtttcgcctgatcttgagcgccatgaaaaaattcctgcttttttctctgtccggcacgctattgctgcttgccgttttttccagccaggcgcaggctgcaatcgtgctggagaacccgctctggcacatcgtgctggatccgggcacgctggcgattcgcgtaacgcctgccggcgccgccgcggtccaggtttccgacggcgtcggcagccatcgggtcgcggccctgcaaagcacagccgaccaggccggctggcaatgggacgacggcgcctaccgcatcgaggcaaaactcagcgagcgcgacctgatgctgaccgtgcgcgccaatgcggcgggcgcactgaccttgatcaggcaaccgggaagcgcaatagggcgtggcctgatcctgccgctggcggagggccactatgtggcgcgcgacaacaaggtgtggaatgacttcatcctgcaaaagatggggcgcctgaataccacgcaagatctcagcctgccgttgtggggcatggatcacggcaagttttccctgcattggctgctgaccaatccatacaataaccagcttgatttcagcgctgacggctccggcctggcgctacaggccagccacactttcacgcaactggcgccggacacgccgatgacgctgaccttgcacctgggagacggcgatctgctcgccggcgccaagcactatcgcgcatggctgctggccgaaggccgctttgaatccctggcggaaaaaacggcaaaaagtccgggcgccgccaagctgatcggcgcatcgcatgcatatctgtggggcagcggactgatcgccgccaaagatgtcaggagctggccggctttcctgaggattttgcgcagcaagaatccgctggcaatcgacctgcgccggcatttcgcgccggaaagcaggaaagcattggcggaagccgggaccaaccctgccaggtatcaggaaaaaatactcgtcggcgccttcaacgccggtctcaacagcttggctcgcgaagcctggcagaccgacgcccccgacgtcaatcgactggccagccgctatggagaactgagatcggaggtggcgcgggcatttggcgcggccctgaatgccgatgccaaggattggggcggcggcgtttccggcgctaccatggagcagctgcgcaaggcgggattggcgcgcctttggctgggcctgggcgaaggttgggaaggcggcttgtggcatcccgaggcaattgccgccggcgtcaaggcaggttatctgctggctccctacgattcctatgaaacggcgctgccgcgcggccacaatccggattgggccaccgcgcacttcggcgaaaagacctatcgcgattgcgccatcgtgctcgatgacggtcgcttcaagaccggctttaacggcttcggccactacactaatccgttttgcatgcggccgttgatggaagcgagggtgagggccgtccaagaaaaagccggattcaatagctggtttctggacgttaccgcggccggaatgctgttcgatgactatcgccggagggccgccatgaccatggcgcaaaatgcctacgccaatgcggccagcacgcgctggatttccgaagacaggcaacttccggccggttcggaagacggcaatgccgtgacggcgcaaggcatattctttgcccacggcatgcagacgccggtgatcggctggggcgacaaggagatgcagaaggacaagaaatctccctactacctcggcaattactatccgccggaagagcccagcaacatgttcaaggcagtgccgctgaaagccttgtatcgcagcatccatttcgatccggccgcgcgcttgcccctgtaccaggcggtgtttcacgattctgtcatcactacgcatcattggctgttcgataatctgaagctgaccaatgtgcgaagggaaaacgaattggcgcagctgctctataacgtgccgccgctgttccacttgagtgaaggcaccttggcgtcgcgcctgccgctgatgcagcgccaggacgcgttctttcgtcctctgcatgaaaagctggcaaaccaggctctgaccggattccgctggctttcagccgatcgtctgttgcagcagaccggtttcgccgacggcacaatgcaagtggcgaatttttccgccgaggaacgcagtttcaatggccggcgttttcctccatatagcgtgaccgcattgactgccgacggcaaaaccacggtgtttgtcagcgaggacgggcgatag

SEQ ID NO: 753 - DNA, 1512 bp, Collimonas sp.
ttgatcgaggagagagacatgagaacaatcgtatccaataccctgctgctgggcctggccggcgccatgctggcggcctgcagcgacggcggttcgtccggcgtttcgagcgcaagcctgcagcaggtttcggccaaggccagcgccccggcttgcgccgccgcctgggttgccagcgccatctacaccggcggcaacagcgccagctacagcaacgtcaactacaccgccaactggtggacccaagggaataacccgtcaaccgaaagcggccccatcggcagcggcaaaccgtggacgtcggccggcgcctgcggcgacgccgcaccgccggttactccgccgcctgtcacgccgcctccgggcgccaccaccggaaccatcaatttccacctgctgctgggcgcaggctcggcgcaggaccagctgctgctggacggcggcaactacaacgacctgatcatgtcgaacatcgtcgccggcgtcatgtatgggcacctgctgcagcaatactatcccggcatgcagttccagaaagactacctgtacggttcgatcctgggccagctgctgcaggagaacatcgccaccggcttgtacgtcagcagcggcaacctgatcgacccgtcgcccgaccagcaggcggtgatggccaccggccagggcggtccgtaccagatcaacaattacgcggccgacatggtgtcgggctcctatgcgccggccggccattcgctgatcaactacgtcgccatccagaaaaacatcggctacaccatggccaacgcggcccagcagtacagcaagccgacgccgccgtcgttcaacaacaagtattacgggccgatgctgaccgcctacttccactacaacgactttgtcgccctgatcgtcaccggcaagggtatgggcggctggaccacgccgtggcagccggattacgacaatgcgctggtcaagttcaccaagctgccgaacaacttcctggatgtgctgctgaacgttgcctacaaccagggtttctacggcaccctgatgagcagctacagcaagctggcggcaaccgctaccgcgtcgaccgtaaccagcgtcaatgcctacagttcggtatggggtgcgactgacacctacaagcagtatccgtatcaggtgcgctactacctcgaccagctatatgacaacccgatcccgaccaccagcgccaccactttcgtgacgcccgccaaccatgtcgccttcggtgtcgcggcgctggaaaccgtgttctccaacgtcttccagactctggcgtatgtgaacggctcggggcaatcggcctatatttcggcggcgcaggcgcaggctgcgttcaacagcgcactggccacggccgaggtcgccgccggcgccaccctggacttgagcaatgccgccaaccgtgcgcagatcttcagcgtcctggaaaaggcgatcggcaacctggagaccagcctgaacaccaagttcaacgccaccaccagcgtccagctgtaa

SEQ ID NO: 754 - DNA, 1263 bp, Collimonas sp.
atgaaactacctgcagcatggcttattcctgtttgcggcgtattggcggcttctcaagcgtctgcgtgggaaaaatacggcatccattcggtctacccggcggccatcagcgtccagatcaatccgtcgcaaatatcaaaccagcaactggcggccatcaaggatgccggtttcgaatacgtcaggttcggcacccgtccgccggtcagcgacaagccgcaggatttttcggaactgctggagcgcttgcgcaaggcgcagctgaaacccatcatcaccctgtttggcggcgccacggtctgggtacagccgaaacggatgatgtcggccaccatgacgccgctggatgcggccgacaatttctccaagtttgccctgaccaccttgaaccagtacgccgatccaaacatcttgtgggaactgtggaacgagccggacaatccgactttcctgaagccgggcatgctgcaagccggcctggtgccggcgatacagaaaatctgttcggcgctggagcagcaaaagggcggcgtcaagaaaaacatcttcggtttcggtttcgccaagctgccgaatttgcagccgaagatcccggacgacaagctgctcgccatctcgctgcaaaactgcctgagcggcgtgtcggtgcatccgtaccggaaaatccccgaaacgttggccgacgatgcgaccaaaagccgcgagctgctgcacaagtacggcaagggcgaattgccgatgattgcatccgagtggggatactctaactttaccgccgccagggaccagggcggccaggcgcagctggtgctgagggagtatctgtcgacggtatttgccggcattccgctggtgaatatctaccagtggcaagacaccgggtcggaccgcgctgcgcgcgaacagaattacggcctgaccgacagcagtggccaggtcaagcaggctttgccggcgctcaagcatttgctgggcaagctgaaagatacccagcttgccggcagcgagaaagtaggggaggcgtaccagctggtcttgaatagccagccgggggctgcggcaaagcgcagcgtccacgtcgtatggagttcggcggcgcgctctggccctggcggtggtttttcgatcccgaggaacaaggggcagcgctgcatcatcagtgagttttatccgcagcagggcgacaagccctgcccggaaggcgccggcagcgtcgatatcaacgctggtccgtcgccgctggcagtcacgctatacgattag

SEQ ID NO: 755 - DNA, 1506 bp, Collimonas sp.
gtgattgcatcatccctcccaatcgtggcctttatcggtgactgtatgaaacgaattttcacctgtgcgctgattttcttgttcgtggctgtctctgctcaggccgcaaccgccgggtattctggctataccggtgctgccagtattgtcaatggagtgccaggcaaggttgctactgcatcgcttggtgcagtggttgatgctaccgtgttggatcaggttgtggtggctactgaggctggtgcgcgggttactgtgcctgtctcaactactgctgctgttgctgctgagggtatcgctggggctggcttaaaacttgttccttatcttggtgctgcgctgactgctgcacaagtcgcttccatgttaaaaaatgctggtttgcgctatggcagttgctcggctcagtcttggttcgggttgcctgcttattgccaacaaccgccagctgctgaccagtatctctggcacggtggtttcggctctaattcttcagtcccatatcctgatcccacttcggcgtgtcagggtgatatggctgcgttgatcaggtccaattctacttgggccggttggactatgactttgggtagctctagtgggcctgatgttgtgggttgtgtactagttagtcccactggtgtcgttggctcttcaaattttaccgttgctagtcggtatctaaatcctaatcccggtcagttgccgccgcttgcgcctgctactggcgatgacatagctggcgcattgaaacttcaggctattcaggacagtaatgcgcgtaaagcgctgtatgacgcaattaaatctgatcttgctgctcatcctgaatatcagacagccgataccaatcctgtgcagccgtctacgcctgcgtctgttaccgcctcgcctgtaatcagtccgaccgttacgacgcgtgttgatactgtccctaagtctgacggttcgactgacactgtaactacctcccaatcaactactgttaatccaactacgaccggaacgactgttggcgatattaagaccacttttccgagcactacgactacaacggttacgactactaacaatgtgaccaatcagaccaccacaaacacttctgttaccagtaatcctgcgccttctcctgagttaaaaattcctgatgactacaacaaggaagtcactcagaagcaagttgaaaaagatttgaacactgatgctgcgccaccaatggatgatcagcaaaaagttattactgatgcaaatacaaagggtgatacggatcgcgacaaaatatacgacgacattaagtcgggtcagcaggataagagtagttggttttcttgggtgtggtcgcctcccgttggcgtctgtgcgccgattaccggcgttattgctgggtttcatgtgtcatgggatttgtgtccatcgatagctatcattcaggccatcatcggttggttgatgggtattttcagtgcggcggaagtgtacggccagttgttcaaacgggaggattga

SEQ ID NO: 756 - DNA, 2328 bp, Collimonas sp.
atgcctctttcgaagcgaaatcgcctcatttctcgtctgttttgcagtgtcttcctggctggggtgctgtctgggctggcggggtctgcatcggcggcgccggccgccgccgatagcgctacaagcccggcccggccgcgcatcggcctggtgctgtccggcggcggcgcgcgcgggtatgctcacctgggcgtgttgcaggcgctggaaaaaatgcacatcccgatcgactatgttgccgccaccagcatgggcgcggtggtcggcggcctgtatgcgagcggattgtcggtcgatgagctggaccgcatcttgaccgggaccaatctgagcgatatcgcctttgaccgcaatgagcgggcagacctgccgcaatcccagcgcgaggacgattatcaatatcctatcggcctgtcggccggttacggcgacggcaaactgaagctgccggccgggctggtgcagggcaataacctgctggcgctgctgcagaactggactccgcagctgccggcgaatatttccttcgacaagctgccgacgccattccgcgccgtggccaccgatctcggcagcggcgccgaggtagtgctgagccagggctcgctgccgcgcgcgatccgcgccagcatggcggtgccgggcctgttcgcgccgctcaagctggatggccgcaccctggtggacggcggcctggtgcgcaatctgccggtatcgctggcgcgcagcatgggcgccgacatcatcatcgcggtcaatatcgccaccgacctgcaagatccgtcgacgctcgaatcgccgaccgccgtggcgcaacagatggtgaccatcctgatccagcagaacgtcaagcatgaaatagatacgttgaagcagcaggatgtgctgatcgagccgaatcttggcgatctgtcgtttgccgatttttcgcgcggcaaggatggcgtcaaggccggttacgatgccgccgaacgccagagcgccaaactggccgcgctcgcgctgccgccgcagcaatggaaggaatatctggcggcgcgcagcggcggcggaccggtgctggcccaggacacccatatagatgcgatcgaaatccgcagcaacggccaggtgccggcggccgtggtgcgtcgcgcgctggatgtcaaggaaggcgatttctataatccggttgcgctgaacaaggacgtggcgcggctggcgaccaacggcgacttcaaaagcgtgacgcaggagctggtgacggagaacggccgcaatgtgctgaaggtggacgccgacgacaaatcctggggtccgcatttcctgctgttcggcctcggcgtgtcgaacaatttcgacggccgcggcgatttcaacctgcagatcggccaccgcctgccgtggcttaccgagagcggcctggagtggcgcaacgatgccgtgctgggcagcaaacaggcgagcttgcataccgaattgcggcagccgatatggaataccgtgggcctgtatgtggcgccttatgccgaatacggacgccggcatatcgacctttatacggatgaaggtgcggtaacctcaaaaactgtcccggtgactgcgtaccgggtcgataccaccagggtcggcgttgaccttggcatcccgatcggccggctgggagagtttcgcgccggcgtgaattaccaatggctgactgcagctcctgcttataatctgccgaccgaatttgcgaacctgattggcgtcgacaccattttcgataaattccgcataaaccagccggtggtccgtgctcagctcaccatcgatcaactcgacgatccgctatttccgcgcaaaggttattacctgtccgcggtcagcaatatcggccttggcggcgcggcgaacagttatagcgatgcccagggcaaggcgctgtgggcgggcagccgcggccgcaatacagtgaacctggcgctggaggctgccggcacctatggcaacgagacgaacgacgccagcggcaacggcggcctgggattttcgttgggaggctttcagcacttgtcggcctatgcgcccgaccagtttaacggcaactacctgctgtatggtcgcctgacttacctgcgggacatgcccgaactgaacttgccgggactgcgcaataccgtgctcggcaccagcttggaaatgggcgacatctggcagacccgcgaagccttcggcaccggatcttacaagaaaagcgcgagtgtattcttgggcggcagcagcttcctcggtccactgtatttcggcgccgcgatcgcaccgcgcggcgtctggaacctgtatctgcaattggggcgggtattctag

SEQ ID NO: 757 - DNA, 1986 bp, Collimonas sp.
gtgatgcagactccagcgccaaatcaactttgcattgccgatcgcaatgcagggctgcggcgtcttttatctgttccattcaagaggaataagcaaatgaaatcggaaatatcagcgaaagcactagcagcaaattttgcgattccccaggcttcggcgttgtcattggcgttgtccctggtgtttgcatcattgtctgtccacgcagccgtggcggacaacagcgcttgggtcaccaccaagacccaagcgttcttgccgcaagtccaagcgaatcaaaagagcgtggcagccgatgccagcgtggtaacccccgccgcaaccgccgtgcagctggcgcaaggcgaaccggtccatgtgacgctcagtctgaacctgcgcaatgaagccaagctcgacaagttcctgcaggatctgcatacacctggcactgcttcctacggcaagtttctgacaccggcgcaattcgccgcagaatatgcgcctacggaaaaagatgtggcgaaagtggttgcccatctgagcaagtccggttttgtcaacatccaggtcgcgccgaaccgccatctggtgacagccgacggcaccgccgccactgtacaaaccggcttccgcacagcgctgaaacgcttccagcaggacggccgcaaagtgttcgccaataccgatgcagcacaagtgcctgccgcactgagcggcatcgtcgattcggtgctgggtttgcaaaacgttgcgatcgcccagacccaccatcgctgggtgcagacgcctgaagccggcgtgagcgcacaagctaaagtcacggtcaatgcaacgccggtggcgacagcgcacagccctgtgcagttccctgcgatctatagcgtcggcaccacgccgactgcttcgaacaccgtagtcggcatcatctcggcaggcgatctcagcccgacgattaccgacctgaaaaccttcactacagccaagggcctggccaccgtcaatactctggtggtgaaaaccggcgctgccggcgccgactatagcgatacctccggccaagtcgaatggaacctggacagccagaccatcaccggcacttccggcggcgtcaagcaactgattttctacgcatcgcctgacatgagtttcagcggcatcaccgcagcctacaaccgtgcggtgactgacaacgtggccaaggtcatcaacgtttcgctcggcggctgcgaatcggatacccatagcgacggcacgcaggcagccgacgacaacgtgttcaagcaagcagttgcgcaaggccagacattctccatttcaaccggagatgcaggtacttacaactgccagaccagttcgatttccggcgcgcctggcgtaccgaaaaacaaatcgacctatgatgtcagcgaaccggctgcttcgccttacgtcatcgcagtcggcggtacaaccctgtacaccaactccggcgcctacagcagcgagaccgtgtggaacgaaggcctgagcgcgatcggcacctacgacgacgcgggcgactacgattccaccaagcgcctgtgggcaaccggcggcggctacagcaagtacgaagcggcgccatcctaccagtcgggtgtgattgctgccggcaagactacccgcggcttgccggacatcgcgtttgacgctgccagcgccagcggcgccaccatctactacaacagccagaccggtacggtaggcggcaccagcttggcggcgccgatcttcgccggcgtctgggcccgcctgcaatcggccaacaacaatgccctgggtttcccggcagccagcttctacaagtacttcccggttgccgccaacgcctcgctgctgcatgacgtgacttccggcaccaacggcgccagcagctcgtacggctacaaggctgcagcaggctgggatgcaactaccggtttcggtagcctgaacattggcaacctgaataccttcgtcaagaacacctcggactttgcacgttaa

SEQ ID NO: 758 - DNA, 552 bp, Collimonas sp.
atgactatcaacaaaatcctcgcgaccatgctgatcggcgttgccggcttcagcggcacctcgctggccttggcggccgacagcgccaaagccagctacaaggcggcggaagatgcggccgacgctacctacaaggccgacaaggcaaaatgcgacgagctcagcggcaacggcaaggatgtttgcctcaagcaagccaaggccacccgtgagcataccaagcaagacgcaaaggccgagtataaaaacacgccaaaggccgtggcaggcgcgcgtaaatccgaagccgacgccgactatgcggtagccaaggaaaaatgcgatgcgctggcaggtaacgccaaggatgtctgcgtcaagcaggccaaggcagaccagaccaatgccgtagccaacgccaacacccagaaagatgtgtccaaggccaaggccgacgcccgggaagaacgggcagatgcgcgctacaaggtagccatggccaagtgcgatgcgctggcaggcgccgccaaggatgattgtgttgccgcagccaaggcagacgctggtaaataa

SEQ ID NO: 759 - DNA, 375 bp, Collimonas sp.
atgaggttacagaaatacacgtcaaattgtaacaaatatgttattatcgaatatcaggttagttactatagccaacagatccaggcagacattatgtccttgccggcaacgctgcaggcacgctatctcagcttgaccgccagaatgaagatttacggccctcatttgggggagcctcataccaaggtgcttggcaatggcttgcttgagttacgcttgaagggcgcggaaggcattgcccgtgttttttattgcacgatggtcgggaagcagattgtcatgctgcacagtttcgtcaagaagacacaaaaaattccttttaaggaaaaacggattgcagaaattcgcatgagggaagttaaaaatgagcgctaa

SEQ ID NO: 760 - DNA, 1506 bp, Collimonas sp.
atgaatcgatcattgcaaatacccaggcgaatattgcttgccgcgctcatcagcgcttgctgcgtgctgccggcgaaacttgcatttgcggtgcaaaacctgcccaccctgggcgacacctcgcgcgaatcgctgtcgccgctgatggagcgcaagctcggcgaggaggtaatgcacgatatccgtcgcgatcctgattacctgaatgatgcgccgctgctggaatacctgaacaatttcggctggaccctggttaacgcccggcccgaggtgcggggcgaagcggggtttgattttttcttctttgcggtgcgcgatccggtcttgaatgcgtttgccttgccgggcggttttatcggcgttcattccggcttgctgctggcggcgcagagtgaatcggagctggcttcggtgctcgcgcatgaaatcggccatgtggcgcagcgccatatcgcgcgcatggtgggtagccagaagcaggattcgatgatcgcgctggcgtccatgctgctgggagcgctggcgatgcgcggcagcggcgatgccggtgcggcggtgatgatgggcggcaccgggctggcgatgcagcggcagttgaacttcagccgcgatgctgagcgtgaggcggatcggatcgggctgtcgatcctggattccggcggtttcgataccagcggcatggtggcttttttcgggcgcatgcagaccgcttcccgcaattattcggatgtggttccaccatatctgctgacgcacccgctgaccaccgagcggattgccgacatcgaggcccggatccgcgagcagcgttaccggcagcgcgccgatagtctggatttccagctgatacgcgctcgcgtgcgggtgctgcaggatgataccgaacagggccggcgcgatgcccagatcgtattcgatgcgcagctgcagctgaataccaagcagcagattgttgcggctaaatatggcatggctttcctggcgttcaagcagggcgcttacgacaaggccgaggatttgctgcagcaggccgtggcggcggctttgccggcgaagcagagcctggtgctgacggacctgggcgttgagatcatgctggccagcaaacgcgaggcggaagccttgaaactggtgcagcagggacagctccagtatcccctgtcgcgcgggctggcgcatcagtatgcgcgggcgctgattgcttccaagagactggacgacgctatcaaatatttgcgtgagcaggcccggctgtatcgccaggatgcggatgtgcaggatctgctggcccaggcctattcggcgcagggcaagcgggcgttgcagcatatggctttggcagaatcttatgtgttgaccgggagtgtgccggcggcgctggatcagttgcggattgcgcggaattcgggggatgcggggttttatgaccagtctatgattgatgcgcgggaaagggagttgcaggagcggtggaaagaggagttggctgcatccaaagagcgttga

SEQ ID NO: 761 - DNA, 1146 bp, Collimonas sp.
atgaaaaaaatactcgcggcgctcgctgccactgtcctctccatatccgtagcctttgcccagacattgccgccgccgacagtggccgccaaatcgtggctgctgctcgacaccaccagcaaccaggtggtggcgtcgcaagatcccgacatgcgcatcgaaccggcttcgctggccaagatcatgaccgcctatgtggtctttgatgcgctcaaggacaagaaaatcaccctcgaccagatggtcaacgtttcggtgcgcgcctggaaggtcgatccaagcagctccaagatgttcatcgaaccgaatacgccggtctccatcaacgacctgctgtacggcctgatggtggtgtcgggcaacgacgccgcggtggcgctggcggaagccgtggccggcaccgaagattccttcgtcgcgctgatgaaccacgaagccgaacgcatgggcatgaaatcgacccacttcggcaacccgcacggcttgccgagcgcggacacctactcgaccgcgcgcgacctggcgacgctggcggcccacgtgatcgtcgatttccccgagttctacaagatcgattcgaccaagaaatacacctacaacaagatcacccagcctaaccgcaaccgcctgctgtggctggatccgaccgtcgacggcatgaagaccggccacaccagcagcgccggttattccatcatcgccagcgccaagcgtcctaacgcaggcggcgaccgccgtttgctggcggtcgtgatcggcaccaactccgacggcacccgcacccaggaagcgcaaaagctgctgaactggggcttccagaacttcgacgcggtcaagctgtacgccaagggccaggccatcgatacgccgcaagtctggaaaggcgccaagagccagatcaagatcggcttcacgcatgacgtctacgtgaccgtaccaaagggcatcgccgacaagatcaagccggtgctggaacgcaccgatccgctgatcgcgccgatccagcagaacgccaaggtcggcaccgtcaaggtgaacgccgacggcaagaccattgccgagttcccggtagtggcgctggaagatgtggcccaggccaccatcttcggccgcgcctgggattcgatccgcttgctgttcaaataa

SEQ ID NO: 762 - DNA, 306 bp, Herbidospora sp.
gtgaagaggatcctcctcacctccgcgctcgccgccgtcatcgccgggaccgccgggatggcccacgcctcggtgtacgtcgcctacgagggccccggcttctccggccggagcgtcgccctcagcgcgtgcggcatcaacaacatccccttcggcggctcgtacaagtggtacggcaccggccagagcggccggatgtacaacctgcccaacgcccagggcgtggcccacttcacgctcgacagcaaccgcaacgccgagcagatcacgccggtcggctggaagagcgtcttcatcgtgtgctga

SEQ ID NO: 763 - DNA, 1437 bp, Lysobacter sp.
atggacggaagaaccacacactatcgggtcatacagctaggcgcgccaaaaggggcggggggcgtccagagcaacgaggtcgtttcggatttcgattcgctggtgacgcaccatcccggcaacaaccgcaacgcccacctcgagaatgggttggtggtcgggggcgagcgcacccggcagcacgctttgatcggcggcgagattcaggaaatcgagatcgtccgcaatggcaatacgttccagggcctgaagcccgatcaggtgctgctgaagaaggatttcatgttggaagccccggggcaggcgaatcctcgccaggtggatgtcccctcgcccgtggccggtgtggtggggcgcgtcagtcatgccgaaggtttggtggatatccatgaccggcaaggcggcgatgtgatcgcccgtgtccggcatatgcgggatatcgagttggaagtaaacgacgcggtcgcctatgggcaaagcctgggtacgcaacaccgggtcgcgaccgagaaagtgcatgtccacatggaagtggatacgcggtattacaggcagttcgaaaactacgtgggcgatctgaccgaggggcgattgccggtcgaggctgctgcccggctgggtgtcgagccccgcgccgtcgcggacgacggagtgctgagactcggcgaatccagcttacgcattcgcgacctgcagaatcatttgaacggcatggggtatgttggcgcggacgggcaggcattgacggccgacggtgtctatcgattgaacatgcagcgtgccgtgctggactaccaacgcgagcagtgcctgccgcaaaccggcgatatcagccgcgagatgctgcaggcggtgcccgcgcgaacgccggggccgttcgatccggcgctgggtggcattccagcaccgggattgccgtatgccccgatgccgcatcccttcggtaccggcgccgatgatcgtccctgcgccccgcctacgcttcagcaaatcgaggatgccgctgaaaggcgccggccgtgggacccggcgttttccgcggcgccgccgtcgatctctagcgacccgttggtgcaatcgatccgcgaacggctgccgcaggcgtttgccacttacggggctgcaccgccagaagtggagctggaccgcatcgcaactggtctggcggtcgagtgtcgtaagcaaggcatcgagcgccccgaccacatcgcggtcggcaatccggcgaccgatggttccggacgtcacgttttcgccgtagtgggggatttgcgcgatccggccagtcatcgggtggacgtggccgctcatgcggcggcgcaagttccggtcgaagcgtcgctgcttaagctcgatgccttgcaggcttcgacgcctgcgctggtgcagggggatcaggctcaggagctgcagaaggctccttccatgcgggtttga

SEQ ID NO: 764 - DNA, 813 bp, Lysobacter sp.
atgagcaagacgacccgaaccccgaccttggcgatggcttcctgtgtattggcctcgctcgtcctgatcggttgttcgagcacggtcgtccgcgagcccagccgcggcggcggacgccccagcgcctcgcgcccgagcggctcgcgtccggcgccgccgccggcgtcgcgaccgaagtacggcgccaccgtcaccgtccagcgcggcgaaggcctgtaccgcatcgccaccaacaacggcatccagctggccgacctcgccgcctggaacaacctgtcgccgccttacaacctgtatcccggccagcgcctgcgcctgtatccgcaaagcggcggccggccttcgtcgggttcggtcagcgccggttcctcggtcgccggcggcaccaccgcgccgcgtcccagcacgccgccgccggctccaaccgcgtcggtcgacagcggcatccgctggcgctggccgtccgacggcccgctgctgggccgttacctcgctaacgaaccgaccaagcagggcatcgacatcggcggcgccagcggcgccccggtgcgcgcggccgccgacggcgtggtcgtctattcgggcaccggcctggtcggctacggcgagctgatcatcgtcaagcacaacgaacaatggctgtcggcctacggccacaaccgcaagcggctggtcaacgaaggccagctggtcaaggccggcgaccagatcgccgagatgggccgcagcggtgcggcgcgcgacatgctgcacttcgaagtgcgctacaacgccaagccggtcgatccgatgttgtatctgccggcgaaataa

SEQ ID NO: 765 - DNA, 1005 bp, Paenibacillus sp.
atgtataaaacaaagtttcttatgatcttgctaagctttactgtaatcgcttctttctctagcttgtccggcccttcacctagcaaggcttttgctgaagagcatggaactccggtgcagaaaacgatcgatttaaatgagggcttcgacaattcaaatgaagctagtacagagccattatcccttaccagcgaagaagctactagccaagcaacggttacagctattgatcatgatgctaatttctcaccttcaacacttcagtttctgaaggctaatacaggactcgacggtgagcaatgggataatattatgaagctagtgaacaaaccagagcaagattctttgaaatggactgaattctatggctatgctgaagatatcggcgataatcgtggatacacaatcggtatctttggagcaacaacaggcggttcaaatgatacaggacccgatggcccggacttattcaaagcttttgatgctgctagtggagctagcaacccttccattgcaggtggattaacacgtgctggtctgaaggggaaaatgagtggttcgattctaaaactcagcgatagcgatagtgtaatcaagaagaagatcaacgctctccaaaacaatgaagcttggagagaagccatgtggcgtacgttctatgacacctatatcgaatatagtgtacagcaagcacagaaacgcggatttaatactgctctgacgattggatcatttgtcgacacagcactcaatcaaggcgctactggtgattcaggtagtcttgaaggaatcctctcacgctcaggcagtagtacgaatgagaagaagttcatgactagcttctatgctaagcgtacattggttgtcgataccaatgattataaccaacctcccaatggtaagaatcgtgtgaaacaatggagctctctcttagcttctggcgaaacagatcttaagaacgcagatgcagctgtgatcaaagcaactaattgggaactgaagtaa

SEQ ID NO: 766 - DNA, 669 bp, Paenibacillus sp.
ttgaaacatctaaaacatattggtaaaacgatgaaatttgcggtgcttgccgcagctattgcagggctgacacagacagctggagtagcggctgctgcttcgcttcacactgccaaagagggcgataccttctttttgcttgctcaacgttatggggtatcggtagacgagctaacgaaggcgaacccaaacattgcttccaacaatatatatgcaggtctgcaaattaaggtgcctggcgaaaaaagtgtgaaggcagcttcggattcgaagccgcagcttcttacggagaaagcaccagcgaatgaggggccaacgattgaagcgtggggcaaaacattcaactatagcaaaatagttgacgttaaggcttcagcgtattctgccgcagccgacgagaatggtaaatggggagcagtggactactacggcaatccgcttaaactaggtacaattgcggtagacccgaacgtcattccgatgggcacgaaagtgctggttacaggctattcccacccaggtttgccggatcattcttttgtagctgtcgctcgcgatcagggcagcgccattacaggaaagcggattgatatctttattccaggcaacaaatcatttgtgaacgactttggatttcaaaatgtgaagctgtacgttattgataaatag

SEQ ID NO: 767 - DNA, 855 bp, Pantoea sp.
atggaccagcacatcgatcgacggcgcttcatgacgctcggactcgccggagccgcgacgaccgccctcggcgcgacggcgatcccggacggctcggcacaggccgtgaccggagctgcggcgccgaccgctgcgcccgtgctgctcgccgccgacgagttcgacggcccggccggcagcgcgccgaacccggtgatctggcggtacgacctgggtgccagcggctggggcaacgccgagctgcagacctacacggactcgcggcggaacgcggcgctcgacggtgccggcaacctcgtgatcaccgcacaccgcgaggccgacgggtcgtactcgtcggcccggctgaagtccgagagcacctacaccgcgcagtacggccgcatcgaggcgcggatccggatcccccgcggccagggcatctggccggcgttctggatgctcggcgcggacatcgggcaggtcggctggccggcgtgcggggagatcgacgtcatggagaacgtcgggtacgagccggggatcgtgcacggcacggtgcacggacccgggtactccggcgcgcagggcatctcggctgcctacacgaacccttccggagcagcgttcgccgacgacttccacgtgtacggggtcgactggcgccccggctcgatcacctggacggtcgacggcgtcgcgtaccggacggtcacccgggccgacgtcggctcggcgacgtgggtgttcgacaagccgttcttcgtgatcctcaacgtcgcggtcggcgggaactggccgggttcgcccgacgcctcgacacggttcccgcagcagatgaccatcgactggctgcgggtccaccagaacgcctag

SEQ ID NO: 768 - DNA, 1974 bp, Pantoea sp.
atgaaaccccttcacgcgcaataccttttctgctgtgccaccctgagcctgctgtcgccgctacctgcgatggcctggagcgacctcaccgtctttggcgatagcctgagtgatggcgggaacgtcgggcgctttacctatgatggcgcgacccatccgctctatgacgagatcgtagcgcagtcgctgggtgataacctgcgcccttcatcgcagggtggaagcaactatgccgaaggtggcgcagttgcggtgcctgcgattaatcccctgtttaacactcaggatcagcttgataactaccttgcggcgcggggcggacgggctgatccggacggtctctatattcactggattggcggcaatgatttagcggcggcggctcttgcccctctcgctgcccggcagatagtggataacagcgccagtgcagcggcctcacaggtcagccggttgctggatgccggagccggaacggtgattgttccgacggtacccaatgtaggggcaacgcccgccctgctgcaggcgattctgcaggttcttggcccagcggcacaacctgccacggcggcgctgtttcagtcgctgagcaccaccactacgcctgaccgtgccgcaagagagcaggcgattgaaaccgcgcttggcgaggcggccggacaaatctcttcaattccgctgatccgggatgccattgcgcagcagctgattgccgcctggcaattactgagtcaggaggcggcggcactcaccgaccgttacaaccaggctgaagagcaggggctgatggccgcacgcgggaatatcgcgcgggtggatatcaatggcctgtttaatgaggtgatcgataatccgggcctgtatggactcacgaatacggccggaatggcctgtccgccaggtgtctcggcgatggactgcacctcctcgacgacaggattttcgcagtcacagcagtatctgtttgcagacagactgcatcccagcccggcggtccatgcgctgatcgccgattacattcagtcggtgctgaatgcgccgctgcaggtggcggcgctgagtcgggcgccgtcgatgctggtgggcgatgcgcacaatacgctggatggacatctgcagcagcagcgtcagcagcccgcaaacgccggagagtttacggtcttcggcggttatgccgggcagcagcgtgatttccgcggcgacagcctgcaggatggcgatgccaccagcgccagcggcaccgtgggtgtgggctatcagctgaccgatcactggcaggccggtgccatgctctctacgacctctcaacgtcaggatccctcgtcgcgctttgattaccgtttacgcggcaatctggtggcgctctggagtcagttcaattatcttgatcggggatggattaatgcggacgcccattatgcggatctcgactttgatgatattgagcgtcagatcaggctgggaccggcgacccgcacggaaaagggcaacagcgatggtaaggtgctggggatgcggctgcagaccggctgggatttgccgctgggtagttatgtttctaccggcccggtggccagctatgcgctcgactacacccaggtcgatggctataaagaagagggcaacagcagcacctcaatgcgctttggcgaccagacgctgcactctcaaatcggctcagtgggctggcgtatcgacagcaaagatttactgatcaatccctgggcgcaggtcagttacaaccaccagtttggcgacagcgattcggcagtcaccgccggactgaaatcgacccgcaccgcctttacccgcagcagcgatgccagtgatgataactggatcgatatggctgtgggtgcgagcgtgccgcttggcacctcggtgaatgcctttgcgggcgtctcggcgataacaggcaacagcgacatgcatcaggtgacatggaacgtcgggcttaacgcccgcttttaa

SEQ ID NO: 769 - DNA, 1038 bp, Pantoea sp.
ttggcggcggtcgccgtcgtcgggctggtggtggccggggtcgcggcaccggggccggtggaacccgcgtcggccgcgccgatgtggcccgtcccgcagccctacccggtgccggacgaccccaccgaatcgctcgccgacctcccgcccggcagcgagtacgtcgccctcggtgactcgtactccgccggctacggcctcggcgaccggacccggctgcccacgagcgcgtgcgtgcagtcggcccgtgactacccgcaccggctcgcggcgcggttcggcctcgacctgaccgacgtcacgtgcgcgggcgccaccagcgaggacgtcacgaccggacaccagttcacgggcgtccccccgcagatcgagtcgctgtcgtcgcgcactcggctcgtgaccctgacgatcggcggcaacgacgcggacctgttcggcaccgccgcgtcgtgcctggcgatctcggccgacggcccggtgttctccggacgtgacgcgccgtcgtgcgagagcacgctcgtgcaggacggtgaggaccagctcagcgtgaagatccagtcgcgggtcgcgctcgggatcgccgacaccctcgcagcggtgcaacgggccgcgccgaacgccgtcgtcgtgttcctcgggtacccggcgatcttcccggacgccgagcacaccccggcgaagggctgcttccgctcggcgctcgacctcggcacgctcgcggggtcgttcccctcggacaccttcccgttcaccgacgacgacgtggcgtacctccacggtgtgcaggaggagctcgacgccgtgtccgcatccgccgccgacgccgccggggtgcggttcgtcgacgtcctcgaacgcaccgaggcccactcggcctgcgccccggcggacgaacgctacgtcgccggtgtcagcctgaccggctcgagcgacctgcgacgcatcgacctcaaggccggcgccctgcacccgaacggccgcggtgtcgcgtacctcaccgaccagatggccgacgcgatccgggaactcgccggctga

SEQ ID NO: 770 - DNA, 1464 bp, Pseudomonas sp.
atgtcgtcatctattcgtaaagccatcaattcagacgcattgacccgcttggctcaagccatcgcggtggctgtgtccgccactttggcgggctgttcaagccatgtcccgcaacccgaagccacacacgttccgaatattgccgcccgagccaagcagaaacccatctggctcagcgagaaaccaacaccgcaagtaccgcaggacgtctgggagcgcatgcgccagggcttccagctgcaggacaacctgggcgtcaacccgcgtatcgagcaacaacgactgtggttcgccagtaacccgtccttcctcgaaaacgccggcgaacgcggcagcctgtacattcactacatcatcgaacgtcttgaagaacgcaacatgccgctggaactggcgctgctgccagtgattgaaagtgcctacaacccgatggcctattcccgggccgacgcggtgggtctttggcaattcatcccttccaccgggcgttactacaacctgcgtcaaacccgtttctatgatggccgtcgcgatatcaccgcttcgaccacagcggccatggactacctgacccgcctgcacgacatgttcaacggtgactggttgctggccctagcggcctacaacgccggcgaaggcacggtcagccgcgccattgagcgtaacgagaagctcggtctgccaaccgattactggaacctgccgctgccggccgaaacccaggcctacgtgccaaaattgctggccctgtcgcaagtggtactggcgccggaagcctacggcgttaacctcaacccgatcgccaacgaaccgtacttccaggtcgtcgaaatcaaccagcgcatggacctgtccaaggttgctgcggtggccaacatcgatgaagacgaactgttccagctaaacccggccttcaagcaacgcaccaccatcgacggtccccagcatttgctggtgccgacgtccaaggcgcaactgctgacggccagcctgtcgaccatgcgccccgaagagttgatcagctcgcgaccactgaaaccggtgttcgaaggcgctgacgacaacgaaatcgccaaactcaagcgcgcctaccgggtgaaacgtggcgataacctcgctgctattgccaaggccaacaaggtcgatgtcaaagacctgcagcgctggaacaagatgaccggcaagaacctcaaggtcggccagaccctggtcatgcaggacaacaccaagcgcagcgccggccggatcaacacggtcgtcgccgcgagcggcaagtccaaaggcaaggacaccggcaagaccgtcgccaagacccagcagacctacaaggtccagcaaggcgactcgctgtatatggtcgccaaacgtttcaacgttgagatgcaacacctaaagcgctggaatcctcgggttggccaggcgctgaagcctgggcaaatgctgacggtgtcttcgccacgctaa

SEQ ID NO: 771 - DNA, 771 bp, Pseudomonas sp.
atgaaaccaatgaacaaactctgcctgatcgccgccagcctgttgatgctcggcaccggctcagccatggccgccaacattgcgcccgtgaaggccaacaacgtcgtgctggtgcacggctcctgggccgatggttcgagttggtcagaggtgatcacgcggttgcaggccgccggtttgcacgtcactgccgtgcagaacccgctgacctccgtggccaacgatgtcgccgccacccaacgcgtactcgaccaacaagacggcccgaccgttttggtcggccactcctacgcgggcaccgtggtcagtgaagccggggtggatccgaaggtcagctcgctggtctacgtcgcggcacgcgccccggatgccggtgaagatttcgtcgccctctccggcaagtacccgaccatgcccgtgcgcgccggcaccgaagagcacgacggttacgtcagcttgaaacaggacgccttcctcaagtatttcgccagcgatgttccccacgacaaggctatggagctgttcgccgtgcaacaaccgatcgccaaaaccctgtttggcgaacgcaccaccgccgctgcctggcacaccaaaccgtcgtggtacgcggtgtccagcctcgaccagaccatcaacccggacctggaacgcttcctcgccaagcgcatgggcgcgaccaccatcgagctgccatcgagccatttgtcgctggtctcgcactcgaaagagatcgccgacctgatcctcgaagcctccggccgccagccgtaa

SEQ ID NO: 772 - DNA, 1434 bp, Pseudomonas sp.
atgacttttttgcgccccaccctgctgacgctcgcttgcctgctcgcctcaccaggcttcgccgacgacctgccgtcactcggtgatgccagttctgccattgtctcgccacaacaggaataccagttgggccgcgcgtggctggcgatgttgcgcagccaggtccagcagttgagcgacccgcagctcaaggattacgtcgaatccagcgtctacaagctggtggagaccagccaggtcagtgaccgacgcctggaattcatcctgatcaacagcccggagctgaacgcctttgccgcgccaggcgggattgtcggggtcaacggcggcttgttcctcaatgcgcagaccgagggcgaatacgcgtcggtactcgcccacgaattggctcacttgtcgcaacgccacttcgcccgcggcgttgaagcctcgcaacgcatgcaggtgccgatgatggccgccctcctcgccgggatcgtgattgccgctgctggcgccggtgatgccgggatcgccaccattgccggtacacaagcggcagcgatccaggaacaacggcgcttctcgcgccagaatgagcaggaagccgaccggatcggcatcatcaatctggaaaaggctggttacgatccgcgctcgatgccgaatatgttcgaacgtctgatgcgccagtaccgctacgacgccaagccgccggaattcctgctgactcacccggtaaccgaatcgcggatcgccgatacccgcaaccgtgccgagcaagccaaacagggtggcatcgaagacagcatgcgttaccagctgattcgcgcacgggtgcagctgatttatgaagaaaccccaggcctgggcgccaaacgcttccgcgcccaactcgatgaaaacccgaaaaacgatgtcgcccgatatggcctggccattgcccagatcaagggtggccagctgaatgaagcgcgggagaatctcaagcttctgctgaccacggcaccaaacgaaatcatctacaacctggcccaggttgatctggacatcaccaacaatcggctgccggacgcccagactcgggtcgaccgattgctaacccagtttccgggcaactatccgttgaaccaggtacgggttgatctgttgctgaaacagaaccgcactgccgatgcggaaaaagccttggagaacttgctcaagtcccgtcctgacgatccggacgtctggtacatggtggcggaaactcgcgggctgtcgggcaacatcatcggcctgcatcaggcgcgcgccgaatacttcgcgctggtcggcgactaccgccaggccattcagcagctggacttcgccaagcgcaaggccggcggcaacttccccttgtcatcgcggatcgatgcacgacaacgggagctgatggagcaggaacggatgatcaaggacatgatgggctga

SEQ ID NO: 773 - DNA, 1740 bp, Pseudomonas sp.
atggatttttctctcaagcaactggccgctaccactcttgtattggcgagccttgcgtcgttcaccccactggcccacgccaacatcactgcgcaacaaagcgcgaccatcctcaaggctttcagtgatgcatcggccacggatttccggcaattcctgggcagcgtggccaagagcgaactggccaaaaccgccaacctgggcccggccatcagcgcttttctcgacaacaaaaccctgtctgctgaacagcaaaacgaaatcaatcgcctgctgggtatttatgcccgggtgaaatatggcaacgctgccaccgaaaccctgcgtgagctggtggccattccgaccttccaagtggaaggcgtcgcccagcacgacaaccctgaattcatcaagatcgccgacaagatcaagggcctggcccaggcgttcaatctgaacttccgcaacatcgacaaccgcgtctacgaaatatccctcgaaggcagcggtgatgaagtcgtgggcatccacgcccatgccgatgtggtgccagtgacaccggaaaactgggtgctaaaggacggcaccaaactcgacccgttcaaggtcaccctgatcggcgaccgcatgtacggccggggcaccgaggatgacaagaacggcatcgtggtagcgatgtacgcgatgaaagtcatcaaggaagagaagctgccactggcccgtaacttcaagctgttggtcgacaccaccgaagaaaccagcggcgacgccattccttattacttcgaacacaacccgacgccgaactacaacctggcgctggatggcggctacccggtggtgattgccgagaaaggctacggcacggtcatgggcaacttcccacggcgtgatggcgagggcaaaggcgccgaaatcatctcgatgactggcgggatggccaccaaccagattccgtcggcttcggtggccgtccttgtcaccgataaacccgccgaactggccgccagcctgcagaaggccggggctgattatgccaagcgcaatggcggtaacttcgaagtgaacgccaaggtcgacggcaaggacgtcaagctgaccgtcaccggcgtgtccgcgcactcctccgagcccgagtccggcgtgaacccggtggcgaggatgctggacttcatccacagcatcgacggcaaagtcgcactcaagcacaaccacatcaccgacgccgcgcgttacgccgccgataactggggcctggattacctgggtggcaaattgggcgttggtttctccgacgccttcatgggtccgctgactacttccctgaccttcgtcggcatggatgacaaaaccttcaagctcgcggtcaacctgcgcgtaccgaagggcgaatccccggaagcgctcaaggcgaaaattgctgacaagattggcgcctggagcaagaaaacccacgtcccggcgaccttcacctactcgatcgccgagccgatgtaccgcaatcccgagggcgaatgggtcaaggctctgctggccgtgtccactgaaaacctgggcatggaacacaagttcggctcttccgccggtgccacgtcggtccatgagctgcctaacggcgtgcaattcggcctggcccgacctgaggtcaagtacaccggccacaccgacaacgagttcaagacggtcgaccagttcctgctggacctgcagatcgtgaccgagatgatggggcgcgtcgggcagttgccgaagctctga

SEQ ID NO: 774 - DNA, 1989 bp, Serratia sp.
atgcctctaaaaataactcgcatgccccgcccggcggcgcttgcagtggcgatattatgcagtatgactaccccggcgctggcctatgaccaggtttacgtatttggcgatagcctgagcgataccggcaacaatggccgctttacctacgacggcaataagcacctgctgtatgacgaagtgctggcggaacgcatcggcgccgcgttggtggcgtcggacgacggcggctacaattatgccgccggcggcggtgtggcggtgccggcgctcaacccggcggacaatactcaggatcaggtgcagagctaccttggccgggtcgatggccgggccgatggcgacggtctgtatattcactggattggcggcaacgatctggcggcggcggcgttaaacccgacaaccgcgtcggacgtggcctataacagtgcagccgccgccgcagtgcaggttcgttcgctgttgaatgccggcgccggtacggtgatcgtaccgacggtaccgaatattggttcaacgccgcagctgatggagctgattatccagcaggcgctgacgccggtgcagggcgccgcagtgcaggcggcctatgccaccctcaattcgctgactacgccggataatgtttcgcgcacccaggctatccatcaggcgctgacttccgccgccgcacaggccagcgcaatcccgcaggtgcagcaggcgatcgccgcacagctgattgccgcctttgacagcctgagcgctcaggccgcgcagttgaccgatttttataaccagagtgaggatcgcctgttggcgcagggcggtggcaatgttgttcgcgtcgacgtgaacaagctgttcgccgaggcgatagccaatccggcgcagtttggcttcgccaataccgccggcatggcttgtccggccggggtgtcgtcggcggtgtgcagctccgccacgccgggcttcgacgccagtcagtcctatctgttctccgatcattttcaccccagcccgcaggcgcatctgttgattgccgattacattcaggcgttgctggatggcccggcgcaggtggtggcgctgaatcaggcgacggcggcgatggcgcgtgacagccgcgcgacgctcgacagccgtttccagcaattgcgcaatggcgacaacccgcagggatcgctgggcgtcttcggtggctatgccgggcagcattatgattactcggccaataaggcggcgggcgacggcaacgccaccacccataatctgacggttggggtagattatcagttggccgaaggctggctgattggcgcgctgatatccggttccaatgacgatcagcagccgtccagccgctatgaatacaaggcgcgcggcctgctgttgtcggcctttaccgcccttgatctgtttgagcacggctgggtgaatgccgatctgcactacgcgacgatggattacgacgatattcgccgcagcatgcagctcgggccgctaacccgcaccgaaaccggctcgacctccggcaagcagtggggcgcacgcctcaccgccggttatgatttcccgatcacctcttatctgacgaccggtccaatggcgcagtttgcctgggattacagcaacgtctccggttacagcgaggatggcaacaacagtacctcaatgcgctttaacgaccagacctaccattcgcagatcggcgcgttgggctggcggctggacagccaatttggcctgtttaatccgtacgccgaagtcagctatcaacatcagtttggcgatgatgtctaccgggccggcggcgggctgaagtccacgcagacctcgttcacccgcgacagcgccggccaggataaaaactgggtggatgtgacgctgggggcgaacatgccgctgactgaccaggtggcggcgttcgccgccgtttcgcaaaccggtggcctgagcagcggcgagcagtttatgtataacgtcggcgtcagcgcgcggttttga

SEQ ID NO: 775 - DNA, 1113 bp, Serratia sp.
atgtctgcaacgctgaaacgcctgacgttcggcatgctgctgctgtgtgcattcggcgcggcggcggcctgcgagtggccggcctggcaacagtacaaacagttttacatcagcgacgaaggacgggtgatcgacccgagcagcccgaaccgcatcaccacctcggaggggcagagctacggcctgttcttcgccctggtggcgaacgatcggccgacgttcgacaagctgctggagtggacggaaaacaacctggcggcgggcgatctcagcgcccatttgcccgcctggctgtggggcgaggacgataaaaaacgctggacggtgctggacacgaatacggcgtccgatgccgatctgtggattgcctacaatctgctggaagccggtcgtttgtggaaaagccggcgttatcaaactctggggacgctgctgttgcagcgtatcggccgcgaagaagtggccgacatccccgggctggggctgatgttgctgccgggcaagatcgggttcgtggcgcaagatcgctggcggctcaatccaagctacctgccgccgcagctgctggcgcgttttgccgccctgaacggcccatggcgagcgatgcagaaaaccaatcagcggttgttgctggaaaccgcaccgcacggtttctccccggattgggtggtgtggcaggccggcaaaggctggcaaccggataccgtgaaaccggatgtcggcagttacgacgccatccgggtttatttgtgggtcggtatgttggcggacgatgacgagcataaagccgcattggtcaaacagctgctgccgatggcgcaattgaccgctcaacagggtgtaccgccggaaaaaaccgacaccgccagcggcaaaaccagcggcgacggcccggtgggtttctccgcggtcatgctgccgatgctggccaatcaaacggctgcgctggacgtccagcgccaacgcatcaatcaacaccctccgggcgacgatgcctatttcagcgcctctttgacgctgttcggccagggatgggatcaacaacgttatcgttttaatcggcagggtgaacttcaacccgcctggggcggccaatgcgtaacttcaaaataa

SEQ ID NO: 776 - DNA, 753 bp, Serratia sp.
atgaaaaagcgtttttctctgttggcaggaatgctgtttgcattaacgatgccggcgcatgccgccgagaatatcgaagcgaaagcgatcgggccaaagcatggcgctaccttgattcccaaggcgcgtcaggtgatttgtgaacaggacggcggttacaaccacccggatgatggctcgaacatacctaatgcggcctgcagaaatgcctttttgtacaaagcggagactattcctatttgggaacgccgccagatgtttaccgaatggcccgcctactcgcaaaacctgcaaggtacccagcatccgtcagacaaggtccccgatggccagctttgctcggcgggcatcgccaagtttgaaggcatcgaccagccgcatgccgactggtatgtgagcagcgtctcggtaaaagacggccaggctacgctgtacttcgacgctacccaggtgcatgagccgagcaagtggacggtgtcgcttgccaagccgagtttcaatgccgccacggataagttgaaatggagcgatctgacaccgcttgaggtgactaaagtgacagttccgccgccggccaaaggcaaccatgtcaaatatgccggcgtctaccagattgaggttaagatcccggccgatcgtgctgacgggaagcaaaccctgttgtatgtgcagtgggaacggcaggacccagcgagagaaacctttttcagctgtagcgacgtaaggttcaacggggaatctgcagccaaataa

SEQ ID NO: 777 - DNA, 2202 bp, Serratia sp.
atgcgtttatctacattggtgctggcgatcggcatggcgctgagctcgcaggcacaggcagcagaaaccaatccgcacgcgagtcatagcgcgttgccaagcggccaggctaaggaggctaacgtgaccggtgaagctaaccagcacgagaacaaaaagaacgagaacccgttcttctatcagagccgtctgccgttccaggcaccgccgttcaatctgatcaaagaaagcgactacgccccggctatcgacgccggcatcaagcaaaagcgggaagaggtggagaagatcgccaataacccggccaagcccgattttaaaaatacctttgtggcgctggagcaggccggtgcgctgttgacgcgggtgatgaacgtgtttggcgccatgacctcggccaacaccagcgacgcgttgcaaaagttggatgaggaaagctcgccgaaactggcggcgctggaagacgccatcatgctgaacagcaagctgtttgagcgcatcagggcgatttatcagcagcgcgacgcgctgaagctggacgcggaatcgcgtcgcctggtggaggtgacttacaaaaacttcgagctggcgggggccaacctgtccgacgccgataaaaccaggctgaaagcgctgaatcaggaagcggcgacgctgagcacccagttctccaacaagctgctggcggcgaccaaagacggcgcgctggcgatcgccgacaaaggcaagctggacggcctgtcggaaagcgaactggctgcggcggctcaggctgccggcgagcgcaagctggacaagcagtggttgctggtgttgcaaaacactactcagcagccggagttgcagagcctgaaagacagagacacccgcaaggcactgtttgacgcttcgtggaaccgagcggaaaagggcgacggcaacgacacccgccagaccatcgcgcgcctggccaaggtgcgcgccgagcaggcaaaactgctgggcttcccgaactatgccgcctggaaactgcaaaatcagatggccaaaaccccggatgcggcgctgagctttatgcgcaatatcgttccggcggccaccgcgcgcgccgaacgcgaagccaaagacattcaggcggtaatcgatcagcagaaaggcgatttcaaggttgcagcctgggactggcagttctacgccgagcaggtccgcaaggcgaaatacgatctggatgaatcgcagatcaaaccttacttcgaattggataacgtgctgaacaacggcgtgttctatgccgccaacctgttgtatggcatcagctttaaagagcgcaaggacatcccggtctaccagccggacgtgcgcgtgtatgaagtcttcgataaagacggcaaatcgctggcgctgttctacaccgacttctttaagcgcgacaacaagggcggcggcgcctggatgagcaactttgtcgaacagtcgaagctgaaaggcaccaaaccggtgatctacaacgtcgccaacttcaccaaaccggcaccgggccagcctgcgctgctgtcgtacgatgacgtgatcaccctgttccacgagtttggccatgcgctgcacggcatgtttgccgatcaggagtatccgagcctgtccggcaccaatacggcgcgcgattttgtcgagttcccctctcagttcaacgaacactgggccagcgatcccaaagtctttgcgcacttcgccaaacactacaaaaccggcgaagccatgccgcaggaactggtcgacaaaatcaaaaaagccgacaaattcaacaaagggtatgacatgaccgagctgctgtccgctgcgctgctggacatgcactggcacatgctgagcgcggatcagccgcagcaggacgtggacaagttcgaagccgaatcgttgctgaaggataaaatcgatctcagctacgtgccgccgcgttatcgctccagctatttcaagcatatctggggcaacgggtatgccgccggttactacgcttatctgtggaccgaaatgctggcggatgacgccttccagtggttcaccgagcacggcggcctgacggcggagaacggtcaacgtttccgcgacatggtgctgtcgcgcggcaatagccaggatctggaaaaactgtatgtcgactggcgcggtaaagagcccagcatcgagccgatgctgattaaccgcgggctgaaagacgaataa

SEQ ID NO: 778 - DNA, 1566 bp, Serratia sp.
atgaacttaatttatcgggcgttattctacgcctttgcagtgatgctgtccttttttagcagcactgcggttgttgcgggccagctaatattgaaaaacacctctttatcgcccattacttgcacggttgacggctggacggtctcttcaggcagcagtttcgattggttcattaaggtgcagccggggcagtcattctttgtcggacagaacaccagcaggccgaaagacccggtaattaattgggcaaagtgcaataacttgcaaacccgcgcgatgaccataacgcccagcggccccaatcaaacgctggtgctgaacgggcaacaaacgcaagtattgaacgtctcgctttatccttttcttcctacgctgcccacggataacttcgaaaatttggtcgcctatattgtgcagacttatcagtcgcagcacccgcaggtgttactcaatgcagtgctgaatccgcaggtgaatatttacagttttaccgagttgccggtcctgttgggtaatgatggatttgacgtgatagagcttgatgtcctttatctgggtttcctggcggataatcatctgatcaaccccgcccagattaccggcgaagcgccctgggccgtggcgctggcgggggcgacttaccaaggccagttatgggcgatccccagttggctctgcatggactttttctacgcgttcgatcaggcgattcagcagcagaaaaccttgtcgaaaatgctgaattatttgaatacccgaacgtcgtcagtcgccaaaatggcaggcagctttaatggcagttgggctattccttctgattatatcaacgcttatgtgcagacctatggttacggtgcgttgcaacaggcgatgcaaatgccgcctgataacggcgttgtccatcaattggtttcactgtctgatacctgcagctttaacggggtcaacaagtgcaccaataacacctaccataacgccccgaatggcggtgccgagcaggtgttcgcctccgggcaggccagtaccgacatgggcttttccgagcagtctttctacgtgaatctctattcgtcggcgcaaaaaccgctgtatgtcgtgcctaccccttggggagaacacccccaaccgctgttatttgaagacgcttttgtttccagcgccgcgacgtgcaagccgggcagccaatgtgcggccaatgcgcaagcgttcaccacgttaatgaccgggacggcgatgaaaaattatatcgtgcagtccaaagatctgcccgccggtacgccgtggcggacgttgttggtggccactcagcaattctggcaacagtcgatcattgccaataacagttattaccaacagttatcgccgatatttatgacggcaaaggcgtttcctaacaactttaccccgcaaagccaggttgctatggccaatggcatttgcaatgccctaaaacagcagcagcctaattttgtttgtaaaagcaataatagcaccagcttgttagccccatctcacggcagttccatcatcaacccaggcagcactgatagcaggagaggtttatga

SEQ ID NO: 779 - DNA, 402 bp, Serratia sp.
atgagtattggacccgtttccggtaatggcatcaccatcaccttacccgtaggcaaaacgctattttggaccgccaatgtccaggcatcgtactcacaatatgttctggttcgcgactcgacgaatcaggtggttattgagagcaaaggtgcatcgacaggcgggcattcgccgacccaaattggccagggctcgtttgttaccgcaggcagcggggtttataccgttttcattggctataacaatggccagtcctggtcccaggttatgtgggatgaaatcgcgttaaatatcggcagccagatttactccagttgtttcaatttcattagtgaagacggcgcggatcaggatttcaatgatacctgcctgacactgacctggtttaacagcatcggttga

SEQ ID NO: 780 - DNA, 339 bp, Serratia sp.
atggcaatcggtcactatgagctgaaaaaagcaaagaatgggcaataccacttcaacctgaaagccagtaatggcgaaatcattttgggcagtgagatgtacgccagcaaagcctcggcggagaatggcattgcctcggtgcaaaccaactccccccaggaagcgcagtatgaattgaaacacagcaccagcaatcaaccttactttgtactgaaagccaagaaccatcaggtgatcggcgtcagtgaaatgtacagttctgaaactgccgcgaaaaacggcattcagtcggtgatcaagaacggcccaagcaccgacgtgcgcgatttaagcgcgtaa

SEQ ID NO: 781 - DNA, 480 bp, Serratia sp.
atgaaaggcgataaaaagatcattgctcacctcaacaaactgctcggcaacgagctggttgccatcaatcaatatttcctacacgcccgaatgttcaaaaactggggcttaatgcgcctgaatgacaaggaatatcacgagtcgatcgacgaaatgaagcatgccgatcgctacatcgagcgcattttattccttgaaggtctgccgaatttacaagatcttggcaaactgaacattggcgaagatatcgaagaaatgctgcgttcagacctggccctggagttggatggcgccaagaatctgcgtgaagccatcgcctatgccgactcgatccacgactacgtcagccgcgatttgatgatagagatcctggcagatgaagaagggcatatcgactggctggaaactgagctggatttgattgcgcgtctgggcattcaaaattacgcacaagcccaggtactggaacgtaaagactag

SEQ ID NO: 782 - DNA, 1983 bp, Serratia sp.
atgactgagctgacgcccggcatcgccgcgcctctcggggcgcattatgacggtaacggcatcaactttaccctgttttccgcccacgccaccggcgtggagctgtgcctgttcgacgggcaacagcgcgaggtgcgtttgccgctgccggcgcgcagcggtgatatctggcatggctatctgccgggcggcaaaccgggccagcgctacggttaccgggtgtacggcccgtttgatcccgcgcaggggctgcggtttaaccctaacaaactgctgctggatcccgccgctcgcgcggtcgaggggccggtggcggacgatctggaactgcatggcggctacgaccggccggacccgcaggacagcgcagaagtgatgccgaagtgcgtggtcatcgacgaagcctatgattggcaggatgatcgcccgccggccacgccgtggggcaaaacggtgatttacgaagcgcacgtgcgcggtctcactctgctgcacccggatatcccgccggtgctgcgcggcagtttcgcagctctcgggcatccggtgatgatcgcccatttcaagcgcctcggcatcacggcgctggaactgctgccggttcagcagcatagctccgagccgcgtctgcagcgtctcgggctgattaactactggggatataacgtgctggcgccctatgcgcccgataaccgttattgcagcctgcgcaccgacatgacgccgctgcgtgaatttcgcgatgcggtgaaggcgctgcacaaggccggtatcgaggtgatcctcgacgtggtgttcaaccacagcgccgagctggacatggacgggccgacgctgtcgctgcgcggtatcgataacccggagtattactggctgactcccgacggggaatacgttaacgacactggctgcggcaacacgctgcggttggataaaccgcagggtgtggcctgggtgatggagtgcctgcgtttctgggtgagcgaatgtcatgtcgacggtttccgcttcgatttgggtagcgtactggggcgcactccggcgttcgatcgcgatgcgccgctgttccaggcgatgctggcggacgatctgctgtcgcgctgcaagctgatcgccgagccgtgggacattggccccggcggttatcaggtgggcgcttttccggggcgcttcgccgagtggaatgaccattaccgggatgatatgcgtcgcttttggctgcagggcgatttgccgcttggccagtttgcccaacgctttgccggttccagcgatttgttcaaccaacgcgggcgtgcgccgtacgccggcatcaacatgctgaccgctcatgacgggtttaccctgcaggatctggtcagttttaaccgcaagcacaaccagcttaacggtgaaggcaaccgtgacggcagcgaccataatttcagctataaccacggtgttgaaggcccgattgccgacgacgccattgtgcaacgccgcagggccagccggcaggcgctgcttgccacgttgttgctgtcccaggggacgccgatgctgctggccggcgatgagcatggacacagccagcaggggaacaacaatgcctattgtcaggacaacgccatcacctggctcgactgggccaaggcggatgactcgctcaccgcttataccgcagcgctgattcacctgcgccggcagatccccgctctacagcaagaccgctggtggcaggagggcgacggcagcgtgcagtggctgaacgcgcaagggctgccgcctgcggcgcaagaatgggagcagggagacttgcaattgcagatccgcttgtcgcagcgctggctggtggtggttaatgccacgccgcagccggtggagatgaggttgcctgcgggcgattggcaggttgtcgccccttttactcaggaaggatcgcgggcggttttacccgcctggaaccaggctgcgcactcgatttgcgtgctggtacagaaataa

SEQ ID NO: 783 - DNA, 354 bp, Streptomyces sp.
atgacgtccaaattgcagaacgccgcacgtaccgttgcggcgtcgctcgcggctgccgccgcattcaccctgttcgtaccgaccggcacggccgccgccatcgaccacgtcacctgcaatcccggtgcgggatacctgaaaatctggtcgcatctcaacggccgtgacagcgtggactgctatgcgaaccgcggaaagaccaacttcggcggttggtgggtcgacaagatctccacagggaacaacgacgtgaagtactacgacgccaacggggacgtcgtgaaaatcaaccggcacaaggtcatctcgttcccgaaccgtccgccgaaggtcaaggcgatcgaaattctgtaa

SEQ ID NO: 784 - DNA, 474 bp, Streptomyces sp.
atgactgagcggaatcgagtcccgtccctgctctcccgggccggagcggtctcggccctctccctcgccgcgatgagcaccaccctggtcgctcccggcgccgcgcccgaggcggcggcggccacccacgccgccaaggcgctccagatcgcctcctcgaagaagggctcgccctaccggtacggcgcgaccggcccccggagcttcgactgctcggggctgacgctctactcctacaagaaggccgggaagaagctgccacggacggcggcgcagcagcacaaccggaccaaacggatcgccgcctccaaccgccgcaagggcgacctggtcttcttccactccggcggcagcgtctaccacgtgggcatctacgccgggggcggcaagatctggcactcccccaagagcggcgcggtggtgcggctggagaagatctggaccggcagcgtgcggtacgggcgcgtgaactga

SEQ ID NO: 785 - DNA, 339 bp, Streptomyces sp.
atgaataccgtacgcacgacggccatggcgctcgccgcggccaccgcgttcaccctggtgggacctgcgggttccgcctccgccatcgaccacgtcacctgtgacccggaccgcggatatctgaagatctggtcgcacctgaacgggcgcgacagcgtggactgctacgcgaatcgcggcaagaccaacttcggcaactggtgggtcgacaagatctccaccggaaacaacgtcgtgaagtactacgacgccaacggtgatgtcgtcaagatcgaccgcaacaaggcgatttcgtacccgaaccgcccgccgaaggtcaaggccatcgaaattctctga

SEQ ID NO: 786 - DNA, 333 bp, Streptomyces sp.
atgcgcaaccgtcgcaaccgtcgcactcttcgttccaccgtcaccgccacagcggtggccggcgtgctggccctgggcgccggcacggccgtcgcgagcggcttcctgagctgggagggtcctcagaacaccggccgcgccaaggaactcacgcgctgcggctgcagcaacatcgatcccaacttccgtgcggcataccggttcacctacaccggccagaccgcggcgatgtacaaccagcccgactgcgcggggacgagccactacaccttcaggggcaactcggagagtgttcagccctttggctggcggagcatcttcatccactgttag

SEQ ID NO: 787 - DNA, 309 bp, Streptosporangium sp.
gtgaagcgaatcgccctcgtccccgtcatctccgccgccatggtcgcggtcatgggcagtgccgcctacgcctcgcagtatgtggcctacgaagggccgggcttcaccggccggtcggtggtcatcgaccggtgcggcccgtccaacatccccttccacgggtcgtacaagtggtacggcgacggccagagcggccggatgtacaaccagcccaacacgcagggggtgacgcacttcgagctgccgtccaaccgcaacgcggagcagaggacgcccgtcggctggaagagcatcttcatcgtgtgctga

SEQ ID NO: 788 - DNA, 1197 bp, Curtobacterium sp.
atgaccaccactccgtcgaccgtcgcacgtgcgcgccgactcccacgcatcgccggcgccgtgacggcactggccctggcggcgggggcgctcgtggcgacagccgaaccggcagcggcctctgcggtctgggtcggctcagccccggccggcaccaagatcctgcccggcgaccaggtcacgtcgccgaacggccagttcaagctcatcatgcagggcgacggcaacctggtcgagtacggcatcggcaaccgtgtgctgtgggcgtcgaacaccgccggcaactccggcgcgatcgccgtggtcggcaagaaccgcgccctcgacatcacgaagaacggcaagcgtgtggcccgctgggcctcggccggcactgtgaactccaccgcgctgaaggtgcgcgccgacggcacgatggcgctgctcgccggcaagaccgtggtcgtgagctggaacggctaccaggaccgcgtcccgtcggggaacaccatcctgggcggcaccgtgctgcgatccgacacctcgaacacgcgcatcctcaacatgcgcaccgacggcaacctggtgcagaaggtcagcggccgcgtcgtctggcagtcgcgcaccggcggacacccgggtgcctgggcggagctgcaggccaagggcaacttcgtcatctggacccgtgacgcctcgcgcaagaaggtcgcgctctggagctcgcgcaccagcaccgccgggtcgggcaacctgctcgtccaggtcgacggcaacgtcgtgctctacggcgcgaaggacacccgggtctggtcgagccgaccggtcaccggcctggcctggcccgtcaacggcacgaagatcaccggccggtacggcgacgaccgcggcgccgggcacgtgccgcgctaccaccagggcaccgacgccccggtgccggtggggacggccgtgtacggctccgggacggggacggtcaccaagaccatcgcgaacgacgcggcctacggcaactacatcgtcgtcacgtacggcatgacggcggtgctggtcgcgcacctcagcaagatcgaggtgaagcaggggcagatcgtgaagctcggcaccgagatcgcgaagtccggcaacaccgggcagtcgacggggccgcacgtgcacgtcgagacgcggcggaacggcaccctcgtcgacccgctgaagaacatgcacttccgctga

SEQ ID NO: 789 - DNA, 1284 bp, Bacillus sp.
gtggtaaaacaaggcgacactctttctgctatcgcttcacaatacagaacaaccgtaagtgagatcactgaaacgaatgaaataccgaatcccgacagccttgttgtcggacaaaccattgtcattccaatagccggccagttctatgatgtgaagcgaggtgataccctgacatccatcgcccggcagttcaatacaacagcagccgagctcgcaagggttaaccgcatccagttaaataccgtgcttcagattggtttccgtttatacatccctccagctcctaaacgagacatcgaatcaaatgcttatttggagccccgaggaaatcaagtcagcgaaaatctccagcaggcggccagagaagcgtcgccctacttaacgtaccttggcgcattcagcttccaggcacagcggaacggaaccttagtcgcaccgcctttaacgaatttaaggagcattacagaaagtcaaaatacaacattgatgatgattataacgaacctagaaaaccaggcatttagtgatgaacttggccggatccttttgaacgacgaaactgtaaaaagaaggcttctaaatgaaatagtggagaatgccaagagatatggcttccgtgacattcatttcgactttgaatatttgcggccccaggatagagaggcctataatcaatttctccgcgaagcaagggatctttttcatcgagagggcttagaaatttctacggcacttgctcctaaaacaagtgcaacacagcagggcagatggtatgaagctcatgattacagggcacatggccaaattgtcgactttgttgttctcatgacatatgaatggggctatagcggcgggccgcctcaagcggtttctccaattggacctgtccgtgatgtcatagaatatgctttgactgaaatgcctgcgaacaaaattgtcatgggccagaatttatatggatatgactggacgctgccatatacagcagggggaactccagcaagagcagtaagccctcagcaagcaattgtcatagctgatcagaacaatgcttccattcagtatgaccaaaccgctcaagctcctttcttccgctatactgatgcagaaaacagaaggcacgaggtatggttcgaggatgcccgctcgattcaagcaaaattcaatctgattaaagagctgaatttaagaggcatcagctattggaagttgggtctttcctttccacaaaactggctgctgctgtctgatcaatttaatgttgtcaaaaagacgtttcgataa

SEQ ID NO: 790 - DNA, 279 bp, Streptomyces sp.
gtgtccatactcatcaaccgcacgaactgcaatcagaacgactacttcgagatacacaacaacaatggccgtgacacgctctgcttcgccaacgccggttcgatgcccgtcgccatctatggcgtcaactggatcgagtcggggaacaacgtggtgaccttcgagttccagcggaacctgagcgagccccggctggagaccgtcaccctcgacaagtggcgttcgtggcagcccggtcagccgtccattcaccgggtcacttggatcagaatccactga

SEQ ID NO: 791 - DNA, 981 bp, Alkanindiges sp.
atgtcaaacaaaggttctttcattgcactcaatcaggttctcactaccaatgattatctggtgtccagcaaccacgcattttttgccatcatgcagggcgatggcaacctatgcgtttaccggggctccgcactcgatgccaacaagggttttttgtggggcgcactgggtcaaagtcagcccaatggcgattactttagcatcatgcagggcgatggaaatttatgcgtgtataaaggcacttgcccaagtgataacaagggctttgtctggggcgcactgaaccagagccagcccaatcaggcttattttgctgtgctacaggatgacggcaacctgtgcgtatacaagggcaccaaccccagtgacaatcagggcggcgtctggtgcgccagtgcgattgatccggtagtggatattgaaatttccagtattaattatgatgtggcagcagcaaaaatcattaaatccaccccggctgacctgtatcgccagagcgtcactaataataccgcacagtcgcaaaccagcagcattagtggttctgaatcagtttcagaaacctcgggctggtcagattcactggcggtaaaagttggagtgagcaccacctttaaaaccggcattccttttctggcagaaggcaaaattacggtttcactggatgtaaccaatacttatacctggaatggctccaccacgcgcaccaaaacctggtcgtttaataccccagtcaccgtacctgccaattctacctatgtggcgctgattgctgccacggtcagtaccattagtgtgccgtacaccctgacaggcattctgatcctaaagtcaggggcacgagtgccgggtattgttaacggtatgtataccggttcaaactcgcatgacctgacggtgacctacattacgcagaatgccgtaaccctgaaaattgaatcggtgacccagccggtagaacatgccagactggtggcttaa

SEQ ID NO: 792 - DNA, 1416 bp, Streptomyces sp.
gtgaccgtttcgcgtgcacgccgccggcgccgtgatctgaccctcgccctcgccgccgtaccggcgctcgtcctcggcgcgttgaccgccgcgccggcgcacgccgcccccgccgacgacatccgggtgaacgaggtcgtcaccacagggtccgtcgaggactcgatcgagctgtacaacaagggcgcctcgacggtggacgtctccggctggatcctcaaggacgacagcaacagctcgaagtacacgatcgccgcgggcaccacgctcgccccgggcgccttccgcgccttcgacgtgcacgggaagttcggcctcggctccagcgacaaggcacggctgtacctgcccgacggcagcacgctcgtcgacagccacacgtggagcagccactccgcgccgtcctggtcccgctgccccgacggcaccggggcgttcaaggcggccgccgtcaccctcggcgcggccaactcctgcggcggaggcggcggtacgggcccggtggcctggcccggcggcagcacggtgaccacggccgacgcggcgaacgtcttcggcggcgacctgagcggtctgcaccaggagggcgacgtgctctgggccgcgcagaacagcggcaagctgtggcggctggtccggaacggctccggcggctggacccccgacacggcgaacggctgggcctccggcaagaccctgcgcttccccggtggttccggcgcgcccgacggcgagggcgtcacggtcaccggcgcgggcgccgcggccggcgtcttcgtggcgagcgagcggaacggcgacgcgtccggcaccagccggctgtccgtgctccggtacgacgtcgccggtacgggctccacgctcaccgccgcccgcgagtggaacctgaccgcggaccttcccgcgacgggctccaacgccggcttcgaggcgatcacctgggtccccgacaccgccctcaccgccgccggcttcaaggactcctcgaccggtgccccgtacgccccggccggatacggcgcccatggcggcggcgtgttcttcgtcggcgtcgaggggaccggtgccgtccccgggtacgtcctccaggactccggggccttcacccgcgtcgcctccgtgagcaccgggatggcgggcgtgatggaggtccagtgggagccccaggcgtcccggctgtgggccgtgtgcgacgacacgtgcggtgggcagcaccgcacgctgaaggtcgacgcctcgggcgccttcgccgtcgccgccacgtacgcccggcccgccgggatgcccgacctcaacaacgagggcttcgccctcgcgggcgccgacgagtgcgtggccggcagcaagcccgtctactggtcggacgactccaacaccggcggccacgccctgcgccgctccaccgtcacctgctga

SEQ ID NO: 793 - DNA, 1419 bp, Streptomyces sp.
gtgaccgtttcgcgcgtacgccgccggcgccgtgatctgcccctcgccctcgccgccgtaccggcgctcctcctcggcgcggtgaccgccgcgccggcccaggccgcgcccgccgacgacgtccgcgtcaacgaggtcgtcaccaccggctccgtcgaggactcgatcgagctctacaacaagggcacctcggccgtcgacgtctcgggctggatcctcaaggacgacgacaacggctcgaagtacacgatcgccgccggcaccacgctggccccgggcggcttccgcgccttcgacgtgcacggcaagttcgggctcggctccagcgacaaggcccggctgtacctgcccgacggcagcaccctcgtggacagccacacctggaccagccactcctcgccctcgtggtcccgctgccccgacggcaccggggcgttcaaggccgccgccgtcaccctcggcgccgccaacaactgcggcgggaccggcggcggcacggggccggtggcctggcccggcggctcctcggtggccaccgcggacgcctcgaacgtgttcggcggcgacctgagcggtctccaccaggaggggaacgtcctctgggccgcgcagaacagcgggaagctgtggcggctggtccgggacggctccggcggctggacgcccgacacggccggcggctggggctccggcaagaccctgcgcttccccggcggttccggcacccccgacggcgagggcgtgacggtcaccggcgcgggctccgcgggcggcgtgttcgtcgcgagcgagcggaacggcgacgcgtccggcacgagccgcctgtccgtcctgcggtacgacgtctccggtacgggctccgccctcaccgccacgcgcgagtggaacctcaccgccgacctgccgtcgaccggctccaacgccggcttcgaggcggtcacctgggtccccgacaccgcgctcaccggtgccggcttcaaggacgcctcgaccggcgccccgtacgacccggcgggctacggggcccacggcggcggcgtcttcttcgtcggcgtggaggggaccggggcgctccacgggtacgtcctccgggactccggcgccttcacccgcgtcgccaccgtccccaccggcatggcgggcgtcatggaggtccagtgggagccccaggcgtcccggctctgggccgtctgcgacgacacctgcggcggccagcaccggacgctgaaggtcgacgcctccggcgccttcgccgtgaacgccgtgtacgcccggcccgccggcatggccgacctcaacaacgagggcttctcgctcgccggcgccgacgagtgcgtggccggcaccaagccggtctactggtccgacgactccaacaccggcggtcacgccctgcgcaggggcaccgtcaactgctga

SEQ ID NO: 794 - DNA, 1431 bp, Kitasatospora sp.
gtgaccgaaccgcgcgcccccaggtggcgtcgtcgcctctccctgctgctggccgccgttgcactgccggccgtcggcacgggagtgctgaccgcctcgcccgccgccgctgcgccggccgacgacatccgcctcaacgaggtggtgacgaccggatcggtgaacgactcgatcgagctgtacaacaagggcacgtcgacgatcgacgtgtccgggtggatcctcaaggacgacaacgacagcagcaagtacaagatcgcgtccggtaccagcctggccccgggcggcttcaaggcgttcgacgtgcacggcagcttcggcctgggctccgcggacagcgcccggctgtacttggccgacggtgtcaccctggtcgattcgttcagctggacctcgcactccaacccgtcctggtcgcgctgcgccgacggcaccggcggctggacccaggccgccaccctgacgctcggcgccgccaacaactgcggctccagcggcggcggttccacgaccccggtggcctggcccggcggttcgacggtcgccaccgcggacgccgccaacgtgttcggcaccgacctgtccggcctgtaccaggagggcggggtgatgtggggcgcgcagaactccggcaagctgtggcggctggtcccgaacggctccggcggctggacgcccgacaccgccaacggctggggctccggcaaggcgctgcgcttcccgggcggcaccggcacccccgacgacgagggcgtcaccctgaccggcgccggttcggccggcggcgtgtacgtctccagcgagcgcaacgccgacgcctcgtccaccagccggctgtccgtgctgcgctacgacgtgtccggcaccggcagcacgctgagcgccacccgggagtggaacctcaccgccgacctgcccgccaccggcgccaacctcggcctggagggcatcacctgggtgcccgacagctacctgaccggcaccgggttcaaggacgccgccaccggcgcggcctacgacccgagccgctacgccgcgcacaccggcggcgtgttcttcgtcggcgtcgaaggctccggcaccgtctacggctacgtgctgctggaggccggcgggttcaccaaggtcgcgaccgtcagcagcgggatggccggcgtgatggaactccagtgggagccgcaggccaaccggctctgggtggtctgtgacgacacctgctccggccagcaccggaccttccaggtgaacgcgagcggcgcgttcgccgtcaccgccgtctacaaccgcccgtccggcatgccgaacatcaacaacgagggcttcacgccggccggcgccgacgagtgcgtgggcggcagcaagccggtctactggtcggacgacagcaacaccggcagccacgtcctgcgcaagggcagcatcagctgctga

SEQ ID NO: 795 - DNA, 1419 bp, Kitasatospora sp.
gtgaccgcatcgcgcgcaccgcgtcgacgccgcagcctcgccctcctcctcgccaccgccctcggccccgtgctggccaccggcgtgctcggggcgtccccggccgccgccgcgccggccgacgacatccggatcaacgaggtggtgaccaccggatccgtcaacgactcgatcgagctcgtcaacaagggcaccgccgccgtcgacatctcgggctgggtcctcaaggacgacaacaacagctccagctacaaggtcgccgccggcaccaccctcgccgccggcgcgttcaaggccttcgacgtccacaacgccttcggcctcggctccgcggacaaggcccggctgtacctgccgaacggcagcaccctggtcgacagcttcacctggagcacccactccgcgccgtcctggtcgcgctgtcccgacggcaccggcgccttcgcccaggcccagctcaccctgggcgcggccaacagctgcggctccggcggcggcaccccggtggcctggcccggtagcagcagcatcgccaccgccgacgcctcgaacgtcttcgggaccgacctgagcggtctctaccaggacggcggcgtgctgtggggcgcgcagaactccggcaagctctggcgcctgctccccgacggctccggcggctggacccccgacacggcctccggctggagctccggcaagacgctgcgcttcccgggcggcaccggcagccccgacagtgagggcgtgaccgtcacctccgccggggcggcgggcggcgtcttcgtctccagcgagcgcaacggcgacgcgtccggcaccagccggctgtccgtgctgcgctacgacgtgagcggcaccggcagcacgctgaccgccaccaaggagtggaacctcaccgcgagcctgcccgcggtcggctccaacctcggcctggagggcatcacctgggtgccggacagcgcgctgaccgcggccggcttcaaggacgagtcgaccggcgcggcctacgacccggccgggtacgccgcccacaccggcggggtgttcttcgtcggggtcgagggcaccggcgccgtgcacggcttcgtcctccaggacagcggcagcttcaccaaggtcgcctcgaccagcaccggcctggccggggtgatggaggtccagtgggagccgcagacctcgcgcctgtgggtggtctgcgacgacacctgcaacggccagcaccgcaccctgaaggtcaacgcctccggcgtgttcgcgaccaccgccgtcttcaaccgcccgaccgggatgtccaacctcaacaacgagggcttcgcgatcgcgggggccgccgagtgcgtcggcggcagcaagcccgtctactggtccgacgacagcaacaccgggggccacgccctccgcaggggcaccgtcacctgctga

SEQ ID NO: 796 - DNA, 1425 bp, Streptomyces sp.
gtgcccgaagtacccgctccccgtcggcgccgtcgcctcgccttcctctccgccgccgtcgccggccccacgctggtcgtcggcacggtgctggcgccttcggcccacgccgccccggcggacgacatccgcatcaacgaggtggtgaccaccggcagcgtcaacgactcgatcgagctgtacaacgagggccccgtcgccgtcgacgtctcgggctggatcctcaaggacgacaacgacggctcgaagtacgcgatcgccgccggcacgacgctggcccccggcgcgttccgtgccttcgacgtgcacaacgcgttcggcctgggctccgccgacaaggcccgcctctacctccccgacgacaccatcctggtcgacagcttcggctgcagcagccactccaacccctcctggtcgcgctgtcccgacggcaccggcgcgttcggcgcggccccggtgaccctgggcaccgccaacgcctgcggcggcgacaacggcggcaccacacctgcggcctggcccggcggcagttccgtcacgaccgcggacgccgccgacgtcttcgggcaggacctcagcggcctgtaccaggagaaggacgtgatgtggggcgcgcagaactccggcaagctctggcggctggtcccggacggttccggcggttggaagccggacgccgcgaacgggtggacggccggcaagtcgctccgcttctccggcggttccggcaccccggacagtgagggcgtcacgctcaccggcgccggctccccgggcggcgtgttcgtcgccagcgagcgcaacggcgacgcgtccgggatcagtcgtctgtccgtcctcaggtacgacgtcagcggtagcggcaccaccctggcggccaccagggagtggaacctgacctccgacctgccgtcggtgggttccaacctcggcttcgagggcatcacctggatccccgacacctacctgacctcatccggcttcaaggacgagtcgaccggctcggcctacgacccgaaccggtacggcggccacaccggtggggtcttcttcgtcggcgtcgagggcaccggcaaggtctacgggtacgtcctgcaggactccggcgcctacacccgcgtcgcgtccatcgacagcggcatggcaggcgtgatggaactgcagtgggagccgcaggcctcgcgtctgtgggtggtctgcgacgacacctgcgacggccagcaccggaccatgaaggtcaacgcctccggcaccttcgccaccacggccgtctacgaccggccgagcggcatgcccaacctcaacaacgaggggttctccgtctccggggccgacgcctgcgtcagcggctccaagccggtgtactgggccgacgacagcaacgacggcggtcacgcactgcgcaagggcagcatcacctgctga

SEQ ID NO: 797 - DNA, 1389 bp, Kitasatospora sp.
atgctgttggccgccgtcgccctgcccgccgtcggagtgggagtgctgacggccccgccggccgccgccgcgccggcggacgacgtccggatcaacgaggtggtgacgaccgggtcggtgaacgactcgatcgagctgtacaacaagggcgccgcgacgatcgacctgtcggggtggatcctgaaggacgacaacgacagcagcaagtacaagatcgcctcgggcaccagtctggccccgggcgggttcaaggccttcgacgtgcacggcagcttcggcctcggctccgcagacagcgcccggctgtacctggcggacggcgtgaccctggtcgactcgttcagctggagctcgcactccaacccgtcgtggtcgcgctgcgccgacggcaccggcggctggacccaggccgccacgctcaccctcggcgccgccaacaactgcggctccggcagcggcggttccacgacgccggtggcctggcccggcggttcgacggtcgccaccgcggacgcggccaacgtgttcggcaccgacctgtccggcctccaccaggagggcggcgtgatgtggggcgcgcagaactccggcaagctgtggcggctcgtcccgaacggctccggcggctggacgcccgacaccgccaacggctggggctccggcaaggcgctgcgcttccccggcggcaccggcacccccgacgacgagggcgtcacgctgaccggcgcgggctcggccggcggcgtgtacgtctccagcgagcgcaacgccgactcctcgtccaccagccggctgtccgtgctgcggtacgacgtctccggcagcggcagcacgctgaccgccacccgcgagtggaacctcaccgccgacctgccggccaccggctccaacctcggcctggagggcgtcacctgggtgcccgacagctacctgaccggtgcgggcttcaaggacgcctccaccggcgccgcctacgacccgagccggtacgccgcgcacaccggcggcgtgttcttcgtcggcgtcgagggctccggcaccgtctacggctacgtgctgctggaggccggcgggttcaccaaggtcgccacggtgagcagcggcctggccggcgtgatggaactccagtgggagccgcaggccaaccggctctgggtggtctgcgacgacacctgctccggccagcaccgcaccttccaggtgaacgcgagcggcgccttcgcggtgaccgccgtctacaaccgcccgtccggcatgccgaacatcaacaacgagggcttcacgctgtccggcgccgacgagtgcgtgggcggcagcaagcccgtctactggtcggacgacagcaacaccagcagccacgccctgcgcaagggcagcatcagctgctga

SEQ ID NO: 798 - DNA, 1422 bp, Streptomyces sp.
gtgaccgcatcgccctcccgcccgcggcggccccgcgcgctcgcccgcttcctcgtcgccacgccgctgctggccgccggtgcgctgaccggggtgccggcggcgcaggcggccccggccgacgacgtacgcatcaacgaggtggtgaccaccggaggcgtcaacgactccgtggagctgtacaacaagggcaccgcctcggtcgacgtctcggggtgggtgctgaaggacgacgacaaggaccactcgtacaagatcgcctccgggacgaccctggcgcccggcggcttccgggcgttcgacgtgagcggggcgttcgggctcggctcggcggacgaggcgcggctgtacctcgcggacggcaagacgcaggtggacggcttctcctggagcaagcactccgacccgtcctggtcgcgctgcgccgacggcacgggtgcgttcaagcaggcggcctcggtgacgctgggcgccgcgaacgcctgcggcggcgggggcggcggtgactccacgacgcccgcggcgtggcccgggggcagcgcggtcgccacggcggacggctccaacgtcttcggcgaggacctgagcggcctctaccaggacggcagcgtgctgtgggccgcgcagaacagcggcaagctgtggcgcctggtccgggacggctccggcgcctggaagccggacaccgcgaacggctggtcctccggcaagaccctccgcttccccggcggctccggcagcccggacagcgagggcgtgaccgcgacgggcggcgggatcttcgtcgccagcgagcgcaacggggacgcctcgggcacgagccgtctgtcggtgctgcggtacgacgtgagcggttcgggctcctcgctgaccgccgccaaggagtggaacctcacctcggacatcccgtcgacgggctccaacctcggcctggaggccgtgacttggatcccggacgcggcgctgacgagcgccggcttcaaggacgcgtcgacgggcgcggcgtacgacccgtcccgctacgccgcccacagcggcggcgtcttcctcgtcggtgtcgagggcacgggcatggtgtacgggtacgtcctggccgactccggttcgtacacccgggtcgcctccttcagcagcggcatgtccggtgtgatggagctccagtgggagccccaggcatcccgcctctgggcggtctgcgacgacacctgcgacggccggcaccggacgctgaaggtcgacgcggcgggcacgttcgccgcggtcgcggtgtacaaccgcccgagcggcatgccgaactacaacaacgagggcttcgcgctggccggcgccgacgagtgcgtggcggggtcgaagccggtgtactggtcggacgacgccaatgacggcgggcacgcgttgcggcggggcagcgtcagctgctga

SEQ ID NO: 799 - DNA, 1410 bp, Streptomyces sp.
gtgactgcatcgactgcccgtcggcggccccgtgctcttgcccgcattctcgttgccgcgcccctgctggccgcctgcgggctgaccggtgcgccggcggcgcacgcagccggggcggacgacgtgcgcatcaacgaggtggtgaccaacggcgacgtcaacgactccatcgagctgtacaacaagggcggcgccgcggtcgacgtctcgggatgggtactcagggacgacgacaaggaccacgcgtacaagatcgcttccgggaccacgctggcacccggcgggttccgggccttcgacgtcagcggcgcgttcgggctgggctccgacgacgaggcgcggctgtatctcgcggacggcaagacgcaggtcgacggcttttcctggagcaagcactccggcccgtcctggtcgcgctgccccgacggcaccggcgccttcgaacaggcgggctcggtgaccctcggcggcccgaacgcgtgtgggggcgggggttccacgacgcccgtggcatggcccgggagcggcgacgtggccaccgcggacggctccaacgtgttcggcgaggacctcagcggcctgtaccaggagggcgatgtgctgtgggcggcgcagaacagcggcaagctgtggcgcctggtgcgggacggctccgggggctggaagccggacaccgcgaacggctggtcctccggtaggacgctgcgcttccccggcggttccggctcccccgacagtgagggggtcaccgcgaccggcggcggggtcttcgtcgccagcgagcgcaacggggacgcctccggcaccagccgcctgtcggtactgaagtacgacgtcggcggatcgggctcctcgctgaccgccgccaaggagtggaacctcacctccgacctgccctcgaccggttccaacctcggcctcgaagcgatcacctgggtcccggacgcctcgctgaccggcgccggcttcaaggacgcctcgaccgggtcggcgtacgacccctcccgctacggcgcccacagcggcggggtgttcttcgtcggcgtcgagggcaccggcatggtccacggctatgtcctggccgactccggctcgtacacccgcgtcgcctccttcggcagcggtatgtccggcgtgatggaactccagtgggagccgcaggcatcgcgcctgtgggcggtctgcgacgacacctgcgacggccggcacaccaccctgaagatcgacacgaccggcgccttcaccaccgtcgccgcgtacaaccgcccgagcggcatgcccaactacaacaacgagggcttcgccctggccggtgccgacgagtgcctcgccgggtccaagcccgtctactggtccgacgacgccaacgacggcggccacgcactgcgccgtggccgcgtcagctgctga

SEQ ID NO: 800 - DNA, 351 bp, Amycolatopsis sp.
atgcgaaagagtctcaagaggctttcggtcgtcggtgcggccgccctcggtctgctcgtcgctgttccggccagccctgccttcgccatcggtgaggtcgcctgtggcaacagggatgacttcgtgaagctggacatctcgttcggcaacggcatggggacgaacaagtgcttcgcgaacggcggcgtcaccggcacgaacatcggcggtgtctacaacgtcttctccggcaacaacaaggtgacggtcaactacgagcgtaacggccggtacgaatcgtcgaccctcggatactggcagggcgtcggcttctccggcaccgtccgggtgtatgaggttcgcatctggtaa

SEQ ID NO: 801 - DNA, 351 bp, Amycolatopsis sp.
atgcgaaagagtctcaagaggctttcggtcgtcggtgcggccgccctcggtctgctcgtcgcgattccggcgagcccggctttcgccatcggcgaggtcgcctgcggcaacagggacgacttcgtcaagctggacatctcgttcggcaacgggatgggcaccaaccggtgcttcgcgaacgccggcgtcaccggcacgaacatcggcggcgtctacaacgtcttctcgggcaacaacaaggtgacggtcaactacgaacgtgacggccggtacgaatcgtccaccctcgggtactggcagggtgtcggtttcgcgggaaccgtccgggtttacgaggtgcgcatctggtga

SEQ ID NO: 802 - DNA, 396 bp, Amycolatopsis sp.
atgacggttctaaccgtcattaccactcacgaccagcccaggcccatccttggcgcttctgccctactcgcggttgtcggcgcgaccgcgctcggcctggtcgcggccgttccggccaccccggcgttcgccatcggcgaggtcgcctgcggcaaccgggacgacttcgtgaagctggacatttcgttcggcaacggaatgggcaccaaccgttgtttcgccaacgccggcgtcaccggcacgaacatcaggggcgtctacaacgtcttttcgggcaacaacaaggtgacggtcaactacgaacgcaacggccgctacgaaacgtcgaccctcggctattggcagggtgtcggcttcgccgggaccgtgcgggtctacgaagtgcgcatctggtga

SEQ ID NO: 803 - DNA, 354 bp, Amycolatopsis sp.
gtgatctcgagcaagaagacagccggccgcgtcatggccgtggcggccgcggccgccgccacgttcaccatggtcgtcccgaccgggacgtcgttcgccatcgaccacatcccttgccgcgccggggagagcttcctgaagatctggtcgcatctcggcggccgggacagcgtggactgctacgccaaccgcggcaagatcgggttcggcggctggtgggtcgacaagatcgagacgggcaacaacgacctgatctacagcgacgccaacggcgattcggtgagagtcaaccggtggacgatcatcacgtacccgaaccgcccgccgcgcgtgaactacatcgagatcctctga

SEQ ID NO: 804 - DNA, 354 bp, Amycolatopsis sp.
gtgatctcgagcaagaaggcggcccggcgtgtcctggcagcggcggccgccgctgccgccgcgttcagcatgctggtgccgacaggcacctcgttcgccatcgaccacatcccgtgccgggacggggagaacttcctgaagatctggtcccacctcggcgggagcaccagcgtcgactgctacgccaaccgcgggaggatcggcttcggcggctggtggatcgacaggatctacaccggcaacaacgacctgatctactacgacagcaacggcgccgacgtgagaatcaaccggtggaccgatatcagtttcccgaaccgtccgccgaaggtccgtgtcatcgaaatcctctga

SEQ ID NO: 805 - DNA, 354 bp, Streptomyces sp.
gtgaaccagaagacgaagaaggccgtgcgctccacggtcgtggccttcgccgccgcgaccgcgctcgcggcgacgctgcccacgggcaacgcctacgccatcgaccacatcccctgccgcgccggggagaactacctcaagatctggtcgcacctcaacggcaaggacagcgtcgactgctacgccaacaaggggaagatctccttcggcaactggtgggtcgaccgcatctccaccggcaacaacgacctcatctacagcgacgccaacggcgactccgtacgggtgaaccgctggaccgacatcacctacccgaaccgccccccgaaggtctcgtacatcgagatcctctga

SEQ ID NO: 806 - DNA, 357 bp, Streptomyces sp.
atgttctcgaacgcgaggaaagccgtgggttcgatggccgcggccttcgccgcggcggccacgctcaccgtggccgtgccgtccggcagtgccttcgccatcgaccacatcccgtgcgacggaagccgcaacgacttcctcaagatctggtcgcacctcgacggccgtgacagcgtcgactgctacgcgaacggcgggtcgatcggcttcggcgggtggtgggtcgaccggatctccacgggaaacaacgacctggtctactccgacgacaatggcgactcggtgagggtcaaccgctggaccgacatctcgtacccgaaccgcccgccgaaggtcaactccatccggatcctctga

SEQ ID NO: 807 - DNA, 354 bp, Streptomyces sp.
atgctgtccaagacgaaaaaggtcgggcgttccgtagccgtggcgttcgccgcggctgccatgttcaccgtgaccgtaccgaccggcaacgcattcgccatcaacaaggtcgagtgccgcggcggggagaacttcctgaagatctggtcgcacagcggtaacaggcatagcgtggactgctacgccaaccgcgggcgcatgagcttcggcagctggtgggtcgacaggatctacacgggcaacaacgacctgatctactacgacgccaacggcgattcggtgcgggtcaaccggtggaccgacatttcctaccccaaccgtccgccgaaggtgaaggacatcgaaattctgtga

SEQ ID NO: 808 - DNA, 354 bp, Streptomyces sp.
gtgatctcacatgccaagagggtcgcgcgttccgtgaccgtggcgttcgctgccgctgccgcgttcaccatgaccgtgccgagcggcaacgccttcgccatcgaccacgtccaatgccgtggcggggagaacttcctgaagatctggtcgcacagtggcgggcgccagagcgtggactgctacgcgaaccgcgggaagacctccttcggtgggtggtgggtcgacaagatctccaccgggaacaacgacttgatctactacgacgccaatggcgattcggtgaagatcgaacggtggcgtgagatcaccttcccgaaccgcccgccgaaggtcaacgccatcgaaatcctgtga

SEQ ID NO: 809 - DNA, 354 bp, Amycolatopsis sp.
gtgatctcgaccaagaagacggcgcggcgcgttctggccgcggcggccgccgctgccgccgcgttcagcctgctcgtgccgaccggcacgtctttcgccatcgaccacatcccttgccgggacggggagaacttcctcaagatctggtcgcatctcggcggtagcagcagcgtggactgctacgccaaccgcggcaggatcagcttcggcgactggtggatcgaccggatctacaccggcaacaacgacctgatctattacgacagcaatggttccgacgtcagaatcaaccggtggaccgacatcagtttcccgaatcgcccgccgaaggtccgcgtcatcgaaatcctctga

SEQ ID NO: 810 - DNA, 354 bp, Amycolatopsis sp.
gtgatctcgagcaagaagaaggcccggcgcatcctggccgcggcggccgccgctgccgccgcgttcagcctgctcgtgccgaccggcacctcgttcgccatcgaccacatcccctgtcgcgacggggagaacttcctgaagatctggtcacacctcggcgggagcaccagcgtcgactgctatgccaaccgcgggaggatcggcttcgggggctggtggatcgacaggatctacaccggcaacaacgacctgatctactacgacagcaatggcgctgacgtgagaatcaaccggtggaccgatatcagtttcccgaatcgtccgccgaaggtccgtgtcatcgaaatcctctga

SEQ ID NO: 811 - DNA, 354 bp, Streptomyces sp.
gtgttctcgaaaacgaagaagctcatgagtgtcggggctgccacgttcgcggccgcggcggcgttcacggtggcggtgccctcgggcagcgcgttcgcgatcgaccacgtcgagtgccggggaggcgagaacttcctgaagatctggtcgcacaacggaggcattcagagcgtcgactgctacgccaacgcgggccgcaccgacttcggcaactggtgggtcgaccggatctccaccgggaacaacgacctcatctactacgacgccaacggcgattcgatcaggatcaaccggtggacggacatctcgttcccgaaccgtccgccgcaggtgaagtccatcgagatcctgtga

SEQ ID NO: 812 - DNA, 576 bp, Arthrobacter sp.
cttccttgggtggcaccaacaatgaaaaaactgtccatctggctcgcggctatcctcatggccgtcgggttgggaatcctggttccggggcccgcctcggcaaccacatcgtattgcggcctggtctggggatcgttggcggaaaccgaccagcgcttcagcaagacaaccgtcaccaacgtccggaccgggcagcactactgctttgaccggatggtgctggacctcaagggcccggctaccggttacaacgtgcgttacgtaccccgtgtggtccaggacgggtccgggttcacggtccctgtccgtggcggcgcgcgcctgcaggtcaccctgcatgcgccgtcctatgacccctacagcggcgagcccacgtacaaccctcctgccaaccaggctgaactctccaacgttgccaattaccagaccttccgccaggtggcctgggcgggcagctacgaggggtacaccaacattggcctgggcgtccgggcccgccttccgttccgggttttcaccctggacggaccgggttccaactcgcgccttgtgattgacgtggcccacttctggtga

SEQ ID NO: 813 - DNA, 552 bp, Arthrobacter sp.
atgaaaaagttctccacctggctcgcggccatcctgctggccgcggggctgggcatagcggttccggggcaggcctccgcaaccacgtcctattgcggcctcgtctgggggtccctggccaagactgacggcaccctggccgccgcatccgtcaccaacgtccgcaccgggcggcattactgctttgaccggatggtggtggacctcagcggcccggccgtgggctacctggtgcgctacgtgcccaaggtagtcgaagacgggtccggctttaccgttcctgtccgcggcggtgcacggctgcaggtgaccgtgaaggctccggcctatgaccccaacaccggccagccgacgtacacgcccgccaacagggccgagctctccaacgttgccgggtaccagactttccgccaggtggcctgggccggcagttttgagggccagacaaacattggactgggggtccgtgcccggcttccgttccgggtgttcaccctggacgggcccgggtccggttcccggctggtagtggacgtcgcacactactggtaa

SEQ ID NO: 814 - DNA, 516 bp, Arthrobacter sp.
atggccgtcgggctgggaatcctggttccggggcccgcctcggcaaccacctcgtattgcgggctggtgtgggggtcactggccaaagctgaagactcgttcggcaaagcatccgtcaccaacgtccggaccgggcagcactactgcttcgaccgcttggtggtggacctcaacggcccggaaacgggctacaacgtgcgttacgtcgcgaacgtggtccaggacggttccggcttcacggtccccgtccggggcggcgcccggctgcaggtcacggtcaatgcccccgcctatgatccggaaaccgggcagcccacgtacaaccccgctaatcaggctgaactcaccaacgttgccaattaccagaccttccgccaggtggcttgggccggcagctacgaggggtacaccaacctcggactcggcgtccgtgcccgccttccgttccgggtgttcaccctggatggcccgggttccggttcccgcctggtggttgatgtggcgcacttctggtga

SEQ ID NO: 815 - DNA, 564 bp, unknown
  environmental sample
atgggtggccccacaatgaaaaagttctccacctggctcgccgccatcctcatggccgccgggctgggaatcgtggccccggggcctgcctcggcaaccacttcctattgcgggctcgtctgggggtccctggcgaaagccgaccaggacatgagcaccgccaacgtcaccaaggtccgcacggggcagcactactgcttcgacaggatggtagtggacctcaacggccctgccgccggctacaccgtgcgctacgttccccaaatagtgcaggacggatccgggttcaccatcccggtccgggggagcgggcgcctgcaggtgacagtcaacgcacccgcctatgacgggaacggcaactccacctacaccccggctgaccctgccgagctctccaacgtggccggataccagaccttccgccagatggtctgggccgggagctacgagggctacaccagcattggactgggcgtccgtgcccgccttccgttccgggtcttcaccctggacgggccgggttccggatcccgcctggtggtggacgtggcgcactactggtga

SEQ ID NO: 816 - DNA, 552 bp, Arthrobacter sp.
atgaaaaaactctccatctggttcacggccatccttgtggccgtcggactggggctgttggttccggggcccgcctcggcaaccacctcgtattgcgggctcacatggggctcgctgctgaagacggacgactccatgagcggcgcgcccgtcaccaatgtccgcaccggacagcactactgcttcgaccggctggtggttgacctgggcagcggtccggttcccggctattacgtccgctacgttgggcaggtcacccaggacggttccggcaagccggtggacgtccggggcggcgcccgtctgcaggtggtggtccgggcgccggcctacaacgacagtggcaacgccacgtacaccccctccgatcaggccgagctctccaacgtctccggctaccaaaccttccgccaggtggtttgggcaggaagctttgagggccagagcactctcggcgttggcgtccgcgcccgtcttccgttccgtgtctttacgctggacggaccgggctcaggctcccggctggtggtggatgtggcgcacttctggtga

SEQ ID NO: 817 - DNA, 546 bp, Arthrobacter sp.
atgaaaaaactcctactctggctcacggcgcttctggcggccgtcgggctgggcatcctggctccggggcccgcttcggcagccacctcctattgcgggctcgcatggggatctcaggacaagacagcgcccgagatgagctcagcatccgtcaccaacgtccgcacagggcagcaaccctgcttcgaccggatggtggtcgaccttaacggccccgtcaagggctacacggtccggtacgtacccgagatcatccaggacggcaccggcttcacgatcccggtctacggcaacgcacgcctgcaggtcgtcgtgaatgcaccctcctatgacagcaatggcgtcacctacaacccggccgcaaaggctgagctgtccaacgtggccggctaccagaccttccggcaagtggtctatgcgaatagctttgaaggttccaccagcatcggcctgggcgtccgtgcccggcttcccttccgggtcttcaccctcgacgggccagggtccggttcccgactgatcgtggacgtggcccacttctggtga

SEQ ID NO: 818 - DNA, 546 bp, Arthrobacter sp.
atgaagaagttcctcacctggctcgcggcaatcctgttggcttccgggctgggaatcgtggtccaggcgcccgcctcggcggcgccctactgcggcctcacatggggctcccttgcgaagaccgggcaggatacggggaccgcatcggtcaccaatgtccggaccgggcagcactactgcttcgaccggctggtggtggacctcaacgggcccgccgtgtcctacacggtgcagtatgtgccgcggattgagcaggaaggctccggggccttcatcccggtacggggcggcgcgcgcctgcatatcagcatcaaggcgccgtcctacgaccagaacggcaaccccacctacaacccggcggacaaggctgaactcagcaacgtggccggctaccagacgttccgccaggtggtttcggccggaagcttcgaggggtacacaagcctcggtctgggcgtccgggcccgcctgccgttccgggtcttcaccctggccggtcccggcccgggctcgcgcctggtgatcgacgtggcgcactactggtga

SEQ ID NO: 819 - DNA, 786 bp, Arthrobacter sp.
atgcggtcggctcgacctctgattttcttcctctcggttacagcatcagcctcgctctgcctgagcggctgcatggtcaacgcctcggccgaaaaccgggacacgggaaccgccccggccactcagccgccctcagccagcgctccgccggccaacccatcggcgaaaccgacgacgaccgaaacgctgccgccgccaaccactgcaccagcggagccgctcccgtcggccgtcccgccgtcgtcgtcgtccgatcctgcacctgccgccgaccctgtaacttttaccttcgctgacggccggctgtcctttacccacccggccggctggcgggtggagcacagccagactgtggcgtcaccctctgttcaaaacgcgaccgtgtatgacaccagcggaaacgagcagatcgggatcttctacagcgaggtggggggtggtgttgccggtccccacaccaggaccgtgttcttctcagagccagtcccgggattgcagggccattccggtcctgcctccggtcctgcaaccgcccatgtctccttctatgtcgaccatatttacggtgagccgcattactcgctgtcgctcacgcacagagaagccctctcgccggatggcacggaaggcgctgacgttgtcatcgtcggcggcaaccgcgtgctggccgcaaacgtcgtcttcaccggcggaccgtttgcaagtgacgaggcggccaaggcctggttcgcggggactgaaggccaggccctgaaggcgattctgatgagcttttcctaccgctga

SEQ ID NO: 820 - DNA, 774 bp, Arthrobacter sp.
atgcattcggcacgacgtctgattttcttcctctcggttacagcatcagcctcgctctgcctgagcggctgcatggtcaacgcgtcggccgaaaaccgggacacgggaaccgccccggccactcagccgccctcagccagcgctccgccagccaccccatcggcaaagctgacgacgaccgccgcgccgccgccgcccaccaccgcaccagccgagccgctcccgacgtccgccccgccgtcgtcgtcgtccgatccggcacctgccgccgagcctgtgaccttcaccttcgctgacggccggctgtcctttacccacccggccggctggcgggtggagcacagccagactgtggcgtcaccctctgttgaaaacgcgaccgtgtatgacaccagcggaaacgagcagatcgggatcttctacagcgaggtggggggtggtgttgccggtccccacaccaggaccgtgttcttctcggagccagtcccgggattgcagggccattccggtcctgcaaccgcccatgtctccttctatgtcgatcatatttacggtgagccgcattactcgctgtcgctcacgcacagagaagccctctcgccggatggcacggaaggcgctgacgttgtcatcgtcggcggcaaccacgtgctggccgcaaacgtcgtcttcaccggcggaccgttcgccagtgacgaggcggccaaggcctggttcgccgggactgaaggccaggccctgaaggcgattctgatgagcttttcctaccgctga

SEQ ID NO: 821 - DNA, 546 bp, Arthrobacter sp.
atgaggaaaattggagccggtctggcagcggtcctggctgctgccgggctcggtctggcagcgccggggccagcctcggcagcatcttactgcgggttggtctggggttcgttggccaaggccgaccctgatatgagttcagccaatgtcaccaacgtccggaccggccagcagccctgtttcgaccgcctggtgattgacatgacgggcaaagtggccggctactccgtccgctatgttccggtggtcacccaggacgccacgggctaccccatcccggtgatcggtgacgcggacctgcaagtggtagtgaccgcgccgtcgtacaaccagtacagccagccgacctacctgcccgcagccaaggcggagctctccgacgtctccggttaccagaccttccggcaggtggtttatgccggcagctttgagggcaccaccagcattgggctgggagtgcgtgcccggcttccgttcagggtgctcaccttggacgggcccgacggcggctcccgcttggtagtggacgtcgcccatcattggtag

SEQ ID NO: 822 - DNA, 546 bp, Arthrobacter sp.
atgaggaaacttggagcgggtttgacagcggtcatggctgctgccgggctcggtctggtggcaccggggcccgcctcggcagctacatattgcggtatctcgtggggttccatggccaaggccgacctcgactggagctccgccaacgtcaccaacgttcgcacgggccaacagccctgctacgaccgtctggtgattgacatgaccggcaaggtggccggctacgtggttcagtatgttccggtggtgacccaggatgccaccggctaccccatcccggtgctgggtgatgcggatctgcaagtgatggtcacagcgccgtcgtacaaccagaacaaccagccgacgtatgtgccggcagccaaggccgaactgtccaacgtctccggttaccagaccttccggcaagtggtttacgcgggcagttttgagggcaccacgagcatcgggctgggtgtccgggcccgccttccgttccgggtgttcaccttggacgggcccgacggcggttcgcgtctggtggtggatgtggcgcatcgttggtga

SEQ ID NO: 823 - DNA, 3096 bp, unknown
  environmental sample
atggaacagtccacagcccggcaattctcccaacgcctgctgcgaggcaggaagctgaccacagtcgtggccgccgctgccttggccgtcgccggaatgaccgctgtcgtttccagcaccccggcttacgccgaccagcaacgtcaggtggtgggcacaggcctcaccaaacctgccggaacagtagtcgatcccgtcggcaaggtgtgggtttcggacagtgtggcaggcttctgccgcatgagcgatcctgccaatggccagcccggcaccgtggaaaaggacacctgcctgggcggttccctggccggagccggacaaggtccgaaagtgccgggagtcgccaccgtccttgatcccacgccttcctcggcaggcagtggtgacgaaacagcgttcatcccggactcatccgtgggaagctcacatgtggtgcgtgccgtatggagtccggcacaggacctcttcgaatacagcagcacactgaccatcctggacggcgacgtcaggccaaatgctgccagcgacggccccgacggcaacatctacctttcatttgccaatgcccgttcgatcatcaagatcgttgatccgaccatcaagcatcccagcatcgagtccatcgcctcggtcactacgaaggccttggggcttgtggctgccggctgggacagcaacggacatgtcagcgtatacgtcctggaaaccaccgggttgcgggccttttcggctcccgacgacggcgacatgaccaactacgtgccactggcctcctacaacgtaggcgtcgcatcgtcgatctactacgactacgacgcccacatcatctacacgggcacgagcagtggcaccactacggccgacgccggtaaggacaaggtttcgcgcctcaatctcggcaccggagccgtcgacaattcctgggcattgggcttcagcaagatcagtggcctgggcatgcgcggcggacagttgctggtcctggatgatgcaggacagctgaacaacccgccggccacgggccaagggaagatgagcctcctgggtggagtcgcagcccagattacctccggcccaacgctcgccaacggtacccaatcgcccaatacggcgttcaccaacgacaccacacccaccttcggcgtcagcgcagatcccgctggcagtgccttggaatgctccgtcggcggggcctggacagactgcaccagcggcacttacacctcagctgtcctggcaaacgggccacagacgttctcagtccggccggcaccaggaggcgtccccgtctcccgcacgtttaccgtggacacagtggcacccgctgctcctgtcttcacagcaccgaacagtggacaagtggtcaacggcaagcccgtgctcggcgcgactttcgaacccggaacaacactgagttgctccgttgattccacagccgacgcggccttcaaggcttgcgtgccgggcgacaccttcactctgaccacagagggtgcacacaccttgcggataaggagcacggatcccgccggaaacgtcggccctgctgctgccttgaccgtgacagcggatctgacagctccgcaggttgcgatcactgctcccgcgagtggtgccacggtgggtgccggataccagttccagtttgcttcctcttcgccggacgttgccggattccgttgccggttgggaacagatgccttcactgaatgcacctcacccaaggtctatgcggatatcgccaacggcgcgaacaggttcgaagttgaagcccgggacacggccggaaacacgacggtggcaggcgtgaacttcacggtcttcgtcgccgacaccactccaccaactgtgacggcagaccccgttggaggaacctacggtccttccagcaaggtcacactcaccgcgagtgaagccgacgcaaagatctactacacagaggatggaagcacacccaccacggccagcacgctgtacacggctccgattgcaatgggaagcaagaccctcaagtacatcgcagtggatgcagcgaacaacgcctccgcaccccagacacaggtgtacgtgttggacaacgcggcgccggctgtcacgcccaacccgtcgggaggcaaccttgccctgggacaaagcgtcactttgacgacggagtccggagcgaagatctactacacaacggacggcaccactcccacggttgccagccaggcaggcaccacaacggtcaccatcacgcccactgcgaccaccacggtaaagtactttgccgttgatgctgcaggcaaccaatcggcagtagcctcgcagacctacaccttgcccgcagctcccgccaacacttggaaggactacaactccgatgccaagaacgatgtcctggcccgcgattcagccggaactttgtggctctacccgggcaatggcactggtggatggttgggcaaggtcaacaccggtaccgcgtggaacaactacaacctgattgttcccacgcgggacttcagcggtgatggacgcagcgatgtccttgccagggatgccgcgggacaactgtggctcttcaagggcaacggaacaggcggatggcagccggcagtttcagtgggaagtggctggagtggaatgacggcgatcgttgcccccggcgatttcaacggtgatggcaaatccgacgtcctcgccagggatgcggcaggcgtgctgtggctttacaagggcgacggcctgggtaaattcgcagcaggtgccacccaggtcggagccgggtggaacgtcatgaacgccattttcagcaccggcgacttcaacggcgatgccaagactgacgtgattgcacgtgataccagcggcgggctctggctctaccccggcaatggtaccggcgggtggggcacccgcacccagatcggcagcggttggggcggaatgacggcgctcctcggaccaggcgatttcaacggcaacggcaagtccgatgtcctcgcccgggacgccagcggcaatctgtggctctacccgggtaatggcaccggcgggtggcttgcctggggccaggtaggaaccggttggcagggattcacctccctcccgtaa

SEQ ID NO: 824 - DNA, 3084 bp, Arthrobacter sp.
atggaacagcaaacaacgcacgacgccggttggcggcttcgcggacacaaggtcatcactgtattggctgcggttctcctgacggtcgctggcatgacagcggtggtatcaagcacccccgcccacgcagaccaacagaaacaaatcataggtattgggctcaccaagccggcagggaccgtcctggaccccataggccggatgtgggtatcagacagcgtggccggattctgccggatgtccgaaccagtcaacggaaacgcgggcaccattgagcaagacacgtgcctgggcggaacctcgcctgatgccgggcccggaccaaaggtgcccggggtttccgtcgtgctcgatccgacgcccggctccattggcagcggtgatgaaacagcatttatcccggactcagctgttgggagttcacatcttgtaagggcagcgtggaatccgccgctggacctcttcgaatacagcagcacactgacggtgctcgatggcgacgtccgaccaaacgcagtgtccgacggcccggacggcaacatctatttgtcgttcgccaacgcccgctcaatcatcaagattgttgatccgaccatcatgcacccaagcattgaatccatcgcgtcggtcaccacccgtgcgctgggcctggtggctgcgggctgggataacaacggatatgtcagcgtctacgttctggaaaccactggcctcagggcgttctctgccccgggaaacggtgaaatgacagactacgtgccgttgacgtcctataacgtaggcgtcgcggcgtcgatcttctacgactacgacgcccacgttatttatacgggaacgagcagcggcactacggcgggcacagacaaggtgtcacgcctcaacctgagcaccggcgcagtggacaaccaatgggctttgggattcagcaagatcagcggcctgggcatgcgtggcggtcaacttctggtcctggacgatccgggacagctcggcaccaccccggcaaccggccggggcagtatcagcctcctgggcggcgcagtggccaaaattacttcaggtcccacgctggcaaatggtgcacaggctcccaaccccgagttcaccaatgacaccactccaacgttcgttgtgaccgcggaaccggccggcagcgctttggaatgctccatgggcggtacgtgggcggattgcactggcggaacctatacgtcagctgcactgctcaacggattgcagaccttctcggtaaggcctgcccccggcggagttccggtttcacggaccttcacggtggacaacgtcgcacctgctgcgcctgtcttcactgctccaaacagtggtcaggtggtcaacggcaagcctgtcctgggtgccactttcgagccaggaacaacacttagctgttcagttgattcgactgccgatgccgcattccaggcttgcgtaccgggcgacactttcacgctcacaacagcgggtgcgcatactctgcggatccgcagcaccgactcggcaggtaatgtcagccccgctgcagcacaaacagtgacagctgatctgacggccccacaggttgccatcacggctcccgccagcggagccaccgtaggcgccggctaccagttccagttcaactccacatcctcggatgtggcgggattccgttgccgcttggggaccgatgcctttaccgcctgcacctcgccaaaggtctatgcggacattgcgaacggaccaaaacgattcgaggtagaggcccgggatggggcaggcaacaccactgttgcaggcgtcaacttcacggtctttgtagctgacaccactccacctaccgtgacagccagtcccgttggcggaacgtacggtcctgcaaccaaggtcacgctgaccgcgaatgaggccgatgccaagatctactacacggagaatggcaccactcccaccgcggccagtacgctctacaccggtcccatcaccatgggaagcaagaccatcaagtacatagccgtagacgcagccaacaacgcgtccgccccccaatcccaggtgtatgttctggacaacgttgcgccaacggtgacggcgagccccttgggtgggaacctcacccttggtcaaaagatcaccttgaccacagagtccggggcgaagatctactacaccacgaacaattccactccaacggtttcaagtccgtccggaaccacaacggtgacagttactccggcggccaccaccacggttaagtacttcgccgtcgatgctgccgggaaccaatccgccgtggcctcgcagacatacaccttgcctgcggcgccgaccaatacttggaaggactacaactccgatgccaagaatgacgtccttgccagggacgctgccggtacgttgtggctctacccgggtaatggcacaggcggttggttgggcaaggtcaacaccggtacatcgtggaataactacaacctgatcgtcccaacgcgggacttcagcggcgatggacgaagtgatgtcctggcccgggacgcctccggccagatcctgctcttcaaaggcaatggcgcaggcgggtggcagcctcctgaggttgtcggctccggctggagcggcttcacggctgtggcagcaccgggcgacttcagcggagacggcaaatccgatgtcctggccagggatgcttccggagtcctgtggctctacaaaggtgacggaacgggtaagttcagcgctggccgaacccaggtcggagccgggtggaacgtcatgaacgccatcttcagcaccggtgacttcaacggcgactcgaagaccgacgtactggcccgcgatacggggggcgctttgtggctctacccgggtaacggcagcagcgggtggggcacccgctcccagatcggcagcgggtggaacggcatgacggctctgctcggaccgggcgatttcaacggcaatggcaaagctgatgtcctcgcccgggatgccagtgggaatctctggctctaccccggaaacggttccggcggctggctggcttggggccaggtcggcaacggatggcaaggattcacttcgctcccctga

SEQ ID NO: 825 - DNA, 2733 bp, Multievos46 sp.
atgcagatagtggcccacaccgatgatgacctgattttcatcagtccggatttcatgcgtgacatccagtccaagcgctgcgtgcagaccgtgtacgcaacggcgggtgaagccggtgaaggggctgcgtactggaacagcctggaagcgggaatcagggcaagctacgcgaaaatggcgggcgtagccgatgcctggaccacctccgacgcgggcgttccgggccgacccctcacccttcagaccttgaatgcggcacccaacgtttccgtcgttttcatgcggcttccggatggcttcccggatgggaggggcagcagccgctacaacggccagagcatcctgaaactgtgggacggccggctcagctccatccgtccggttgatggggccgcagcgtttaccaaggcgcaattccagacgacgttgaaccagctggtggccaattaccaacccaccaccttccggacccaggattggacgggaaattaccaggacccctacgaccacagcgatcactgggccacggcaaagtttgcccagctggccagcagggcctacacgggaccccatacggcatctgcatacgacgcctacgtaatcgatgaatacgcccagaatgtgacgggcgcggacctgaccaacaaagtcaacacctttgtgcgcttcgccgatttcgataaatacctctgcgacactccctgcccggcgccgccttacagcgactggctcaaacggcagtacatcacggccatcgagtggacgggcaatgctgccaaatcagcaggcacaacagtgagcgcttcttcgcagaaggcctcggggcagagccccgagaaggcccgcgacgggtacgcatggggtacgcccatggacgccaaccgcgaatgggtcaccaacggcggcaaggcaggcagctggatccagtacaacttctcccctgcccggaccatcaacgccgtgacgctttttgaccggccgatcctcagcgaccaggtaaccggcggcaacctggccttcccggatggcagcaccgtgccagtgggcgccctgcctaacaacggttcgggactcacagtgaatttcccggcacggacagtcagttcggtccgcttcaacatcacctccgtgagcggctccaccacgaacgtcggcttgtccgagttcgaggcccacatcacggccgacgtcgttgcacccgaagtgacggcgacaccgcccggcggcacctatgacatcgggcaaaaggtcaccctgtccgcgaacgaacctgcgacgatcttctacacgctggacgggacgacccccaccaccgcgagtgccaaatatgccacgccgatcaccgtgaatggtccactgactctgaagtacttcgccgtggacgctgcgaacaatccgtcggccgtcgtgactcagagctactccaccggcccggacgtgaccaagcctgtggtgacggccaacccgctgggcggcgcctacgccccgggcaccagcatcacgcttacgtccaacgaggcaaactccgtgatcaagtacaccaaggacagcagcgatcccctcactgcaggattggtctactccacgccgattgtcttcgcaggcccggatccgatgaccctgaaattcttcgccacggatcctgccggaaacgtgtccgatgtcgtcacgcagacctacaacgttccgcctgacacgcgggcgcctgtggtgacggcgaatccaaccagccgtgcgctggccagcggggcaaccatcacgctttccgccgatgaaccaggcgcaagcatctactacaccacagacggcagcagccccacggctacggagtctgccagcaacttcaagtattcggctccgcttgtcatggggacatcacagctgaccctgaagtacgtcggtgtggacgctgcagggaacacctcacccattggaacccagacgtacagcgttcccgcagccgggccgccgtcgtcccacgacttcaacggcgacggcaaggccgatgtcttgtcctccgatactgccggcaacctgtacctctacccgggcaatggcggaggcggtctggggccgcggcaaacggccttggcggcacctgcatggtccacgatcaccgacaccataacccccggcgacttcaaccgggacggcaaaccggacctgctggcccgtgcaggtgacgtcctgtggttctacccgggcgacggcgccggcagcttcggcgccagggtccaggtgagcaccggatggagcaccatgagccagttgttctccccgggcgacttcagtggcgacggaatccctgacctgatcgccaggcggagcaccggcgatctgcgcctttacgaaggcaacggcagcggcgggctccggacgccaatcacgattggaaccggctggaatgttatgaatgcaattctgagcaccggggactttaatggagatggtacgggagacgtgctggccaggcgttcggatactggcgccctctggctctaccccggcgatggaacccgcggatggctcgcatggaagcaaatctccgcgggttgggacaaccgaacatcgatcgcaggcccccgggacctcgacggcgataacaagaacgacgtcatcggccgcatcggagacaccctgtggctctacccaggcagcggcaacgggactctcagcaacgtcccgcccactagcctcggcaccggttggcaggccatgaagatcatcggctag

SEQ ID NO: 826 - DNA, 2733 bp, unknown
  environmental sample
atgcagattgtggcccacaccgatgacgacctgattttcatcagtccggacttcatgcgggacatccagtccaaacgttgtgtccagacggtttacaccacggccggggaagcaggcgagggagcagcctactggaacagcctcgaagccggaatcagggccagttacgccaaaatggcgggcgtggccgatgcgtggaccacctctgacgccggcgtgcctggacgtcccctcacgctccagacgttgaatgcggcacccaacgtttctgtcgttttcatgcggcttccggatggctttcctgacgggaagggcagcagccgctacaacggccagagcatcctgaagctttgggacggcaggctcagctccatccgtcccgttgatggtgctgcggccttcaccaaggcgcaattccagacaaccctgaaccagcttgtggccaattaccagcccaccaccttccgcacccaggattggaccggcagctatcaggacccgtacgaccacagcgatcactgggctaccgcaaagtttgcccagctggccagcagggcctataccagtccccacacggcctcggcatacgacgcttatgtgatcgacgaatacgcccagaatgttaccggcgcggatctgaccaacaaggtaaataccttcgttcggttcgctgacttcgacaaatacctctgcgacactccatgcccggcacctccctacagcgactggctgaaacggcagtacatcacagccatcgagtggaccggcaacgctgccaaatcagcaggaacaacagtgagcgcttcctcgcaaaaggcctcggcgcagagccccgaaaaggcccgggacgggtacgcgtggggctctcccatggacgccaaccgcgagtgggtgagcaacgggggcaaagccggcagctggatccagtacaacttctcccctgcccggaccatcaacgccgtgacactgtttgaccggccggtcctcagcgaccaggtgaccggcggcaacctggccttctccgatggcagcaccgtgccggtaggcgccctgcccaacaacggttcgggactcacagtgaacttcccggcacgcacagtcagttcggtgcgattcaacataagctccgtcagcagctcaaccacgaacgttggcctgtccgagttcgaggcttacatcaccgccgacgtcgttgcacccgaagtgacggcgacaccgcccggcggcacgtacgacgtcgggcaaaaggtcacactgtccgcaaacgagcccgcgacgatctactacacgctggacgggaccacccccaccacggcgagtgccaaatatgccactccgatcaccgtgaatggtcccctgacgctgaagtacttcgccgtggatgctgcgaacaatccttcggcggtggtaacgcagagctactctaccggccccgatgtgaccaagcccgtggtatcggccaacccggcgggcggcgcctatgccccgggcaccaccatcaccctcacatccaacgaggccaactccgtgatcaagtacaccaaggatggcagcgatcccctcactgctggcctggtctactccacgccgattgtcttcgcgggcccggatccgatgacgctgaagttcttcgccaccgatccggccggaaatgtgtccgatgttctcacgcagagctacaacgttccgcctgacacgcgggcacccgtggtgacggcgaatccaaccagccgtgccttggccaacggggcaaccatcacgctttcatccgacgagcccggcgcaagcatcttctacaccacggacggcagcactcccacggccacggagtccgccaccaacttcaagtattcggctccgattgtcatgggaacatcgcagctgaccctcaaatacatcgctgtggacactgcggggaacacctcgcccgttggaacccagacgtacagcgttcccgcagccggtccgccgtcgtcccatgacttcaacggcgacggcaaagccgacgtcctgtcctccgataccgccggcaacctgtacctctacccgggaagtggcggaggcagtctggggccccggcaaacagccttggccgcgcccgcgtggtcaacgattacggataccatcacgcccggcgatttcaaccgggacggcaaaccggatgtgttggcccgtgacggagacgttctgtggttctacccgggcgacggtgccggcagcttcggcacccgggtccaggtaagcaccggatggagcaccatgagccagttgttctccccgggcgacttcagtggcgacggcatccctgacctcatcgccaggcgcagcggcggcgatctgcgcctctacgaaggcaatggcagcggcggtctgcggacacccaccaccattggaaccggttggaatgttatgaatgcaattctgagcacgggggactttaatggagatggtacgggagacgtgctggcccggcgttcggatacaggcgccctctggctctaccccggcgacggaacccgcggctggctccaatggaagcaaatctccgcgggttgggacaaccgaacatcgatcgcaggcccccgggacctcgacggcgatggcaagaacgatgtcatcggccggatcggagacaccctgtggctctacccaggcagcggcagcgggactttcagcagcgtcccgcccaccagcctcggcaccggttggcaggccatgaagttcatcggctag

SEQ ID NO: 827 - DNA, 2919 bp, Arthrobacter sp.
atggttgtggaccgtccaaaatacgcacgtcgtcctacccgactacaactcatcaccacccgttcattagcccggcgaatcctcggattcctgctgggcctttctgttgccctttcatcacttgtcttcggtgcggccctgcccgcctcggcggccgtgccgccttgcccggggaccggcggtgcgcagatgatcgtcgcccacaccgacgacgatctgatcttcatcagcccggacttcatgagggacatccaggccaagcgctgcgtccagaccatttacgtcaccgcgggggaagccggtgaagggcagtcctactggggcggcctggaggacggcatcaggtccagttacgccatgatggccggggtagcgaatgcttggacggcctcggacgccggcgttcctgagcgacccctgaccgtacacaccctcaatgcggctccgaatgtatcggtagttttcctgcggcttccggacggctttcccaacgggaacggcacaacccgctacaacggccagagcatcctcaaactgtgggacggccgcatctccaccatccgccccgttgatggatctgccacgtacacaaaagcgcaacttcaaagcgtattgaaccggctggtggccaacttcaaaccgaccacgttccgcacccaggactggaccggcaacttcaccaccccgtatgaccacagcgaccattgggcggcagcaaaattcggtcagctggccacccgcgcctacacaggcccgcacacttcctccgcgtacgacgcctacgtgattgacgaatacgcccagaacgtcacagggactgacctcaccaacaaggtgaacacgttcaggcgcttcgctgagttcgacgagtatctctgcggcgatatctgcccggacactccctacagcgactggctcaaacggcaatacatcaccgcgattgaatggacaggcaacgcagcgaaatcggcgggaaccacggtctccgcgtcgtctcaaaaggcctcgggacaaagtccggagaaggtgcgggatggatatgcctggggtacccctatggatgccaaccgcgaatgggtcagcaacggtggcaaagccggcagctggatccaatacaacttctcccccgcacggaccatcaacgccgtgacgctctctgaccgtccgctgcccagcgaccaagtaaccggcggcaatcttgtgttctcagatggcaccactgttcccgttgcggccctgcccaacaacggctcaggactgacggtgaacttccctgccaggaccgtcagctccgtgcgcttcaacatcacctccgtcagcggcaccaccaccaacgtgggcttggcggaattcgaagcgcatatcaccgctgacgttattgcccccgtggtcacagccacccccaccggcggcacgtacgacgtcggacaaaaggtcacgctcgccgcgaacgagccagccaccatctactacaccgtggacgggtccacgcccactacggccagcagcaaatacgccactccgctcactgtaaacgggccgctgaccgtgaagtacttcgcggtagataccgcgaacaacccgtccgctgtggtcacccaggtctattccaccggcccggacgtgaccaagcctgtggtgacggccaaccccgcaggcggcgcctacgctcccggcaccgccatcaccctcaccgtcaacgaaacgaattcggtgatcaagtacaccaaggacgggtccgaccccctgaccgctggcgtggtgtactcggctccgatccccttcgagggcccgggtccgatgacgctgaaatactctgccacggatcctgccggaaacgtctccgacgtcgtcacccagacgtacacggtgccgccggataccacggctcccgtggtcacggccaaccccaccagccgggcactggccagcggggccaccatcaccctctccgtcaatgagccgggtgcagccatctactacaccaccaatggcagcaagcccacggccacggaatcggccacgaacatcaagtattcggcaccggtttccatgggcacctcaacgctgaacctgaagtacatcggggtggacacggccggtaacacttcggccgtgggcacccagacgtacaccgtgcccgcagccggaccgccgtcggcccatgacttcaacggtgacggcaaggccgatgtcctggcctccgacaccgccggcaatctgtacctgtacccgggcgacggcgcaggcggcctcctgacacggcaggtagccttggcggccccggcgtggtccaccgtcaatgaaaccatcactcccggtgacttcaacaaggacggcaaaccggatctgctggcccgcgccggcgacgtcctgtggttctacccgggtgacggtgccggaagcttcggagcccgggtccaagtcagcacgggctggagcaccatgagccagttgttctcacccggcgacttcagtggcgacggcatcccggatatcatcgcccggcgcagcaccggagagctgaggctctacgaaggcaacggcaccggaggtcagcggacaccgaccaccattggaaccggctggaatgtgatgaatgcaattctgagcacgggggactttaatggagatggaaaggcggacgtgctggcgcgacgcgcagacacaggcgccctctggctctaccccggagatggaacccgcggatggcttcagtggaaacagatctccacgggctgggacaacagaacatctatagccgggccccgcgacctcagtggcgatggcagcaacgacgtcataggccgcatcggcgacaccctgtggctgtacccggggacgggcagcggagcgttcagcaccgcaccgcccatcagcctcggcaccggttggcaggcgttgaagatcatcacctag

SEQ ID NO: 828 - DNA, 2919 bp, Arthrobacter sp.
atggttgtggaccgtccaaaatacgctcgtcgtcatacccgcttatcattcttcggcacccgctcattggtccggcgaatcctcggatttctgctgggcctttgtcttgccctttcttcatttatcttcggatttgcccagcccgcatcggcagccgtacctccttgtcccgggaccggcggtgcccagcaaatcgtggcccataccgatgatgacctgatcttcatcagtcccgatttcatgcgggatgtccaagcaaagcgctgcgtccagacgatctacctcactgcgggtgacgccggagaagggcagtcctattgggccggcctcgaagccgggatccggtcaagctacgccttgatggcgggggtcgccaatgcatggacggcttcggacgccggtgtacccgagcgtccggtgactgtccacacgctcaacgcggcgccgaatatctcagtggttttcctgaggcttccggacggctttcccaatggcaatggcagcacccgtttcaatggccagagcatcctgaagttgtgggacggacgcatttcttcaattcggcccgtggacggttccgccacctattcaaaatcgctgttgcagaccgtgttgaacaggctggtagccaactacaaacccaccacgttccgcacccaggactggaccggcaatttcaccaccccctatgaccacagcgaccactgggctgcggcaaaattcgggcagttggccactcgtgcttacaccggaccgcatacctcgtccgcctatgatgcctatgtcatcgacgagtacgcacaaaacgtcacgggcgccgaactcaccagcaaggtcaacaccttcaggcactttgccgaattcgatgagttcctctgcggcgccatctgtccggacacgccctacagcgactggctcaaacggcagtacattacggccatcgagtggaccgggaacgcggctaaatcggcaggtaccaccgtctcagcatcctctcagagggcctcggcacaaagtccggagaaagcgcgggacggatatgcctggggcacccccatggatgccaaccgggagtgggtcaccaatggaggcagagctggcagctggctccaatacagcttctcgccggccaagaccatcaatgcggtgacgctctttgatcgaccgatcaccagcgatcatgtcacgggcggcaatctcgtcttttcggatggcagcactgtcccggttgctgccctgccaaacaatggctccggcctgacagtgaattttcctgccaggaccgtcagttcagtgcgcttcaacatcagctccgtcagcggttccaccacgaacgttggcttggcggagttcgaggctcacatcaccgctgatattgttgcccccgtggtaacagccacacccgcgggcggcacctacgacatcgggcaaaaggtcacgctgaccgcaaatgagccagctacgatctactacacagtggacgggtcgacgcccacagtggccagcagcaaatacgccacccccatcactgtgaacggcccgctgaccctgaagtacttcgcggtggactccgcgaacaatccctccgccgtggtcacccagacatactccaccggcccggatgtgactaagccggtggtaacggcgaacccggcgggcggcgcctacgctcccggcaccaccatcaccctcacggtcaacgaagcgaactcggtgatcaaatacaccaccgatggtaccgacccgttgacggccggacaggtgtactccacgccgatagcgttccccggcacggctcccatgacgctgaagtactttgccacggatcctgcggggaatgtctcggacgtggtcacccagacgtacactgttccgccggacaccacggctcccgtggtcacagccaaccccaccagccgcgcgttggccaatggggccaccatcaccctctccgccaatgaacccggagcggccatctactacaccaccgatggcagcacccccacggcaacggaatcagccacgaacatcaagtactcggctccgattgtcatggggacttccaaccttgtcctcaagtacatcggggtggacacggccggtaacacctcggctgtgggcacacagacctacaccgtgcccgcagccggaccgccgtcggcccatgactacaacggcgacggtaaagccgatgtcctggcctccgacaccgccggcaatttgtatctctacccaggggacggcgcagggggccttttgccccggcaagtagccctgccggcacctgcctggtccacggtgactgacaccatcacccccggcgacttcaacagggatggcaaacctgacttgcttgcccgtgccggtgacgtcctgtggttctacccgggtgacggtgcaggcagcttcggagcacgggtacaggtcagtaccggctggagcaccatgagccagctgttctcccctggagacttcagtggcgacggcattccggacttcattggccggctcagctcaggagagttgcggctctacgaaggcaacggaacaggtggtcagcggacaccggtcaccattggatccggctggaatgttatgaatgcaatcttcagcacgggggactttaatggagatggtaagggagacgtgctggcgcgacgctcggacacgggcgccctgtggctgtaccccggaaacggaacccgcggatggctcccatggaagcaaatctccacgggttgggacaaccgaacatcgatggccgggccccgcgacctcaacggcgatggcagcaacgacgtcataggccgcatcgcagacaccctgtggctctatcccggcacaggcagcggagttttcagcaccgtgccgcccatcagcctcggcaccggttggcaggccatgaagatcatcgcctag

SEQ ID NO: 829 - DNA, 2919 bp, Arthrobacter sp.
atggttgtggaccgtccgaaatacgctcgtcgtcatactcgcccatcactcatcagcactcgttcattggcccggcggatcctgggattcctgctgggcctttctgttgccctttcctcgtttgtcttcggatttgccacgcccgcctcggcagccgtacccccttgtcccgggaccggcggtgcccagcagatcgtcgcccatacggacgacgacctgatcttcatcagccccgatttcatgcgggatgtccaagcaaagcgttgcgtccagacgatttacctcacagcgggcgacgccggagaaggccaatcatattgggccggtcttgaggacgggatccggtcaagctacgccttgatggcgggggtcgccaatgcatggacggcttcggacgccggtgtacccgagcgaccggtgactgtccacacgctcaacgcggcgccgaatatctcggtggttttcctgaggcttccggacggcttccccaacggcaatggcagcagccgtttcaatggccagagcatcctgaagttgtgggacggacgcatttcttcaattcggcctgtggacggatcggccacgtattcaaaatcgctgctgcagactgtgttgaaccggctggtggccaactacaaacccaccacgttccgcacccaggactggacaggcaatttcaccaccccctatgaccacagcgaccactgggctgcggcaaaattcggtcagttagccactcgcgcctacaccggaccgcatacctcgtccgcctacgatgcctatgtcatcgacgagtacgcgcaaaacgtcactggcgccgaactcaccagtaaggtcaacaccttcaggcactttgccgaattcgatgagttcctgtgcgggaacatctgcccggacgtgccgtacagcgactggctcaaacggcagtacattacagccatcgagtggaccggcaacgcggcgaaatcggcgggaacaaccgtctcagcgtcctctcagagagcctcgggacaaagtccagagaaagcgcgggacggatatgcctggggcactcccatggacgccaaccgggagtgggtcaccaacgggggcaaggccggcagctggatccagtacaacttctcccccgcacggaccatcaacgccgtgacgctttttgaccggcctctgcccagtgaccacgtaaccggcggcaaccttgtcttctctgatggcagcactgttccggttaccgcactgcctaacaacggctcagggctgacagtgaactttcctgccaggacggtcagctccgtgcgcttcaacatcagctccgtcagcggcaccaccaccaatgtgggcctgtctgagttcgaggcacacatcaccgcggacgtcgttgcccccgtggtgacagccacacccgcgggtggcacctacgacatcgggcaaaaggtcacactgaccgtgaatgagccagcttccatctactacacagtggacgggtctactcccacagtggccagcagcacatacgccacccccatcactgtgaatggcccgttgaccctgaagtacttcgcggtggactctgcgaacaatccctccgccgtggttacccagacatactccaccggcccggatgtgactaaaccggtggtaacggcgaacccggcgggcggcgcctacgctcccggcaccaccatcaccctcacggtcaatgaagcgaactcggtgatcaaatacaccaccgatggtaccgacccgttgacggccgggcaggtgtactcaacaccgatagcgttccccggcacggctcccatgacgttgaaatacttcgccacggaccctgccggaaacgtctccgacgtcgtcacccagacgtacacggttccgccggacaccacggctcccacggtgacagccaaccccaccggccgcgcattggccagcggggccaccatcaccctctcggcgaatgaacccggagctgccatctactacaccaccgacggcagcacgcccacggcaacggaatcagccacaaacatcaagtacgcggctccgattgtcatgggaagttccaacctcgtccttaagtacatcggggtggacacgtccggcaacacctcgaccgtgggcagccagacgtacaccgtgcccgcagccggaccgccgtcggcccatgatttcaacggcgacggcaaagccgatgtccttgcctccgataccgccggcaacctgtacctgtatccaggcgacggcgcaggcggcgttctgacacggcaggtagccctggcggcaccggcgtggtcaacggtgaatgaggccatcactcccggtgacttcaacagggatggcaaaccggacctgctggcccgcgcaggcgacgtcctgtggttctacccgggcgatggcgtaggcagtttcggagcgcgggttcaggtcagcaccgggtggagcaccatgagccagttgttctcccccggcgacttcagcggcgacggtattccggacttcattggccggctgagctccggtgagttgcggctctacgaaggcaacggaaccggcggtcagaggacacccacaaccattggaaccggctggaacgtgatgaatgcaattctgagcacgggggactttaatggagatggaaagggagacgtgctggcgcgacgctcggacacgggcgccctctggctctaccccggaaacggaacccgcggatggctccagtggaagcaaatctccacgggttgggacaaccgaacatcgatagccgggccccgcgacctcaacggcgatggcagcaacgacgtcgtaggccgcatcggagacaccctgtggctgtacccgggcacaggcagcggagcgttcagcaccgtacctcccatcagcctcggcaccggttggcaggcattgaagatcatcgcctag

SEQ ID NO: 830 - DNA, 2919 bp, Arthrobacter sp.
atggttgtggaccgtccgaaatacgctcgtcgtcatactcgcccatcagtcatcagcactcgttcattggcccggcggatcctgggattcctgctgggcctttctgttgccctttcctcgtttgtcttcggatttgccacgcccgcctcggcagccgtacccccttgtcccgggaccggcggtgcccagcagatcgttgcccatacggacgacgacctgatcttcatcagccccgatttcatgcgggatgtccaagcaaagcgttgcgtccagacgatttacctcacagcgggcgacgccggagaaggccaatcgtattgggccggtcttgaggacgggatccggtcaagctacgccttgatggcgggggtcgccaatgcatggacggcttcggacgccggtgtacccgagcgaccggtgactgtccacacgctcaacgcggcgccgaatatctcggtggttttcctgaggcttccagacggcttccccaacggcaatggcagcagccgtttcaatggccagagcatcctgaagttgtgggacggacgcatttcttcaattcggcctgtggacggatcggccacgtattcaaaatcgctgctgcagactgtgttgaaccggctggtggccaactacaaacccaccacgttccgcacccaggactggacaggcaatttcaccaccccctatgaccacagcgaccactgggctgcggcaaaattcggtcagttagccactcgcgcctacaccggaccgcatacctcgtcggcctacgatgcctatgtcatcgacgagtacgcgcaaaacgtcactggcgccgaactcaccagcaaggtcaacaccttcaggcactttgccgaattcgatgagttcctgtgcgggaacatctgcccggacgtgccgtacagcgactggctcaaacggcagtacattacagccatcgagtggaccggcaacgcggcgaaatcggcgggaacaaccgtctcagcgtcctctcagagagcctcgggacaaagtccagagaaagcgcgggacggatatgcctggggcactcccatggacgccaaccgggagtgggtcaccaacgggggcaaggccggcagctggatccagtacaacttctcccctgcacggaccatcaacgccgtgacgctttttgaccgtccgctaccaagtgaccacgtaaccggcggcaaccttgtcttctctgatggcagcactgttccggttaccgcactgcctaacaacggctcagggctgacagtgaactttcctgccaagacggtcagctccgtgcgcttcaccatcagctccgtcagcggcaccaccaccaatgtgggcctgtctgagttcgaggcacacatcaccgcggacgtcgttgcccccgtggtgacagccacacccgcgggtggcacctacgacatcgggcaaaaggtcacactgaccgtgaatgagccagcttccatctactacacagtggacgggtctactcccacagtggccagcagcaaatacgccacccccatcactgtgaatggcccgttgaccctgaagtacttcgcggtggactctgcgaacaatccctccgccgtggttacccagacatactccaccggcccggatgtgactaaaccggtggtaacggcgaacccggcgggcggcgcctacgctcccggcaccaccatcaccctcacggtcaatgaagcgaactcggtgatcaaatacaccaccgatggtaccgacccgttgacggccgggcaggtgtactcaacaccgatagcgttccccggcacggctcccatgacgttgaaatacttcgccacggaccctgccggaaacgtctccgacgtcgtcacccagacgtacacggttccgcccgacaccacggctcccacggtgacagccaaccccaccggccgcgcattggccagcggggccaccatcaccctctcggcgaatgaacccggagctgccatctactacaccaccgacggcagcacgcccacggcaacggaatcagccacaaacatcaagtacgcggctccgattgtcatgggaagttccaacctcgtccttaagtacatcggggtggacacgtccggcaacacctcgaccgtgggcagccagacgtacaccgttcccgcagccggaccgccgtcggcccatgatttcaacggcgacggcaaagccgatgtccttgcctccgataccgccggcaacctgtacctgtatccaggcgacggcgcaggcggcgttctgacacggcaggtagccctggcggcaccggcgtggtcaacggtgaatgaggccatcactcccggcgacttcaacagggatggcaaaccggacctgctggcccgcgcaggcgacgtcctgtggttctacccgggcgatggcgtaggcagtttcggagcgcgggttcaggtcagcaccgggtggagcaccatgagccagttgttctcccccggcgacttcagcggcgacggtattccggacttcattggccggctgagctccggtgagttgcggctctacgaaggcaacggaaccggcggtcagaggacacccacaaccattggaaccggctggaacgtgatgaatgcaattctgagcacgggggactttaatggagatggaaagggagacgtactggcgcgacgctcggacacgggcgccctctggctctaccccggaaacggaacccgcggatggctccagtggaagcaaatctccacgggttgggacaaccgaacatcgatagccgggccccgcgacctcaacggcgatggcagcaacgacgtcgtaggccgcatcggagacaccctgtggctgtacccgggcacaggcagcggagcgttcagcaccgtacctcccatcagcctcggcaccggttggcaggcgttgaagatcatcgcctag

SEQ ID NO: 831 - DNA, 2844 bp, Arthrobacter sp.
gtgctgggcatggtgcttagccctgccttggccttcggcggactggtcctggcctctgccgcacctgcctcggccgccgtgcccccatgcgcggggaccggcggggccatgcagatcgtgggccataccgatgacgacctgatcttcctgagtcccgacttcatgcgcgacatccaggcgaaacgatgcgtccaaaccgtcttcaccaccgcaggggaagcgggcgaaggggccacgtactggcgcagcctggaggcgggaatcagggccagctacgccaagatggccggtgtggcggactcctggacgacctccgacgccggtgtccccaaccggccgctgaccatgcagacgctcaacggcgcgccgaacatctcggtggtgttcatgcgcttgccggacggcttccccaacggtttggggagcgctgcctacaattcccaaagcatcctcaagctgtgggacggccgcttgtcctccatcaggcccgtggataacgccgccacgtttaccaagtcccagttccagaccgccctcaaccgcttggtcgcgaacttcaaacccaccacgttccgcacgcaggactggaccgggaatttcaacagcccttatgaccacagcgaccactgggccacagccaagttcgcgcaactggccacccgcagctacaccgggccgcacacctccatggcctatgacgcctacgtcatcgacgaatacccgcagaacgtcaccggatctgaactgaccgccaaggtggatacgtttgtccggttcgcagacttcgatatgtatctctgcaacagccctggagaagggtgcccggactccccctacaacgagtggttgaagcggcagtacatcacggccatcgagtgggtgggcaacgctgccaaatcaacgggcaccacagtcagcgcgtcatcacagaaggcctccgcccaaagccccgaaaaagcccgggacggctacttctggggtgcgccgatggacgcgtcccgtgaatgggtgtctgccggcgagaaggcaggaagctggatccaatacaacttcacacccacccgtacgatcaacgccgtgacacttggcgaccggccgatcctcagcgaccaggtgaccggcggaaacctcgtgttctcggacggcagcacggtccccgttccggctctgcccaacaacggctccgggcttaccatcaacttccccgccaagaccgtgagctcggtgcgcttcaacatcacctcagtcagcggcagcaccacgaatgccggactggcggagttcgaggcctacctcggcacggacaacgtggcgccggtggtcaccgcggcacccgagggcggaacctacgccgcaggccaggccatcacgttgacggccaacgaaaccgcgacgatctactacaccaccaacggctccacgcccaccacggccagcaccaagtacacggcaccgatcatcctgaacgggccgctgacgctgaagtacttcgcagtggacggcgccaacaactcctccgcagtggtcacccagacctactccaccgggcccgatgtcaccaaacccatcgtgacggccaacccggccagcggagaatacgcagcagggacgaacatcaccctcaccgccaacgaggccgccgagatccgctacacgaaggatggcaccgaccccctcaccgcaggtctgctgtacacggcacccatcaccttcacgggccccggtcccatgacgctgaagtactttgcgaaggacaccgcgggcaacacctccgacgtggcgacacagacctacaccattcccccggacaccactgccccggtgatcacggccaacccgacggggcgggccctcgccaacggtgccaccatcaccctaagcgccaatgaaacggcaaccatctactacaccaccgacggcagcacgccgacgaccaccgattccgcaaccaacctcaagtacaccgttcccctcgtgatgggcaactccaccctgaccctcaagtacatcggagtggacgcggagggaaatacctcgaccgtgggaacccaaacctacaccgttcccgccgccgggccgccgtcgacccatgacttcagcggtgacggccgctccgacgtcctggctgcggacaccgccggcaacctgtacctctacccgggcgacggcgccggcggactcctgccgcggcaagtggccctcgcggctccggcctggtcctcggtcaccgacaccattactccgggcgacttcaacagggacggcaagaacgatctccttgcccgtgccggagacatcctgtacttctaccccggcgacggagccggcagcttcggggcgcggaaacaggtcagcaccggctggaccaccatgtcccagatcttctcccccggcgacttcagcggcgacggcatccccgatttcatcggccgcaggagcaacggagaactgagactctacgaaggaaacggcagcggcggacaacgctcgccctacaccgtcggctggggctgggacgtcatgaacgccatcttcagcaccggcgatttcaacggtgacggcaagggggatgtactggcgcggcgcaccgacacaggggcattatggctatatccgggaaatggctccggaggctggctgacctggaagcagatcgcaaccgggtggagcacccgcactgcgctggccggccccagggatcttgatggcgacggcaagaacgacgtcctcggccgcatcggagacaccttgtggctgtaccccggatcgggtggcggaacgctgggcaacgtgccgccgatcagcttgggcacgggttggcagggaatgaaagtcatcgcctga

SEQ ID NO: 832 - DNA, 2898 bp, Arthrobacter sp.
gtggtccgttcacacgtttccaaccgcacgaatcccccggtaagccgccctgctctgctgcgccgtgtccttggcgcaatcctcagcccggctctggcctttggcgggctggtgttggccgctgcggcccctgcgtccgccgccgtccctccgtgcgcgggaaccggcggggccatgcagatcgtggcccacaccgacgacgacctgatcttcctcagtcccgacttcatgcgcgacatccaggcgaagcgctgcgtccaaaccgtcttcaccaccgccggggaagccggcgaaggggccacctactggcgcagcctcgaagcagggatcagggcaagctacgccaagatggccggcgtcgcagattcgtggaccacctccgatgccggcgtccccaacaggcccctgaccatgcagaccctcaacggcgccccgaacatttcggtagtgttcatgcgcctgccggacggcttcccgaacggggacggcagcgcggcgtacagggaccaaagcatcctcaaactttgggacggaaggttgtcctccatccggccggtcgacaacgccgcgacctttacgaagtcccagtttcagaccgccctcaaccgcctggtggcgaacttccagccgaccacgttccgcacgcaggactggacaggcaacttcaacagcccgtatgaccacagcgaccactgggccacggccaaattcgcccaattggccacccgcagctactccggcccgcacacgtcctcggcctatgacgcctacgtcattgacgaatatccccagaacgtcacggggagcgagctgaccgcgaaggtggacacgtttgtcaggttcgcggacttcgatatgtacatctgcagcagccctggcgagggatgccctgactccccctacaacgaatggctgaagcggcagtacatcaccgcaattgagtgggtgggcaacgcagcgaaatcaaccggcaccacagtgagtgcatcatcgcagaaagcatcggcccaaagcccggaaaaggccagggacgggtatgcctggggtgcgcccatggatgcaacccgtgaatgggtaaccgccggcgaaaaagccgggagctggatccagtacaacttcacgcccacccgcaccatcaactccgtcacgctttttgaccggccgatcctcactgaccaggtgacaggcggcaacctcgtcttctccgacggcagcacggtcccggttccggccctgcccaacaacggctccggactgaccatcaacttccccgccaagacagtgagctcggtgcgcttcaacatcacctccgtcagcggcagcaccaccaacgccggattggccgaattcgaagcctacctcggtacggacaacgtggcgcccgtggtcaccgctgcaccccagggcggaacatacgccgccggccaagcaatcacgctgacggccaatgaaaccgcgacgatctactacaccaccaacggttcgactcccaccacggccagcaccaaatacacggcgccgatcatcctcaacggacctatgacgctgaagtacttcgcggtggacagtgccaacaactcctccgcggtggccacccagacctactcaacgggcccggacgtcaccaagcccgtagtgaccgccaacccggccagcggagagtacgcaacaggcacaaacatcaccctcagcgccaacgaacccgccgaaatccgctacaccaaggacggaacagaccccctcacggcgggcctgccctacacggcacccatcaccttcacgggccccggtcccatgacgttgaagtacttcgccaaggacaccgccgggaacacttccgaagtggctacacagacgtacaccgcgcccccggacaccagcgccccggtgatcacggcaaacccgagcgggcgggcactcgccagcggagccaccatcaccctgagcgccaatgaagcagccaccatctactacaccaccgacggcagcacgcccacgacgtcaagcaccaaatacacggacccgatcgtgatgggaagctccaccctgaccctcaagtacatcggggtggatggggccggcaatacctcggcagtaggaacccagacctacaccgttcccgccgccggcccgccgtcgagccatgacttcaacggtgacggccgctccgacgtcctggccgcggacaccgccggaaacctttacctctaccccggcgacggcgccggagggctcctgccgcggcaactggccctcgccgccccggcctggtcttccatcacggacaccatcacgcccggcgacttcaacagggacggcaagaacgatctccttgcccgtgccggagacatcctgtacttctaccccggcgacggagcagggagcttcggggcccggaaacaggtcagcaccggctggaccaccatgacccagatcttctccccgggagacttcagcggcgacggcatccccgatttcatcggccgcaggagcaacggcgagctgcgcctctacgaaggaaacggcagcggcggacagcgctcgccctacaccgtgggctggggttgggacgtcatgaatgccatcttcagcaccggcgatttcaacggagacggcaaggcggatgtactggcgcgacgcactgatacaggcgcattatggctatatccgggtaatggttccggaggctggctgacctggaagcagatcgccacgggttggagcacccgcactgcgttggccggccccagggaccttgatggcgacggcaagaacgacgtcctcggccgcatcggagacaccctgtggctgtatcccggatcgggtggcggaacgctgggcaacgtgccgccgaccagcctgggcacgggttggcaggggatgaaagtcatcgcctga

SEQ ID NO: 833 - DNA, 2916 bp, Arthrobacter sp.
gtggaccgtccaaaatacgccagtcgacccctacgtactactatccgcacttcgttccatcgctgggtcctgggctttctgctcggccccgccatggtgatgggctctctggtcctcaccactgcatctgtggcaaccgccgccgaaccgccctgtgcgggcacgggtggtgccatgcagatcgttgcccatacggacgatgacctgctcttcctcagccctgacttcatgcgggacatccaagccaagcgttgtgtccaaacggttttcaccacagcaggtgaggccggcgagggagcaacgtactggcgcagcctcgaatcgggcatccaggcaagctacgccaaaatggccggcgtctccaacagctggacgacctcagacgccggcgtaccggggcgtccgctgacaatgcggaccctcaacggcgctcccaacgtctctgtggtgtacatgcggctgccggacggctttccgaacggcttgggcagcgccgcctacaacagccagagcatcctgaaactctgggatggccggctttcctccatccgccccgtggataatgcagcgacgttcaccaagtcccagttccagtcggcgttgaaccggcttgtggcgaacttccagcccaccactttccgcacccaggactggaccgggaacttcaacagcccctatgaccacagcgaccactgggccaccgcaaaattcgcccagctcgcaacccgcagctacaccgggccgcacacttccctcgcctatgacgcctacgtcattgacgagtatgcccagaacgtgacgggggcagaactgacggccaaagtggatacctttgtccggttctccgacttcgacatgtatatctgcagcacccccggtgagggctgtccggattccccgtatgacgagtggctgaaacggcaatacatcacggccattgagtgggtgggcaacgccgccaaatcggcgggcaccaccgtcacggcttcctcacagaaggccgccgcacagagcccggaaaaggcccgcgacgggtaccagtggggtgctccgatggatgccacccgtgagtgggtgtcagccggggaaaaggcgggcagctggatccagtacaacttctcccccacccggacaatcgatgccgtgacgttgtccgaccgacctttgctcactgaccagatcaccgccggcaacctccagttctccgatggaagtacggtggctgtaccggccctgcccaacaacggctccggcctcaccatcaagtttcctgcgaagacggtgagctcggtgcggctgaacattaccggggtcagttccgggactacgaatgccggcttggccgagtttgaggcctaccttggcgctgataccgcggctccggtagtcaccgcagcgcccccgggcggaagttacaccgcaggccaggcgatcaccctgacggccaacgaaacatccaccatctactacaccaccaacggaagcaccccgaccaccgccagcagcaagtacacggcaccgctgatcctgaatggtccgctgacgctgaagtacttcgccgtggacgcagcgaacaattcatcggctgtggtcacacagacatactccacgggtccggacgtcaccaagcccgtggtcacggccaaccccgtgggaggccaatacgctgcgggaaccaccatcaccttgtccgcgaatgaaccggctgagatccgctacaccacggacggcacggatcccctgacggcaggactgacctacaccacggccatccccttcaacggtcccggtcccatgacgttgaagtacttcgccagggataccgccggcaacgtctccgaggtaagcactcagagctattcgattccgccggacacagccgcccccacggtcactgccaaccccaccagtcgtgcgctggccagtggagcaaccatcgcactgtcggccaatgaacctgccaccatttactacaccaccaacggaagcacgccaacggccacggaatcggccaccaacatcaagtacaaccccgccaatccggtggtcatgggcagttccaccctggtgctcaagtacatcggcgtagacactgccggcaacacctcgcctgtaggcacccagacctacactgttccggcagccgggccgccgtccagccatgacttcaatggagacggacgggcggacgtgctggccgccgatactgcgggcaccctgtacctctaccccggcaatgcctccggcggactggacccacgtcaggtcgccctggccgcaccagcctggtccaccatcactgacaccgtcacccccggtgatttcaacaaggacggtaaaccggatctgctggcccgcgcaggcgacatcctctggttctaccccggcaacggcacagggagcttcggggcacggacacaggtcagcacgggatggagcaccatgacgcagatcttctcacccggcgacttcagcggcgatggcatccccgatttcattggtcgtcgcagcaacggcgagctccggctctacgaaggaaacgggaccggagggcagcgggctccctacaccgtgggctggggctgggacgtcatgaatgccatcttcagcaccggcgatttcaacggcgacggcaaggcagatgtactggcgcggcgaaccgacacaggcgcattatggctatatccgggcgatggaaccgggggctggctgcaatggacccagattgggacgggctggggaacccgcacagcgctggtcggtccgcgggacgttgacggcgacggcaagaacgacatcctgggccgcatcggagacacgttgtggctgtatccgggctcgggaggcggaacgctcagcaacgtcccgccgatcagcctcggcaccggctggcaggccatgaaagtcatcgcctag

SEQ ID NO: 834 - DNA, 2745 bp, unknown
  environmental sample
atgatgaaacgtaaatttttggacccggtcggacgcatccctatggtgcgggcagggctggcgctcaccgtcgcccttacggcgggcagtttcctttgcgcgcccgcatgggcacaatcttccggtccccagccgtcgccgacgtcagaggctccgggcaacggatcaccacaaggcccccaaccggctggtaacggcccggcctcacctgctgccgaaagcacccctcagcaaggaaagctgcctgaccagcaagcgccgatcaccggcgtcgaacttgcacctggcggagcctccgcacctggggctgagccgtccggtaaagcccaagcgcaggccgcaaaacccaagaccatgccaggtgacgcccccgacgccgacagcatgaaggctgccatgcgtgccgccatcccggccggcggtgcggaaatgggccagcgctcccccagagtcgtgacgaacaaatccgaaaaagagggtgccgcgccggcccggggcaaggccgttggagctgcagtcaaggccacggtaccgatggcggcagacacgggccattggcggcccaccattggaatccaagggcaggacgtcagcgcacaccaaggcaacgtcgactggcaaagccaatggagtcaaggctccaggtgggcctacgtcaaagcctccgagggaaactactacctcaacgagaactacacgcagcaatacaacggatcccggaatgttggcatggttcgcggcgcgtaccacttcgctatcccgaactggtcttccggggcagaccaagccaggtacttcgtggcaaacggaggtgggtggtcggcagacggctacacccttcctccggtcctggacatcgagtacaacccctacgcaggccggaccatcaacggcttctacttcggcaacacgtgctacgacatgtccaaggcccaacttggccagtgggcagctgacttcggcaacaccgtcaaggccttgaccggccggttccccgtcatctacagcaccacggactggtggaacacctgcgtgggcaacagcacctttggcagctacccgctgtggattgcttcctattggaacaatcccaccaattcgcccggctcactgccggccagttggaacgactactcaatgtggcagtacagcagcacaggccccttcgaaggcgactccaacatcttcaacggcacctttgatgagctccgcacctttgcccggggagttccggccccggccaatccctccatccgttcgggagcggatgtgcttgcagtgatgccttcgggaagactcgataatttcccggccgatggccaaggacgtatctcagggccagtgaccgtaggctccggctggggcaacgccctctccgtccatgtcgttgattggaaccaggacggagtccaggacctcctggcccaatgggccgacggaacactccaggtcttccgcggctcttcgggcggcggcttcagctcccccattcaggtaggcagcgggtggcaggaaatgtcgcttgccaccggatggtggaactcgaaggatgcgttccccggagtcatcggccaggacggcagcggcaacctgtaccgataccaaaacgcctcgggaggcgccctgggcggtggtgtgctgataggcaccggattcagcggacaccagttcaatctcctggactttgacggcgatggcagccaggatctcgtctccaggaccgccgacggtaccatgcggttgttccgcagcaacggtctcgggtccttcctctccgagccggcacaggtcattggtaacggatggtcctccatgacctcagtcagctcagcagcgggcttcaacggcgccggttcgcaaggactgcaggcacgtgctgccaacggcgatctctactactacccggcggtgaacggctcgtggggcaaccgcttcctcaccggtctcggctggaacgatgccatgctgatcggtggcgccccggtcaacgttgacgcaaccctgggcgttgatgaacccgacgtccttgccattcgccaggacggcaacctttaccggtacgccggatcaggttccggcggactcaacgcaccggatctgatcgggaaacaatggacggggctgaaggcaggcttccttactgactggaatggcgatggcgccttggacatccttgcccagtggaacgacggccgcctgtccctctacccgggctttaagggggccggcttcggctcgcccatcagccttggtacaggctggcaggactggacactcaccgtcggaacgtggaaaaagtccgattcccggccaagcattgtgggctatgaccccgcaggccggttgttccagatcggcaatccctcaggcggcgcccttggaacgcgtacccagatcggaacaggctggtcaggcctggacatagtccaaatggatttcgacaaggactcaaacgccgatcttgtcgctaaaaccgcgtcgggagacctcatgctttaccgctccaccggtaccgggagtttcatcccggaagctccgtccaccatcggtaaagggtggaatgtcattaacagcttcggagcaatccgcggatttgccggagccggttcaaccggcatcatcggtcgaacaacgggcggagaactccggtattaccccgttgggcagaaccgtgcctggggttcacccagcgtcgtcggatccggctggacagggatgaagatcctctctcccgcttccagatag

SEQ ID NO: 835 - DNA, 2748 bp, Arthrobacter sp.
gtgaaaatgaaaactacttcgatggacccggtccgccgcatcccactggcacgtgtaggcctggcgcttactatcgccctgatcggaagttcaagcctgggagcacctgcatgggcgcagacgtccggaccgcaaccggcaccgcagtcggagacccgggaaccaacgccgtcacagggtccgcgaccagccggagacggctcgggttcggcgccctccggcagcgatttgccgaccatcgaaccggttcccggtcagcaagagccgccgcccgccgtcgaaccttcaccattagaggcgccgttgccaacctcaacggcctcaggacaacccgaagcgcagcgcgcaacaccccaggcaatgcctggcagcgccaataacgccgacgccatgaaagcggccatgcgcgccgctattccggccggtggcgcagaaatggggcagcgctcgccgagagtattggccaagcagcagaaggctgcttcgcagccatctggagcaaaagcagtcggcggagccgtggacacggtcttccctatggcggcggacccggggcattggcgccccactatcggcattgccggacaggacgtcagtgcccatcagggcaacgtcaactggcagaaccaatggaaccaaggttcccgatgggcatacgtcaaggcctctgaaggcaactactacctcaatgagaactacacacagcagtacaacggctcccggagcgtaggcatggtccggggtgcctaccacttcgcaatccccaactggtcatcaggtgctgaccaggcccgatatttcgtcgcaaacggtggtgggtggacagccgacggttacacattgcctcccgtcctggacattgagtacaacccctacgccggacgcaccatcaacgggttctacttcggcaacacgtgctacgacatgtccaaagcccagctcggacagtgggcggccgactttggtaacacagtcaaggccctgaccggccgtttcccggtcatctacagcaccaccgactggtggaacacctgcgtagggaactccaccttcggaaactacccgctgtggatcgcgtcctactggaacaacccaaccaactcgcccggggccatgcctctcagttggggcaattacaccatgtggcagtacagcagcatgggcccctttgaaggcgactcgaatattttcaacggcacttatgaccagcttcggacattcgctagaggagtcccccgcccctccagcccctccatccggtccggggcggacgtgctcgctgccatgccctccggacgtctggacaatttcccggcagacggacagggccgcatcacaggaccggtaggcattggttccggttggggaactgcacagtccgtccacgtcgttgactggaaccaggacggagtccaggacatcctcgcccagtggcaggacggctcgctccaggttttccggggcgcttccggtggcggtttccttgcgcccattctggtgggaacggggtggcaggagatgtcgctcaccgcggggtggtggaactccagggacgcgtatccgggtgttatcggccaggacggcaaaggaaatctgtaccggtacgtgaatgcggccggaggcgccctcggtggaggagtgctgatcgggaccggattcggagggcaccagttcaaccaactggacttcgacggggacggcaaccaggacatcgtctcccggacaaatgacggcatcatgcgtctgtaccgctccaacggggtgggatcgttcctctccgaaccgagccgggtaatcggaaacggctggtccgccatgacgtcggtgagctcatcggccgggttcaatggcgctggttcgcaggggctccaagcccggaccgccaacggtgacctgtactactacccggcagtgtccgggtcgtggggcaaccgcttcctcatcggagtgggatggaatgatgcgaacgtgatcagcggcgctccggtcaacgttgaggccacgctcggcgtagacgctcaagatgtggtggccacgcgtcaagacggcaacatgtatcgctaccccgggtcaggttcaacctccttgttgcctgctgaacttatcggcacgcagtggaccgggctgaaggccggcttcctcgccgactggaacaacgacggcaccttggacatcctggctcagtggaccgatgggcggctcagcatgtatccgggattcaaaggccgaggctacggggcgcccatcagcctcggtaccggttggaaagactggacgctcactgtcggttcgtggaagaagtccgacgcccggccgagcatcgttggatacgacccctcaggccgcttgttccacatcagtaacccgtccggcacgggattgggcgcgcgtgttcagattggcgtcggttgggccggattggccatcctccagatggacttcgacaaggacaccaacatggatctcctggcgaagaatgccgccggcgatttggtgctctaccggtcaaccggcagcggaacactgattcaggaagcgcccgacaccgtaggtgtcggttggaacgtgatcaacagcttcggagccatccgtggattcgctggagccggctcaagcgggatcctggcgcggacgaccggtggcgatctgcgttattacccggttggacagaatcgaagctggggcacacccaccagaatcggcaccgactggggcgggctaagaatcctcgcccccgccgcaagttag

SEQ ID NO: 836 - DNA, 2730 bp, Arthrobacter sp.
gtgaaaatgaaaactaattcgatggacccggtccaccgcatccctctggcacgtgccggcctggcgctgactgtcgcactgctggcggctggcagccttggagttcccgcatgggcgcagccgtccggccctcaaccggccccgcattcccagactcaggaaaacccgccgctgcagggcccccggccggccggagacggctccggctcctctccggacagcgggttgccaacggatgggcaggtgcctgatcagcaagagcggccggccgccgtcgaaccctcacccgtggtgacaaacccaaccgccaccggtcagcccgaagcacctgccgcaacacccaaatccatgcccggcaacgccccggacgccgaagccatgaagacggccatgcgagccgccattccagccggtggcgcagaaatggggcagcgctcgccgagagtattggccaagcagcagaaggctgcttcgcagccatctggagcaaaagcagtcggcggagccgtggacacggtcttccctatggcggcggacccggggcactggcgccccactatcggcattgccggacaggacgttagtgcccatcagggcaacgtcaactggcagaaccaatggaatcaaggttcccgatgggcatacgtcaaggcctctgaaggcaactactacctcaatgagaactacacacagcagtacaacggctcccgcagcgtaggcatggtccggggtgcctaccacttcgcaatccccaactggtcatcaggtgctgaccaggcccgatatttcgtcgcaaacggtggtgggtggacagccgacggttacacattgcctcccgtcctggacattgagtacaacccctatgccggacggaccatcaacgggttttacttcggcaacacgtgctacgacatgtccaaagcccagctcggacagtgggcggccgactttggtaacacagtcaaggccctgaccggccgtttcccggtcatctacagcaccaccgactggtggaatacctgcgtgggtaactccaccttcggaagctaccccctgtggatcgcgtcctactggaacaacccaaccaactccccgggtaacctgccggtcagttggggcaactacaccatgtggcagtacagcagcaccggcccctttgagggcgattcaaacattttcaacggcacctatgaccagcttcggacatttgcgcgtggagtcccccgcccgtccagcccctccattcggtccggggctgacgtgctcgctgccatgccctccggacgcttggacaatttccccgccgacggtcaaggccgtattacgggcccggtaacgatcgggtccggttggggcactgcgcagtccgtccacgtcgttgactggaaccaggacggagtccaagacatcctcgcccagtggcgggacggctccctccaagtcttccgcggtgcctccggcggcggattcctttcacccttgctggtgggaacagggtggcaggagatgtcgctcacggccgggtggtggaactcgagggacgcatatccgggtgtcatcggccaggatggcaaaggaaacctttaccgctatacgaatacggcaggaggcgccctcaatgggggtgtgctgatcgggaccggattcggagggcaccaattcaaccaaatggacttcgacggggacggcaaccaggacatcgtctcccggacggccgacggcatcatgcgtctataccgctcaaacggcgtggggtcgttcctctccgaatcgagccgggtgattggcaacggctggtccggcatgacatcggtgagctccgcagcgggtttcaacggctccggttcgcaggggctccacgcccggactgccaatggtgaccttttctactacccggctgtcgccggatcatggggcaaccgcttcctcatcggagtgggatggaatgacgcgaacgtgatcggcggcgcaccggtcaacgttgagagcactctcggcgtagacccgcaagatgtggtggccgctcgtcaagacggcaacctgtaccgttaccccggttccgggtctacttcgttgttgccagccgagcttatcggcacgcagtggaccggtcttaaggccggtttcctcgcagactggaacaacgacggcgctttggacatcgttgcgcagtggaccgatggacggcttagcgtctacccgggattcaggggccggggttacggggcgccgatcagtctcggaaccggttggaaggactggacgctcacagttggttcgtggaagaagtctgacgcacgcccgagcatcgttggctacgatcccacgggccgtttattccatatcagcaatccatccggcaccaccttgggctccagggttcagattggtacaggttgggcaggcttggacatcgcccagatggacttcgacaaggactccaacatggaccttctcgcgaagaatgccgccggtgatttattgctctaccggtcatccggcagtggagcactggtccaggaagcgcccggcgtagtgggaaccggttggaacgtagtcaacagctacggagccatccgtggattcgcaggagccggttcaaccggaatcctggcgcgcaccacaggcggcgatctgcgctactacccggtcggacagaatcgtagctggggttcgcccaccaaagttggcactggttggggcgcgctgagaatcttcgcccccgcctga

SEQ ID NO: 837 - DNA, 2751 bp, Arthrobacter sp.
gtgaaaatgaaaactacttcgatggacccggtccgccgcatcccactggcacgtgtaggcctggcgcttactatcgccctgatcggaagttcaagcctgggagcacctgcatgggcgcagacgtccggaccgcaaccggcaccgcagtcggagacccgcgaaccaacgccgtcacagggtccgcgaccagccggagacggctcgggttcggcgccctccggcagcgatttgccgaccatcgaaccggttcccggtcagcaagagccgccgcccgccgtcgaaccttcaccattagaggcgccgttgccaacctcaacggcctcaggacaacccgaagcgcagcgcgcaacaccccaggcaatgcctggcagcgccaataacgccgacgccatgaaagcggccatgcgcgccgctattccggccggtggcgccgaaatggggcagcgatcgccaagggtcatggcgacgaagcagcagagtgcggtttcgcccccgtcgggagcccgttcaatcggcggagcagtgaattcagtggttcccatggcggctgacccgggacactggcgcccgactatcggcatcgcgggtcaggatgtcagcgcccaccaaggcaacgtcaactggcaaacccaatggaaccaaggttcccgatgggcctacgtcaaggcgtccgaaggcaactactacctcaatgaaaactacacacagcagtacaacggctcccgtgacgtaggaatggtccggggcgcctaccacttcgctatccccaactggtcatcgggtgcggaccaggccaggtatttcgtggcaaacggtggcggatggactgccgacggttacacgctcccgcccgtcctggacatcgaatacaacccctacgccggacgcaccatcaacgggttctacttcggcaacacatgctatgacatgtccaaggcgcagctcggacaatgggcggccgactttggcaatactgtcaaggcactgacgggtcgattcccggtgatctacagcaccaccgactggtggaacacctgcgtagggaactccaccttcggaaactacccgctgtggatcgcgtcctactggaacaacccaaccaactcgcccggggccatgcctctcagttggggcaattacaccatgtggcagtacagcagcacgggcccctttgaaggcgactcgaatattttcaacggcacttatgaccagcttcggacattcgctagaggagtcccccgcccctccagcccctccatccggtccggggcggacgtgctcgctgccatgccctccggacgtctggacaatttcccggcagacggacagggccgcatcacaggaccggtaggcattggttccggttggggaactgcacagtccgtccacgtcgttgactggaaccaggacggagtccaggacatcctcgcccagtggcaggacggctcgctccaggttttccggggcgcttccggtggcggtttccttgcgcccattctggtgggaacggggtggcaggagatgtcgctcaccgcggggtggtggaactccagggacgcgtatccgggtgttatcggccaggacggcaaaggaaatctgtaccggtacgtgaatgcggccggaggcgccctcggtggaggagtgctgatcgggaccggattcggagggcaccagttcaaccaactggacttcgacggggacggcaaccaggacatcgtctcccggacaaacgacggcatcatgcgtctgtaccgctccaacggggtgggatcgttcctctccgaaccgagccgggtaatcggaaacggctggtccgccatgacgtcggtgagctcatcggccgggttcaatggcgctggttcgcaggggctccaagcccggaccgccaacggtgacctgtactactacccggcagtgtccgggtcgtggggcaaccgcttcctcatcggagtgggatggaatgatgcgaacgtgatcagcggcgctccggtcaacgttgaggccacgctcggcgtggacgctcaagatgtggtggccacgcgtcaagacggcaacatgtatcgctaccccgggtcaggttcaacctccttgttgcctgctgaacttatcggcacgcagtggaccgggctgaaggccggcttcctcgccgactggaacaacgacggcaccttggacatcctggctcagtggaccgatgggcggctcagcatgtatccgggattcaaaggccgaggctacggggcgcccatcagcctcggtaccggttggaaagactggacgctcactgtcggttcgtggaagaagtccgacgcccggccgagcatcgttggatacgacccctcaggccgcttgttccacatcagtaacccgtccggcacgggattgggcgcgcgtgttcagattggcgtcggttgggccggattggccatcctccagatggacttcgacaaggacaccaacatggatctcctggcgaagaatgccgccggcgatttggtgctctaccggtcaaccggcagcggaacactgattcaggaagcgcccgacaccgtaggtgtcggttggaacgtgatcaacagcttcggagccatccgtggattcgctggagccggctcaagcgggatcctggcgcggacgaccggtggcgatctgcgttattacccggttggacagaatcgaagctggggcacacccaccagaatcggcaccgactggggcgggctaagaatcctcgcccccgccgcaagttag

SEQ ID NO: 838 - DNA, 2742 bp, Arthrobacter sp.
gtgaaaatggaaaatagctctatggacccggtccgccgcatcccgctggcacgtacggccttggcgcttactatggcgctggtggggggcagttgcctcggagcaccggcatgggcccagtcctccggcccccaaccggctccgacgtcggatgttcaggaagcgtcgccctcgcagggcccccgcccggccggaaatggccccggttcagggacccccggcagcgagatgccgagtagtacgtcggtgtccaagcagcaagagccgcctcccgccgtcggaccttcaccagcagtcactccagcgccaacatcaaaagcttccgggcagtccgctacgccaacgcctcaggcatcgcctggcactgcacccgatgccgacgccatgaaagcggcaatgcgggcggctattccggccggtggcgctgaaatgggccagagatcaccaagagttttgtcggcaaagcaacagaacgccacgtcacccgcttccggctccaaggcaattggcggggcagtgacgtccgcagtccccatggcggcagatacgggtcactggcgccccaccatcggcatcgccggacaggacgtcagcgcccaccaaggcaacgtcaactggcaaagccaatggaaccagggctcccgatgggcgtacgtcaaggcgtccgagggcaactactacctcaatgaaaactacacacagcagtacaatggctcccgtaacgttggcatggtcaggggcgcctatcacttcgcgatccccaactggtcctcgggtgcggatcaagccagatacttcgtggccaacggcggtggatggactgccgacggttacactctcccgcctgtcctggacatcgaatacaacccatacgccggacgcaccatcaacggcttctacttcggcaacacctgctatgacatgtccaaggcccagctcggacaatgggcggccgattttggcaacacagtcaaggccctcaccggccgcttcccggtgatctatagcaccactgattggtgggacacctgtgttgggaactccaccttcggaaactatccgctgtggatcgcgtcctattggaacaaccccacgaactccccgggggacatgcctctcagctggggcaattacaccatgtggcagtacagcagcaccggcccctttgaaggggactcgaacatcttcaacggcacctatgaccagcttcgcacctttgcccgcggagtctcgcgcccttccagcccctctatccggtccggggctgacgtgctcgccgccatgccatcgggacgactggacaacttcccggctgacggacaaggccgcatcacaggacccgtagccatcggctccggttggggaactgcgcaatccgtgcacgtcgttgactggaaccaagacgggatccaggatgtccttgcccaatggcaggatggttcactccaagtcttcaggggcgcggcgggcggcggtttcctcgcccccatacttgtcggaactggctggcaggaaatgtccctcactgttgggtggtggaactccagggacgcatatcccggtgttatcggtcaggatggcaaaggaaacctttaccgctatgcgaatcccggcgctggcgccctgagcggaggcgtgctcattgggacaggatttggcgggcaccagctaaaccaactggacttcgacggggacggcaaccaggacatcgtctcgagaacgagcgatggcatcatgcgcctttaccgctccaacggggtgggatcgttcgtctccgaaccaagccgagtgattggcaacggctggtccgctatgacgtcgatcagctctgcggccggtttcaacggcgccggttcgcaagggcttcaagcccggacggccaacggagacctgtattactacccggcagtttccgggtcctggggcaaccgtttcctcatcggagtgggatggaatgacgcgaacgtcatcagtggcgcgcccgtcgacgttgaaacgacgctcggcgtggacgcgccagacgtggtggctgcccgacaagacggcaatctgtaccgctacccggggtcaggttccacgtccttgttgcccaccgaagttatcggtactcagtggaccggcctgaaggcaggctttctcaccgactggaataacgacggcgccctggacatcctcgcgcaatggagtgatgggcgactcagcgtctacccgggattgaagggtcgtggctatgggactccgatcagtttgggcaccgggtggaaggactggacgctcacagtcggtaagtggaagaagtccgatgcccggccaagcattgtgggatacgacccctcaggtcgcctgttccagatcagcaacccgtccggcaccggattgggagcacgcgttcagattggtacgggttgggctggattggacatcctccagatggacttcgacaaggactcgaacatggatctcctggcaaaaaatgctgccggcgatttggtgctctacagatcaaatggcagcggagcatttgtgcaggaaccaaccgagaccgtaggaatcgggtggaacgtaatcaacagcttcggatccatccgcggattcgccggagccggatccaccggaattttggcgcggacaagcagcggagacctgcgctactaccccgtcggacagaacggaagctggggtactcccacaagagtcggcaccgactggggcggcctgaaaatcctcgcccccgccagttag

SEQ ID NO: 839 - DNA, 1518 bp, Multievos46 sp.
gtggcggcttgcgctgtattcctcggcctggtgctggcggccgccctcgctcccgcggccgacgcggcagccccggccagcgcggcacccacagctcaggcgacccggtacgtttccgaagccggagtcacggcccaccgcgccgccgtcgtgaacgccgcggccgtaaaagcgcaggtgccttcgaccgccaatccgctgcctggcctcgatcccgcgggtgatcctgccaacttgtccgtccttgtgaacaagtcccgccccctgaaccctgccacctacgccccggcagatctggtgaacgcgcgtggctcgggacagtatctccgggccgaagctgcagcgtggctcaatgggcttttccagggtgcggcggatgccgggaccggcgggctggcggtcgtgagtggctatcgttcttacgcccagcaacaacaggtgtactcgtcctatgtgaacctttacggccaggcgcaggcggacctgatctcggcaaggccgggctacagtgagcaccaaaccggtcttgccgtggatgtcggaaatgccaacggttcgtgtgggctcagcacctgctttggtgacactgccgccggcatgtgggtggcagcgaacacatacaaatacggtttcatcgtccggtaccccaacggctacaccaacatcaccgggtacagctacgaaccgtggcacctgcgctacgtcggagtggatctggcaacggatatgaagcgccgtggctttgccactttggaacaatatttctccggcaaccccagcgtccatgccagcatcacctcgggcgcggacctggtggccgcggacgctgccggccggctgcttcgctaccccgcgctgccgagcggcggctacggcgttcctgtacagattggctccaactggacgggactgaagcaggcgttcgtggtggattgggattcggacggcgtctatgaccttttggcgcaatggaacaacggcaccctgggcctgttcaagggatggcccggcggcgctttctcgacccagatcgtggttggcacgggcgactgggacgccatgaccatcactgtgggcaagtggtccagcgaccagggttacccgggcgtcgtggggtatttccccgacggcggcctgcgctactaccccaacacctccggccgggcgttgacttaccgggtggacatcggaaccggctgggcgggactggggctgaccatggccgattgggacgcggacggcgccaacgacatcctggccaccacatcctccggacttctgctcagttacccaggcaatggagttggcggcttcaaaggccagccaagcatcatcggctcggggtggggaaccatgaaggccttggtgcctggcttcggcttgtcaggtccaggtacacgcaacattaccgcccagaccgtggacgggtacttggtggactacggattgggactcggagtctggggtccgcaacgccaagtgggcaacggctggggctcaatgaagctattcaaatga

SEQ ID NO: 840 - DNA, 1431 bp, unknown
  environmental sample
atggctgcttgcgctgctttcctcgctctggcgctggcgtctgccctcgctcccgcggccggcgctgtacccgccgtcgtgaacgcgatggtgccgtcggccgccaatccgctgcccgggctcgatcccgcgggtgatcctgccaacttgtccgtcctcgtgaacaagtcccgcccgctgaacccggccacctacgtcccggcagatctggtgaatgcccgtggttcgggccagtatctccgggccgaggccgcagcgtggctcaatggccttttccagggtgcggcagatgccggaaccggcgggctggctgtcgtgagcggctaccgttcctacgcccagcagcaacaggtgtactcgtcctatgtgaacctttatggccaggcgcaggcggatctgatctccgcaaggcccggttacagtgagcatcaaacggggcttgccgtggatgtcggaaacgccaatggttcctgtggactcagcacctgtttcggggacactgccgccggtatctgggtggctgcgaacgcgcacaaatacggtttcatcgtccggtacccaaatggttacaccaacatcaccgggtacagctatgaaccgtggcacctgcgctacgtcggattggatctggcaacggatatgaagcgccgcgggttcgccactttggagcaatatttctccggcaaccccagtgtgtatgcgagcatcacctccggggcggacctggtggcggcggacccttcgggacggctccttcgctaccccgcgcttccgagtggtggctacggcgttcccgtgcagattggttccaactggacgggactgaagcaggcgttcgtggtggattgggattctgacggcgtctacgacctgctggcgcaatggaacaacggcaccctgggcctgttcaagggttggccgggcggtgctttttccacccagatcgtggtgggcacgggagactgggacgccatgaccatcaccgtgggcaagtggtccagcaaccagggttacccgggcgttgtggggtatttcccggatggcggcctgcgctactaccccaacacctccggccgtgcgttgacctaccgggttgatattggaacgggctgggccggactggggctgaccatggcggattgggacgcagacggcgccaacgacatccttgccaccactgcgtccggccttctgctgaactaccccgggaacggcgtgggcggcttcaaggggctgcctggcagcatcggttcggggtggggaaccatgaaagcactggtgcccagcttcggcttgtcgggtccgggaacacgcagcatcactgcccagaccgtggatggcttcttggtggactacggtttggggaccggagtgtggggctcccaacgccaggtgggcaacggctggggctcaatgacgctgttcaaataa

SEQ ID NO: 841 - DNA, 1515 bp, Arthrobacter sp.
atgcgaagtcacatccgttcgggttccatggggaacgcacgacgacggctggcggcttgcgctgctgtcttcagcctggcggtggctggcggagtcgtggctgcagcgcctgccacggctgcgccgactcaagctgtcaccaccacagcaccggcagccgtcgcccaaacagcggtccccaccacagcgaatccgctgccgagcgtcgatcctgtgggcgatcccgcgaacctctctgtcttggtcaataagtcccggccactgaacccggtgagctacgctcctggcgacctggtcaacgcccgcggttccggacagtatctgcgggccgaggctgcggcatggctcaatggtttgttccaaggtgcggccgatgccggcacaggcgggctggcggtagtgagcggttaccgctcctacgctcagcagcagcaggtctactcctattacgtcagcatctacggccaggcccaggctgacctcatttcggcgcgtcccgggcacagcgaacaccagacggggctcgccgtggacgtcggaaacgccaacggttcctgcggcctcagcacctgcttcggggacactgccgcaggtatctgggtggcggcgaatgcccacaggtacggcttcatagtccggtaccccaacggctacaccaatgtcacggggtacagctacgagccgtggcatttgcgctacgtcggggtggatctggccaccgaaatgaagcgccgcggcttccccaccatggaacaatacttcgccggcaaccccaccgcatatgcaagcatcacctccggcgctgacctggttgctgcggactcctcgggccggctccttcgctaccctgcacacggcggtggcggctacggcattccttctgtgatcggctccaactggcatggtctgaagcaggccttcgtggtggactgggacgctgatggcgtctacgacatccttgcgcagtgggacaacggcacgttgggcttgttcaagggttggcctggcggtgctttctccactcagatcgtggtgggaacgggtgattgggacaagatgaccatcaccgtgggcaaatggtccgccgcgcaggggtacccgggcattgtggggtatttcccggatggcggtctccggtactaccccaatacttcgggcagggctttgagctaccgggtggatatcgggagtggttgggcaggcatgggcctgaccatggccgactggaatggcgacggcgccaacgacatcctggcaatcaccacctccgggcatttgctcagctacccgggcaacggcgggggtggtttcgcgggccttcccgccactgttggttccggttggggcaccatgaaggcactggttccgagctttggtttgtccggtccgggtacgcgcagcatcactgcgcaaaccgtggacggttacctcgtggactacgcgctgggcgtaggtgtgtggggtgctcagcgccaagtgggcaacggctggaacggcatgaagctgtttagataa

SEQ ID NO: 842 - DNA, 1542 bp, Arthrobacter sp.
gtgcctgcggctgactacaagcaaattgggggcgttatgcgaggtcaattccacccgggttccatgaggaacgcacggcgacggctggcggcttgcgctgctttcttcagcctgaccgttgctggcggtgtcattgctgcggctccagccacggctgcgccggcgccatccaacgcgcgcgccgccgtcgttcaaagtgcagtaccgaccactgcgaatccactgccgagcgtcgatcctgtgggcgaccccgcgaactactctgtcctggtcaacaagtcccggccattgagtcctttgagctacgctcccggcgacttggtcaatgcccgcggctccggccagtatctgcgtgccgaggctgcggcatggcttaatgggttgttccaaggtgcagctgatgccggcacgggcgggctggccgtggtgagcggttaccgttcctatgcgcagcagcagcaggtctactcctattacgtcagcatctacggccaagcacaggcggacctgatctccgcacgtccggggcacagcgagcaccagacggggctcgccgtcgacgtcgggaacgccaacgggtcctgcggcctcagcacctgtttcggggacactccggccggggtttgggtggcggcgaatgcccacaagtacggcttcattgtccgataccccaacggctacacgaatgtcacgggctacagctatgagccgtggcatttgcgctatgtcggagtggacctcgccaccgacatgaaacgccgtggcttccccaccatggagcagtatttcgccggcaaccccactgcgtatgcgagcatcacctccggcgcggacctggttgctgcggactcgtccgggcgcctccttcgctaccctgcacatggcggtggcggttatgggattcccacagtcatcggttcaaactggcagggcttgaagcaggccttcgtggtggactgggatgctgatggcgtctacgacattttggcccaatgggacaacggcaccttgggcctgttcaagggttggcccggcggtgctttctccactcagatcgtggtgggaacgggtgactgggacaagatgaccataaccgtgggcaaatggtccgcggcgcaggggtatccaggcatcgtgggctatttcccggatggcgggctccggtattaccccaacacctcaggcagggcgttgacctaccgtgtggacatcggaagcgggtgggcgggcatgggcctgaccatggccgactggaatgccgacggcgccaacgacatcctggccaccactacctccgggcacttgctcagctaccccggcaacggtggcggcggcttcgcgggcctgcccaccacagtgggttccggttggggaaccatgaaggcactggtcccgagcttcggtttgtccggtccgggaacgcgcagtatcactgcccagaccgtggatggctacctcgtcgattaccggctggggaccggagcctggggcgcccaacgccaggtgggcaacggctggaatggtatgaagctgttcaggtaa

SEQ ID NO: 843 - DNA, 1548 bp, Arthrobacter sp.
gtgcggctggcaacaagcaaattggggggcgttatgcgaagtcacatccgttcgggttccatggggaacgcacgacgacggctggcggcttgcgctgctgtcttcagcctggcggtggctggcggcgtcgtggctgcagcgcctgccacggctgcgccgactcaagctgtcaccaccacagcaccggccgccgtcgcccaaacagcggtccccaccacagcgaatccgctgccgagcgtcgatcctgtgggcgatcccgcgaacctctctgtcttggtcaataagtcccggccactgaacccggtgagctacgctcctggcgacctggtcaacgcccgcggttccggacagtatctgcgggccgaggctgcggcatggctcaatggtttgttccaaggtgcggccgatgccggcacaggcgggctggcggtagtgagcggttaccgctcctacgctcagcagcagcaggtctactcctattacgtcagcatctacggccaggcccaggctgacctcatttccgcacgtcctgggcacagcgaacaccagacggggctcgccgtggacgtcggaaacgccaacggttcctgcggcctcagcacctgcttcggggacactgccgcaggtatctgggtggcggcgaatgcccacaggtacggcttcatagtccggtaccccaacggctacaccaatgtcacggggtacagctacgagccgtggcatttgcgctacgtcggggtggatctggccaccgacatgaagcgccgcggcttccccaccatggagcaatacttcgccggcaaccccaccgcatatgcaagcatcacctccggcgctgacctggttgctgcggactcctcgggccggctccttcgctaccctgcacacggcggtggcggctacggcattccttctgtgatcggctccaactggcatggtgtgaagcaggccttcgtggtggactgggacgctgatggcgtctacgacatccttgcgcagtgggacaacggcacgttgggcttgttcaagggttggcctggcggtgctttttccactcagatcgtggtgggaacgggtgattgggacaagatgaccatcaccgtgggcaaatggtccgccgcgcaggggtacccgggcattgtggggtatttcccggatggcggtctccggtactaccccaatacttcgggcagggctttgagctaccgggtggatatcgggagtggttgggcaggcatgggcctgaccatggccgactggaatgccgacggcgccaacgacatcctggcaatcaccacctccgggcatttgctcagctacccgggcaacggcgggggtggtttcgcgggccttcccgccactgttggttccggctggggcaccatgaaggcactggttccgagcttcggtttgtccggtccgggtacgcgcagcatcactgcgcaaaccgtggacggttacctcgtggactacgcgctgggcgtaggtgtgtggggtgctcagcgccaagtgggcaacggctggaacggcatgaagctgtttagataa

SEQ ID NO: 844 - DNA, 1545 bp, Arthrobacter sp.
gtgcctgcggctggctataagaaaattgggggcgttatgcgagggaaaaatcattcgggttctgtgaggaacgcacgacgacgactggcagcttgcgctgcgatcttcagtctggcggtggctgtcggcgtcatggccgggacccctgccacggcagcgccggtccctggcacggcggcacaggccgccgtcgttcaagcagcggtgccaaccgcagcgaatccgctgccgagcgttgatcctgtgggcgccccctcgaattactctgttctggtcaataagtcccggcccctgaacccggtgagctacgctcccggcgacctggtcaatgcccgcggctccgggcagtatctgagggccgaggctgcggcttggctcaatggtttgttccaaggtgcggctgatgccggcacgggcgggctcgcggtggtgagcggctaccgttcctacgcgcagcaacagcaggtctattcctattacgtcagcatctacggccaggcccaggcggatctcatatctgcacgcccgggccacagcgagcatcagaccgggttggccgtggatgtgggtaacgccaacggttcatgtgggctcagcacctgttttggggatacggctgccggcatctgggtggctgcgaatgcccacaaatacgggttcattgtccgctaccccaacggctacacgaacatcacgggctacagctacgagccgtggcacctgcgttacgtcggcgtggatctggccaccgacatgaaacgccggggcttccccaccatggaacagtactttgcgggcaaccccaccgcgtatgcgagcatcacctccggcgcggacttggtggccgcagactcttccggccggctccttcgctaccctgcacacggtggtggtggctacggcgttcccacggtgatcggctccaactggcatggcttgaaacaggccttcgtagtggactgggattctgatggcgtctacgacattctggctcaatgggataacggtactttgggcttgtttacgggctggcctggcggtgctttctccactcagatcgtggtaggtacgggtgactgggacaagatgaccatcaccgtgggcaaatggtccgctgcggagcgcttcccaggggtcgttggctatttcccggatggcgggctgcgctactaccccaatactttgggcagggcgttgatctaccgcgtggacattggaagcggctgggcgggaatgggcctgaccatggccgactggaatgccgacggcgccaacgacatcctggccacaacaacctccgggcagctgctcagctaccccggcaacggcggtggcggcttcgcgggcctgcccgccaccgttggttccggctggggcaccatgaaggcgctggttccgagcttcggtttgtcgggtccgggaacgcgcagcatcactgcccacaccgtggacgggctgctcgtcgattacgccttgggggccggggcttggggcacgcagcgccaggtgggtaagggctggaatggcatgaagttgttcaaatag

SEQ ID NO: 845 - DNA, 468 bp, Bacillus sp.
atgtcaattgaagtaggcagcaagttacagggaaaggtaacaggtattacaaactttggagcttttgtggagcttccagggggaacaacaggcttagttcatattagtgaagtggctgataactatgtaaaagacattaacgaccatttaaaagtcggcgatgaagttgaagtaaaagttattaacgtagagaaagatggcaagattggtctttcaattaagaaagctgtagagcgtgcagaacgcccagaacgtccagagcgaccagcgcgtgcaccacgttctgacagacctcgtgactcacatcgcccacagcgtaataatcgcggtggtggtaatgacttccgttcaaaagaaacgtttgagcaaaaaatgaatcgtttcttaaaagatagtgaagaacgtttatcttccctaaaacgccatacagaatcaaaacgtggcggacgcggcgcgaaacgcggctaa

SEQ ID NO: 846 - DNA, 459 bp, Bacillus sp.
atgtccattgaagttggcagcaagttacaaggtaaagtaactggtattacgaatttcggagcttttgttgagctaccgggaggttccacgggtctagttcacataagcgaagtagccgataattacgtgaaagacattaatgaccatcttaaagttggcgacatggttgaagtaaaagtcatcaacgttgaaaaagatggaaagatcggtctatcgattaagaaagcaatcgaccgtccagatcgtcctgaacgtcctgagcgtcctcgtcaggatcgcccgcgtacagaccggccgcaccgaggtggcggaggcggagcaggaagaaacgaattccgtcctaaagagaattttgaacaaaaaatgagccgcttccttaaagacagtgaagaccggttatcttctcttaaaaggaatacagaatcaaaacgcggcggacgcggagcaaaaagaggctaa

SEQ ID NO: 847 - DNA, 453 bp, Bacillus sp.
atgtcgatagaagttggcagcaagttacaaggtaaggtaacgggcattacaaatttcggagcgttcgtagagctttcgggtggcactacaggactcgtccacatcagtgaagttgctgataattatgtgaaagatattaacgatcacttaaaagtcggtgacgaggtaaccgttaaagtcatcaatgtagagaaagacggaaaaattggcttgtcaattaaaaaggcaattgatcgtcctgagcgcccagaacgttcagaacgcccgaatcgctcagaccgtccaaaccgctcagatcgtccaagaggcagaacgaacacaaatgaattccgccctaaggagaatttcgagcaaaagatgagcaggttcttaaaagacagtgaggatcgcttatcatcacttaaacgcaatacagaatcaaagcgcggcggtcgcggagcaagaagaggttaa

SEQ ID NO: 848 - DNA, 441 bp, Bacillus sp.
atgtcgattgaagttggcagcaagttacagggtaaagtgacgggcattactaattttggagcgtttgtggagttaccaggcggatccacaggtctcgttcatattagtgaagtagccgataattatgtgaaggatattaatgatcacttaaaagtcggagatgaagttacagttaaggttattaatgttgaaaatgatggtaaaattggtttgtctattaaaaaggccattgaccgtccagagcgtcctcaacgtccggaacgcccaagaaattcagaccgcccgagatcaagagggaatgatttccgaaataatagtaataacaaagaaaactttgaacaaaaaatgaatcgtttcttaaaagatagtgaagatcgtctagcttcattaaaacgtaataccgaatcaaaacgtggtggtcgtggggctagaagaggatag

SEQ ID NO: 849 - DNA, 438 bp, Bacillus sp.
atgtcaattgaagtaggcagcaagttacaaggaaaggtaacagggataacaaatttcggtgcgtttgtcgagctgccaaatggctcaacaggactcgttcatattagtgaggttgctgataactatgtgaaggatatcaatgatcacctaaaggttggcgatcaggttgaggtaaaagtcatcaatgttgagaaggacggaaaaattggtctatcgattaaaaaggcaaaagacagaccagagccggaaagaagacaacattcaaactctcattcgcaacgtcctcgtcagggccggccaaacgatcgtaacaacaacaaaggggaaaccttcgagtcaaaaatgtcaaagttcctaaaagacagtgaggatcgtttatcttccttaaagcggcacacggaatccaagcgcggaggaagaggggctaaacggggttag

SEQ ID NO: 850 - DNA, 456 bp, Bacillus sp.
atgtcaatcgaagtaggcagcaagttaaaaggaaaggtcacaggcattacaaaattcggagcatttgtggagctgccggaaggctcaacgggtctggtgcacataagtgaagtcgctgacaagtatgtaaaagatattaatgagcacctcaaagtgggtgatatggttgaagtgaaagtcattaatgtcgaaaaggacggcaagattggattatccatcaaaaaggcaaaagaccggcctgagcgttctgaaagacctgaaagaggcgacagaaaagaattcagacctaattcaaactctggccgacctcgccaaaaccgatcaaacgaccatcgccctaaagaaaactttgaagccaaaatggctcgtttcctaaaggacagcgaagatcgtctgtcatcgctaaaacgccatactgaatccaaacgcggaggaagaggcgctaaacgaggataa

SEQ ID NO: 851 - DNA, 492 bp, Bacillus sp.
atgtcaatcgaagtaggcagcaagttacaaggaaaggtaacaggaattactaattttggtgcgtttgttgagctcccagaaggcgcaacaggtcttgttcatattagtgaggtcgcagacaattatgtgaaggacattaatgaacacctaaaagtaggcgatgaagtcgaagttaaagttattaatgtcgagaaagatggaaaaattggactatctatcaagaaggcgaaggatagaccagaaagaccggaaagaccagagagaccagagagaccacaatacgaacgcggagaaagaagagaatcgagaggcggctattccggaggaaattctcaaaggtcacgtaatgcaaaatcaaatgataatcgtgctcctaaagagaattttgaatcgaaaatggctcgtttcttaaaagatagtgaagatcgattagcttctttgaaaagaaatactgagtcgaaacgcgggggaagaggcgctagacgcgggtaa

SEQ ID NO: 852 - DNA, 438 bp, Bacillus sp.
atgtcaattgaagtaggcagcaagttacaaggaaaggtaacagggattacaaatttcggagcgtttgtggagctgccggatggatcaacagggctcgtacacattagtgaggttgcagacaactatgtaaaagatatcaatgatcatcttaaggttggcgaccaagttgaggttaaagtcattaatgttgaaaaggatggcaaaattggactatccatcaaaaaagcaaaagatagaccagagacacctcaaagatctcattcaaattcgcattcacaacgtcctcgtcagggtagaacgaacgatcgcaataactctagaccagaaaactttgaaacaaagatggctaaatttttaaaagatagcgaagatcgtttgtcttccctaaaacgacacacagagtcaaaacgtggaggaagaggagctagacgaggataa

SEQ ID NO: 853 - DNA, 459 bp, Bacillus sp.
atgtcaatcgaggtaggcagcaagttacagggtaaagtaacaggtattacaaattttggggcttttgttgagctgccagaaggattaactggtcttgttcatattagtgaagttgctgataattatgtaaaagatatcaatgatcacttaaaagtaggagatcaagtagaagtaaaagttattaatgttgagaaagatggcaaaatcggtctatctattaaaaaagcaaaagaacgcccgaaggcagagggagagcaacaacaacaacaacgctctggacgccctcagcgcaatcgttcttttaacagagataatcgtgaccgcgatagtttccgccaaccgaaggaaaactttgagcaaaagatggcgcgtttcttgaaagacagtgaagatcgtctagcttctttaaagcgtaacacagagtcaaaacgtggtggccgtggcgcacgtcgcggataa

SEQ ID NO: 854 - DNA, 387 bp, Bacillus sp.
atgtcgattgaagttggcagcaagttgcaagggaaaataacaggtattacaaatttcggagcatttgttgaattgcctggaggctcaaccggtctcgttcatatcagtgaggtagccgataattatgttaaagacattaacgagcatttaaaagtcggcgatcaagttgaagtgaaagtcatcaacgttgaaaaagacgggaaaattggtttatcaattaaaaaagctaaagaccgtccgcaagccagacctagaaatgatttccgtccgaaagaatcttttgaacagaaaatgaacaagtttcttaaagatagcgaagaccgcttatcatctttaaaacgaaacacggaatcaaaacgtggagggcgcggagcaagaagaggataa

SEQ ID NO: 855 - DNA, 474 bp, Bacillus sp.
atgtcaattgaagtaggcagcaaattacagggtaaggttacaggaatcactcattttggagcatttgtggagctgccgggtggttcgacgggccttgtacacatcagtgaagtagctgataattatgtcaaggatattaacgagtttttaaaggttggagacgaagtagaggttaaggtcgtaaatgtagagaaagatgggaaaataggattgtctattcgcaaagcgaaggaacgtccggaaggtgctgaacgatcagaaaaaccagctcgtccaacaagaccagctcgtccaagtcgtccttatcaatcttcgtccgcgcgaccgcaaggacaaggtcagcgaaaccatcgaccaggaccatcatttgaagataaaatgagtcgttttttaaaggatagcgaggaaagattatctattataaaacgtcagacagattccaaacgtggtggtcgaggcgctcggagaggataa

SEQ ID NO: 856 - DNA, 438 bp, Kurthia sp.
atgtcaatcgaagtaggcagcaaagtacaaggtaaagtaacaggtattacaaatttcggagcgttcgttgaacttcccgacaaatcaacaggtcttgtgcatattagtgaggttgctgacaactatgtaaaagacatcaacgaccatttaacagttggtgacgtagttgaagttaaagtgatgaacgtagaatcagatggcaaaattggtctttctattcgtaaagcaaaaccagaatcagaacgtccgcaacgaccagaacgtccacaacgatcacgtaacaacaatcgtgggggtaaccgtaatgaacaccgcccacaacaagaaaactttgagcaaaaaatggcacgtttcattaaagatagtgatgaacgcttagctactttaaaacgcgcaacagattctaaacgcggtggccgtggcgctcgtcgtagctaa

SEQ ID NO: 857 - DNA, 444 bp, Bacillus sp.
atgtcaatcgaagtgggcagcaagttacagggtaaagtgaccggcattacaaagtttggtgcgtttgtacaattgccggaaggttcgacgggtctcgttcatattagtgaagtggcggataattatgtcaaagacattaatgatcacttgactgtcggcgatgaagtggaagtaaaagtattgaatgttgagaaggacggtaaaatcggtttgtcaattcgtaaagcgaaggataatccaccaccgcaaacgcaatatcgtccgcgtccacaacgccagggtgatttccgtcaaaaagggggaccacgaggtggaggacagccacctgtagagaactttgaatcgaaagtggcccgtttcctgaaagacagcgaagaacgcatgacaacattaaaacgtcaaacagactcacgccgaggtggaagaggcggaagacgcggttaa

SEQ ID NO: 858 - DNA, 399 bp, Anoxybacillus sp.
atgtcaattgaagtaggcagcaagttacaaggcaaagtaacgggaattacaaaattcggagcgtttgtggagctgccagaaggcgtaacgggtttagtgcatattagtgaagtagccgataactatgtcaaagatatcaatgatcatctcaaagtaggagatgttgttgaggtaaaagttattaacgttgaaaaagatggaaaaatcggcttatccattaaaaaggcaaaagaatcgcagtcttcacagcgtccgcgtacaaaagcaaacgatcgtgccgcaaaggaaagcttcgaacaaaaaatcagccgttttttaaaagaaagcgaagatcgtttggcatctctcaaacgacatactgaatcaaagcggggaggtcgcggtgcgagacgcggttaa

SEQ ID NO: 859 - DNA, 1014 bp, Bacillus sp.
atgaatataaaacgttggcttttgacggtaacaacagttattttagctacatttggagtcagtgcagttccttctgttcatgcttctgaagaaaaagaaactgcttatatagatgtcgcagcagctactctttggacagcaccaaacatcttgcgtgaagtggacgctccgtcagctactaatcctgtagatatgaagaagtggaccacatcgatgaatttgaaacagaagcagcagttatctagtgacgggatgcttgagacacaagcgttatatggaaacaaagtaacggttttagagagacaaggagattgggtcaaagtagctgtagacggacagcctacttctcgaaatgaattagggtatcccgggtggatgcctactaaacaattaacctatagcaaaaggtacgaacagtatgcaaagaagccttttgtaatggtgacggctccgactacttatttatatcattcgccttctttgaaaaagaaaggtattgaagttagctataatacgcgcttacctcttttggtaaaatcaaagagtgcatataaagtattaaaaccaaatggaaagacagcatgggtttctgcaaaagcaggaaaaatctacgcttctcaaaaagatattcctgtaccaactggcacggagcttgttgaaagcggaaaggcatttttaaatcttccatatttatgggctggcatgagtggttttggatttgactgctctggatttacgtttacgatgtaccagtcccatggtattacaattccacgtgactcaggcccacagtctagagcagggaaaccagtagagatgaacaatcttcaacccggagacttattattctttgcctataaccaagggaaaggaagcgtccaccatgtagcaatgtatgcgggagatggtatgatgattcattcgccgaactccgagcggacagtagagattattcctttaaacacgaaggggtatattgaagagtatgcaggtgcacgtcgttatttaccttaa

SEQ ID NO: 860 - DNA, 1014 bp, Bacillus sp.
atgaatataaaacgttggcttttgacggtaacaacagttattttagctacatttggagtcagtgcagttccttctgttcatgcttctgaagaaaaagaaactgcttatatagatgtcgcagcagctactctttggacagcaccaaacatcttgcgtgaagtggacgctccgtcagctactaatcctgtagatatgaagaagtggaccacatcgatgaatttgaaacagaagcagcagttatctagtgacgggatgcttgagacacaagcgttatatggaaacaaagtaacggttttagagagacaaggagattgggtcaaagtagctgtagacggacagcctacttctcgaaatgaattaggatatcccgggtggatgcctactaaacaattaacctatagcaaaaggtacgaacagtatgcaaagaagccttttataatggtgacggctccgactacttatttatatcattcgccttctttgaaaaagaaaggtattgaagttagctataatacgcgcttacctcttttggtaaaatcaaagagtgcatataaagtattaaaaccaaatggaaagacagcatgggtttctgcaaaagcaggaaaaatctacgcttctcaaaaagatattcctgtaccaactggcacggagcttgttgaaagcggaaaggcatttttaaaccttccatatttatgggctggcatgagtggttttggatttgactgctctggatttacgtttacgatgtaccagtcccatggtattacaattccacgtgactcaggcccacagtctagagcagggaaaccagtagagatgaacaatcttcaacccggagacttattattctttgcctataaccaaggaaaaggaagcgtccaccatgtagcaatgtatgcgggagatggtatgatgattcattcgccgaactccgagcggacagtagagattattcctttaaacacgaaggggtatattgaagagtatgcaggtgcacgtcgttatttaccttaa

SEQ ID NO: 861 - DNA, 1014 bp, Bacillus sp.
atgaatataaagcgttggcttttaacggcaacaacagttattttagctacatttggggtcagtgcagttccttctgttcatgcttctgaagaaaaagaaactgcttatatagatgtcgcagcagctactctgtggacagcaccaaacatcttgcgggaagtggacgctccgtcagctactaatcctgtagatatgagaaagtggaccacatcgatgaatttgaaacagaagcagcagttatctagcgatgggatgcttgagacacaagcgttatatggaaacaaagtaacggttttagacgaacaaggagactgggtcaaagtagctgtagacggacagcctacttctcgaaatgaattaggatatcccggatggatgcctactaaacaattaatctatagcaaaaggtacgaacagtatgcaaagaagccttttgtaatggtgacggctccgactacttatttatatcattcgccttctttgaaaaagaaaggtattgaagttagctataatacgcgcttacctcttttggcaaagtcaaagagtgcatataaagtattaaaaccaaatggaaagacagcatggatttctacaaaagcaggaaaaatctacgcgtctcaaaaagatattcctgtaccaactggcacggagcttgttgaaagtggaaaggcatttttaaatcttccatatttatgggctggcatgagtggttttggatttgactgctctggatttacgtttacgatgtaccaatcccatggtattacgattccacgtgactcagggccacagtctcgagcagggaaaccagtagatatgaacaaccttcaacctggagacttattgttctttgcctataaccaaggaaaaggaagcgtccaccatgtagcgatgtatgctggagatggcatgatgattcattcgccgaactccgagcggacagtagagattattcctttaaacacaaagggatatattgaagagtatgcaggtgcacgtcgttatttaccttaa

SEQ ID NO: 862 - DNA, 1014 bp, Bacillus sp.
atgaatataaaacgttggtttttgacggcaacaacagttattttagctacatttggggtcagtgcagttccttctgttcatgcttctgaagaaaaagaaactgcttatatagatgtcgcagcagctactctgtggacagcaccaaacatcttgcgggaagtggacgctccgtcagctactaatcctgtagatatgagaaagtggaccacatcgatgaatttgaaacagaagcagcagttatctagcgatgggatgcttgagacacaagcgttatatggaaacaaagtaacggttttagacgaacaaggagactgggtcaaagtagctgtagacggacagcctacttctcgaaatgaattaggatatcccggatggatgcctactaaacaattaacctatagcaaaaggtacgaacagtatgcaaagaagccttttgtaatggtgacggctccgactacttatttatatcattcgccttctttgaaaaagaaaggtattgaagttagctataatacgtgcttacctcttttggcaaaatcaaagagtgcatataaagtattaaaaccaaatggaaagacagcatggatttctacaaaagcaggaaaaatctatgcgtctcaaaaagatattcctgtaccaactggcacggagcttgttgaaagtggaaaggcatttttaaatcttccatatttatgggctggcatgagtggttttggatttgactgctctggatttacgtttacgatgtaccaatcccatggtattacgattccacgtgactcagggccacagtctcgagcagggaaaccagtagatatgaacaaccttcaacctggagacttattgttctttgcctataaccaaggaaaaggaagcgtccaccatgtagcaatgtatgcaggagatggcatgatgattcattcgccgaactccgagcggacagtagagattattcctttaaacacgaagggatatattgaagagtatgcaggtgcacgtcgttatttaccttaa

SEQ ID NO: 863 - DNA, 1014 bp, Bacillus sp.
atgaatataaaaggttggcttttgacggtaacaacagttattttaactacatttggggtcagtgcagctccttctgttcatgcttctgaagaaaaagaaactgcttatatagatgtcgcagcagctactctgtggacagcaccaaacatcttgcgtgaagtggacgctccgtcagccactaatcctgtagatatgaaaaagtggaccacatcgatgaatttgaaacagaagcagcagttatctagcgatgggatgcttgagacacaagcgttatatggaaacaaagtaacggttttagacaaacaaggagactgggtcaaagtagctgtagacggacagcctacttctcgaaatgaattaggatatcccggatggatgcctactaaacaattaacctatagcaaaaggtacgaacagtatgcaaagaagccttttgtaatggtgacgactccgactacttatttatatcattcgccttctttgaaaaagaaaggtattgaagttagctataatacgcgcttacctcttttggtaaaatcaaagagtgcatataaagtattaaaaccaaatggaaagacagcatggatttctacaaaagcaggaaaaatctacacgtctcaaaaagatattcctgtaccaactggtacggaacttgttgaaagtggaaaggcatttttaaatcttccatatttatgggctggcatgagtggttttggatttgactgctctggatttacgtttacgatgtaccaatcccatggtattacgattccacgtgactcagggccacagtctcgagcagggaaaccagtagatatgaacaaccttcaacccggagacttattgttctttgcttataaccaaggaaaaggaagcgtccaccatgtagcaatgtatgcgggagatggcatgatgattcattcgccgaactccgagcggacagtagagattattcctttaaacacgaagggatatattgaagagtatgcaggtgcacgccgttatttaccttaa

SEQ ID NO: 864 - DNA, 981 bp, Bacillus sp.
atagttattttagctacatttggggtcagtgcagttccttctgttcatgcttctgaagaaaaagaaactgcttatatagatgtcgcagcagctactctgtggacagcaccaaacatcttgcgtgaagtggacgctccatcagctactaatcctgtagatatgagaaagtggaccacatcgatgaatttgaaacagaagcagcagttatctagcgatgggatgcttgagacacaagcgttatatggaaacaaagtaacggttttagacgaacaaggagactgggtcaaagtagcggtagacggacagcctacttctcgaaatgaattaggatatcccggatggatgcctactaaacaattaacctatagcaaaaggtacgaacagtatgcaaagaagccttttgtaatggtgacggctccgactacttatctatatcattcgccttctttgaaaaagaaaggtattgaagttagctataatacgcgcttacctctcttggcaaagtcaaagagtgcatataaagtattaaaaccaaatggaaagacagcatggatttctacaaaagcaggaaaaatctacgcgtctcaaaaagatattcctgtaccaactggcacggagcttgttgaaagtggaaaggcatttttaaatcttccatatttatgggctggcatgagtggttttggatttgactgctctggatttacgtttacgatgtaccaatcccatggtattacgattccacgtgactcagggccacagtctcgagcagggaaaccagtagataagaacaaccttcaacctggagacttattgttctttgcctataaccaaggaaaaggaagcgttcaccatgtagcaatgtatgcgggagagggcatgatgattcattcgccgaactccgagcggacagtagagattattcctttaaacacgaagggatatattgaagagtatgcaggtgcacgtcgttatttaccttaa

SEQ ID NO: 865 - DNA, 975 bp, Bacillus sp.
attttagctacatttggggtcagtgcagttccttctgttcatgcttctgaagaaaaagaaactgcttatatagatgtcgcagcagctactctgtggacagcaccaaacatcttgcgggaagtggacgctccgtcagctactaatcctgtagatatgagaaagtggaccacatcgatgaatttgaaacagaagcagcagttatctagcgatgggatgcttgagacacaagcgttatatggaaacaaagtaacggttttagacgaacaaggagactgggtcaaagtagctgtagacggacagcctacttctcgaaatgaattaggatatcccggatggatgcctactaaacaattaatctatagcaaaaggtacgaacagtatgcaaagaagccttttgtaatggtgacggctccgactacttatttatatcattcgccttctttgaaaaagaaaggtattgaagttagctataatacgcgcttacctcttttggcaaagtcaaagagtgcatataaagtattaaaaccaaatggaaagacagcatggatttctacaaaagcaggaaaaatctacgcgtctcaaaaagatattcctgtaccaactggcacggagcttgttgaaagtggaaaggcatttttaaatcttccatatttatgggctggcatgagtggttttggatttgactgctctggatttacgtttacgatgtaccaatcccatggtattacgattccacgtgactcagggccacagtctcgagcagggaaaccagtagatatgaacaaccttcaacctggagacttattgttctttgcctataaccaaggaaaaggaagcgtccaccatgtagcgatgtatgctggagatggcatgatgattcattcgccgaactccgagcggacagtagagattattcctttaaacacaaagggatatattgaagagtatgcaggtgcacgtcgttatttaccttaa

SEQ ID NO: 866 - DNA, 330 bp, Bacillus sp.
atgcaacaattcttacattctatgaaacattacgctattttttttgcagttatcgctgcacttacatatgtattgacgctggttttaggagcggataaagtagatttagacaaatattcaacggttactattacaaaaggagatacgctttgggaattgtccaacaagtatcataatcaccatcatttgaccaccaatgaatttgtcaaatgggttgaagacgtcaatgacttaaactcagacactgcccagtctttatctcctggagataaattatatattcctgttttaaaaaaagagttacataatcaagtggcaattgaacagtag

SEQ ID NO: 867 - DNA, 330 bp, Bacillus sp.
atgcaacaattcttacattctatgaaacattacgctattttttttgcagttatcgctgcacttacatatgtattgacgctggttttaggagcggataaagtagatttagacaaatattcaacggttactatcacaaaaggagatacgctttgggaattgtccaacaagtatcataatcaccatcatttgaccaccaatgaatttgtcaaatgggttgaagacgtcaatgacttaaactcagacactgtccagtctttatctcctggagataaattatatattcctgttttaaaaaaagagttacataatcaagtggcaattgaacagtag

SEQ ID NO: 868 - DNA, 330 bp, Bacillus sp.
atgcaacaattcttacattctatgaaacattacgctattttttttgcagttatcgctgcacttacatatgtattgacgctggttttagtagcggataaagtagatttagacaaatattcaacggttactattacaaaaggagatacgctttgggaattgtccaacaagtatcataatcgccatcatttgaccaccaatgaatttgtcaaatgggttgaagacgtcaatgatttaaactcagacactgcccagtctttatctcctggagataaattatatattcctgttttaaaaaaagagttacataatcaagtggcaattgaacagtag

SEQ ID NO: 869 - DNA, 330 bp, Bacillus sp.
atgcaacaattcttacattctatgaaacattacgctattttttttgcagcaatcgctgcacttacatatgtattgacgctggttttaggagcggataaagtagatttagacaaatattcaacggttactattacaaaaggagatacgctttgggacttgtccaacaagtatcataatcaccatcatttgaccaccaatgaatttgtcaaatgggttgaagacgtcaatgatttaaactcagacactgcccagtctttatctcctggagataaattatatattcctgttttaaaacaagagttacataatcaagtggcaattgaacagtag

SEQ ID NO: 870 - DNA, 1281 bp, Bacillus sp.
atgcaaaatcgatacagacatataattggtgcgattctccttgtttcgttcatttttgtaggatttattccagttgtgcaacaatatatacacattccaaaacaaatcgtcttatttgaacagcaaaaagcaaaaattaatacgacattaccgcttagcgtagaagcttcatcacctgtttacgatgtaacaagtaacaaggcgaagctgaccgtagcaggcaaacaagtaggcaaagaagagttgatgcttcatttggccggtattcctgtaaagcgtgtagacgtacaggtattatctgattttagagtcattccaggtggccaatcaatcggtgtgaaattaaattcaaaaggtgttcttgttgtaggctatcatcaagtagatacagcaaaaggtaaaagatctcctggcgaaattgcgggtattcaagttggagatatgattacgaagattaatggtaaaaccattgaaaaaatgagtgatattacaccgtttattcagcaggcaggaaaaacgggtgaaccattaaatctgcatattttaagagaaaaaaagcagtttgacactaagctgtatccgttaaaagataagcaagattatgcttacagaatcggtttatacatccgtgattcagctgcaggaattggcacaatgactttttatgatccaaaatctaaaaaatatggcgcattaggtcatgttatttcggatatggatacaaaaaagccaatcgtagtagaagatggacaaattgtccgttcgaccgttacatcaattgaaaaaggttctaacggcgttcccggtgaaaagctagcaaggttttccgaagatagacaaatcattggaaatattacacgaaatagtccttttggtatttttggaaaattgtcttcaacgatggaaaacggaataatggataaagcaatgccaatagccctatctcatcaagtaaaagaaggaccggctaaaattctaacggtagtagatgatgatcaagtggaagaatttgatattgaaattatgagtactatacctcaaaagtttccggctactaaaggaatggttattaaaattacagatcccaaattgctaaagaaaacaggtggaattgttcaaggaatgagcgggagcccgattattcaaaacggtaaagtcgttggagcggttacccatgtttttgtaaatgatcctacctcgggttacggtgtccatattgaatggatgcttaacgaagcaggaatcgatatttataaaaataatcgaaaaaaagcgagctaa

SEQ ID NO: 871 - DNA, 1278 bp, Bacillus sp.
atgaacaatcgacttagatatataattggtgcaattctccttgtttcgtttatttttgtaggctttatccctgttgtgcagcaataccttactatcccaaaacaaatgacactgtttaaaagtgatgaagtaaatttttccacatcgttagcagttagcactcatagtaatgatgttattgaaacgatgaaacaagatgctaagcttagcatagctggcaaagaagtaggcaaagaagaaatgatgcttcatcttgcaggagtaccggtcaaaagagtagatgttcaagtattatctgattttaaagtcattcctggaggtcaatcaattggcgtcaagttgaactctaaaggtgttttggttgttggttaccatcaagttgatacgaaagatggaaagaaatctcctggtgaaattgcaggcatccaagtaggcgacatgattacaaaaatcaatggcaaaacaattgaaaaaatgagtgatattacgccatttattcagcaagcaggaaaaactggagagcctttaaaattacaagtaatgagagaaaaagaacaattacaaacaaagttatatcccttaaaagacaaagaagattacgcgtatcgaattggtctatatattagagattctgctgcgggcattggtacgatgactttctatgatcccaaatcaaaaaaatatggagcgttaggtcacgtaatttccgatatggataccaaaaagccaattgttgtagaagatgggcaaatcgtacgctctaccgtcacatcaattgaaaaaggtgaaaacggtgttccaggcgagaagctagcgcgtttctcagaaaataaagaaattatcggtaatattaaaacaaatagcccatttggtatctttggaaagctatctgaaacgatggaaaatggcattttagataagccgatgccgatttcactatctcatcaagtaaaagaaggaccagctaaaatcttaacggtggtcgaaaacgataaagtggaagaatttgatgtggaagttgttagtagtgttccgcaaaagtttcctgctactaaaggaatggtcattaaaattacagacaaaaagttattagaaaaaacaggcggtattgtgcaaggaatgagcggaagtccaattattcaagatggcaaagtaattggagccgttactcatgtgtttgtgaatgacccaacttcaggatatggtgttcatatcgaatggatgttaaatgaagcgggcattaatatttataaaaaagaatcaaaaagagcgagctaa

SEQ ID NO: 872 - DNA, 1287 bp, Bacillus sp.
atgctaaatagatacagaaaaatcataggcgttattctccttgtttcgctcataagtttaggcttttttccaagcgttcgtcactatgtgaatattccaaagaacatcgtattatttgaagggcagactgaaatggtttccagcgcattgcccgttacagcaaaacctcaagatcaacatgtatatgaaatgaatgcagatggcaaagcagagcttacgatatcgggccatcagttcggtaaagaagagctaatgcttgaattggcgggaattccggtcaaaaaagtaaatgtagatgtgctgccagactttaaagtcattccgggaggacagtctataggggtgcgtctcaattcccgtggtgtattggtggtgggctatcatcaggttgatacaaaagaagggaaaaaatcgcctggtgaaattgccggtattcaagtcggagacatgattacaaccatcaacggaacgaaaatcgaaaaaatgagtgatattactccatttattcaagaggcgggaaagacaggaaagccgttaaatctcgtcattgcacgcgatcaaaaagaatttcgtacaaagcttttcccgcttaaagacaaacaagaatatgcttatcgcattggattgtatattcgtgattcagcagcaggaatcggtacgatgacgttttatgatcccatttctaaaaaatatggggcactgggccatgtcatttctgatatggacacgaaaaagccaattgtggtcgaagatggtcaaattgttaaatcaaccgttacctccattgaaaaaggcagtaacggggttccaggtgaaaaacttgcaagattttcaacggataaaaatatcattgggaatattacacgaaacagtccttttggcatttttggcaaacttaatcagcaaattcaaaatggaaaattagataaaccaatgccgattgctttatcccatcaagtaaaagaaggaccagcgaccattttgacggttgtggataacgatcgggtggaagagtttgatgttcaaatcgtaagtaccgttcctcaaaaattccctgccacaaagggaatggttattaaaataacagatcccaaattactcgagaaaaccggaggaattgtacaaggcatgagcggcagccctatcattcaagatggaaaagtaatcggtgctgttacacatgtattcgtaaacgatcccacttcgggatacggggttcatatcgaatggatgttgaacgaagctggtattgatatctacaaacaaaattcgaaaaaggcgagctaa

SEQ ID NO: 873 - DNA, 1278 bp, Bacillus sp.
atggatagatatagaaaatggataggaacaattctccttgtttcgctcatcgtaataggttttataccaagtgtgcagcaatatgtaaaaatcccaacaaacatcaccctttttgaaaatcaaacgttgcccattcagtccgctcagcaagtgtcatcaaatcagccaaatgtttcagtagaacctgaaaaggaaagttcaacatggcaagttagtggtaataatgctggagaaagcaaactcgttgtccaagcaggcgcttttccagcaaaagaagttgatgtgaaagttcttccagattttaaagtatatccaggaggacaatcgattggagtaaaacttaactctaaaggtgttcttgttgttggatatcatcaggttgatacaaaagaaggaaaaaaatctccaggtgaaattgcaggaatccaagttggagatatgattactgaaatcaacgggaaaaacattgagaaaatgagtgatgtaactccgtttatcaaacaagcaggaaaaagtggggatccacttaacatcacagttactcgtgatgatcaaagtattaaaacaaaactttatccattgaaggataaaggagattatgcttatcgaattggactatatattcgtgattcagcagctggtattggtacgatgactttttttgagccaaattcgaaaaaatatggagctcttggacatgtgatttcggatatggatacgaaaaagccgattgttgtgaaagatggacaaattatgaagtcaacggttacatcgattgaaaaaggaagtgacggagctcctggagagaagcttgctcgtttttcttcggaacgttctgtaattggtgacattacgcgcaacagcccgtttggtatttacgggaagttaacggaacaagtagaaaacaacattgtgaacaaaccccttcctattgcgctttcacatcaagtgaaaaaggggccagccaaaatcttaaccgtaattgaagagaataaagtagaagagtttagtgtcgaaattgtaagtacagttgatcagaagtttccagcaacaaaaggaatggtaattaaagtaacagatccaaaacttctcgagaaaacgggaggaattgtgcaaggcatgagtggaagccctattattcaagacggtcgcttagttggtgctgtaactcacgtttttgttaacgattcaacatcagggtacggggtccatattgaatggatgctaaacgaagcaggaatagacatttatgaacatccacgacaaaaggcgagctaa

SEQ ID NO: 874 - DNA, 1293 bp, Bacillus sp.
ttgcagacagataaaatgagaaaattagttggtgtacttctccttgtgttaataatgagtttaggttttgtaaaagaagttcaagaatatgtaaaaatgccaaaaacggtaacagtatttgagtctcaaacagtgagtgttgacaattctttacccgtaaatgctaatcaaccttctgaggaagcatttacagttcaaaaaaataatgatggtaaaacacttgatatacatgggaaagaagcaggtgaaggtgaagttgtttttgatcttgcaggctttcctgtgaaaaaagccggtgtaaaggttttgcctgattttaaggttatacctggtggacagtcaattggtgtaaaactaaatactcttggcgtattggtggtaggccaccaccaaattgctacaactgacggtaaaaaatctcccggtgaactagcaggtgttgaaataggagacattattactcatattaatggaaaaaaaattgaacagatgagtgatgttactccgtttattcaaaaagctggaaaaaccggagaacctcttgacttagttttaaacagagaacaagtagaagtaaagaccaaattgtatcctcttaaagacgaacatgatcattcctatcgtattggattatatattcgagattctgcggctggaattggaacaatgacattttatgaccctaagtcgaaaaaatacggtgcattaggacatgttatatctgatatggatacgaaaaaaccgattgttgtagacaatggacaaattgttcgttctacagttacctcaattgaaaaaggaagcaacggtaatcctggtgagaaattagcaagattttcaagtgatcggcaagtaattgggaatattacgagaaacagcccttttggaatttttggtgaattaaatcagggtattaataatggtgttatggataaagcgatgccaattgccttatcaaatgaagtgaaagaaggaccggcaaaaattttaactgtagttgatcaagacaaagttgaggaatttgaagtcgaagtggttagttctgttcctcaaaaattcccagcaacaaaagggatggttataaagattaccgatcaacgactacttgataaaacaggtggcattgttcaaggaatgagcggtagccctattatccaaaacggtaaagtaataggggccgtgacacatgtttttgttaacgacccaacttcaggctatggagttcatatagaatggatgttaaatgaagcaggtatagatatatatggaaatcaagaacaaaaagcgagctaa

SEQ ID NO: 875 - DNA, 1299 bp, Bacillus sp.
gtgaagatgttgaattttgaacttcttagaaaaataattggtggaattctccttgtttcaattgttgctcttggattttctaaaccggtgcaacaatatattcaattaccgaaggaaatcacgctttttgaaggacaagaattttcctttcaaaaatcccatcctgtttcagcagaaatgaataactctaaccttagtgtctcagtcgatgatacagacaatacggtttcccttaacgcaaacaaatatggaaaaaatgaaatgcttttagaattagcaggattcccaattaaaaaggtcgatgttaatgttcttaaggatttcaaggtaataccaggtggtcagtcgattggtgtaaaactgaatacagtcggtgttcttgtggttggacatcatcaagtagcgacagtagaaggaaagcagtcgccgggtgaggaagcaggaatcaaggttggcgatatcattacgaaaataaacggaaaacaaattgagaaaatgtctgacgtagctccatttgttcaggaagcaggagagacaggaaagccattgcaaattgaaatcagccgtgaaagtggtaaagtaacaacggaattaaaaccgcaaaaagaaaaagatgaagaaaagtttaagctcggactctatattcgagattccgcagctggaattggaacgatgacgttctatcatccagaatcaaaaaaatatggtgctttagggcatgtcatatctgatatggatacgaaaaagccaattgtcgtagaagacggacaaattgttcgctctactgtaacgtctattgaaaagggaagcaatggagaccctggagaaaaattagctaggttctcttcagataaagaagtaattgggaatattcaacgaaatagcccatttggaatatttgggaagctcaatcgtgacattgagaatggagttatggataaagccttgccaatcgccctttctcatcaagtaaaagaaggtccagcgcaaatcctgacagtcgttgataatgatgaagttaaactttttgatatagacattgttagcacgatcccgcagaaattcccggcaacgaaaggaatggtcttaaaagtaacagataaagaattactggataagactggtggaatcgtacaagggatgtctggaagtccgattattcaagatggaaaagtcgtaggggcagttacacatgtgttcgttaatgatcctacatctggatatggtgttcatatcgagtggatgctaaatgaagctgggatcgatatttatgaaaaagaggaagaaaaggcgagttaa

SEQ ID NO: 876 - DNA, 1290 bp, Bacillus sp.
ttgggctcagataaaataagaaaaataattggttgtattctccttgtttctttaatgagtttaggatttgtaaaacctgttaaagaatacgttctattgccaaattctttaactgtattcgaaaatcagcaattatcaatgcagacatccctgcaggctgatgcagccgcggcggattcagagcaggtattttccattaaaacagggagtgaatcccttcaaattgaaggcaggcaaagcggagtaggagaaatcgtatttgaccttgccggaattccgataaaaaaagtggacgttaaagtccttgaagatttccgggttattccgggcggccagtcaataggcgttaaacttaattcacttggcgtccttgttgtcggacatcatcaaattaaaacatccggaggaaaaaaatcccccggagaaatagccggagtgcaagtcggtgatatcattacgaaaattaacggcaccacagttgaaagcatgagtgatgtgacgccgtttattcagggttcaggaaagaccggcaagcctcttgatttagtgatctcaagggataacaaagagcttaagacaaagcttgttccggtaaaagatgaaaatgaaggcgcataccggatcggactctatatcagagattcagcagcgggaatcgggacgatgaccttttatgatcctaaatcgaagaaatacggcgctttaggccacgttatttcagatatggatacaaaaaaaccaatcgtcgtacaggacggacaggttgtcagatcgactgtcacatccattgaaaagggaagcaacgggaatcctggagaaaagcttgccagattttcaagcgacagacagattatcggggacattacacgcaacagtccattcggtatttttggcagactgaacggagacatgacaaatggtctttatgataagcctatgccaatcgccctttcaaacgaggtaaaggaaggtcctgcgcatatactgacggttgtagacggtgacagagtagaggagtttgatgtacaggtcgtcagttctactcctcaaaagttccctgcaattaaagggatggtcataaaaattacagatccaaaactgcttgagaaatcaggcgggattgttcaggggatgagcggaagtccgattattcaaaatggcaaagtgattggcgccgttacacatgtgtttgttaacgatccgacttcagggtatggtgttcatatcgagtggatgctgagtgaagcgggaattgatatctatacgcaaggtgcaaagaaagcaagctaa

SEQ ID NO: 877 - DNA, 1299 bp, Bacillus sp.
gtgaacaaattgaaattagaaagatttcgcaaaataataggtatttgtctccttgtttctttagtttttattggatgttttaaaccgcttcggacgtttatttcatccccgaagcagattgttgtctttgaaggacaacaatcagaaatagcttcattatcagtatttaaagcttcatctacagatcgtcatgtgtttacagtgagttcaaatgaacaaaaacaaggacttatggtaaattctcatcaaaatggtgaagcggatatggtgtttcaacttgctggttttccagtaaaaaaagtaaatgtgaaagtattgaaagattttaaagttattccaggtgggcaatcaattggtgtgaagttaaacacaaaaggggtacttgttgtaggccatcatttaattcaaactgaaaaagggaaagtatctcctggtgaaacagctggtgtgcaaattggagatatgattactgaaattaatggtaaaacaattgaaaaaatgagtgatgtagcaccatttattcatagtagtggtgaaacaggtgaaccgcttaatcttgttttgttaagagatggaaaatacatccgcactaagttaacaccacaaaaagacagtggtgaatcgtcttatcgtatcggtttatatattcgtgattcggcagctggaatcggaacaatgacatttgttcatcctgattccatgaaatatggggcacttggtcatgtcatttctgataacgatacgaaaaagccgattcaagtcgaagatggacaaattatgcgttcaacggttacatcaattgaaagaggtagtcatgggaatccaggagagaaattagcaaggttctcaccagatcgtgaagtgattggtaatattacaataaatagtccatttggtatttttgggaaattgaatacaaatatgacaaatggcgtaatggataaagcaatgcctattgcattatctcatcaagtaaaagagggaccggcaaaaatattaacagttattgatcaagataaagtggaagcgtttgatattgaagttgttagtacagtaccgcaaaagtttccggctacaaaaggtatggtaataaaagtaacagacaaacgtttattagcgaagacgggtggtatcgtacaaggaatgagcggaagtccaattgtacaaaacgggaaagtaattggtgctgttacacatgtattcgtaaatgatccgacatcaggatatggtgttcatattgaatggatgttacatgaggctggaattaacatttatgatcaagaaagaaaagcgagctaa

SEQ ID NO: 878 - DNA, 414 bp, Bacillus sp.
atgatacgaaaatgggttgctgtatgcgtcgtatttgctgcttttatttttccgcaggcagtaagcgccgaacagccaaaagtagaggtatttcaaattgaaacgggcaaagttgttcggtcaacgcccaaacctccaagtgttcaaaaagaagctgaaaaaagtattgcgtccattactggtttatataaaaaggcaagtccgcttcctaaaaaaggctatcttgttaaagtacctcttgatccagccgtaaaaattgaaaatagtgcggtcaacacgctggcaagtgaagttatttttgttcttgagccgaatcaaaagcctatcatgatggtatttgacaatgaaaatagaacctatttttttgaattcactcatgatttaactcttctcagaaaagcattacagctataa

SEQ ID NO: 879 - DNA, 414 bp, Bacillus sp.
atgatacgaaaatgggttgctgtatgcgtcgtattcgctgcttttatttttccgcaggcagtaagtgccgaacagccaaaagtagaggtatttcaaattgaaacgggcagagtcgttcgttcaacgctcaaacctcccagtgttcaaaaagaagccgaaaaaagtattgcgtccattactggtttatataaaaaggcaagtccgcttcctaaaaaaggctatcttgttaaagtacctcttgatccagccgtaaaaattgaaaatagtgcggtcaacacgctggcaagtgaagttatttttgttcttgagccgaatcaaaagccaatcatgatggtatttgacaatgaaaatagaacctatttttttgaatttactcatgatttaactcttctcagaaaagcattacagctataa

SEQ ID NO: 880 - DNA, 414 bp, Bacillus sp.
atgatacgaaaatgggttgctgtatgcgtcgtattcgctgcttttatttttccacaagcagtaagtgctgaacagccaaaagtagaggtgtttcaaattgaaacgggcagagtcgttcgttcaacgctcaaacctccaaatgttcaaaaagaagccgaaaaaagtattgcgtccattactggtttatataaaaaggcaagtccgcttcctaaaaaaggctatcttgttaaagtacctcttgatccagccgtgaaaattgaaaatagtgcggtcaacacgctggcaagtgaagttatttttgttcttgaaccgaaccaaaaaccaatcatgatggtatttgacaatgaaaatagaacctatttttttgaatttactcatgatttaactcttctcagaaaagcattacagctataa

SEQ ID NO: 881 - DNA, 414 bp, Bacillus sp.
atgatacgaaaatgggtggctgtatgcgtcgtattcgctgcttttatttttccgcaggcagtaagtgctgaacagccaaaagtagagatatttcaaattgaaacaggcagagtcgttcgttcaacgctcaaacctccaaatgttcaaaaagaagctgaaaaaagtattgcgtccattactggtttatataaaaaggcaagtccgcttcctaaaaaaggctatcttgttaaagtacctcttgatccagccgtaaaaattgaaaatagtgcggtcaacacgctggcaagtgaagttatttttgttcttgagccgaaccaaaagccaatcatgatggtatttgacaatgaaaatagaacctatttttttgaattcactcatgatttaactcttctcagaaaagcattacagctataa

SEQ ID NO: 882 - DNA, 414 bp, Bacillus sp.
atgatacgaaaatgggtggctgtatgcgtcgtattcgctggttttatttttccgcaggcagtaagtgctgaacagccaaaagtagagatatttcaaattgaaacgggcagagtcgttcgttcaacgctcaaacctccaaatgttcaaaaagaagctgaaaaaagtattgcgtccattactggtttatataaaaaggcaagtccgcttcctaaaaaaggctatcttgttaaagtacctcttgatccagccgtaaaaattgaaaatagtgcggtcaacacgctggcaagtgaagttatttttgttcttgagccgaaccaaaagccaatcatgatggtatttgacaatgaaaatagaacctatttttttgaattcactcatgatttaactcttctcagaaaagcattacagctataa

SEQ ID NO: 883 - DNA, 414 bp, Bacillus sp.
atgatacgaaaatgggtggctgtatgcgtcgtattcgctgcttttatttttccgcaggcagtaaatgctgaacagccaaaagtagagatatttcaaattgaaacgggcagagtcgttcgttcaacgctcaaacctccaaatgttcaaaaagaagctgaaaaaagtattgcttccattactggtttatataaaaaggcaagtccgcttcctaaaaaaggctatcttgttaaagtacctcttgatccagccttaaaaattgaaaatagtgcggtcaacacgctggcaagtgaagttatttttgttcttgagccgaaccaaaagccaatcatgatggtatttgacaatgaaaatagaacctatttttttgaattcactcatgatttaactcttctcagaaaagcattacagctataa

SEQ ID NO: 884 - DNA, 1506 bp, Bacillus sp.
atgaagaaaatatgtatgagcctgatcgttctctgtcttttcagtggaggattggccccgatgagtaaaggagccgctgcttcttcagtgggcactgtcaaaggtgacaacgtaaacgtatatcgttctccttccttacattcttctgttatgcagacagtgaaaaaaggagaagaatttcctgtcatttcatctgaagctggagatgcagctcaggttactactcatacggtagtgccgggaaatacactatggctactagctaagcaatacggtgtaacagtcagtgatctaataaaacaaaatcagctaaaaaagacggagctgattccagggcaaacgctgaaaataccaccaaaaggcttgttacataaagtagtatcaggagatacgctttggaaagtctccgtaaagtacggtgtaaaagcgaatgaattaacaaagttaaatcagctatcctcaacaaatattaagcccggacaaatgcttattattcctgattactatgtacaagtacagcttttggaagggaaaaagggctggatcaaaaaatctgatttagtgcaaaagaagcatcagcctgtagttatgggttggagctttaatgaaaaaacagcaggctatacagaatcgatgaagcaaaagaatttagacgttgtttcacctcgttggtttacactaacgtcgaatgacaaagttgtttcatcttctataaatgaatcatatgttcaaacggctcataaaaacggcaaaaaagtctggccgcttattggtaacaattttgatgatgtacttacaagtgatgtgctaagcaacaaagcaaagcggaaaaagcttgtatcatcaatagaaagttcgctagtaaaaacaaacagcgatgggatcaatgttgactttgaaaacattaatatcaaaaacaaacaagattttgttttatttattaaagaattaaaagcagcgttaaaacctcatggtatgactatttcagtagacgtaacaagagaaaataatgatcctttttggtcgggaagctttgataggaaacagattggtcaagtggcagactatgtcattatgatgggatatgaagaacactggggaggaagtcaggttccaggatctgttgcttcactgccttgggtgaaagaaggcacacaacttcttatgaaagatgtacctgcacacaaaatccttctgggagttcctttttatacgcgagaatggaaaacggacctatcgaccaaaaaagttgtcacaaaagacttaacgatgaaagaagccgaatctgttatctcttctaaaaagttagctaaaaaatgggatagccaagcctcacagtactatgtagaatacgcggaaaatggtacgaagcatcaaatatggctcgaagacaaagcatctatgcagcgccgggttaaattaattaatgactatcatttaggtggggcggcagcttggtatattggttcagaaacctcagatatatgggagttatacaacttttaa

SEQ ID NO: 885 - DNA, 1506 bp, Bacillus sp.
atgaagaaattatgtatgagcctgatcgttctctgtcttttcagtggaggattggccccgatgagtaaaggagccgctgcttcttcagtgggcactgtcaaaggtgacaacgtaaacgtatatcattctccttccttacattcttctgttatgcaaacagtgaaaaaagaagaagaatttcctgtcatttcatctgaagctggagatgcagctcaagttactactcatacggtagtgccgggaaatacactatggctactagctaagcaatacggtgtaacagtcagtgatctaataaaacaaaatcagctaaaaaagacggagctgattccagggcaaacgctgaaaataccaccaaaaggcttgttacataaagtagtatcaggagatacgctttggaaagtctccgtaaagtacggtgtaaaagcaaatgaattaacaaagttaaatcagctatcctcaacaaatattaagcccggacaaacgcttattattcctgattactatgtacaagtacagcttttggaagggaaaaagggctggatcaaaaaatctgatttagtgcaaaagaagcatcagcctgtagttatgggttggagctttaatgaaaaaacagcaggctatacagaatcgatgaagcaaaagaatttagacgttgtttcacctcgtgggtttacgctaacgtcgaatgacaaagttgtttcaacttctataaatgaatcatatgttcaaacggctcataaaaacggcaaaaaagtctggccgcttattggtaacaattttgatgatgtacttacaagtgatgtgctaagcaataaagcaaagcggaaaaagcttgtatcatcaatagaaagttcgctagtaaaaacaaacagcgatgggatcaatgttgactttgaaaacattaatattaaaaacaaacaagattttgttttatttattaaagaattaaaagcagcgttaaaacctcatggtatgactatttcagtagacgtaacaagagaaaataatgatcctttttggtcgggaagctttgataggaaacagattggtcaagtggcagactatgtcattatgatgggatatgaagaacactggggaggaagtcagattccaggatctgttgcttcactgccttgggtgaaagaaggcacacaacttcttatgaaagatgtacctgcacacaaaatccttctgggagttcctttttatacgcgagaatggaaaacggacctatcgaccaaaaaagttgtcacaaaagacttaacgatgaaagaagccgaagctgttatctcttctaaaaagttagctaaaaaatgggatagccaagcctcacagtcctatgtagaatacacggaaaatggtacgaagcatcaaatatggctcgaagacaaagcatctatgcagcgccgggttaaattaattaatgactatcatttaggtggggcggcagcttggtatattggttcagaaacctcagatatatgggagttatacaacttttaa

SEQ ID NO: 886 - DNA, 1446 bp, Bacillus sp.
atgagtaaaggagccgctgcttcttcagtgggcactgtcaaaggtgacaacgtaaacgtatatcgttctccttccttacattcttctgttatgcagacagtgaaaaaaggagaagaatttcctgtcatttcatctgaagctggagatgcagctcaggttactactcatacggtagtgccgggaaatacactatggctactagctaagcaatacggtgtaacagtcagtgatctaataaaacaaaatcagctaaaaaagacggagctgattccagggcaaacgctgaaaataccgccaaaaggcttgttacataaagtagtatcaggagatacgctttggaaagtctccgtaaagtacggtgtaaaagcgaatgaattaacaaagttaaatcagctatcctcaacaaatattaagcccggacaaatgcttattattcctgattactatgtacaagtacagcttttggaagggaaaaagggctggatcaaaaaatctgatttagcgcaaaagaagcatcagcctgtagttatgggttggagctttaatgaaaaaacagcaggctacacagaatcgatgaaacaaaagaatttagacgttgtttcacctcgttggtttacgctaacgtcgaatgacaaagttgtttcatcttctataaatgaatcatatgttcaaacggctcataaaaacggcaaaaaagtctggccgcttattggtaacaattttgatgatgtacttacaagtgatgtgctgagcaacaaagcaaagcggcaaaagcttgtatcgtcagtagaaagttcgctagtaaaaacaaacagcgatgggatcaatgttgactttgaaaatattaatattaaaaacaaacaagattttgttttatttattaaagaattaaaagcagcgttaaaacctcatggtatgactatttcagtagacgtaacaagagaaaataatgatcctttttggtcgggaagctttgataggaaacagattggtcaagtggcagactatgtcattatgatgggatatgaagaacactggggaggaagtcaagttccaggatctgttgcttcactgccttgggtgaaagaaggtacacaacttcttatgaaagatgtacctgcacacaaaatcctgctgggagttcctttttatacgcgagaatggaaaacggatctatcgaccaaaaaagttttcacaaaagacttaacgatgaaagaagcagaagctgttatctcttctaaaaagttaactaaaaaatgggatagccaatcctcacagtactatgtagaatacacggaaaatggtacgaagcatcaaatatggctcgaagacaaagcatctatgcagcgccgggttaatttgattaaggactatcatttaggcggagcggcagcttggtatattggttcagaaacatcagatatatgggagttatacaacttttaa

SEQ ID NO: 887 - DNA, 1527 bp, Bacillus sp.
gtggggaggcgagatgataaaatgaagaaaatatgtatgagcctacttattctctgtcttttcagtggaggattggccccaataagtaaaggagacgctgcttcttcagtgggtactgtcaaaggtgataatgtaaacgtgtatcgttctccatctttacattcttcggttgttcagacagtgaaaaaaggagaagaatttcctgctatttcatctgaagcgggagatgcagctcaagttattactcataaagtagtgccaggaaatacgctatggctactagctaaacaatatggtgtaacagtcagcgagctaataaaacaaaatcagctaaaaacgacggagctaactccggggcaaacgctgaaaataccaccaaaaggcttgttacataaagtagtatcaggagatacgctttggaaaatctctgtaaagtacggtgtaaaagcgaatgaattaacaaagttaaaccagctatcatcaacaaatattgagccgggacaaacgcttgttattcctgattactatgtgcaagtacagcttttggaagggaaaaagggctggatcaaaaaatctgatttagtacagcaaaagcatcagcctgtagttatgggatggagctttaatgaaaaaacagcaggctatgaagaatcgatgaaacaaaagaacttagatgttgtttcaccgcgctggtttacgctaacgcggagtgacaaagttgtttcatcttctataaatccatcgtatgttcaaacggctcacaaaaacggcaaaaaagtctggccgctcatcggtaacaatttcgatgatgtgctgacaagtgacgtcctaagcaataaagcaaagcggcaaaagcttgtatcgtcagtcgaaagttcgcttgtgaaaacaaacagtgacggtattaacgttgactttgaaaatattaatatcaaaaacaaacaagattttgttttatttattaaagaattaaaagcagcgttaaagcctcatggtatgaccgtttcagtagacgtaacacgagaaaataatgatccgttttggtcaggaagctttgatcgaaaacagattggtcaagtggcagattacgtcattatgatgggttatgaagaacactggggaggaagtcaggttccagggtctgtggcttcgctgccttgggtgaaagaaggaacagaacttcttatgaaagatgtacctgcacacaaaatcctgctgggagttcctttttatacgcgagaatggaaaacggatttatcgaccaaaaaagttgtcacaaaagacttaacgatgaaagaagccgaagcaattatctcttctaaaaagttaactaaaaaatgggacagccaagcctctcagtactatgtagaatacaccgaaaatggtacgaagcatcaaatatggctcgaagacaaagcatctatgcagcgccgggttaaattaattaatgactatcatttaggtggagcggcagcttggtatattggttcagaaacatcagatatatgggagttatataacttctaa

SEQ ID NO: 888 - DNA, 1446 bp, Bacillus sp.
atgagtaaaggagccgctgcttcttcagtgggcactgtcaaaggtgacaacgtaaacgtatatcgttctccttccttacattcttctattatgcagacagtgaaaaaaggagaagaatttcctgtcatttcatctgaagctggagatgcagctcaggttactactcatacggtagtgccgggagatacactatggctactagctaagcaatacggtgtaacagtcagtgatctaataaaacaaaatcagctaaaaaagacggagctgattccaggacaaacgctgaaaataccaccaaaaggcttgttacataaagtagtatcaggagatacgctttggaaagtctccgtaaagtacggtgtaaaagcgaatgaattaacaaagttaaatcagctatcctcaacaaatattaagcccggacaaatgcttattattcctgattactatgtacaagtacagcttttggaagggaaaaagggctggatcaaaaaatctgatttagcgcaaaggaagcatcagcctgtagttatgggttggagctttaatgaaaaaacagcaggctatacagaatcgatgaagcaaaagaatttagacgttgtttcacctcgttggtttacgctaacgtcgaatgacaaagttgtttcatcttctataaatgaatcatatgttcaaacggctcataaaaacggcaaaaaagtctggccgcttattggtaacaattttgatgatgtacttacacgtgatgtgctaagcaacaaagcaaagcggaaaaagcttgtatcatcagtagaaagttcgctagtaaaaacaaacagcgatgggatcaatgttgactttgaaaacattaatatcaaaaacaaacaagattttgttttatttattaaggaattaaaagcagcgttaaaacctcatggtatgactatttcagtagacgtaacaagagaaaataatgatcctttttggtcgggaagctttgatagaaaacagattggtcaagtggcagactatgtcattatgatgggatatgaagaacactggggagggagtcaggttccaggatctgttgcttcactgccttgggtgaaagaaggcacacaacttcttatgaaagatgtacctgcacacaaaatccttctgggagttcctttttatacgcgagaatggaaaacggacctatcgaccaaaaaagttgtcacaaaagacttaacgatgaaagaagccgaagctgttatctcttctaaaaagttaactaaaaaatgggatagccaagcctcacagtactatgtagaatacacggaaaatggtacgaagcatcaaatatggctcgaagacaaagcatctatgcagcgtcgggttaaattaattaatgactatcatttaggtggggcggcagcttggtatattggttcagaaacctcagatatatgggagttatacaccttttaa

SEQ ID NO: 889 - DNA, 1446 bp, Bacillus sp.
atgagtaaaggagccgctgcttcttcagtgggcactgtcaaaggtgacaacgtaaacgtatatcgttctccttccttacattcttctgttatgcaaacagtgaaaaaaggagaagaatttcctgtcatttcatctgaagctggagatgcaactcaggttactactcatacggtagtgccgggaaatacactatggctactagctaagcaatacggtgtaacagtcagtgatctaataaaacaaaatcagctaaaaaagacggaactgattccagggcaaacgctgaaaataccaccaaaaggcttgttacataaagtagtatcaggagatacactttggaaagtctccgtaaagtacggtgtaaaagcaaatgaattaacaaagttaaatcagctatcctcaacaaatattaagcccggacaaacgcttattattcctgattactatgtacaagtacagcttttggaagggaaaaagggctggatcaaaaaatctgatttagtgcaaaagaagcatcagcctgtagttatgggttggagctttaatgaaaaaacagcaggctatacagaatcgatgaagcaaaagaatttagacgttgtttcacctcgtgggtttacgctaacgtcgaatgacaaagttgtttcatcttctataaatgaatcatatgttcaaacggctcataaaaacggcaaaaaagtctggccgcttattggtaacaattttgatgatgtacttacaagtgatgtgctaagcaataaagcaaagcggaaaaagcttgtatcatcaatagaaagttcgttagtaaaaacaaacagcgatgggatcaatgttgactttgaaaacattaatatcaaaaacaaacaagattttgttttatttattaaagaattaaaagcagcgttaaaacctcatggtatgactatttcagtagacgtaacaagagaaaataatgatcctttttggtcgggaagctttgataggaaacagattggtcaagtggcagactatgtcattatgatgggatatgaagaacactggggaggaagtcaggttccaggatctgttgcttcactgccttgggtgaaagaaggcacacaacttcttatgaaagatgtacctgcacacaaaatccttctgggagttcctttttatacgcgagaatggaaaacggacctatcgaccaaaaaagttgtcacaaaagacttaacgatgaaagaagctgaagctgttatctcttctaaaaagttagctaaaaaatgggacagccaagcctcacagtactatgtagaatacacggaaaatggtacgaagcatcaaatatggctcgaagacaaagcatctatgcagcgccgggttaaattaattaatgactatcatttaggtggggcggcagcttggtatattggttcagaaacctcagatatatgggagttatacaacttttaa

SEQ ID NO: 890 - DNA, 1446 bp, Bacillus sp.
atgagtaaaggagcggctgcttcttcagtgggcactgtcaaaggtgacaacgtaagcgtatatcgttctccttccttacattcttctgttatgcaaacagtgaaaaaagaagaagaatttcctgtcatttcatctgaagctggagatgcagctcaagttactactcatacggtagtgccgggaaatacactatggctactagctaagcaatacggtgtaacagtcagtgatctaataaaacaaaatcagctaaaaaagacggagctgattccagggcaaacgctgaaaataccaccaaaaggcttgttacataaagtagtatcaggagatacgctttggaaagtctccgtaaagtacggtgtaaaagcaaatgaattaacaaagttaaatcagctatcctcaacaaatattaagcccggacaaacgcttattattcctgattactatgtacaagtacagcttttggaagggaaaaagggctggatcaaaaaatctgatttagtgcaaaagaagcatcagcctgtagttatgggttggagctttaatgaaaaaacagcaggctatacagaatcgatgaagcaaaagaatttagacgttgtttcacctcgtgggtttacgctaacgtcgaatgacaaagttgtttcatcttctataaatgaatcatatgttctaacggctcataaaaacggcaaaaaagtctggccgcttattggtaacaattttgatgatgtacttacaagtgatgtgctaagcaataaagcaaagcggaaaaagcttgtatcatcaatagaaagttcgctagtaaaaacaaacagcgatgggatcaatgttgactttgaaaacattaatattaaaaacaaacaagattttgttttatttattaaagaattaaaagcagcgttaaaacctcatggtatgactatttcagtagacgtaacaagagaaaataatgatcctttttggtcgggaagctttgataggaaacagattggtcaagtggcagactatgtcattatgatgggatatgaagaacactggggaggaagtcaggttccaggatctgttgcttcactgccttgggtgaaagaaggcacacaacttcttatgaaagatgtacctgcacacaaaatccttctgggagttcctttttatacgcgagaatggaaaacggacctatcgaccaaaaaagttgtcacaaaagacttaacgatgaaagaagccgaagctgttatctcttctaaaaagttagctaaaaaatgggatagccaagcctcacagtactatgtagaatacacggaaaatggtacgaagcatcaaatatggctcgaagacaaagcatctatgcagcgccgggttaaattaattaatgactatcatttaggtggggcggcagcttggtatattggttcagaaacctcagatatatgggagttatacaacttttaa

SEQ ID NO: 891 - DNA, 1446 bp, Bacillus sp.
atgagtaaaggagccgctgcttcttcagtgggcactgtcaaaggtgacaacgtaaacgtatatcattctccttccttacattcttctgttatgcaaacagtgaaaaaagaagaagaatttcctgtcatttcatctgaagctggagatgcagctcaagttactactcatacggtagtgccgggaaatacactatggctactagctaagcaatacggtgtaacagtcagtgatctaataaaacaaaatcagctaaaaaagacggagctgattccagggcaaacgctgaaaataccaccaaaaggcttgttacataaagtagtatcaggagatacgctttggaaagtctccgtaaagtacggtgtaaaagcaaatgaattaacaaagttaaatcagctatcctcaacaaatattaagcccggacaaacgcttattattcctgattactatgtacaagtacagcttttggaagggaaaaagggctggatcaaaaaatctgatttagtgcaaaagaagcatcagcctgtagttatgggttggagctttaatgaaaaaacagcaggctatacagaatcgatgaagcaaaagaatttagacgttgtttcacctcgtgggtttacgctaacgtcgaatgacaaagttgtttcatcttctataaatgaatcatatgttcaaacggctcataaaaacggcaaaaaagtctggccgcttattggtaacaattttgatgatgtacttacaagtgatgtgctaagcaataaagcaaagcggaaaaagcttgtatcatcaatagaaagttcgctagtaaaaacaaacagcgatgggatcaatgttgactttgaaaacattaatattaaaaacaaacaagattttgttttatttattaaagaattaaaagcagcgttaaaacctcatggtatgactatttcagtagacgtaacaagagaaaataatgatcctttttggtcgggaagctttgataggaaacagattggtcaagtggcagactatgtcattatgatgggatatgaagaacactggggaggaagtcagattccaggatctgttgcttcactgccttgggtgaaagaaggcacacaacttcttatgaaagatgtacctgcacacaaaatccttctgggagttcctttttatacgcgagaatggaaaacggacctatcgaccaaaaaagttgtcacaaaagacttaacgatgaaagaagccgaagctgttatctcttctaaaaagttagctaaaaaatgggatagccaagcctcacagtcctatgtagaatacacggaaaatggtacgaagcatcaaatatggctcgaagacaaagcatctatgcagcgccgggttaaattaattaatgactatcatttaggtggggcggcagcttggtatattggttcagaaacctcagatatatgggagttatacaacttttaa

SEQ ID NO: 892 - DNA, 1446 bp, Bacillus sp.
ataagtaaaggagacgctgcttcttcagtaggcactgtcaaaggtgataatgtaaatgtgtatcgttctccatctttacattcttcggttgttcagacagtgaaaaaaggagaagaatttcctgctatttcatctgaagcgggagatgcagctcaagttatcacccataaagtagtgctaggaaatacactatggctactagctaaacaatatggtgtaacagtcagcgagctaataaaacaaaatcagctaaaaacgacggagttaactccggggcaaacgctgaaaataccaccaaaaggcttgttacataaagtagtatcaggagatacgctttggaaaatctctgtaaagtacggtgtaaaagcgactgaattaacaaagttaaatcagctatcatcaacaaatattaagcctggacaaatgcttattattcctgattactatgtacaagtacagcttttggaagggaaaaagggctggatcaaaaaatctgatttagcacaaaagaagcatcagccagtagttatgggctggagctttaatgaaaaaacagcaggctatgcagaatcgatgaaacaaaagaacttagacgttgtttcaccacgctggtttacgctaacgcggagtgacaaagttgtttcatcttctataaatccatcgtatgttcaaacggctcacaaaaacggcaaaaaagtctggccgctcatcggtaacaatttcgatgatgtgctgacaagtgacgtcctaggcaataaagcaaagcggcaaaagcttgtatcgtcagtcgaaagttcgcttgtgaaaacaaacagtgacggtattaacgttgactttgaaaatattaatatcaaaaacaaacaagattttgttttatttattaaagaattaaaagcagcgttaaagcctcatggtatgaccgtttcagtagacgtaacacgagagaataatgatccgttttggtcaggaagctttgatcgaaaacagattggtcaagtggcagattacgtcattatgatgggttatgaagaacactggggaggaagtcaggttccagggtctgtggcttcgctgccttgggtgaaagaaggaacagaacttcttatgaaagatgtacctgcacacaaaatcctgctgggagttcctttttatacgcgagaatggaaaacggatctatcgaccaaaaaagttgtcacaaaagacttaacgatgaaagaagccgaagcaattatctcttctaaaaagttaactaaaaaatgggacagccaagcctctcagtactatgtagaatacaccgaaaatggtacgaagcatcaaatatggctcgaagacaaagcatctatgcagcgccgggttaaattaattaatgactatcatttaggcggggcggcagcttggtatattggttcagaaacatcagatatatgggagttatataacttctaa

SEQ ID NO: 893 - DNA, 768 bp, Bacillus sp.
gtgaaatggtgcttgtcaattattattattgtttccattaatttctatggtattcaggcggatgctgcaaagaagagcagattttattatgaaaaaaaaggagatatcgtgtgggaagttcccatgaaagacgaaaagttgattgcgcttacatttgatgatggaccagatcctaaatatacgccgaccattttgaatttattgcaaaagtacggtgccaaagccactttttttgtagtgggcgatcgaataacgtcttttcccaagcttgctcaaagagaagttcgtgaaggtcatgaacttgctaatcatacatatagccatttgaaagtaaggggccaggaagtagagagaattgaacaagaaattgaaaaagcggatgaacgtatacaagctattgcaggaataaaaccttacctgtttcgcccacctactggctattatgacgatcgggtagtaaaagctgctaaaaatcagcagtataccattattctttggtcttggcatcaagatacatttgattggagaaatccaggcgtaggtaaaattgtaagtcaagtgcttaaccatgccaggtcaggagatattgtattgtttcatgatacgggaggagatcgaacccaaaccattgaagcattaaaacaaattttaccgaagttaaaggaagaggggtataaatttgtaacggtctcagaacttttaaaacatcaccccaattataaatctctttatttgatgcagcagcaaaaacagcactccgttcaataa

SEQ ID NO: 894 - DNA, 768 bp, Bacillus sp.
gtgaaatggtgcttgtcaattatcattattgtttccattaatttctatggtattcaggcggatgctgcaaagaagagcagattttattatgaaaaaaaaggagatatcgtatgggaagttcccatgaaagacgagaagttaattgcgcttacatttgatgatggaccagatcctaaatatacgccgaccattttgaatttattgcaagagtacggtgccaaagcaactttttttgtagtcggcgatcgagtaacatcgtttcccaagcttgctcaaagagaagttcgtgaagggcatgaacttgctaatcatacatatagccatttgaaagtaaggggccaggaagtagagagaattgaacaagaaattgaaaaagcggatgaacgtatacaagctattacaggaataaaaccttacctgtttcgtccacctactggctattatgacgatcgggtagtaaaagctgctaaaaatcagcagtataccattattctttggtcttggcatcaagatacatttgattggagaaatccaggcgtaggtaaaattgtaagtcaagtgcttaaccatgccaggtcaggagatattgtattgtttcatgatacgggaggagatcgaacccaaaccattgaagcattaaaacaaattttgccgaagttaaaggaagaggggtataaatttgtaacggtctcagaacttttaaaacatcaccccaattataaatctctttatttgatgcaacagcaaaaacagcactccgttcaataa

SEQ ID NO: 895 - DNA, 768 bp, Bacillus sp.
gtgaaatggtgcttgtcaattattattattgtttccattaatttctacggtattcaggtggatgctgcaaagaagagcagattttattatgaaagaaaaggagatatcgtgtgggaagttcccatgaaagatgagaagttaattgcgcttacatttgatgatggaccagatcctaaatatacgccgactattttaaatttattgcaaaagtacggtgccaaagcaactttttttgtagtcggcgatcgaataacgtcgtttcccaagcttgctcaaagagaagttcgtgaaggtcatgaacttgctaatcatacatatagccatttgaaagtaaggggccaggaagtagagagaattgaacaagaaattgaaaaagcggatgaacgtatacaagctattacaggaataaaaccttacctgtttcgtccgcctactggctattatgacgatcgggtagtaaaagctgctaaaaatcagcagtatacgattattctttggtcttggcatcaagatacatttgattggagaaatccaggcgtcgataaaattgtaagtcaagtgcttaaccatgccaggtcaggagatattgtattgtttcatgatacgggaggagatcgaacccaaaccattgaagcattaaaacaaattttaccgaagttaaaggaagaggggtataaatttgtcacggtctcagaacttttaaaacatcatcccaattataaatctctttatttgatgcaacagcaaaaacagcactccgttcaataa

SEQ ID NO: 896 - DNA, 768 bp, Bacillus sp.
gtgaaatggtgcttgtcaattatcattattgtttccattaatttctatggtattcaggcggatgctgcaaagaagagcagattttattatgaaaaaacaggagatatcgtgtgggaagttcccatgaaagatgagaagttaattgcgcttacatttgatgatggaccagatcctaaatatacgccgaccattttgaatttattgcaagagtacggtgccaaagcaactttttttgtagtgggcgatcgaataacgtcttttcccaagcttgctcaaagagaagttcgtgaaggtcatgaacttgctaatcatacatatagccatttgaaagtaaggggccaggaagtagaaagaattgaacaggaaattgaaaaagcggatgaacgtatacaagctattacaggaataaaaccgtacctgtttcgtccacctactggctattatgacgatcaggtagtaaaagctgctaaaaatcagcagtatactattattctttggtcttggcatcaagatacatttgattggagaaatccaggcgtaggtaaaattgtaagtcaagtgcttaaccatgccaggtcaggagatattgtattgtttcatgatactggaggagatcgaacccaaaccattgaagcattaaaacaaattttaccaaagttaaaggaagaggggtataaatttgtaacggtgtcagaacttttaaaacatcaccccaattataaatctctttatttgatgcagcagcaaaaacagcacaccgttcaataa

SEQ ID NO: 897 - DNA, 777 bp, Bacillus sp.
atgaaaaaaggttgtttgcttctttgcgcacttctctttttcacaggtgcatcgaacggacaagcagcaaagaaaagccgcttttactatgagaaaaaaggtgatattgtttgggaaattccaacaagtgaagaaaagattattgcattaacgtttgatgatggacctgatccaacgtatacgccactcattctagatttattaaaagaatacaatgcaaaagctacattctttgttttaggtgaccgagttactcaatatcctacaattgctaaaagagaggttaaagaagggcatgaacttggaaatcatacgtatagtcacttagaagttcgtggtaaagatactgtaaaaatagaaggtgagattgaaaaggctgatgacaaaattcagcagataacgggtattaaaccctatctttttaggccaccaactggttactatgatgataaagtggtgaaagcagctaaaaatcagcagtatactgttgtattatggtcatggcatcaagacacatttgattggagaaaccctggtgtagacaaaattgttcatcaagttctgaaaaatgcaagctctggcaacatcgttttgtttcacgatacagggggggatcgcacgcaaacggttcaagcactgaaacaaatactgcctgagctaaaggaaaaaggatatcgttttgtcacaatttcagagcttttgaagcatcatccaaactacgaatcgctttatttaatgcaaaaggaaaacaaaaacaaaggcactcctttaaaatag

SEQ ID NO: 898 - DNA, 576 bp, Bacillus sp.
atgtttaagaaactagcaattattggagcactggcagttcctatgttcggcatgagtcacggggcaaatgccgctgaaacaactcatcgcgtaaaagccggagagactctttacaagattggcgctgaatacggcgttacggttaaacagttaaaagaagcgaatcacaaatctacggactctattaatgcaaatgaaacactaacaatccctaactctattagcgaaagtgataaagaattgttagctcgccttgtacaagctgaagcaaaaggcgaaccttacgctggcaaagtggctgtagcaacagttgtcttaaaccgcgtggatagcgattctttcccaaactctattcatgatgtcatttatcaaggtacacagtttacacctgtacaaaacggtgaaattaataaagcagcggatgctgaagcaaaaaaagctgtaaatgaagcactagcttttagaggtcaaggaaaaggttcattattcttctttaatccagataaaacaagcgaccaatggcttcgtcaaaaacaggttacgattacgatcggaaatcacgtttttgcaaaataa

SEQ ID NO: 899 - DNA, 576 bp, Bacillus sp.
atgtttaagaaactagcaattattggagcactagcggttcctatgttcggcatgagtcacgtggcaaatgccgctgaaacaacccatcgcgtaaaagctggagagactctttacaagattggcgctgaatacggagttacggttgaacagttaaaagaagcgaatcacaaatctaccgactctattaatgcaaatgaaacactaacaatccctaactctattagcgaaagtgataaagaattgttagctcgccttgtacaagctgaagcaaaaggcgaaccttacgctggcaaagtggctgtagcaacagttgtcttaaaccgcgtggatagcgattctttcccaaattctattcatgatgtgatttatcaaggtacacagtttacacctgtacaaaacggtgaaattaataaagcagcggatgctgaagcaaaaaaagctgtaaatgaagcactagcttttagaggccaaggaaaaggttcgttattcttctttaatccagataaaacaagcgaccaatggcttcgtcaaaaacaggttacgattacaatcggaaatcacgtttttgcaaaataa

SEQ ID NO: 900 - DNA, 576 bp, Bacillus sp.
atgtttaagaaactagcaattattggagcactagcagttcctatgttcggcatgagtcacgtggcaaatgccgctgaaacaacccatcgcgtaaaagctggagagactctttacaagattggcgctgaatacggagttacggttgaacagttaaaagaagcgaatcacaaatctaccgactctattaatgcaaatgaaacactaacaatccctaactctattagcgaaagtgataaagaattgttagctcgacttgtacaagctgaagcaaaaggcgaaccttacgctggcaaagtggctgtagcaacagttgtcttaaaccgcgtggatagcgattctttcccaaattctattcatgatgtgatttatcaaggtagacagtttacacccgtacaaaacggtgaaatcaataaagcagcggatgctgaagcaaaaaaagctgtgaatgaagcactagcttttagaggccaaggaaaaggttcgttattcttctttaatccagataaaacaagtgaccaatggcttcgtcaaaaacaggttacgattacaatcggaaatcacgtttttgcaaaataa

SEQ ID NO: 901 - DNA, 576 bp, Bacillus sp.
atgtttaagaaactagcaattatcggagcactagcaattcctatgtttggcatgaatcacggggcaaatgccgctgaaacaactcatcgcgtaaaatccggagagactctttacaagattggcgctgaatacggggttacggttaaacagttaaaagaagcgaatcacaaatctaccgactctattaatgcaaatgaaacattaacaatccctaactctattagcgaaagtgataaagatctgttagctcgccttgtacaagctgaagcaaaaggcgaaccttacgctggcaaagtggctgtagcaacagtcgtcttaaaccgcgtagatagcgattctttcccagactctatccacgatgtcatttaccagggtacgcagtttacacctgtacaaaacggtgaaattaataaagcagccgatgctgaagcgaagaaagctgtaaatgaagctctagcttttagaggtcaaggaaaaggttcgttattcttctttaatccagataaaacaagtgatcagtggcttcgccaaaaacaggttacgatcacgatcggaaatcacgtttttgcaaaataa

SEQ ID NO: 902 - DNA, 576 bp, Bacillus sp.
atgtggaaaaagttagctattattggtgctttaacagtatctatgctcggattagggcattcagcaagcgcagcggaaacaacgcatcgcgtagacagcggcgagtccctttataaaattgggatggaatatggtgtctctattaaagatttaaaagctgaaaacaacaaagaaactgacgcacttgcaatcaatgaaacactaaaaatcccaagctcaattagcagtacagacaaagatctattagctcgcattatacatgcagaagcaaaaggagagccttacgctggaaaggttgccgttgcgactgttatcttaaaccgtgtcgatgatgatgcgttcccaaattctattcgtgaagtcatttaccaaaaaggccagtttgaacctgtaagcaatggtgaaattaacaagccagctgatgctgaagcgaaaaaagcagtaaacgaagcgttagcattacatgggggaggtagcggttctctcttcttctttaacccttcaaaaacagataatcaatggttacgtcaaaaagaagtcactactacaatcggtgatcatgtttttgcaaaataa

SEQ ID NO: 903 - DNA, 1233 bp, Bacillus sp.
atggaaagtgtaattcgagagcttttacaagtcacgttcgaattacagatgtcttgggaagggatggcatatcaacggtttttcgatgaatttttctcaaaaaagaggagtatggatggtttagttaagcatttacatcatactgaactcgaactaaagaaagctgcgaaaacattccgtgaagcggatgagaaagcgtttggggattttaatcagatgggcaagctatgggacgcctttcagcgaggaagcgggaaggctgcaggagacactatttttgatccattaaaaaaagggtggaacaaaacatccgaatttttcgaaaacttggtggataatccaatgaacgcattggaagatgcaaaatatggacttacggactttgtggagagttctattgatgatacgaaagaggaatttagagataaatacgaatttatgaaagatatgtggaataatcctattggaacattaaaacatgagttggacgaggaagtccaagagatgtatgctatacgaaatgttttatcagattggtatgtggagaacataaaatatggagatgcagaaagtatcacggaatcagtagcatacggagcgactaatttagcgttctttggacttataacaaggggtgccggtactgtaggtaatggtgcaagatggggaaaaaatttatcatctatgcctaagtttcagttagaaaatcgtttagaaccagctctcgcttatggtaagatagattataaagttgatactattaaaccatcagatacatatatgtttgcaaaaacttctagtgcagtaaaaagaaagacaccaggtacagtaaccttaagttttaatcttgaacgaagtttaggtacccaaaagaagttaatgtataatgatggagctattggtattattccacaagaagttcgagaaaaattagcaggaagagaattcaaatcttttgacgattttagagaggaattttggaaaactcttgctaattcaagttatgctaaagaatttaatcctatgaatataaaacttatgaaaaaaggtaaggcaccttactcacccagaacagaacattatggtaaccataataaatatatactacatcataaacagcctattgataaaggtggagatgtctataatcttgataatctaataattgtatctcctaaaatgcatcaaaacgttttagatcccgcataccatttcgggaacaaagggctataa

SEQ ID NO: 904 - DNA, 1305 bp, Bacillus sp.
ttgggacaagtacgtgttgatccagataaattagaagcagctgcgaattccatgtcacgaaatagagaggctatggaaagagtaattcgagaacttttacaagtcacgttcgaattacagatgtcttgggaaggggtggcgcatcaacgattttacgatgaatttttctcgaaaaagaagagtatggatgatttaattaagcatttgcaacataccgaactcgaagtaaagaaaactgcgaaaacattccgtgaagcggatgagaaagcgtttggggagtttaatcaaatgggcaagctatgggacgcctttcagcgaggaagcgggagagcggcaggtgatactttgattgatccacttaaaaaagcagggaatcaagcattagacttttttggacacttagttgatgatccaatagatgcattggaagaagcaaaatatggacttacggactttgtggagagttatgttaatgacaaaaaagagaaagctaaagttacatacgaatttattggcgatctgtggaatgatcctatcggaacattaaaacatgagtggaacgaggaaatccaagagctgtatgcaatacgaaatgttttatcagattggtatgtaaagaacatagaatatggagatggagaaagtatcacagaatcgatagcatatggagcgactaatttagcgttctttggacttgtcacaagaggtgccagtgccgtaggtaatggtgcgagatggggaaaaaatttatcatctatgtccaagtttcagttagaaaatcatttagaaccagctctcgcttatggtaagatagattataaagttgatactattaaaccatcagatacatatatgtttgcaaaaacttcaagtgcagtaaaaagaaagacaccaggtacagtaacctcaagttttaatcttgaacgaagtttaggtacccaaaagaagttaatgtataatgatggcgctattggtattattccacaagaagttcgagaaaaattagcaggaagagaattcaaatcttttgacgattttagagaggaattttggaaaacactttctgattcgagctatgctaaagaatttagtcctatgaatataaaacttatgaaaaaaggtaaggcaccttactcgccaagaacagaacattatggtaaccataataaatatatactgcatcataaacagcctattgataaaggtggagatgtctataatcttgataatctaataattgtatctcctaaaatgcatcaaaacgttttagatcccgcataccatttcgggaacaaagggttataa

SEQ ID NO: 905 - DNA, 1305 bp, Bacillus sp.
ttgggacaagtacgtgttgatccagataaattagaagcagctgcgaattccatgtcacgaaatagagaggctatggaaagagtaattcgagagcttttacaagtcacgttcgaattacagatgtcttgggaaggggtggcgcatcaacgattttacgatgaatttttctcgaaaaagaagagtatggatgatttaattaagcatttgcaacataccgaactcgaagtaaaaaaaactgcgaaaacattccgtgaagcggatgagaaagcgtttggggagtttaatcaaatgggcaagctatgggacgcctttcagcgaggaagcgggagagcggcaggtgatactttgattgatccacttaaaaaagcagggaatcaagcattagacttttttggacacttagttgatgatcccatagatgcattggaagaagcaaaatatggacttacggactttgtggagagttatgttaatgacaaaaaagagaaagctaaagatacatacgaatttattggcgatctgtggaatgatcctatcggaacattaaaacatgagtggaacgaggaaatccaagagctgtatgcaatacgaaatgttttatcagattggtatgtaaagaacatagaatatggagatggagaaagtatcacagaatcgatagcatacggagcgactaatttagcgttctttggacttgtcacaagaggtgcgggtgctgtaggtaatagtgcgagatggagaaaatatttgtcatctatgtccacgtttcagttagaaaatcgtttagaaccagctctcgcttatggtaagatagattataaagttgatactattaaaccattagatacatatatgtttgcaaaaacttcaagtgcagtaaaaagaaagacaccaggtacagtgacctcaagttttaatcttgaacgaagtttaggtacccaaaagaagttaatgtataatgatggcgctattggtattattccacaagaagttcgagaaaaattagcaggaagagaattcaaatcttttgacgattttagagaggaattttggaaaacactttctgattcgagctatgctaaagaatttagtcctatgaatataaaacttatgaaaaaaggtaaggctccttactcaccaagaacagaacattatggtaaccataataaatatatactacatcataaacagcctattgataaaggtggagatgtctataatcttgataatctaataattgtatctcctaaaatgcatcaaaacgttttagatccggcataccatttcgggaacaaagggctataa

SEQ ID NO: 906 - DNA, 1305 bp, Bacillus sp.
ttgggacaagtacgtgttgacccagataaattagaagcatctgcgaattccatgtcacgaaatagagaagatatggaaagagtaattcgagaacttttacaagtcacgttcgaattacagatgtcttgggaagggatggcgaatcaacggtttttcgatgaatttttttcaaaaaagaggagtatggatgatttagttaagcatttacatcatactgaactcgaactaaagaaatcggcaagaacattccgtgaagttgatgaaaaagcgtatgggaatttcaatctactcagtaatctatcagacgcctttctgcgaggaagcgggagagctacaggggacactatttttaatccgttaaaaaaagcgtggaaacaaacctccggctttttcggacacttagttgacaatccaatggacgcaatggaagatgcaaaatatggacttagggactttgtggagagttctattgatgatacgcaagaggaatttagagataaatacgaatttattaaagatatgaggaagaatcctattggaacattaaaacataagtgggacgaggaattccaagagatgcatgctatgcgaaatgttatgtcagattggtatgtagagaacatagaatatggaaatgcagaaagtatcacagaatcgatagcatacggagcgactactttagcatttttgggacttgttacaaggggtactggtgctgtaggaaatggtgcgagatggggaagaagtttaccttctatgtctgaatttcaattaggaagtcgtttggaaactgcttatgcctatggtaagatgaattataaaatagatactattaagcctttagatacatattggtttgcaaaaacttcaagtgcagtaaaaagaaatacaccaggtgcagtgacttcaagttttaaccttgaacggagtttaggtactcaaaaaaagctaatgtacaatgatggtgctattggtgttattccacaagaagttcgagaaaaattaataggaagagaatttagttcgtttgatgaatttagaaaagagttttggaaaaccgttgctgaatcaagttatgcggaagaatttaatcgcatgaacaagatgaggatgatggaaggtaaagcaccttatactccagaatcacagcaatatggagaacacaaagtatatgtcttacaccacaaacaacccattcatcaaggtggcgatgtctataaccttgataacttaatcattgtatctcctaagactcatcaaaccatattagatccttcttatcattttgggaaaaaagggctataa

SEQ ID NO: 907 - DNA, 1254 bp, Bacillus sp.
atgtcacgaaatagagaagatatggaaagagtaattcgagaacttttacaagtcacgttcgaattacagatgtcttgggaagggatggcgaatcaacggtttttcgatgaatttttttcaaaaaagaggagtatggatgatttagttaagcatttacatcatactgaactcgaactaaagaaatcggcaagaacattccgtgaagttgatgaaaaagcgtatgggaatttcaatctactcagtaatctatcagacgcctttctgcgaggaagcgggagagctacaggggacactatttttaatccgttaaaaaaagcgtggaaacaaacctccggctttttcggacacttagttgacaatccaatggacgcaatggaagatgcaaaatatggacttagggactttgtggagagttctattgatgatacgcaagaggaatttagagataaatacgaatttattaaagatatgaggaagaatcctattggaacattaaaacataagtgggacgaggaattccaagagatgcatgctatgcgaaatgttatgtcagattggtatgtagagaacatagaatatggaaatgcagaaagtatcacagaatcgatagcatacggagcgactactttagcatttttgggacttgttacaaggggtactggtgctgtaggaaatggtgcgagatggggaagaagtttaccttctatgtctgaatttcaattaggaagtcgtttggaaactgcttatgcctatggtaagatgaattataaaatagatactattaagcctttagatacatattggtttgcaaaaacttcaagtgcagtaaaaagaaatacaccaggtgcagtgacttcaagttttaaccttgaacggagtttaggtactcaaaaaaagctaatgtacaatgatggtgctattggtgttattccacaagaagttcgagaaaaattaataggaagagaatttagttcgtttgatgaatttagaaaagagttttggaaaaccgttgctgaatcaagttatgcggaagaatttaatcgcatgaacaagatgaggatgatggaaggtaaagcaccttatactccagaatcacagcaatatggagaacacaaagtatatgtcttacaccacaaacaacccattcatcaaggtggcgatgtctataaccttgataacttaatcattgtatctcctaagactcatcaaaccatattagatccttcttatcattttgggaaaaaagggctataa

SEQ ID NO: 908 - DNA, 1005 bp, Bacillus sp.
atgattaggaagatcgtgccgtttctagcggttctacttgtactgtcgacattgcttaatgtcacaccagccgaagctagcacaaagcaagatcaactcgtcactgaagccaagaagcatataggagttccatatagatggggcggaacgacaactagtggatttgattgttcaggttatatgcaatatgtatttaaccaaattggagtaagcctcccgagaacaacgggtcaaatgtataacactggtacttctgtttcaaagtcaaacttacaagttggagacttagtcttctttaatacatcaggttctggcgtctcacatgcaggaatctacattggaagcagccaatttattcattcttcttcatctagaggtgtttcgattgcttctattaatgaccctcactattggggttcgcgttatattggtgcaaagcgtgtattacctgaagaaaaacctcaaccagtacgcgtgttaggagctggtgagtatcatgatgtagcaacaaaccactgggcttatagtccaattcgtaatctaagcaaccaaaacattatcagtggttatggtaatgatcgctttgttccaaatgatcaattaactcgcgcacaagtagcagcactactcgttcgtgcaacaggattagcaacaccaacaaaaacgaatgcatttagtgatgttcctgaatcacactgggcatcagccgatatttcagctgcagatcgtgctgggtactttgactatctgcctggaagtacgtttaaccctaacgaagctgtcacacgtgatgaaattgctgttcttttcgctgcagcatttgagttatcagcctcatcttctagctctttccctgatgttgattcatcaaactgggcatataatgaaatttcagctttaaaagcaaatggcattgtacacggctttgcagatggtacataccgtcctaacagcaacttaactcgtgcggaatttgcttctatcttattccaagctttaaattaa

SEQ ID NO: 909 - DNA, 390 bp, Bacillus sp.
gtgtattcgacaacattcaatattggtcaaatcaataaagcttttgtcttctttctcgcggcagccgttttatgcggatgcggcaaagcggatgattccgccgcaaaaaaagcactgcccgttacgctccatgttgaggatgcggacggttcaccggcggccggtgtgacggttaccgtgatgaaagcggcggagtcagatcatcagccgaatatagaccgcggagagataataggcaagactgatcaccacggcgagatgacatggaaaagcggcgcgaaaggaacctatgccgttgtttttgaaaaagacggggtaccggaaacccggaatatttccttagctgagagcgataaacatacggtgatcagcattacgttgaaacattga

SEQ ID NO: 910 - DNA, 390 bp, Bacillus sp.
gtgtattcgacaacattcaatattggtcaaatcaataaagcttttgtcttctttctcgcggcagccgttttatgcggatgcggcaaagcggatgattccgccgcaaaaaaagcactgcccgttacgctccatgttgaggatgcggacggttcaccggcggccggtgtgacggttaccgtgatgaaagcggcggagtcagatcatcagccgaatatagaccgcggagagataataggcaagactgatcaccacggcgagatgacatggaaaagcagcgcgaaaggaacctatgccgttgtttttgaaaaagacggggtaccggaaacccggaatatttccttagctgagagcgataaacatacggtgatcagcattacgttgaaacattga

SEQ ID NO: 911 - DNA, 390 bp, Streptococcus sp.
gtgtattcgacaacattcaatattggtcaaatcaataaagcttttgttatctttctcgcggcggccgttttatgcggatgcggcaaagcggatgattccgccgccaaaaaggcaatgcccgttacactccatgttgagcatgcagacggttcaccggctgccggtgtgacggttaccgtgatgaaagcggcggagtcagatcatcagccgaatatagaccgcggagagataataggcaagactgatcaccacggcgagatgacatggaaaagcggcgcgaaaggaacctatgccgttgtttttgaaaaagacggggtaccggaaacccggaatatttccttagctgagagcgataaacatacggtgatcagcattacgttgaaacattga

SEQ ID NO: 912 - DNA, 390 bp, Bacillus sp.
gtgtattcgacaacattcaatattggtcaaatcaataaagcttttgttttctttctcgcggcggccgttttatgcggatgcggcaaagcggacgattccgccgccaaaaaagcattgcccgttacgctccatgttgaggatgcagacggttcaccggcggccggtgtgacggtcaccgtgatgaaagcggcggagtcagatcatcagccgaatatagaccgcggagagataataggcaagactgatcaccacggcgagattgcatggaaaagcggcgcgaaaggaacctatgccgtcgtttttgaaaaagacggagtaccggaaacccggaatatttccttagccgagagtgataaacatacggtgatcagcattacattgaaacaatga

SEQ ID NO: 913 - DNA, 390 bp, Bacillus sp.
gtgtattcgacaacattcaatattggtcaaatcaataaagcttttgttttctttctcgcggcggccgttttatgcggatgcggcaaagcggatgattccgccgccaaaaaagcattgcccgttacgctccatgctgaggatgcagacggttcaccggcggccggtgtgacggtcaccgtgatgaaagcggcggagtcagatcaccagccgaatatagaccgcggagagataataggcaagactgatcaccacggcgagattgcatggaaaagcggcgtgaaaggaacctatgccgtcgtttttgaaaaagacggagtaccggaaacccggaatatttccttagctgagagtgataaacatactgtgatcagcattacattgaaacactga

SEQ ID NO: 914 - DNA, 390 bp, Bacillus sp.
gtgtattcgacaacattcaatattggtcaaatcaataaagcttttgttttctttctcgcggcggccgttttatgcggatgcggcaaagcggatgattccgccgcaaaaaaagcattgcccgttacgctccatgttgaggatgcagaaggctcaccggcggccggtgtgacggtcaccgtgatgaaagcggcggagtcagatcatcagccgaatatagaccgcggagagataataggcaagactgatcaccacggcgagattgcatggaaaagcggcgcgaaaggaacctatgccgtcgtttttgaaaaagacggagtaccggaaacccggaatatgtccttagctgagaatgataaacatacggtgatcagcattacattgaaacactga

SEQ ID NO: 915 - DNA, 390 bp, Bacillus sp.
gtgtattcgacaacattcaatattggtcaaatcaataaagcttttgttttctttctcgcggcggccgttttatgcggatgcggcaaagcggatgattccgccgccaaaaaagtattgcccgttacgctccatgttgaggatgcagaaggctcaccggcggctggtgtgacggtcaccgtgatgaaagcggcggagtcagatcatcagccgaatatagaccgcggagagataataggcaagactgatcaccacggcgagattgcatggaaaagtgccgcgaaaggaacttatgccgtcgtttttgaaaaagacggagtaccggaaacccggaatatgtccttagctgagaatgataaacatacggtgatcagcattacattgaaacaatga

SEQ ID NO: 916 - DNA, 366 bp, Bacillus sp.
gtgtattcgacaacattcaatattggtcaaatcaataaagcttttgttttctttctcgcggcggccgttttatgcggatgcggcaaagcggacgattccgccgccaaaaaagcattgcccgttacgctccatgttgaggatgcagacggttcaccggcggccggtgtgacggtcaccgtgatgaaagcggcggagtcagatcatcagccgaatatagaccgcggagagataataggcaagactgatcaccacggcgagattgcatggaaaagcggcgcgaaaggaacctatgccgtcgtttttgaaaaagacggagtaccggaaacccggaatatttccttagcgagagtgataaacatacggtga

SEQ ID NO: 917 - DNA, 393 bp, Bacillus sp.
gtgttttcgacaacattcaatattggtcaaatcaataaagtttttattttctttctcgccgcggctgttttatgcggatgcggcaaagcggatgattccgccgccggcaaaaaaacactgcccgtcactctccattttgaggatgctgacggctcacctgctgacggtgtgacggtaacagtgatgaaagcggcggagtcagatcatcagccgaatatagaccgcggagagacaataggcaagaccgatcaccacggcaatattgcctggaaaagcgggacggaaggaacctatgccgtcgtttttgaaaaagacggcataccggaaacccggaatatttccttagttgagagcgataaacatacggtgatcagctttacattgaaacattaa

SEQ ID NO: 918 - DNA, 393 bp, Bacillus sp.
gtgttttcgacaacattcaatattggtcaaatcaataaagtttttattttctttctcgccgcggctgttttatgcggatgcagcaaagcggatgattccgccgccggcaaaaaaacactgcccgttactctccattttgaggatgctgacggctcacctgctgacggtgtgacggtcacagtgatgaaagcggcggagtcagatgatcagccgaatatagaccgcggagagataataggcaagaccgatcaccacggcaatatcgcctggaaaagcgggacggaaggaacctatgccgtcgtttttgaaaaagacggcataccggaaacccggaatatttccttagttgagagcgataaacatacggtgatcagctttacattgaaacattaa

SEQ ID NO: 919 - DNA, 393 bp, Bacillus sp.
gtgttttcgacaacattcaatattggtcaaatcaataaagtttttattttctttctcgccgcggctgttttatgcggatgcagcaaagcggatgattccgccgccggcaaaaaaacactgcccgttactctccattttgaggatgctgacggctcacctgctgacggtgggacggtcacagtgatgaaagcgccggagtcagatcatcagccgaatatagaccgcggagagataataggcaagaccgatcaccacggcaatatcgcctggaaaagcgggactgaaggaacctatgccgtcgtttttgaaaaagacggcataccggaaacccgggatatttccttagctgagagcgataaacatacggtgatcagctttacattgaaacactaa

SEQ ID NO: 920 - DNA, 894 bp, Bacillus sp.
atggcgaaaagaatatttctgtttattttaacgaaccttttggtcattacgacaatcggaattgtgcttacgattattacaagcgttaccggtgtcggctcgtatatacaaaatggccgcattgatctgatggcattgctcgtgttcagtcttgtcgtcggttttgtcggttcttttatttctctcggaatgtccagatggatggccaaaacgatgatgggcgtccgggtgttaaatccgaagaaacagtcactcagctatgaagaacagcaattgattgaccgtgtgcacagattgtcccgtgccgcagggatgacgaaaatgcctgaagtcggcatttatcagtccccggaggtcaatgcttttgcgaccggaccttctaagcgccgttcgcttgtcgcggtttcttcaggtttattgcagcagatggatgatgctgcggtggaaggggttcttgcccatgaagtcgcacacatcacaaacggtgatatggtcacgatgacgctgctgcagggaatcgtcaatacgttcgtcgtattcctttcccgaatcgcggcatgggttgcaagccgctttgtcaaagaagacctcgcaccggtcgtgcattttatcgcgatgatcgtgtttcagattatcttttccattctcggcagtcttgtcgtcttcgcctactcgcgccacagagagtttcacgctgaccgcggcggtgcagaccttgccggcaaggataaaatgattcacgccctgcgtacgctgaagtcttatacaggacatgtgaatgaagaagaccagacggcggtgcagacgttaaaaattaacggcaaaaagcattcgtcactgttctccacacaccctgatctcgatgagcgcatccgcaggctggaagcaaaataa

SEQ ID NO: 921 - DNA, 894 bp, Bacillus sp.
atggcgaaaagaatatttctgtttattttaacaaaccttttggtcattacgacaatcggaattgtgcttacgattattacaagcgtcaccggtgtcggctcgtatatacaaaatggccgcgtcgatctgacggcattgctcgtgttcagtcttgtcgtcggttttgtcggttcttttatttctctcggaatgtccagatggatggccaaaacgatgatgggtgtccgggtgttaaatccgaagaaacagtcactcagctatgaagagcagcaattggtggaccgtgtgcacagattggcccgtactgcagggatgacgaaaatgcctgaagtcggtatttatcattcccctgaggtcaatgcctttgcgaccggaccttctaagcgccgctcgcttgtcgcggtttcctcaggtttattgcagcagatggatgatgctgcggtggaaggggttcttgcccatgaagtcgcacacattacaaacggtgacatggtcacgatgacgctgctgcagggaatcgtcaatacgttcgtcgtcttcctttcccgtatcgcggcatggattgcaagccgctttgtcaaagaagaccttgcgccggtcgtgcattttatcgcgatgatcgtgtttcagattattttttccattctcggcagtcttgtcgtcttcgcatactcgcgtcacagagagttccacgctgaccgcggcggtgccgaccttgccggcaaggataaaatgattcacgccctgcgtaccctgaagtcttacacaggacacgtgaatgaagaggatcagacggcggtgcagacgttaaaaatcaatggcaaaaagcattcgtcactgttctccacacaccctgatctggatgagcgcatccgcaggcttgaagccaaataa

SEQ ID NO: 922 - DNA, 894 bp, Bacillus sp.
atggcgaaaagaatatttctgtttattttaacaaaccttttggtcattacgacaatcggaattgtgcttacgattattacaagcgtcaccggtgtcggctcgtatatacaaaatggccgcgtcgatctgacggcattgctcgtgttcagtcttgtcgtcggttttgtcggttcttttatttctctcggaatgtccagatggatggccaaaacgatgatgggtgtccgggtgttaaatccgaagaaacagtcactcagctttgaagagcagcaattggttgaccgggtgcacagactggcccgtactgcagggatgacgaaaatgcctgaagtcggtatttatcattcccctgaggtcaatgcctttgcgaccgggccttctaagcgccgctcacttgtcgcggtttcctcaggtttattgcagcagatggatgatgctgcggtggaaggggttcttgcccatgaagtcgcacacattacaaacggtgacatggtcacgatgacgctgctgcagggaatcgtcaatacgttcgtcgtcttcctttcccgtatcgcggcatggattgcaagccgctttgtcaaagaagacctcgcgccggtcgtgcattttatcgcgatgatcgtgtttcagattattttttccattctcggcagtcttgtcgtcttcgcatactcgcgtcacagagagttccacgctgaccgcggcggtgccgaccttgccggcaaggataaaatgattcacgccctgcgtacgctgaagtcttacacaggacacgtgaatgaagaggatcagacggcggtgcagacgttaaaaatcaatggcaaaaagcattcgtcactgttctctacacaccctgatctggatgagcgcatccgcaggcttgaagccaaataa

SEQ ID NO: 923 - DNA, 897 bp, Bacillus sp.
atggcgaaaagaatttttctgtttattttaacgaatattttggtgcttacaacaatcgggattgttttgtctattttgagctctgttaccggagtagggacatactttacagctgatggcggtattgatccaatggcgcttcttgtgttcagtttagtcgttggctttgtcggttcctttacgtctcttgcaatgtccagatggatggcaaagacgatgatgggcgtgagagtgctgaatccgaaaaaacactcactcagctacgaggaacagcaattggttgatcgtgtccatagattaagccgttctgcagggttaacgaaaatgccggaagtcgggatttaccgttcacctgaagtaaacgcgtttgcgactggaccgtctaaacgccgttctcttgtcgcagtatcgtctgggctgctggagcagatggatgatgcggcggtcgaaggagtgcttgcccacgaggtcgcgcatatcgctaatggtgatatggtaacaatgacgcttttacaaggtatcgtcaatacctttgtcgtctttctatcacgcatcgcagcttggattgcaagccgttttgtcaaagaagatctagcgccgatcgtacattttattgcaatgattgtctttcagattatcttttcgatacttggcagcctggttgtgtttgcgtattcacgccatcgtgaattccatgctgacaggggaggagcggatcttgccggcaaggataagatgattcatgcgcttcggacgcttaaaggctactcttcccgaatgatggaagacgatcagacagctgtccaaacgttaaagatcaatggcaagaagcgctcttcacttttctctactcaccctgatttagacgagcgtatcagacggctggaagctaagtaa

SEQ ID NO: 924 - DNA, 897 bp, Bacillus sp.
atggcgaagagaatttttctgtttatcttaacgaatattttggtgcttacaactatcgggatcgttttgtctgttttaagctctgttaccggagtcggaacgtactttacagctgatggcggtattgatccaatggcgctccttgtgttcagtttagtcgttggttttgtcggttcctttacgtcgcttgcgatgtccagatggatggccaagacgatgatgggcgtcagagtgctgaatccgaacaagcacacgctcagctatgaggaacagcaattggttgatcgtgttcaccgattaagccgctctgccggattaacgaaaatgccggaggtcggaatttatcgttcacctgaagtgaacgcgtttgcgacaggaccgtcaaaacgccgttctcttgtggccgtatcgtcagggctgctggagcagatggatgatgccgcggttgaaggtgtgcttgcccacgaggtcgcgcatatcgctaatggtgatatggtaaccatgacgcttttacaaggtatcgtcaatacctttgtcgtctttttatctcgtatcgcagcatggattgcgagccgttttgtcaaggaagatcttgcgcccatcgttcattttattgcaatgatcgtctttcagattgtcttttccatactcggcagcctggttgtgtttgcgtactcacgccatcgtgaattccatgctgacagagggggagcggatctcgccggcaaggataaaatgattcatgcgcttcggacgcttaagagctactcttcacgcattatagaagacgatcagacagctgtccaaacattaaagattaatggcaaaaagcgctcttcgcttttctctacacaccctgatttagatgagcgaatcagacgattagaagctaaataa

SEQ ID NO: 925 - DNA, 897 bp, Salinibacillus sp.
atggcgaaaagaatttttctgtttattttaacgaatattttggtgcttacaacgatcggcattgttttatctgtcataagctctgtcactggagttgggacgtactttacagctgatggcggtatagatcctattgcgcttcttgtattcagtttagtcgtcggttttgtcggttcctttatgtctcttgcgatgtccagatggatggcaaaaacaatgatgggcgtcagagtgctgaatccggagaaacatacacttagctatgaagagcagcaattggttgaccgtgtttatagattaagccgctctgccggcttaacgaagatgccggaggtcggaatttaccgctcatccgaagtgaacgcgtttgcgaccggcccttcaaaacgccgctctcttgtcgctgtgtcgtcaggcctgcttgaccaaatggatgacgctgcggttgaaggcgtgcttgcccatgaggtcgctcatattgcaaatggtgatatggtgacaatgacgcttttacaaggtattgtgaatacctttgtgttctttttatcacgtattgctgcatggatcgcgagccgctttgttaaggaagatcttgctccgattgttcattttatcgcaatgattgtgtttcagattgtcttttcaattctcggaagcctcgttgtttttgcgtattcacgccaccgtgaattccatgctgaccggggaggagcggatcttgccggcaaggataagatgattcatgctcttcgaacgcttaagggctattcttcccgcatcatggaagaagatcagacagctgtccaaacactaaagattaatggcaagaagcggtcatcgcttttctctactcaccctgatttagatgaaagaatcagacgattagaagctaaataa

SEQ ID NO: 926 - DNA, 897 bp, Bacillus sp.
atggcgaaacgaatttttctgtttattttaacaaatattttggtgcttaccacaatcgggatcgttttatctgttttaagctcggttaccggagtcgggacgtactttaccgctgatggcggtatcaatcctattgcgctccttgtgttcagtttagtcgttggttttgtcggctcctttacgtctcttgcgatgtccagatggatggcaaagacgatgatgggcgtcaaagtgctgaatccggaaaaacacacgctcagttacgaagaacagcaattggttgatcgtgttcatcggttaagccgttctgccggtttaacgaaaatgccggaggtcggcatttaccggtcgcctgaagtgaacgcatttgcgactggaccgtcaaaacgccgttctcttgtggcagtgtcgtcagggctgctggagcaaatggatgatgccgcggttgaaggtgtgcttgcccacgaggtcgcgcatatcgctaacggtgatatggtaacgatgacgcttttacaaggtatcgtcaatacctttgtcgtctttttatcccgtatcgcagcatggattgcaagccgttttgtcaaggaagaccttgcgccgatcgttcattttattgcagtgattgtctttcagattgtcttttccattctcggcagccttgttgtgtttgcgtactcacgccatcgtgaattccacgctgacagaggaggagccgatctggcgggcaaggataaaatgattcacgcgctgcgtacgcttcagagctattcttcccgcattaaggaagacgatcaggcagctgttcaaacattaaaaattaatggtaagaagcactcttcgcttttctctactcaccctgatttggatgagcgaatcagacggttagaagctaaataa

SEQ ID NO: 927 - DNA, 900 bp, Bacillus sp.
atgggtaaaagaatatttctgtttatattaacgaacattcttgttatcactacgattggaattgtactttcgattattagtgcaacaactggtgttggttcttatataggagcagacggaagtcttaatatcatgtatcttcttgtcttcagtgcagttgttggttttgttggctcgtttatgtcattagcaatgtctcgctggatggcaaaaatgatgatgggtgtgcgcgtgttaaaccctgaaaaggatacattaacatacgatgagcagcagcttgttgaccgtgttcacagattatctagagcagcaggtctttctaaaatgcctgaggttggtatttatcaatcatcggaagtaaatgcttttgcgacaggtccttctaagagaagatcacttgttgctgtatcgactggtttgctgcatgaaatggatgatgcagcggttgaaggtgttattgctcacgaagtcgctcacgttgcgaacggtgacatggtgacaatgacgttgctacaagggatcgtcaacacgttcgttgttttcctttcaagaattgcggcatggatcgcaagtcgtttcgtttcacgtgaagagcttgtgccgattgtccactttatcgctgtgattgtcttccaaatcattttctctatcctaggaagccttgtcgtgtttgcatattctagacatcgtgaattccacgcagaccgcggcggtgctgaccttgctggaaaagacaaaatgattcatgcacttcgttctcttgaggcgtatacgtcaagaatcaaagatgatgatcaaacagcagtcgcgacactgaaaatcagtggtaaaagaaaagcttctcttttctcgactcaccctgatttaaacgaaagaatcagaagactagaagcaaaataa

SEQ ID NO: 928 - DNA, 894 bp, Bacillus sp.
atgggaaaaagaatctttctctttcttttatcgaacattttagttattacgacgatcggtattgtgctgtccattatcggttcgctgacaggcgtaggcacgtatttcacggctggcggcggcatcaatattgttgcgcttctcgtattcagtgcggttgtcggctttgtcggctcctttatgtcgcttttgatgtcaagatggatggcgaaaatggcgatgggcgttcaggtgctgaatcctgataagcaaacgctcagctacgaagagcagcagctcgttgaccgggtatataagctgtcccgcgctgccggactgacaaagatgcctgaagtcggcatctacaattcacgcgaagtgaatgcctttgcgacagggccgtccaaaaaccgctcgcttgtcgctgtatcgacgggtcttcttcaggaaatggatgacgacgcagtggaaggcgttcttgctcacgaagtcgcgcatatcgcaaacggcgatatggtgacaatgacgctccttcagggaatcgtcaacacgtttgttgttttcttcgcccggattgcggcatgggctgtttcacgcgttgtccgtgaagagctggcgccgatcgttcactttatcgcggtcatcgtattccaaatcgtgttttccattctcggaagccttgtcgtgtttgcgtactcccgccaccgcgaatatcatgcggatagaggaggagcggaccttgcaggcaaggataagatgattcacgcgctccgctcgcttgagcagtacacttcaagagtcaaagaagagcaggcatctgttgccactttgaaaatcaacgggaaaaagcacacatcgcttttctcaacacaccctgatttaagcgacagaatccgccgtctggaagcaaaataa

SEQ ID NO: 929 - DNA, 894 bp, Bacillus sp.
atgggaaaacgaatccttctctttcttttatcgaacattttggtcatcacgaccatcggcatcgttttatcgatcatcggttcgctgacaggcgtcgggacgtattttacagccggtgggggcattcatataggcgcccttctcgtcttcagcgcggtcgtcggttttgtcggttcctttatgtcgctttcgatgtcaagatggatggcgaaaatggcgatgggcgttcaggtgctgaaccccgaaaagcagacgctcagctacgaagagcagcaattggttgaccgcgttcataaattggcgcgggctgccggattgacgaaaatgcctgaagtcgggatttacaactcccgtgaagtgaacgcgtttgcgacaggaccttctaaaaaccgctcgcttgtcgctgtgtcaacagggcttcttcaggaaatggatgatgatgcggtcgaaggcgtcctcgctcatgaagtcgcacatatcgcgaacggcgacatggtgacgatgaccctgcttcaaggtattgtcaacacattcgtcgttttctttgcaaggattgctgcgtgggcggtatcccgagtcgttcgtgaggagctggctccgatcgttcactttatcgcggttattgtgttccaaatcgcattttccattctcggaagcctcgtcgttttcgcctattcgcgccatcgcgagtaccatgctgacagaggaggagcagatcttgccggcaaggataagatgattcacgcgcttcgttccctccagcagtacacatcaagaatcaaagaagaacaggcttctgtggcgacattgaaaatcagcggtaaaaaacattcttcactgttttcgacccatcctgatttacacgatagaatccgccgtctggaagccaaataa

SEQ ID NO: 930 - DNA, 879 bp, Bacillus sp.
atggctaaacggattttcctctttattttaacaaatattcttgtgctcattacgataggggcagtcctttccctgttaggagttggctcatatgtgacggcttcaggtggaatcgatctcataagcctgcttgtgtttagtgcagtcgtcggttttaccgggtcatttatttctctcatgatgtctaaatggatggcaaaaatgatgatgggcgtgaaggtgttaaaacctgatcaatcattatctgactatgaaagaaatcttgtagaccgtgtatacagattatcgagagctgccggtattacgaaaatgccggaagtagggatctatcaatcgcgcgaggtaaatgctttcgcaacaggtccatctaaaaacaattcgcttgtggctgtatctactggcctgcttgaggaaatggatgatgcagcggttgaaggtgtgctcgcccacgaggtagcgcatatctcaaacggtgacatggtgacaatgacattgcttcaaggtgttgtcaatacatttgttgtcttccttgccagaattgcagcatggatcgcatccagatttgtcagagaagatatggcgccaattgttcattttattgcgattttgattttccagctgctgttttctatccttggcagccttgtggtctttgcttattcccgccaccgcgaattccatgccgacaacggcggagcggatcttgcgggaaaagacaaaatggttcatgcgctgcgcacccttaaaggatacacacagcggatcaacaacgagcaatcgtctgttgccacgcttaagatcagcgggaagcgcgggcttgctctcttttcaacacatcctgacttagatgagagaattcgccgtttagaagcgaaataa

SEQ ID NO: 931 - DNA, 882 bp, Bacillus sp.
atgggtaaacgaattttctattttcttttgacgaatatactcgtattgctaacgattagcattatcttctctgtcacaggagcaggtaattatattgatcctcaaggcaacatcgacttaggagcgttgcttgtattcagtgccattattggtttctctggatcattcatttcactggctatgtcccgttggatggccaaaaaaatgatgaatgtaagggtattggatccgaataaatctttatcagctcatgaacaagaggtagttgaaaaagttcaccgcttgtccaaggcggctggcttaatgcatatgcctgaagttggtatctacgattcaccagaagtaaacgcctttgctacaggcccatcaaagaagcgctccttggttgctgtttcaacaggactgttgcgtgaaatggatgacgatgcggtggaaggtgtcattgcccacgaagttgcacatattgcaaacggtgatatggtaacgatgaccttactgcaaggggtcgtcaatacatttgtggttttccttgcgagaattgcagcctggattgcatcccgttttgtaaaagaagatatggcgccaatcgtccatttcatcgccgtgatcgtattccagattgtcttttcgatcctcggaagcttagttgtcttcgcctattcccgtcacagagaataccatgctgacaggggcggggcagaccttgccgggaaggataaaatggtgcatgccctgcgtatgctgaaagcttactccaaccgtgttgttgaggaaagggatacagccgtcgcaacattaaaaatcagcggaagaagaaaatcccctattttctctacacatcctgatttggatgaccgcatcagcagactggaaggcagataa

SEQ ID NO: 932 - DNA, 879 bp, Bacillus sp.
atggcaaagcgtatattcttttttattcttacgaacgtacttgttttaacaacgatttctatcatctttatggtgactggtgctggaaactatattcaagatggcggaataaattttggagcacttctagtatttagtgccattgtcggtttcacaggttccttcatttccttattgatgtcccgttggatggctaagaaaatgatgaatgtgaaggttatcgatccagatggtccgatgaattcacaagagcgtcaaattgttgaaatggttcaccgcatgtcccgtgcagctggcatcacaaaaatgccggaagttggaatttactactctccagaggttaacgcatttgctacaggtccttccaagaaccgttcattagtagctgtttcttctggtctattagatgaaatggacgaagccgctgttgaaggtgttatcgcccatgaggttgcccatatcgccaatggtgacatggtaaccatgacattattacaaggtgttgtgaatacattcgttgtattcttggctcgtatcgcagctttcattgcgtcccgttttgtaaaagaagaaatggcaccgattgtacatttcattgccattatcgtattccaaatcgcattctcgatccttggaagcatcgtcgtatttgccttctcccgttaccgtgagttccacgctgaccgtggaggcgcagaccttgcaggtaaagacaaaatggtgcatgcattgcgttctcttcaggcttacacaaaccgtgtgacagaagagaaagatactgcgattgcatctcttaaaattaacgggaagagaaagagttctttattctctactcaccctgatttaaatgagcgtatccgtcgtttagaagcgaaataa

SEQ ID NO: 933 - DNA, 879 bp, Bacillus sp.
atggggaaacgaatttttctttttcttttgacgaatgttttagtattagtcaccatcagtattgtgctatctcttacaggtgcgggaaattattttaatgcccaaggcggcattgatctgatttcactattaatatttagtgctatcgttggttttacaggggctctcatatccttggcgatgtcacgctggatggcaaaaatgatgatgaaggttaaggttttagaccctaacgcatcattatcaccaatggaaagaaccattgtcgaaaaagtccatcgcctttcaagggccgctaggttaactcacatgccagaagtgggaatttacaattcaccagaagtaaatgcgtttgccactggtccttcgaaaaaacgatcacttgttgcagtctcaaccgggttgcttcatgaaatggatgatgcagctattgagggcgtaattgcccatgaagtagcacatattgccaatggtgatatggtaactatgacccttctgcaaggtgtagtgaatacatttgtagttttccttgctcggattgcagcttgggcggtgtcacgctttgtaaaagaagacatagcaccaatcgttcatttcattgccgttattgtcttccaaatagccttctcgattttaggaagccttgtggtatttgcttattcaagacatcgtgaattccacgctgacagtggcggagcagacctagcgggcaaggataaaatgactcatgcattacaatgtctaaaagcttattcaaatcggatgaaagatgaagagcaaacggcgatttctactttaaaaattaacggaaaacgtaaatcaatgctattttcaacacatccggatcttgacgagagaattaatcgattgaatagatga

SEQ ID NO: 934 - DNA, 891 bp, Cohnella sp.
atgaaacggattttcctgtttattcttacgaacttgctcgtcatggttacgatcggcattattttatccgttgtcggagtcaattcgtacattaacgaaagcggcggcattaacttccagcaattgcttatcttcagcgcaatcgtaggcttcaccggcgcgttcatctcgctggcgatgtcccgttggatggcgaaaatgatgatgggcgtgcaagtgctcgaccctcgcggcagcctatcgtccggcgagcgggagctcgtcgatatggttcaccaaattgcgcgcgacgcaggcatgacggttatgcccgaagtcggtatctacgaatccaaggaagtgaacgcgttcgcgaccggtccttccaagagacgctcgctcgtcgcggtgtcgaccggattgctggaaatgatggaccgcgacgcggtcgaaggcatcatcggccacgaggtcgcgcatatcgtgaacggagacatggtcacgatgacgcttctgcaaggcgtcgtgaacacgttcgtcgtcttcctgtcgcgtatcgcggcttgggcggcatcccgtttcgtgaaagaagacgtcgcgccgctcgtgcatttcatcgcggtcatcgtgttccagatcgtattctcgattctcggcagcttggtcgtcttcgcttactcccgtcatcgcgagttccacgcggaccgcggcggcgcgattctcgcgggcaaggacaagatgatccatgcgctgcaatcgctgcaaagatacaaggaacgcatggtcgtgggagagcagcagacttccgtcgcgacgctcaagatcggcggcaagcccggcagagtgtcgtggttctcgacgcacccggatctcggcgaccgcattcgcgcgctgcaagaggcgcagctataa

SEQ ID NO: 935 - DNA, 882 bp, Paenibacillus sp.
atgggaaaacgaattttactgtttattctgactaatattctcgttattgtaaccattgggattatctttacaattctgcctatcggttcgtatattaccgaatcaggcaatattgattttgctgctttattggtatttagtgctgttatcggttttacaggcgcatttatttccttggcaatgtcccgctggatggctaagaaaatgatgaatgtgcaggtgctagacccgcaggggcctcttaacgagcatgagcgtgagcttgttgatatggtacaccgcttgtcccgcagcgccggcctgactcatatgcctgaggtgggaatataccatgcggaagaagttaacgcgtttgcaacaggaccgtcgaagaagcgctccttggttgcagtgtccactggtttgctgcaggagatggaccgcgatgcggttgaaggcgtaattgcccatgaggttgctcatgtagctaacggcgacatggttacgatgactttgcttcaaggagtggtcaacacctttgtcgtcttcctgtcccggatcgctgcctggattgcatcgcgttttgtcaaggaagaactggcaccgatcgttcactttattgcagtcattgtattccagattgctttctctattctcggaagccttgtcgtcttcgcctactccagacatcgcgagtaccatgccgataacggaggagcgcatcttgccggcagagataagatgatccatgccctgcaatcgctgaaggcttacacagaccggattaagaacgaaaaggattcctctctggcaactctgaaaattagcggccagaagaaaagctctttgttctctactcatcctgccctggatgatcgtatccaacgcttacagcaaggttaa

SEQ ID NO: 936 - DNA, 879 bp, Bacillus sp.
atgtttaaacgaattggattattcatattaaccaacatcctggtcattacaacaatagggatcgttctatccgttttaggcgttggcaactatataacggcttctggcggaatcgaccttgtaactttgcttgccttcagtgcagttgtaggttttacaggttctttattctccctggccatttcccgctggatggcgaaaatgatgatgggggttcaggtattaaaacctgaagacaatctttcccctattgaaagagaccttgtcgaacgcgttcatcaacttgcacggactgcaggtatgcgggtcatgccggaggttgggatttaccgctcaccggaggtaaatgcatttgctacaggtccttccaagaaccgctctctcgtagcagtatcaaccggcttgcttgaagaaatggatgaggatgctattgatggtgttcttgcccatgaaattgcccatattgttaatggagatatggtgacgatgacccttctgcaagggattgtcaatacatttgtcgtgttcctcgcaagagttgccgcatgggcagtatcaagatttgtccgcgaagaacttgcaggagttgtccattttattgcgattttggtattccagatccttttctctattttgggaagtcttgtcgtatttgccttctcgcgctaccgcgaataccatgctgaccgcggcggagcggactttgcaggtaaagataaaatgattcatgcattaagaagccttcagaactatactcagcgcacaagagatgatgatacttctcttgctactctgaaaataatcagcaaacgaaaacgttccattttctccacacaccctgaccttcaggatcggattgctagattggaacagcgttaa

SEQ ID NO: 937 - DNA, 1269 bp, Bacillus sp.
atgttcgtgaatacagttatcgcgtttattattattttcggaacgctcgtttttttccatgagctggggcatttattgctcgcccaaagagcgggaatcctttgccgtgaatttgcgatcggcttcggccctaaaatcttttcatttaaaaagaatgaaaccgtgtatacgatcagactccttccggtcggcgggttcgtccgcatggccggtgaagacccggagatgatcgaagtcaaacccggttataccgtcgggcttctttttaataaagatgacgaagtggaaaaagtcatcattaatcaaaaggaaaaatatcccgacgctttaattatcgaggtggagacggctgatcttgagcacgaaatgaagattaccgggtacgagcaggggaaagaagatgaactggcgggctttactgtcagtcagacctccttttttatcgtagacggagaagaagtgcagattgcgccttacaatcgacaattcgggtctaaacccgtatggaagcggattaaggcgattgctgccggtccgataatgaacttcatcttagcgtatgtcattctcgtcatgcttggattcattcaaggcgtgccttcgaatcagcctgagctcgggaagctgacagacaatggacgcgcagcggctgccggtttaaaagaaggcgactatatccagagcattaacggggaaaaaatgaggtcatggacagacatcgtgacagcggtaaaagaaaatcccggaaaaaaaatcgatgtcgccgtcaaacgggacggcaaatcgtttcatatctcggttacacctgaagctgtaaaagatgaaaataaaaaaacaatcggccgcttcggctcttatgcgccgactgaaaaaggcgcgcttgcagcgattgcctatggcgcgacatctaccgttgatgtcacaaaagcgatcctgaccaatctgagcaaacttgtgacaggccagtttaagcttgatatgctttcgggtcctgtcggcatttatgatatgacggatcaagttgcaaaaaccggtattatcaacctattccagtttgcggcgtttttaagcatcaacctgggaattgtcaacctgctgccgataccggcgcttgacggcgggcggctgctgtttttattcattgaagcaatccgcggcaagccgataaaccgtgacaaggaagcatttgtcgtatttatcggcgtagctttcttaatgcttcttatgctggttgtcacatggaacgatatccagcgtttattcttataa

SEQ ID NO: 938 - DNA, 1263 bp, Bacillus sp.
gtgaatacagttatcgcgtttattattattttcggaacgctcgtttttttccatgagctggggcatttactgctcgcccaaagagcgggaatcctttgccgtgaatttgcgatcggcttcgggcccaaaatcttttcatttaaaaagaatgaaaccgtgtatacaatcaggctccttccggtcggcgggttcgtccgcatggccggtgaagacccggagatgattgaagtcaaacccggttataccgtcgggcttctttttaataaagacgacgaagtggaaaaagtcatcattaatcaaaaggaaaaataccccgacgctttaattgtcgaggtggagacggctgatcttgagcacgaaatgaagattacagggtatgagcaggggaaagaagatgaactgtcgggctttactgtcagtcagacctcttttttcatcgtagacggagaagaagtgcagattgcgccttacaaccgccaattcgggtcaaaacctgtatggcagcggattaaggcgattgctgccggtccgattatgaacttcatcttagcatatgtcattctcgtcatgcttggattcattcaaggcgtgccttcgaatcagcctgagctcggaaaactgacagacaatggacgcgcagcggctgccggtttaaaagaaggcgactatatccagagcattaacggtgaaaagatgcggtcatggactgacatcgtgacagcggtaaaagacaatcccgggaaaaaaatcgatgtcgccgtgaaacgtgacggcaaatcgtttcatatctcggttacccctgaagccgtaaaagatgaaaacaaaaaaacaatcggccgcttcggctcttatgcgccgactgaaaaaggcgcgtttgttgcgatcgcttacggcgcgacatctacggttgatgtcacaaaggcgatcttgaccaatctgagcaaaatcgtgacaggccagtttaagcttgatatgctttcaggccctgtcggaatttatgatatgacggatcaggttgcaaaaaccggtattatcaacctattccagtttgcggcgtttttaagcatcaaccttggaatcgtcaacctgctgccgatcccggcgcttgacggcggaagactgctgtttttatttattgaagcaatccgcggcaagccgattaaccgtgacaaggaagcatttgtcgtatttatcggcgtcgctttcttaatgcttcttatgctggttgtcacatggaacgatatccagcgtttattcttataa

SEQ ID NO: 939 - DNA, 1224 bp, Bacillus sp.
gtgaatacagttatcgcgtttattattattttcggaacgctcgtttttttccatgagctcgggcatttattgctcgcccaaagagcgggaatcctttgccgtgaatttgcgatcggcttcggccctaaaatcttttcatttaaaaagaatgaaaccgtgtatacgatcagactccttccggtcggcgggttcgtccgcatggccggtgaagacccggagatgattgaagtcaaacccggttataccgtcgggcttctttttaataaagatgacgaagtggaaaaagtcatcattaatcaaaaggaaaaatatcccgacgctttaattatcgaggtggagacggctgatcttgagcacgaaatgaagattaccgggtacgagcaggggaaagaagatgaactggcgggctttactgtcagtcagacctctttttttatcgtagacggagaagaagtgcagattgcgccttacaatcgacaattcgggtctaaacccgtatggaagcggattaaggcgattgctgccggtccgataatgaacttcatcttagcgtatgtcattctcgtcatgcttggattcattcaaggcgtgccttcgaatcagcctgagctcgggaagctgacagacaatggacgcgcagcggctgccggtttaaaagaaggcgactatatccagagcattaacggtgaaaaaatgatgtcatggaccgacatcgtgacagcggtaaaagaaaatcccggaaaaaaaatcgatgtcgccgtcaaacgggacggcaaatcgtttcatatctcggttacacctgaagctgtaaaagatgaaaataaaaaaacaatcggccgcttcggctcttatgcgccgactgaaaaaggcgcgcttgcagcgattgcctatggcgcgacatctaccgttgatgtcacaaagtttaagcttgatatgctttcgggtcctgtcggcatttatgatatgacggatcaagttgcaaaaaccggtattatcaacctattccagtttgcggcgtttttaagcatcaacctgggaattgtcaacctgctgccgataccggcgcttgacggcgggcggctgctgtttttattcattgaagcaatccgcggcaagccgataaaccgtgacaaggaagcatttgtcgtatttatcggcgtagctttcttaatgcttcttatgctggttgtcacatggaacgatatccagcgtttattcttataa

SEQ ID NO: 940 - DNA, 1263 bp, Bacillus sp.
gtgaatacagttatagcgtttatcattattttcggaacgctcgttttcttccatgaactgggccatttattgctagcccaaagagcgggaattctctgccgtgaatttgcgatcggcttcggtccaaagattttttctttcaaaaaaaatgaaacagtttatacgatcaggctgcttccggtcggcggatttgttcgtatggccggcgaagatccggaaatgattgaggtgaaacccggatacacggtcgggcttctgtttaataaggaagatcaagttgagaaagtcatcatcaatcaaaaggaaaaatatccggatgcattagtcattgaagtggaaacagcggatctagagcatgacatgaagatcaccggttatgaacaggggaaagaggacgaactttccagctttactgtcagcgaaacatccttttttatggtagacggagaagaagtgcagattgcgccgtataatcgccaatttggttccaaacctgtatggcagcggattaaagcaattgctgcagggccgattatgaactttattttagcttacgtcattttagtgatgcttgggctgattcaaggcgtaccgtcaaatgaacctatgctcgggcagctgacagacaatggacgggcggctgaagcagggctaaaagaaggggattatatccaaagcattaacggagagaaaatgaggtcttggactgacattgtctccgctgtaaaagaaaacccggagaaagaaatggacgttgcggtaaaaagagataacaaaacgcttcatatttcggtgactccggaagctgttaaagatgagaacaaaaaaacaatcggacgtttcggttcctatgcgccgactgaaaaaggcgtactctcagcggttgcttacggcgcgacatcaacagttgatgtcaccaaagccattttaaccaatctgagcaaattagtaacaggccaatttaaactcgatatgctgtcaggtcctgtcggcatatatgacatgacagaccaagtggcgaaaacagggatcgtgaatttatttcagtttgcggcgtttttaagcattaatcttgggattgtcaacctgcttccgattcctgcacttgacggaggaagactgttgtttctatttattgaagcgattcggggcaaaccgattaacagggaaaaagaagcatttgttgtgtttatcggagtagctttcttaatgcttcttatgctggttgtcacatggaacgatatccagcggctgtttttgtaa

SEQ ID NO: 941 - DNA, 1263 bp, Bacillus sp.
gtgaatacagttatagcgtttattattattttcggaacgctcgttttcttccatgaactgggccatttattgctagcccaaagagcgggaattctctgccgtgaatttgcgatcggcttcggtccaaagattttttctttcaaaaaaaatgagacagtttatacgatcaggctgcttccggtcggcggatttgtccgtatggccggcgaagacccggagatgatcgaggtgaaacccggttacacggtcgggcttttgtttaataaagaagatcaagttgagaaagtcatcatcaatcaaaaggaaaaatacccggatgctttagtcatcgaagtagaaacagcggatttagagcatgacatgaagatcaccggctatgaacaggggaaagaggatgaactttccagctatactgtcagcgaaacctcctttttcattgtagatggagaagaagttcagattgcgccgtttaaccgccaatttggttccaaacctgtttggcagcggattaaagcaattgctgcagggccgattatgaactttattttagcttatgtcattctagtgatgcttgggcttgttcaaggcgtaccgtccaatgatcctgtgctcgggcagctgactgacaatggccgggcggcagaagcagggctaaaagaaggggattacattcagagtattaacggagagaaaatgaagtcttggactgacattgtctccgctgtaaaagaaaatccggaaaaagaaatggacgttgcagtaaaaagagataacaaaacgcttcatatttctgtgactccggaagctgtgaaagatgagaacaaaaaaacaatcgggcgtttcggctcctatgcaccgactgaaaaaggcgttctctcagcagttgcttacggtgcgacatcaacagttgatgtcaccaaagcgattttaaccaacttaagcaaattagtaacaggccaatttaaacttgatatgctgtccggtcctgtcggcatatatgatatgacagaccaagtggcgaaaacagggttagtgaacctattccagttcgctgcgttcttaagcatcaaccttgggattgtcaacttgcttccgattccggcacttgacggaggaagattgttattcctatttattgaagcaatccggggcaaaccgattaacagggaaaaagaagcgtttgttgtgtttatcggggtagctttcttaatgcttcttatgctggtcgtcacgtggaatgatatccagcggctgtttttgtaa

SEQ ID NO: 942 - DNA, 1263 bp, Bacillus sp.
gtgaatacagtaatagcgtttattattattttcggaacgctcgttttcttccatgaactgggccatttattgcttgcccaaagagcgggaatcctctgccgtgaatttgcgatcggctttggtcctaaaattttttcttttaagaaaaatgaaacggtgtatacaatcaggctgcttccggtcggcgggtttgtccgcatggccggtgaagatcctgagatgattgaagttaagccggggtacacggtcggccttctttttaataaagaggaccaggttgagaaggttattatcaatcagaaagaaaaataccctgacgctttggtcatcgaagtggaaaccgctgatttagaacatgacatgaaaatcaccggttacgaacaggggaaagaagaggaactgtcaagcttcactgtcagccaaacctctttctttatcgtagacggagaagaggtacagattgcgccatataaccgtcagttcggttcaaaacccgtatggcagcggatcaaggccattgccgcgggtccaattatgaactttatattggcctatgtcatccttgttatgctcggtctgatgcaaggagtgccgtcaaatgagccggttctcggaaaactgactgacgatggacgggctgctgtctccggattaaaagaaggagactatattcaaagcattaacggagaaaaaatgcgttcttggactgatatcgtctcggccgttaaaaaaaatccggacaaagaaatggacgtcgctgtaaagcgggataacaaaacactccatatttctgttacaccggaagctgtaaaagatgagaacaaaaaaacggtcggccgttttggctcatattcaccgacggaaaaaggggtgcttgcctctatcgtgtacggtgctacctcaactgtcgatgttacaaaagcgattttaaccaatctgggtaaattagtgactggccaatttaaaattgatatgctagctggcccggttggcatttatgatatgacagatcaagtggcaaaaaccggtttaattaatttatttcgatttgccgcatttttaagcattaaccttggtattgtcaatttgcttccgattcctgcgcttgacgggggaagactgttattcctgtttgtcgaagctattcgcgggaaaccgattaatcgtgacaaagaggcatttgttgtatttatcggggttgcttttctaatgcttctcatgcttgttgtgacatggaatgatatccagcgattatttttataa

SEQ ID NO: 943 - DNA, 1263 bp, Bacillus sp.
gtgaatacagttatagcgtttatcattattttcggaacgctcgttttcttccatgaactgggccatttattgctagcccaaagagcgggaattctctgccgtgaatttgcgatcggcttcggtccaaagattttttctttcaaaaaaaatgaaacagtttatacgatcaggctgcttccggtcggcggatttgttcgtatggccggcgaagatccggaaatgattgaggtgaaacccggatacacggtcgggcttctgtttaataaggaagatcaagttgagaaagtcatcatcaatcaaaaggaaaaatatccggatgctttagtcattgaagtggaaacagcggatctagagcatgacatgaagatcaccggttatgaacaggggaaagaggacgaactttccagctttactgtcagcgaaacatccttttttattgtagacggagaagaagtgcagattgcgccgtataatcgccaatttggttccaaacctgtgtggcagcggattaaagcaattgctgcagggccgattatgaactttattttagcttacgtcattttagtgatgcttgggctgattcaaggcgtaccgtcaaatgaacctatgctcgggcagctgacagacaatggacgggcagctgaagcagggctaaaagaaggggattatatccaaagcattaacggagagaaaatgaggtcttggactgacattgtctccgctgtaaaagaaaacccggagaaagaaatggacgttgcagtaaaaagagctaacaaaacgcttcatatttcggtgactccggaagctgttaaagatgagaacaaaaaaacaatcggccgctttggttcttacgcgccaactgagaaaggcgttctctcagcagttgcttacggcgcgacatcaacagttgacattggcaatcaaatcttagaaacgtttggtaatttagtaacaggacaatttaaaataaatatgttggcgggaccagttggtatttatgatatgacagaccaagtggcgaaaaccgggttagttaatttggttcgtttcgctgcgtttttaagcattaatcttgggattgtcaacctgcttccgattccggcacttgacggaggaagactgttgtttctatttattgaagcgattcggggcaaaccgattaacagggaaaaagaagcatttgttgtgtttatcggagtagctttcttaatgcttcttatgctggttgtcacatggaacgatatccagcggctgtttttgtaa

SEQ ID NO: 944 - DNA, 1260 bp, Bacillus sp.
gtgaatactgtgatcgcgtttattcttatttttggaacgctcgtatttttccatgagcttggtcatctcatccttgctcaaagagccggaatactgtgccgggagtttgctatcggcttcggtccgaaaatcttttcgtttaagaaaaatgagaccgtttatacgatcaggcttcttccgatcggcggctttgtcagaatggccggcgaagatcctgagatgattgaagtgaagcccggttatacggtcgggctgttgttcgacagcgaaaacaaggtcgaaaagatcattatcaaccaaaaagaaaagtatcccgacgcattggtcattgaagtggagcaggccgacctggagcaccagatgaggattacgggctatgagcacggcaatgaagatcatctctcttcattttctgtcagtgaaacgtcctttttcatcgtagacggggaagaagtccagatcgctccttacaaccgccaatttcattcgaaaacggtttggcagcgcatcaaagcgattgctgccggaccgatcatgaactttattttggcttatgtcatactcgtgatgctcggactgatgcagggagtgccgtctgacgagccggtgctcggcaagttgatagacaacggacgggcggcggaagcaggcctccaggagggagaccgcattcaaacgatcaacggggagaacatgaggtcgtggacggatattgtcaacacggtcagagaacaccctgaaaaagaactgaaaatcgttttgatgcgcgacaatgtcaagctgacgaaatacgtaacacctgaagctgtcaaggcaggggatgaaaccgtcggcagattcggcgcttacaatcctgtgaaaacaggcgttctgacatcgatttcctacggtgcgaccgaaacggcgacagtggcccagagcatcgtcaccaatctcggaaagctcgtcacaggacaattctcaatcgacatgctggccggtcctgtcggcatttatgacatgacagaccaagtggccaggacaggcgttatcaacctgctgaagctggccgcatttttaagcatcaacctcgggatcgtcaaccttctgccaatccctgcgctggacggcggaagactgttgttcctgtttattgaagcgatccgcgggaagccgatcaaccgcgaaaaagaagcgtttgtcgtctttatcggcgtcgcatttttgatgctcctaatgcttgtcgtcacatggaacgatatccagcgcttatttctgtaa

SEQ ID NO: 945 - DNA, 1065 bp, Bacillus sp.
atggctggcgaagatccggaaatgattgaggtgaaacccggttacacggtcgggcttctgtttaataaagaagatcaagttgagaaagtcatcatcaatcaaaaggaaaaatacccggatgctttagtcatcgaagtggaaacagcggatttagagcatgacatgaagatcacaggctatgaacaggggaaagaggatgagctttccagctttactgtcagccaaacatcctttttcattgtagacggagaagaagtgcagattgcgccgtataatcgccaatttggttccaaacctgtgtggcagcggattaaagcgattgctgcagggccgattatgaactttattttagcttacgtcattttagtgatgcttgggctgattcaaggcgtgccgtcaaatgagcctgtgctcgggcagctgactgacaatggccgggcggccgaagcggggctaaaagaaggggattacatccaaagcattaacggagagaaaatgaggtcttggactgacattgtctccgctgtaaaagaaaatccggaaaaagaaatggatgttgccgtaaaaagaaataacaaaacgcttcatattgcagtgactccggaagctgtgaaggatgagaacaaaaaaacaatcggacgtttcggttcctatgcgccgactgaaaaaggtgttctctcagcggttgcttacggcgcgacatcaacagttgatgtcaccaaagccattttaaccaacttaagcaaattagtaacaggccaatttaaacttgatatgctgtcaggtcctgtcggcatatatgacatgacagaccaagtggcgaaaacagggttagtgaacttattccagtttgctgcgtttttaagcattaaccttgggattgtcaacttgcttccgatcccggcacttgacggaggaagactgttattcctatttattgaagcgattcggggcaaaccgattaacagggaaaaagaagcatttgttgtgtttatcggggtagctttcttaatgcttcttatgctggtcgtcacatggaatgatatccagcggctgttcttgtaa

SEQ ID NO: 946 - DNA, 1260 bp, Bacillus sp.
gtgaatacagtgattgcgtttattattatttttggaacgctcgtttttttccacgagcttggccatttaattatggcgcagcgcgcaggcattttatgccgcgagttcgcaattggttttggaccgaagattttctcctttaaacgaaaagaaaccgtctataccatcagacttctgccaatcggcggatttgttaaaatggctggagaagatcctgaagtcattgaaattaaaccgggtcatacagtggggctcttattcaatgagcaaaatgaagtagaaaaaatcattttaaatgataaagagaaatatcctgatgcacttgtcattgaagttgaacaaattgatttagatcatgcgatgagaatttcaggatatgaggctggaaatgaagacattctgactggttacaatgtaagccaaacaagcttctatattgcagatggtgaagaaattcaaattgcgccatacaaccgtcagtttggttcaaaaacagtatggcagcgtattaaagccattgcagctggaccgattatgaactttatcctggcatatgtgattctagtggctttaggatttattcaaggtgtaaccgtggatgatcctgtacttggtaagctgacaaaagacggccgggcagcgcaagctgggcttatgcagggagatcatatcgtttcaattaacggggataaaatgaattcttggacagacgttgttcaaacggttcaaaagaacccagataaaaaaatgaatgtcgtcattgaccgagatggcaaagaaagcaccattcaagttgtaccggaagctgtgaaggccgaaggaaaaaccattggccgttttggctcttatccgccaacagaaaatggctttctcaaagtcatctcatcctcaggaacgacagtgatatcaacagcaggtctcatcttaacgaacttgcaaaagattgtcacaggacaattttcattagatatgcttgcaggtcctgttggaatatatgacatgacaggagaagtagcgaaacaaggtgtgttaacattaatgcagtttgctgcgtttcttagtatcaacttagggatcgtgaatttattaccgattcctgcattagacggaggaagattacttttcctattcgttgaagccattcgcggcaaaccaattaatcgtgagaaagaggcacttgttgtcttcattggtgttgcgttcctcatgctattaatgctagtagtgacatggaatgacatccagcgattatttttataa

SEQ ID NO: 947 - DNA, 1260 bp, Bacillus sp.
gtgaatacagtgattgcgtttattattatttttggaacgctcgtttttttccacgagcttggccatttaattatggcgcagcgcgcgggtattttatgccgcgagttcgcaattggttttgggccgaagattttctcctttaaacgaaaagaaaccgtttataccattagacttctacctatcggtggatttgtcaaaatggctggagaggaccctgaagtcattgaaattaaaccaggtcatacagtggggctcttattcaacgagcaaaatgaagtagaaaaaatcattttaaatgataaagagaaatatcctgatgcacttgtcatcgaggtcgagcagatagatttagatcatgccatgagaatctcaggatatgaagctggaaatgaagatattctgactggttacaatgtaagtcaaacaagcttctatattgcagatggtgaagaaattcaaatcgcaccatacaatcgtcaatttggttcaaaaacggtatggcagcgtattaaagctatcgcagctggaccgatcatgaactttatcctggcatacgtgatattagtcgctttaggttttattcaaggtgtaaccgtagatgatcctgtgctcggtaagctcacgaaagatggccgagcggcgcaagctggtctcatgcagggggatgaaatcgtttcgattaatggggataaaatgaattcttggacagacgtggttcaaacggttcaaaaaaaccccgagaaaaaaatgaatgtcgtcattgaccgagacggcaaagaaagcaccgtgcaggttgtaccagaagctgtgaaagcagacgggaaaaacattggccgttttggatcatatccgccaacagaaaatggatttctaaaagtcatttcatcttcaggaacgactgtgatatcaacggcaggtctgatcttaacgaacttgcaaaaaattgtcacaggacaattttcattagatatgctggcaggtcctgtcgggatctatgacatgacaggagaagtagccaaacaaggtgtgttaacattaatgcagtttgcggcgttcctcagcatcaacttaggaatcgtcaatttattaccgattcctgcattagacggagggcgtttacttttcttatttgttgaagccattcgcggtaaaccaattaatcgtgagaaagaagcacttgttgtcttcatcggtgttgctttcctcatgctgttaatgctagtggttacgtggaatgacatccagcgattatttttataa

SEQ ID NO: 948 - DNA, 1266 bp, Bacillus sp.
atgttcgtgaatacagtgattgcgtttattattatttttggaacgctcgtttttttccacgagcttggccatttaattatggcgcagcgagcggggattttatgccgtgagttcgcaattggttttgggccgaagattttctcctttaaacgaaaggaaaccgtttataccattagactgctccctattggcggatttgttaaaatggcgggagaggaccctgaagtcattgaaattaaaccaggtcatacagtggggctcttattcaatgagcaaaatgaagtagaaaaaatcattttaaatgataaagaaaaatatcctgatgcacttgtcatcgaagtggagcagattgatttagatcacgccatgagaatctcaggatatgaagctggaaatgaagatattttgactggttacaatgtcagtcaaacaagtttttatattgcagatggtgaagaaattcaaatcgcaccatacaatcgtcaatttggatcaaaaacggtatggcagcgtattaaagcgatcgcagctggaccgattatgaactttatcttggcgtatgtgattttagttgctttaggatttattcaaggggtcaccgttgatgatcctgtactcggtaagctgacgaaagacggccgagcggcagaagctggactcatgcagggagaccacatcgtgtccattaacggggataaaatggattcttggacagatgtcgttcaaaccgttcaaaagaaccctgagaaaaaaatgaatgtcgtcattgaccgagacggcaaagaaagcactgtacaggttgtaccagaagctgtgaaagcagacgggaaaaacattggccgtttcggatcttatccgccaacggaaaatggatttctgaaggttatttcatcctcaggaacaactgtgatttcaacagcaggtttgattttaacgaacttgcaaaagattgtcacagggcaattttcattagatatgttagcaggtcctgttgggatctatgacatgacaggagaagtagctaagcaaggtgtgttaacattaatgcagtttgcggcgttccttagtatcaacttaggtatcgtgaatttattgccgattcctgcactagacggaggacgtttactcttcttgtttgttgaagccattcgcggtaaaccaattaatcgtgagaaagaagcacttgttgtctttatcggtgttgcattcctcatgctgttaatgctagtggttacgtggaatgacatccagcgattatttttataa

SEQ ID NO: 949 - DNA, 312 bp, Bacillus sp.
atggcgaaagaatctattatatttgtcgggctgtttactgcaattttaagtgccgctattttacttgtctcatgtgcggggaatgatcattccctcagccaatatgttaaaataaaggttcaggacggcgatacactctggtcacttgcggatcatgtagcagaaaagaaacatattaataaagaagatttcattgagtgggtgacggagaataatcatctccaaactgctgatataaagcccggagacgaacttattcttccggttaagaagaagcatccggccgtatatcagctggccattgtcaattag

SEQ ID NO: 950 - DNA, 312 bp, Bacillus sp.
atggcgaaggaatctatcatatttgtcggactgtttactgcgattttaagtgccgctattttacttgtttcatgcgcggggaatgatcagacgctcagccaatatgttaaaataaaggttcaggacggcgatactctctggtcacttgcggatcatgtagcagaaaagaaaaatattaataaagaagatttcattgagtgggtgacggagaataatcatcttcaaactgctgatataaagcccggagacgaacttattcttccggttaagaagaagcatccggccgtatatcagctggccattgttaattag

SEQ ID NO: 951 - DNA, 312 bp, Bacillus sp.
atggcgaaggaatctatcatatttgtcggactgtttactgcgattttaagtgccgttattttacttgtttcatgtgcgggaaatgatcaggcgctcagccaatatgttaaaataaaggttcaggacggagatactctgtggtcacttgcggatcaagtagcagagaagaaaaatattaacaaagaagattttattgagtgggtgacggagaataatcatctccaaactgctgatataaagcccggagacgaacttattcttccggttaagaaggagcatccggccgtatatcagctggccattgtcaattag

SEQ ID NO: 952 - DNA, 648 bp, Bradyrhizobium sp.
atgccgtcatcgcagccgatccgccaggcgcgaccatggctcgcattcctgctgctactggcgggtagcggagctgcccccgcagcaccattgccgacggcgtcgttgcatgtcggcacgacgtacgcacgttggctttggcccgtacaagcggtgcgcgggcagaccaataccgcgagtgtgtcgcttcagatccggccgagcgagaccgtcaatgtcggcggcaaggtctcgttcggcgtcaccgccaggaagaccggatatctcattttggtcgatgtcgacgcggaagggcggatgtcccagatctttccgacccccgagctattggcgcagtcgaacgaacgcgacatcaatctcgtcaagccgggtgtcgaatttgttgttcctgccccggcggcgcgacagcgtggttttgaatatatcgtcgcaccgccgacggggtccgcagtgatgatcgccatcctgagcgagcgacgcgtgcaattgctcgatttgccggacatgccccgcaagctggaaggtcaggccgacgcgttgagctatctatcggcctggaccagcgagctacgcgtgccggacagcagcagcggaaagctggtgacgaacaattggtcgttcgacgtcaaatcttattccatcaagtga

SEQ ID NO: 953 - DNA, 648 bp, Mesorhizobium sp.
atgccgtcatcgcagtcgatccgccgcaagcgagcatggttcgcattcctgctgctacaggcgggcagcggacctgcgtccgcagcaccgttgccgacgggggcgttgcatatcggcacgacgtacgtaccttggctttggcccgcacaagcggtgcgcaggcagaccaataccgcgagtgtgtcccttcagatcctgccgagtcagaccgtcaacgtcggcgccaaggtctcgttcggcgtcaccgccaggaggcctggatatctcattctggttgacgtcgactcggaagggcggatgtcccagatctttccgacccccgagctattggcgcagtcgaacgaacgcgacattaatctcgtcaagccgggtgtcgaatttgtcgtccctgctccggcggcgcggcagcgtggttttgaatatgtcgtcgcaccgccgacggggtccgcagtgatgatcgccatcctgagcgagctgcgcgtgcaattgctcgatttgccggacatgcctcgcaagctggaaggtcaggcggacgcgttgagctatctatcggcctggaccagtgagctgcgcgtgccggacaacagcagcggaaagcttgtgacgaacaattggtcgttcgacgtcaaatcctattccatcaagtga

SEQ ID NO: 954 - DNA, 648 bp, Bradyrhizobium sp.
atgccgtcatcgcagccgatccgccgggagcgaccatggctcgcattcctgctgctgctggcgggtagcggagcttcgtccgcagcaccgttgccgtcggcatcgctgaatgtcggcacgacgtatgcaccctggctttggcccgtacaagcggcgcgcaggcaggccaataccgcgagtgtgtcccttcagatcctgccgggtcagaccgtcaacctcggcggcaaggtcacgttcggcgtcaccgcgaggaagccgggatatctcattctcgtcgacgtcgacgcggaagggcgaatgtcccagatctttccgactcccgagctattggcgcagtcggacggacgcgacatcaatctcgtcaagcccggcgtcgaatttgtcgttccaaccccggcggctcggcagcgtggttttgaatatgtcgtctcaccgccgactgggtcagcagtgatgatcgccatcctgagcgagcggcgggtgcagttgctcgatttgccggacttgccgcgcaagctacaagatcaggccgaggcgttgagctatctaacggcctggaccagtgagctgcgcgtgccggacaacggcagcggaaagctggtgacgaataattggtcgttcgacgtcaaatcctattccatcaagtga

SEQ ID NO: 955 - DNA, 648 bp, Bradyrhizobium sp.
atgccgtcatcgcagccgatccgccgggggcgaccatggctcgcattcctgctgctgctggcgggtagcggagcttcgtgcgcagcaccgttgccgtcagcatcgctgaatgtcggcacgacgtatgcaccctggctttggcccgtacaagcggcgcgcaggcaggccaataccgcgagtgtgtcccttcagatcctgccgggtcagaccgtcaacctcggcggcaaggtcacgttcggcgtcaccgcgaggaagccgggatatctcattctcgtcgacgtcgacgcggaagggcggatgtcccagatctttccgactcccgagctattggcgcagtcggacggacgcgacatcaatctcgtgaggcccggcgtcgaatttgtcgttccaaccccggcggctcggcagcgtggttttgaatatgtcgtctcaccgccgactgggtcagcagtaatgatcgccatcctgagcgagcggcgggtgcagttgctcgatttgccggacttgccgcgcaagctacaagatcaggccgaggcgttgagctatctaacggcttggaccagtgagctgcgcgtgccggacagcggcagcggaaagctggtgacgaataattggtcgttcgacgtcaaatcctattccatcaagtga

SEQ ID NO: 956 - DNA, 663 bp, Bradyrhizobium sp.
atgtggcgatcggagctgatccgccgtaaacgagtatgcttcgcattcgccctgctgctggcgggaagcggggccgcgcccgcagcgccgctgcggcccgaatctctacatgcgagcctggcgagcgcaccatggtcttggcgcatccaggcgacgcgcggacagtccagcgccgcgcagagcaatgctgcaagtgtgtcccttgagatcctgcccagcctgaccgtcaacgttggcggcaaggtgtcattcggcgtgactgcgaagaaggcaggctatctcattctggtggatgtcgatgcggacggacggatgtctcagatctttccgacacccgaattgttggagcagtccgacggccgcgacatcaatctcgtcaagcccggcgtgcaatttgttgtgccgaccccggcagggcggcaacgtggctttgaatatgtcgtcgcaccgccgaccggctcggccgtcatggttgcgatcctgagtgaacggcgcgtgcaattgctcgatttgccggatctcccgcgcaaactacagaatcaagccgatacgttgagctacctgtcggcgtggacgagtgagctgcgtgtgccggacggcggcagcggaaaactggtgccgaacaattggtcgttcgacgtcaagtcctattccatcaagtga

SEQ ID NO: 957 - DNA, 651 bp, Bradyrhizobium sp.
atgccgcgatcgaagcagatccgtcaagcgcgatcatggctcagcgttctgctgctgatggttgcaagcgtagggagcgtgtctgcggcaccgctgtctttgagatcgccccatctcagcatggcgaacaccccatggttattgcccgtacaggcgcagcgtggacaggccaatacggcaagcgtgtctcttgaaataagaccgagtcagaccgtcaacgtcggcagcaaggtgtcgttcggtgtgaacgccagaaagccgggatatctccttctggtcgatgtcgatgcggaagggcggatgtcccagatctttcccactcccgagctgttggcgcagtcggacggacgcgacatcaatctcgtcaagcccggcgtcgaattcgtggttccgactccggcggcgcagcagcgcgggtttgagtatgtcgtctcacccccaggagggaccgctgtgatcgtcgcgatcctgagcgagcgtcgtgtgcaactgctcgatctgccggacctgccccgcaagctgcaaggccaggccgaggccttgagctatctgtcggcctggacccgcgagctgcgcgtgccggacggcgacagcggaaagctggtctcgaacgtctggtcgttcgacatcaagtcttattccatcaagtga

SEQ ID NO: 958 - DNA, 663 bp, Bradyrhizobium sp.
atgtggcgatcggagctgatccgccgtaaacgagtatgcttcgcgttcgccctgctgctggcgggaagcggggccgcgcccgcggcgccgctgtggccggaatctctacatgcgagcctggcgagcgcaccatggttttggcacatccaggcgacgcgcggacagtccagcgccgcacagagcaatgctgcaagtgtgtcccttgagatcctgcccagcctgaccgtcaacgttggaggcaaggtgtcattcggcgtgactgcgaagaaggcaggctatctcattctggtggatgtcgatgcggacggacggatgtcccagatctttccgactcccgaattgttggaacagtcggacggccgcgacatcaatctcgtcaagccaggcgtgcaatttgttgtgccgaccccgtcagggcggcaacgtggctttgaatatgtcgtcgcgccgccgaccggctcggccctcatggttgcgatcctgagtgaacggcgcgtgcaattactcgatttgccggatctcccgcgcaaactacagaatcaagccgatacgttgagctacctgtcggcgtggaccagggagttgcgtgtcccggacggcggcagcggaaaactggtgccgagcaattggtcgttcgacgtcaaatcctattccatcaagtga

SEQ ID NO: 959 - DNA, 645 bp, Bradyrhizobium sp.
atgtcgccagcggaactggtttgccgcaagcaatcatggttcgcgttcgtgctgctgctggcgggaagcggggccgcgtcggcggcgccgccgccatcggcctcatcggcgggtgcgacgaatgctccgttgctctggcgcgtacaggccccgcgcggcccggcaaatgctgccggcgtgtcgcttgagatcctgccgggtccaactgtcaacattggcggcaaggtgtcgttcggcgtaaccgccaggaagcccggctatctgatgctggtggatgttgatgcggaagggcggatgagccagatcttcccgactgccgagctattggcgcagtcggtcggacccgacatgaatcttgtcaagcctggcgtccaattcatcgttccgaccccggcggcacagcaacgtggatttgaatatgtcgtcgcgccgccggccgggtccgccgtgatcgttgcgatcctgagcgagcgacgtgtgcaattgctcgatttgccggacattcagcgcaagcttcaagggccggccgacacgttgagctatctgtcggattggaccagtcagctgcggataccggacagcggcggcggaagactgttgccgaacaattggtcgttcgacatcaaatcatattccatcaagtag

SEQ ID NO: 960 - DNA, 648 bp, Bradyrhizobium sp.
atgtcgccagcggaactggtttgccgcaagcaatcatggcttgcgatcgtgctggtgctggcgggaagcgaggtcgcgtgcgcggcgccgctgccatcggcatctccatctgcaggtgcgacgaacgctcaatcggtccggcgcgtacaggccccgcgcagcccggcaaatgccgccagcgtgtcgcttgaaatcctgccgggtccaactgtcaacattggcagcaaggtgtcattcggcgtcaccgccaggaagcctgggtatctcatgctggtggatgtcgatgcggaagggcgcatgtcccagatctttccgactgccgagctattggcacagtcggtcggagccgacatgaatcttgtcaagcctggcgtccaattcattgttccgaccccggcggcacagcaacgcggatttgagtatgtcgtcgcgccgccggccgggtccgctgtgatcgttgcgatcctgagcgagcggcgtgcgcaattgctcgatttgccagacattcagcgcaagcttcaggggccggccgatacgttgagctatctgtcggattggaccagtcagctgcgtgtaccggacagcggcagcggaaaactggtgccgaacaattggtcgttcgacatcaaatcatactccatcaagtag

SEQ ID NO: 961 - DNA, 249 bp, Bradyrhizobium sp.
atgatcaccaagaagcttctcgccgccgtcggcgtggtttccctgctggctgttccggcaatggccgatagcaccgacaaggaaaagaacggtcatcactacagcggtggccccaagaccgaagtaccgcatcacatgggcaagaagacaacaagcggctcctcggcgaagaccagttcgggcggtcatcattacacgggcggaccgaacacctcgtcgccgcatcacatgggcgacaagacaaagtga

SEQ ID NO: 962 - DNA, 252 bp, Bradyrhizobium sp.
atgatcacgaagaagttcctggcagccgtcggcattctttcgctgttggccgttcctgcgatggcccagaccaccgacaaggaaaagaacggccatcattacagcggaggcccgaagaccgaggtcccgcaccacatgggcaagaaggagacggtcggctcctcgaagggctccacttcggcaggccaccactacactggcggcccgagcacgtctgctccccatcacatgggcgaaaagaaggatcagtga

SEQ ID NO: 963 - DNA, 645 bp, Bradyrhizobium sp.
atggcgcgcagagttatgaggcgtgctcaaggccgaagtcggcggcgagcatcgctgcgctgcgagcgcttgcaaaatcacaaggagtttcaattgtgtaggagttcgtggcttggttctggatggcgcggtcgcccagtactcatctgcgaacccggccccgtttcggctggccaacaccgccttttcgagcaaatctctactgccctgatcccgatcgaggtgtcgtcgattcgtcggagatcgggtggtcggctgacggcaggccggccgagccgacctgccgaaaccgagaagcccgccgcggcggtgttgccgccgcgagaacgggcgcgatccttattactttttgtcgcccatgtggtgcggcgacgaagcggggccgcccgtgtagtgatggccaccggacgcgccgtccttcgaaacgccgaccgtctccttcttgcccatgtggtgggggacctcggtcttcggaccaccgctgtaatgatggccgttcttttccttgtcggtggtctgcgccatcgccggcaccgccaacagggaaacgatgccgatcgcagccaagagcttcttcgtgatcatgtccgttctcccggattgtggacccgccatcatgaggcgcagccgggctttccgctttga

SEQ ID NO: 964 - DNA, 243 bp, Bradyrhizobium sp.
atgatcacgaagaagctcttggctgcgatcggcatcgtttccctgttggcggtgccggcgatggcgcagaccaccgacaaggaaaagaacggccatcattacagcggtggtccgaagaccgaggtcccccaccacatgggcaagaaggagacggtcggcgtttcgaaggacggcgcgtccggtggccatcactacacgggcggccccgcttcgtcgccgcaccacatgggcgacaaaaagtaa

SEQ ID NO: 965 - DNA, 246 bp, Bradyrhizobium sp.
atgatcaccaagacactgctggctgccgttacggccgccctgattgcgctccccgccgtggcgcaaactgcggataaagaaaagaacggccaccattacagtggcggtccgaagaccgaggtcccccaccatatgggtcccaaggaggcggtcggctcctccaagaagacgacctcaggaggtcaccactacacgggcggtccgtcgacatcgaatccgcatcacatgggcgacaaggacaagtga

SEQ ID NO: 966 - DNA, 246 bp, Bradyrhizobium sp.
atgatcatcaggacattgttcgccgcaataactgccgcgtcgctcgcggtgcccgcgacggctcagactgccgacaaggaaaagaacggccaccactacagcggtggtccgaagaccgaggtcccccaccacatgggcccgaaggatacggccggctcctccaagaagacgacctccggaggtcaccactacaccggcggtccatcgacatcgaatccccaccacatgggcgacaaggacaagtga

SEQ ID NO: 967 - DNA, 342 bp, Brevibacillus sp.
atgttttataatccgtatgattataatccgcattatgatgacccgtatcattatgtagaagttcagcatcgtgtgaatcgtttttttgaacatatagacggaaacggtgcgtctttcactctgaactcgggagaaagattgtcatacgtgggggatgcttggaacgacagaatttcgtctgtacgtgtcgcacctaaaacgcttgttgttttatatgagcatataaattttacaggtagaaaaaagctgcttgaaaattcaagtaatcgatcccatctcttcaacattcacgaagattttaatgatatcacttcttctattaaaacttttcgactctgctaa

SEQ ID NO: 968 - DNA, 342 bp, Brevibacillus sp.
atgttttataatccgtatgattataatccccattatgatgacccgtatcattatgtagaagttcagcatcgtgtgaatcgtttttttgaacatatagacggaaacggtgcgtctttcactctcaactcgggagatagattgtcatacgtgggggatgcttggaacgacagaatttcgtctgtacgtgtcgcacctaaaacgcttgttgttttatatgagcatataaattttacaggtagaaaaaagctgcttgaaaattcaagtaatcgatcccatctcttcaacattcacgaagattttaatgatatcacttcttctattaaaacttttcgactctgctaa

SEQ ID NO: 969 - DNA, 522 bp, Brevibacillus sp.
ttgaaaaagaatatatcagataagagaactgagaaaatagctgatttggctaactctggcctcttaaaaagctcctattccccatctttcctcatattaaaaaatacctgtgtcaatgcacagatatggcaattaggcatacagtgtatgaattacaaaaaaagtattggagagatgttcatgttttataatccgtatgattataatccgcattttgatgacccgtatcattatgtagaagttcagcatcgtgtgaatcgtttttttgaacatatagacggaaacggtgcgtctttcactctcaactcgggagatagattgtcatacgtgggggatgcttggaacgacagaatttcgtctgtacgtgtagcacctaaaacgcttgttgttttatatgagcatataaattttacaggtagaaaaaagctgcttgaaaattcaagtaatcgatcccatctcttcaacattcacgaagattttaatgatatcacttcttctattaaaacttttcgactctgctaa

SEQ ID NO: 970 - DNA, 417 bp, Brevibacillus sp.
atgtcttggagaaaatctacactatttggtggcagtggcggtagccccttcaatgatgatcatactgatgtgaaaagattagcaggcttctacattcgtcatggcagtagaattgatgctattcagggtatttacgattatttagatggaagaagagccccacaagaattccatggaggaaatggaggcactcaagccattgttttctttgaagatgatgagtatatcatccggattactggtcgcactggtagccgtgtagatcaacttaccattacgacaaataagcgtacgtatggttcttacggtggaaacgggggaagtccctttgagattgacgctgcaaatattggtggtttctttggaagatcgggaagtgaaattgatgccataggattttttatacctacatcctaa

SEQ ID NO: 971 - DNA, 954 bp, Brevibacillus sp.
atgaaaaaatttgcaagtttaattcttataagtgtgttccttttttcgagtacgcaatttgttcatgcgtcatccacagatgttcaagaaagattacgggacttggcaagagaaaatgaagctggaacccttaatgaagcatggaatactaacttcaaacccagtgatgaacaacaattctcttatagtccaactgaaggaattgttttcttaacaccacctaaaaatgttattggcgaaagaagaatttcacagtataaagtaaataatgcatgggctacattagaaggaagtccaaccgaagtatcggggacacctttatatgcgggaaaaaacgtattagataactcaaaaggaacaatggatcaagagctgttaacaccagagtttaactatacctatacggaaagcacttcaaatacaacaactcatggattaaaattaggagtcaaaaccactgctaccatgaaattcccgattgctcagggtagcatggaagcttctactgaatataactttcaaaattcttccactgatactaaaactaaacaagtatcatataaaagcccatcacaaaaaattaaagtaccagcaggtaaaacctttagagttttagcatacctaaatactggatctatttcaggtgaagctaacctttacgcaaatgttgggggtatagcttggggggttttaccaggttatcccaatggcggaggaataaatataggtgctgtacttaccaaatgccaacaaaaaggatggggagatttcagaaactttcaacctagtggaagagatgtaatcgttaaaggccaaggtactttcaaatctaattatggaacggacttcattttaaaaattgaagacatcacagattcaaagttacgaaacaataacgggagtggaactgtcgttcaagagattaaagttccactaattagaactgaaatatag

SEQ ID NO: 972 - DNA, 954 bp, Brevibacillus sp.
atgaaaaaatttgcaagtttaattcttataagtgtgttccttttttcgagtacgcaatttgttcatgcgtcatccacagatgttcaagaaagattacgggacttggcaagagaaaatgaagctggaacccttaatgtagcatggaatactaacttcaaacccagtgatgaacaacaattctcttatagtccaactgaaggtattgttttcttaacaccacctaaaaatgttattggcgaaagaagaatttcacagtataaagtaaataatgcatgggctacattagaaggaagtccaaccgaagtatcggggacacctttatatgcgggaaaaaacgtattagataactcaaaaggaacaagcgatcaagagctgttaacacccgagtttaactatacctatacggaaagcacttcaaatacaacaactcatggattaaaattaggagtcaaaaccactgctaccatgaaattcccgattgctcagggtagcatggaagcttctactgaatataactttcaaaattcttccactgatactaaaactaaacaagtatcatataaaagcccatcacaaaaaattaaagtaccagcaggtaaaacctatagagttttagcatacctaaatactggatctatatcaggtgaagctaacctttacgcaaatgttgggggtatagcttggggggttttaccaggttatcccaatggcggaggaataaatataggtgctgtacttaccaaatgccaacaaaaaggatggggagatttcagaaactttcaacctagtggaagagatgtaatcgttaaaggccaaggtactttcaaatctaattatggaacggacttcattttaaaaattgaagacatcacagattcaaagttacgaaacaataacgggagtggaactgtcgttcaagagattaaagttccactaattagaactgaaatatag

SEQ ID NO: 973 - DNA, 954 bp, Brevibacillus sp.
atgaaaaaatttgcaagtttaattcttataagtgtgttccttttttcgagtacgcaatttgttcatgcgtcatccacagatgttcaagaaagattacgggacttggcaagagaaaatgaagctggaacccttaatgaagcatggaatactaacttcaaacccagtgatgaacaacaattctcttatagtcccactgaaggtattgttttcttaacaccacctaaaaatgttattggcgaaagaagaatttcacagtataaagtaagtaatgcatgggctacattagaaggaagtccaaccgaagtatcggggacacctttatatgcgggaaaaaacgtattagataactcaaaaggaacaatggatcaagagctgttaacacccgagtttaactatacctatacggaaagcacttcaaatacaacaactcatggattaaaattaggagtcaaaaccactgctaccatgaaattcccgattgctcagggtagcatggaagcttctactgaatataactttcaaaattcttccactgatactaaaactaaacaagtatcatataaaagcccatcacaaaaaattaaagtaccagcaggtaaaacctatagagttttagcatacctaaatactggatctatatcaggtgaagctaacctttacgcaaatgttgggggtatagcttggggggttttaccaggttatcccaatggcggaggaataaatataggtgctgtacttaccaaatgccaacaaaaaggatggggagatttcagaaactttcaacctagtggaagagatgtaatcgttaaaggccaaggtactttcaaatctaattatggaacggacttcattttaaaaattgaagacatcacagattcaaagttacgaaacaataacgggagtggaactgtcgttcaagagattaaagttccactaattagaactgaaatatag

SEQ ID NO: 974 - DNA, 2511 bp, Burkholderia sp.
atgaaccgaacgctgctcctgaaggccgccctgatcgcggccgccgtgctaccggccgccgccggcgcgcaatccgcccagaccttcaacgcgccgatgccgggcgcacctgccacgcccggcgcgcaggcccggccgcccggcggcatcctcagcccgttcctgctgtcggcccagctcggccgcgacctgatgctgcattacgcgatcgacaacaacaacgcgaacgcggccggcgtgccctgtgccgatctcggcgccgattcggcgagctgcgccaccggccggctgatcctcgagaatcgcggccaggcgcgcatcagcggcgacggctggaagctctacctgcacagcatccggcgcctgctgcgcatcgaccatcccggcttcacgctgcgccacctgacgggcgacctctacgagctgacgcccaagcccggcgcggtcacgctcgcgcccggcgcgcgcctgaccgtgcccttcgtggccgaatactggttcctgcgctacagcgatctgctgccgcgcccctacgtgatcgtctcgggcgcgctgccgaccgtgctgcgccacaacgacaccgatgacgagacgcgctacgtcgattcgctgccggccgacgcgcagagcagctcgaccggcaacgcgccgcccgccgcggtccagccggtggcgtcgcgcgccctgccgagcgtgaagcgcgagcgcctcggcaacgacacggtggagctgcgcggcgtgcagctggcactcaccggcctcgcggccaaccacgtggcggcgctgcgcgagcgcgccggcgagctgggcctgggcggctcgggcctgccggtgcgcggcagcatcgtgccgcaacaactgcccgccgacatcgcgatccccggcggctaccggctctcgatcacgcgccagggcgcaaacatcgaggcctacgaccagaccggcctctactacggcgtgcagacgctgttctcgctgacgccggccggcggcggccggatcccggccatgcaggtggaggacgcgccgcgcttcccgcatcgcggcatgcacgccgacctggcgcgcaacttcaagcacgccgacacgctgcgcaagctgatcgaccagatgagcgcctacaagctcaaccgcctgcacctgcacctgtccgacgacgagggctggcgcatcgagatccccggcctgcccgagctgacggcggtgggctcgcgccgctgccacgatccgagcgagacgctgtgcctgctgccgcagctcggctcggggccggacaaccgctcgggcggcggctacctgcgtcgcgacgaatacgtctcgctgctgcgctacgcggccgagcgcttcgtcgacgtgatccccgagatcgacatgccggcccacgcgcgcgccgcggtgcagtcgatggaggtgcgctaccggctgttccacgcgctcggccgcgagcgcgaggccagcgagtaccggctggtcgatccgcaggacacctcgaacacgctgtcggtgcagttctacgatcgccgcagctatctcaacccctgcgcgcccggctcactgaagttcgccaccaaggtgatccgcgagatcgccgcgatgtacgccgatgcgcaggcgccgctgccgatctggcacttcggcggcgacgaggccaagaacatcctgctcggcgccggcttccagccgctcaacggcaccgacccgaacaagggccgcgtcgaccaggccgcgcaggacctgccctgggcccgctcgccgatgtgcaccgccctgctgcagcgcggcgagatcaagtcgaccgaggagctgccgacgcgcttcgcgcagcaggtcagcgcgcaggtcgcggccaacggcatcggcaccatggcggcctggcaggacggcctcaagcatgccaacggcccgcaggacttcagcacccgcaacaccatggtgacgctgtgggacacgctgttctggggcgccgccgacagcgcgcgggactggagcgcgaagggctatcgcaccgtgctggcgctgcccgactacctctacttcgacttcccctacaccaccaacccgcgtgagcgcggctactactggggctcgcacgcgaccgacgagtacaaggtgttctcgttcgcgccggagaacctgccgcagaacgccgaggtgatcggcgaccgcgacggcaatccgttcgaggtgaccggcaccggcgccgcgccgcgcctggaaggcatgcagggccaggcctggggcgaggtgatgcgcaacgacagcgagttcgagtacatggtgtacccgcgcctgctggcgctggccgagcgcgcctggcatcgcgccgactgggagcgcccgtacgcggccggcgtgcgctacaagctcggcgacacgcacctggtcgacaaggacgcgctgaacaaggattgggccggcttcgccaccgtgctcaagcagcgcgagctgccgaagctgggccgcgccgggatcggctaccgctcgccgaccttcagcctgtccggcagctga

SEQ ID NO: 975 - DNA, 2511 bp, Burkholderia sp.
atgaaccgaacgctgctcctgaaggccgccctgatcgcggccgccgtgctaccggccgccgccggcgcgcaatccgcccagaccttcaacgcgccgatgccgggcgcacctgccacgcccggcgcgcaggccaggccgccgggcggcatcctcggcccgttcctgctgtcggcccagctcggccgcgacctgatgctgcattacgcgatcgacaacaacaacgcgaacgcggccggcgtgccctgcgccgatctcggcgccgattcggcgagctgcgccaccggccggctgatcctcgagaatcgcggccaggcgcgcatcagcggcgacggctggaagctctacctgcacagcatccggcgcctgctgcgcatcgaccatcccggcttcacgctgcgccacctgacgggcgacctctacgagctgacgcccaagcccggcgcggtcacgctcgcgcccggcgcgcgcctgaccgtgcccttcgtggccgaatactggttcctgcgctacagcgatctgctgccgcgcccctacgtgatcgtctcgggcgcgctgccgaccgtgctgcgccacaacgacaccgacgacgagacgcgctacgtcgattcgctgctggccgacgcgcagagcagctcgaccggcaacgcgccgcccgccacggtccagccggtggcgtcgcgcgccctgccgagcgtcaagcgcgagcgcctcggcaacgacacggtggagctgcgcggcgtgcagctggcactcaccggcctcgcggccaaccacgtggcggccctgcgcgagcgcgccggcgagctgggcctgggcggctcgggcctgccggtgcgcggcagcatcgtgccgcaacaactgcccgccgacatcgcgatccccggcggctaccggctctcgatcacgcgccagggcgcgaacatcgaggcctacgaccagaccggcctctactacggcgtgcagacgctgttctcgctgacgccggccggcggcggccggatcccggccatgcaggtggaggacgcgccgcgcttcccgcatcgcggcatgcacgccgacctggcgcgcaacttcaagcacgccgacacgctgcgcaagctgatcgaccagatgagcgcctacaagctcaaccgactgcacctgcacctgtccgacgacgagggttggcgcatcgagatccccggcctgcccgagctgacggcggtgggctcgcggcgctgccacgatccgagcgagacgctgtgcctgctgccgcagctcggctcggggccggacaaccgctcgggcggcggctacctgcgccgcgacgaatacgtctcgttgctgcgctacgcggccgagcgcttcgtcgacgtgatccccgagatcgacatgccggcccacgcgcgcgccgcggtgcagtcgatggaggtgcgctaccggctgttccacgcgctcggccgcgagcgcgaggccagcgaataccggctgatcgatccgcaggacacctcgaacacgctgtcggtgcagttctacgaccgccgcagctatctcaacccctgcgcgcccggctcgctgaaattcgccaccaaggtgatccgcgagatcgccgcgatgtacgccgatgcgcaggcgccgctgccgatctggcacttcggcggcgacgaggccaagaacatcctgctcggcgccggcttccagccgctcaacggcaccgacccgaacaagggccgcgtcgaccaggccgcgcaggacctgccctgggcccgctcgccgatgtgcaccgccctgctgcagcgcggcgagatcaagtcgaccgaggaattgccgacgcgcttcgcgcagcaggtcagcgcgcaggtcgcggccaacggcatcggcaccatggcggcctggcaggacggcctcaagcatgccaacggcccgcaggacttcagcacccgcaacaccatggtgacactgtgggacacgctgttctggggcgccgccgacagcgcgcgggactggagcgcgaagggctatcgcaccgtgctggcgctgcccgactacctctacttcgacttcccctacaccaccaacccgcgtgagcgcggctactactggggctcgcacgcgaccgacgagtacaaggtgttctcgttcgcgccggagaacctgccgcagaacgccgaggtgatcggcgaccgcgacggcaatccgttcgaggtgaccggcaccggcgccgcgccgcgcctggaaggcatgcagggccaggcctggggcgaggtgatgcgcaacgacagcgagttcgagtacatggtgtatccgcgcctgctggcactggccgaacgcgcctggcatcgcgccgactgggagcgcccgtacgcggccggcgtgcgctacaagctcggcgacacgcacctggtcgacaaggacgcgctgaacaaggactgggccggcttcgccaccgtgctcaagcagcgcgagctgccgaagctggggcgcgccgggatcggctaccgctcgccgaccttcagcctgtccggcagttga

SEQ ID NO: 976 - DNA, 2496 bp, Burkholderia sp.
atgaaccgactcattccgtccatcgtcgccggcctgctggtcgccgcgctgcctgcgtgcgcgaccttcgcccaatccgcgccgcccgcgcctgccgcgccgccggccgccgctgccgccgctgcgtcgcccgccgtatcgccggccgaactcgcggcggtgctgtcgaacggcctcgcgttgcgcgtcgccgtcgacaacaatcatgcagcggcggccggcgtgccgtgcgccgatctcggcgccgacggcgccgcgtgcgcgacgggccgcctgatcctgcagaatcgcggccatcgaacgatcgccgccgccggctggaggctctatctgcacagcatccgccgcctgctgcggatcgaccgtccgggcttcgcgctgcgccggctcaccggcgacctgtacgcgctgacgccgcagcccggcgcgctgcggctcgcgcccggcgagcgcgtcgagctgccgttcgtcgccgaatactggctgcgccgctacagcgacgtgattccgcgcccgtatgtggtcgtcgacggcgcgccgccggccgtgctgcgctacaacgacaccgacgacgaacttcgctacgtcgaatcgctgccggccgacgcgcagaacagttcgaccggcaacgcaccgccggtggcggcccgccccgatccgagccgcgcgttgccgagcgtgaagcggcagcagatgctggccggcgcgctcgagctgcgcggcgtcgagctcgcgttgtccgatctgccggccgcgcaggtcgccgcgctgcgcgaacgcgcgacgacgctcggcctcgacggcacgcgcgtgccggtgcgcggcgccgtcgagccgcgccggctgccggccgacatcgcgacgcccggcggctaccggctcgcgatcgggccgcgcggcgcgctgatcgaaggctacgaccgcgcaggcctctattacggcgtccagacgctgttctcgctggtgccggccggcggcggcacgattccggcgatgctgatcgacgacgcgccgcgcttcgtgcatcgcgggatgcacgtcgacctcgcgcgcaacttcaagcacccggcgacgctgcggcgcctgatcgatcagatgagcgcgtacaagctcaatcgcctgcacctgcatctgtccgacgacgaaggctggcgcatcgagattccgggcctgcccgagctgaccgacgtcggcgcacggcgctgccacgatccgagcgagacgcgctgcctgctgccgcagctcggctccggcccggacaaccgttccggcggcggctatctgacgcgcgacgactacgtcgcgctcgtccgctacgcagccgaccgtttcgtcgaagtgatcccggagatcgacatgcccgcgcacgcgcgcgcggccgtcgtgtcgatggaagcgcgctatcggcgcctgcacgcggcgggccgcgagcaggaagcgaacgcgtaccggctgctcgatccgcaggacacgtcgaacctgctcactgtgcagttctacgatcgccgcagcgatctgaatccgtgcgtgccgggcgcgctcaacttcgcgacgaaggtgattcgcgagatcgcgtcgatgcacgcggacgcgcaagtgccgctgcgcatctggcatttcggcggcgacgaggcgaagaacatcctgctcggcggcggcttccagccgttgaacggcaccgacccgaacaaggggcgcatcgatctcgccgcacaggacaagccgtgggcgcgttcgcccgcgtgcacggcgctgcttcagcgcggcgagatcaagtcgatcgacgagctgccgacgcgtttcgcgaagcaggtgagcgcgatcgttgccgcgaacgggatcggcacgatggccgcgtggcaggacggcatcaagcacgcgaacggaccgcaggacttcagcacgcgccgcgtgatggtgtcgctgtgggacacgatcttctggggcgcgtcggacagcgcgcgcgatctcggcaaccgcggctatctgacggtgctcgcgctgcccgactacctgtacttcgacttcccgtacacgctgaacccgcgcgaacgcggctattactggggttcgcaggcgacggacgaatacaaggtgttctcgctcgcgcccgagaatctgccgcagaacgccgaagtgatcggcgaccgcgacggcaacgcattcgaagtgacgggcaccggcgccgcgccgcgcatcgaagggatccaggcgcaggcgtggggcgaagtgatgcgcaacgatacgttcctcgaatacatggtgtatccgcggctgctcgcgcttgccgagcgcgcgtggcatcgcgccgactgggagctgccgtacacggccggcgtgcgctacaagcgcggcgacacgcaccatgtcgatacggccgcgctgcagcgcgactgggccggcttcgcgacgctgctcaagcagcgcgaactgccgaagctcgaccgtgcggggatcggctaccggaagccgacgttcacggtgacgggcgaatga

SEQ ID NO: 977 - DNA, 2484 bp, unknown
  environmental sample
atgagccgaaccttgtccaccctgtttgccggcgtgctgatcgcggcactgccaccggtcgcgcttggcgcgctgcccgcgtcgagtgcggcggtcgcggcggccggtgccgtccgtccccccgtgccgccggccgatctcgcggcgcggctgtcgaacggcctcgcgctgcgcgtcgccgtcgacaacaatcacgcggcctcggccggcgtgccgtgcgccgacctcggcgccgacggcgcggcctgcgcgacgggccgcctgatcctgcagaaccgcggccaccaggcgatcgccgacggcggctggaagctctacctgcacagcatccgccgcctgctgcgaatcgatcgccccggcttcgcgctgcggcggctcaccggcgacctgtacgaactgacaccgcaacccggctcggtgcggcttgcaccgggcgaacgcatcgaactgccgttcgtcgccgaatactggctgctgcgctacagcgacgtgatcccgcgtccgtacgtggtcgtcgagggcgcgccgcccgccgtgctccgctacgacgacaccgacgacgagctgcgctacgtcgaatcgctgccggccgacgcgcagaacaactcgacgggcaacgcgccgcccgtggccgcacggcccgacccgagccgcgcgctgccgagcgtgaagcgcgagcagccgctgcccggcacgctcgagctgcgcggtgtcgagctcgccctgcccgatctgccggacgcgcaggtcgcggcgctgcgcgaacgtgcgacgacgctcgggctcgacggcgcgcgcgtgccggtgcggggcgccgtcgcgccgcgccggctgccggccgacatcgcgacgccgggcggctaccggctcgcgatcgggccgcgcggcgtgctgatcgagggctacgatcgcgccggcctctactacggcgtgcagacgctctactcgctcgcaccggccggcggcggcccgatcccggcgatgctcgtcgaggatgcgccgcgcttcacgcatcgcgggatgcacgtcgatctcgcacgcaacttcaagcacccggcgacgctgcgccgcctgatcgaccagatgagcgcatacaagctcaatcgcctgcacctgcacctgtcggacgacgagggctggcgcatcgagattcccggcctgcccgaactgaccgggatcggctcgcgccgctgccacgacccgagcgagacgcgctgcctgctgccgcagctcggctccggcccggacaaccgctcgggcggcggctacctgacccgcgacgactacgtggcgctcgtgcgctacgcggccgcgcatttcgtcgagatcgtccccgagatcgacatgcccgcgcatgcgcgcgcggccgtcgtgacgatggaggcacgttaccggcggctgcatgcggccgggcgcgagcaggaagcgaacgcataccggctgctcgatccgcaggacacgtcgaacttgacgacggtgcagttctacgaccgccgcagcgacctgaacccgtgcgtgccgggcgcgctcaatttcgcatcgaaggtgatccgcgagatcgcggcgatgcatgcggatgcgcaggcgccgctgcacatctggcattacggcggcgacgaggcgaagaacatcttcctcggcgcgggcttccagccgctgaacggcaccgatccgaacaaggggcgcatcgatctcgccgcgcaggacaagccgtgggcgcgttcgcccgcatgcacggcgttgctccagcgcggcgagatcaagtcgatcgacgaactgccgacgcgtttcgctcagcaggtgagcgcggcggtcagcgcgaacgggatcgacacgatggccgcgtggcaggacggcatcaagcatgcgaacgggccgcaggacttcagcacgcgccacgtgatggtgtcgctgtgggacacgatcttctggggggcgtcggacagcgcgcgcgacctgagcggcaagggctatctgacggtgctcgcgctgcccgactacctgtacttcgacttcccgtacacgctcaacccgcgcgagcgcggctactactggggctcgcacgcgacggacgagtacaaggtgttctcgctcgcaccggagaacctgccgcagaacgccgaagtgatgggcgaccgtgacggcaacccgttcgaggtcacgggaacgggccccgcgccgcgcatcgaaggcatgcagggccaggcatggggcgaggtgatgcgcaacgacaccttcctcgaatacatggcctatccgcggctgctcgcgctcgccgagcgcgcctggcaccgcgccgactgggagctgccgtatgcggccggcgtgcgcttcaagcgcggcgacacgcatcacgtcgacacggccgcgctgcagcgcgactgggccggtttcgcgacgctgctcacgcaacgcgaattgccgaagctcgaccgggccggtgtcggctaccggaagccgaccttcacgctgacgaatccgtga

SEQ ID NO: 978 - DNA, 2484 bp, Burkholderia sp.
atgaagagcacgttgccctccctgctgaccggcttgctgatcgcggcgctgttgccggccgcgacctgcgccgcgccggtgcaaaccgccgccggcgcgatcgccggcaccgcccgggcggccatgcagccggccgatctcgcggcattgctgtcgaacggcctcgcgttgcgcgtatccgtggacaacaaccacgcggccgcggccggcgtgccgtgtgcggaccttggcgccgacggcgcggcctgcgcgacgggccgcctgttcctgcagaaccgcggccaccagccaatcgccgacggcggctggaaactctacctgcacagcatccgccgcctgctgcgcatcgaccgtccgggcttcgcgctacgccggctcaccggcgacctgtacgagctgacgccgcagccgggatcggtacggctcgcgcccggcgaacgcatcgagctgccgttcgtcgccgaatactgggtgcggcgctacagcgacgtgattccgcggccgtacgttgtcgtcgacggcgcaccgcccgcggtgctccgctacaacgataccgacaacgagcttcgctacgtcgaatcgctgccggccgacgcgcagaacaactcgacgggcaacgcgccgaccgtcgccgcgcggcccgacgcgagccgcgcactgccgagcgtgaagcgcgagcagccgctgcccggcgcgctcgatctgcgcggcgtcgagctcttgctggccgggatgcccgacgcgcaggtcgcggcgctgcgcgagcgcgcgacgacgctcggcctggacggcgcacgcgtgccggtgctcggcgcggtcgcgccgcgccggctgccggccgacatcgcgacgccgggcggctaccggctcgcgatcgggccgcgcggtgtcctcatcgaaggctacgatcgcgcgggcctctactacggcgtgcagacgctgttctcgctcgcgccggccggcggcggcacgatcccggcgctgctcatcgaggatgcgccgcgcttcacgcatcgcgggatgcacgtcgatctcgcgcgcaatttcaagcagccggcgacgctgcgccgcctgatcgaccagatgagtgcgtacaagctcaatcgcctgcacctgcacctgtcggacgacgaaggctggcgcatcgagattcccggcctgcccgagctgaccgacatcggcgcgcgccgctgccacgacccgagcgagacgcgctgcctgctgccgcaactcggctccggccccgacaaccgctcgggcggcggctacctgacgcgcgccgactacgtcgcgctcgtgcgctatgcggccgaccgcttcatcgacgtgattcccgaaatcgacatgcccgcgcacgcgcgcgcggccgtcgtgtcgatggaggcgcgctaccgccggctgcatgcggccggccgcgaccaggacgcgaacgcgtaccggctgctcgatccgcaggacacgtcgaacctgacgacggtgcagttctacgaccggcgcagcgacctgaacccgtgcgtgccgggcgcgctcaacttcgcgtcgaaggtgatccgcgagatcgcgaccatgcatgcggacgcgcaggcgccgctgcgcatctggcactacggcggcgacgaagcgaagaacatcctgctcggcggcggcttccagccgttgaacggcaccgatccgaacaaggggcgcgtcgacctcgccgcgcaggacaagccgtgggcgcgctcgcccgcgtgcacggcgctgctccagcgcggcgagatcaagtcgatcgacgagttgccgacgcgcttcgcgaaacaggtgagcgcggcggtcgactcgaacgggatcggcacgatggccgcgtggcaggacggcatcaagcacgcgaacgggccgcaggacttcagcacgcggcacgtgatggtgtcgctgtgggacacgatcttctggggcgcgtcggacagcgcgcgcgacctgagcggcaagggctaccagacggtgctggcgctgcccgactacctgtacttcgacttcccgtacacgctgaacccgcgcgaacgcggctattactggggctcgcaggcgaccgacgagtacaaggtgttctcgctcgcgccggagaacctgccgcagaacgccgaggtgatgggcgatcgcgacggcaacgcgttcgaggtgaccggcacgggccctgcgccgcgcatcgaaggcatccagggtcaggcctggggcgaggtgatgcgcaacgacacgttcctcgagtacatggtgtatccgcgcctgctcgcgctcgccgaacgcgcgtggcaccgcgccgactgggagctgccgtacacggccggcgtgcgctacaagcgcggcgacacgcaccgcgtcgacacggccgcgctgcagcgcgactgggccggtttcgcgacgctggtcacgcagcgcgaattgccgaagctcgaccgtgccggcatcggctatcggaagccgacttttacgctgacgaacccgtga

SEQ ID NO: 979 - DNA, 2403 bp, Burkholderia sp.
gtgaccgcgacagccgccgccgctccccccgcgtccgcgcccgccacgcccgccgagctcgccgcactgctcgcgaacggcctcgcggtgcgcgtcgccgtcgacaacaatcacgcggcgtccgccggcgtgccgtgcgccgatctcggcgcggactgggcaagctgcgcgacgggccgcctgatcctgcagaatcgcggccacccgcccctcaccgacggcggctggaagctctatctgcacagcatccgccggctgctcaggatcgaccgccccggcttcacgctgcgccatctgacgggcgatctgtacgagctgacgccgcagccgggcacggtgcggctcgcgcagggcgagcggatcgagttgccattcgtcgccgaatactggctgcgccgctacagcgacgtgatcccccgcccgtacgtggtcgtcgacggcgcggcgcccgcagtgctccgctacgacgataccgacgacgagctgcgctacgtcgaaacgctgcccgccgacgcgcagaacaactcgcccggcaatgcgccgcccgctgccgcgcagccggtcgcgaaccgcgcgctgccgagcgtgaagaggcagcgcacgctgtccggcgcgctcgatctgcgcggcgtcgagctgacgctgccggagttgccttccgcgcaggtcgccgcgctgcgcgaccgcgcgggcacgctcggcctcgacggcgcgcgcgtgcccgtgtggggcgccgtcgcgccgcgccggctgcccgccgacatcgcggtgccaggcggctaccggctcgcgattggcccgcgcggcgcgttcatcgagggttacgatcgcgcgggcctctactacggcgtgcagacgctcttctcgctcgtgccggcgggcggcgcgacggtgcccgcgatgctgatcgaagacgcgccgcgcttcacgcatcgcgggatgcacgtcgacctcgcgcgcaacttcaagccgcccgcgacgctgcgccggctgatcgaccagatgagcgcatacaagctcaaccggctgcatctgcacctgtccgacgacgagggctggcgcatcgagattcccggcctgccggagctgaccgacgtcggcgcgcgccgctgccacgatccgggcgagacgcgctgcctgctgccgcagctcggctccggtccggacaaccgctcgggcggcggctatctgacgcgcgacgattacgtcgcgctgctgcgctacgcggccgagcgcttcgtcgaagtgatccccgagatcgacatgcccgcgcactcgcgcgcggccgtcgtgtcgatggaggcgcgctatcgccgcctgcatgcggcggggcgagagcaggaagcgaacgcgtaccgcctgctcgatccgcaggacacgtcgaacctgctgaccgtgcagttctacgaccggcgcagcgatctgaacccgtgcatgccgggcgcgctgaacttcgcgtcgaaggtgatccgcgagatcgcgtcgatgcacgcggacgcgcaagcgccgctgcggatctggcacttcggcggcgacgaggcgaagaacatcctgctcggcgcgggcttccagccgctcgacggcgccgatcccggcaagggccgcgtcgatcttgccgcgcaggacaagccgtgggcgcgctcgcccgcctgtacggcgctgcttcggcgcggcgagatcaaatcgatcgacgagctgccgacgcgcttcgcgaagcaggtcagcgccgtcgtcaacgcgaacggaatcggcacgatggccgcatggcaggacggcatcaagcacgcgagcgggccgcaggatttcagcacgcgcagcgtgatggtgtcgctgtgggacacgatcttctggggcgcgtccgacagcgcgcgcgatctgagcgcgaagggctaccggaccgtgctcgcgctgcccgactacctgtacttcgattttccgtacacgcgcaatccgcgcgagcgcggctactactggggctcgcaggcgacggacgagtacaaggtgttctcgctcgcgccggagaacctgccgcagaacgccgaggtattcggcgatcgcgacggcaacccgttcgaggtgacgagcgcgggcgcggcgccgagcatcgagggcatacaggggcaggcgtggggcgaggtgatgcgcaacgggccactgctcgaatatatggtgtatccgcgcctgctcgcgctcgccgaacgcgcgtggcacaaggccgactgggaactgccctacgcggccggcgtgcgctacaggctcggcgacacgcatcatgtcgacacggccgcgctcgagcgcgactgggcgggcttcgcgacgctgctcaagcagcgcgagctgccgaagctcgagcgcgcgggcatcggctatcgcaagccgacgttcacgctgacgggcgaatga

SEQ ID NO: 980 - DNA, 2397 bp, Burkholderia sp.
cgcgacagccgccgccgctcccccgcgtccgcgcccgccacgcccgccgagctcgccgcactgctcgcgaacggcctcgcggtgcgcgtcgccgtcgacaacaatcacgcggcgtccgccggcgtgccgtgcgccgatctcggcgcggactgggcaagctgcgcgacgggccgcctgatcctgcagaatcgcggccacccgcccctcaccgacggcggctggaagctctatctgcacagcatccgccggctgctcaggatcgaccgccccggcttcacgctgcgccatctgacgggcgatctgtacgagctgacgccgcagccgggcacggtgcggctcgcgcagggcgagcggatcgagttgccattcgtcgccgaatactggctgcgccgctacagcgacgtgatcccccgcccgtacgtggtcgtcgacggcgcggcgcccgcagtgctccgctacgacgataccgacgacgagctgcgctacgtcgaaacgctgcccgccgacgcgcagaacaactcgcccggcaatgcgccgcccgctgccgcgcagccggtcgcgaaccgcgcgctgccgagcgtgaagaggcagcgcacgctgtccggcgcgctcgatctgcgcggcgtcgagctgacgctgccggagttgccttccgcgcaggtcgccgcgctgcgcgaccgcgcgggcacgctcggcctcgacggcgcgcgcgtgcccgtgtggggcgccgtcgcgccgcgccggctgcccgccgacatcgcggtgccaggcggctaccggctcgcgattggcccgcgcggcgcgttcatcgagggttacgatcgcgcgggcctctactacggcgtgcagacgctcttctcgctcgtgccggcgggcggcgcgacggtgcccgcgatgctgatcgaagacgcgccgcgcttcacgcatcgcgggatgcacgtcgacctcgcgcgcaacttcaagccgcccgcgacgctgcgccggctgatcgaccagatgagcgcatacaagctcaaccggctgcatctgcacctgtccgacgacgagggctggcgcatcgagattcccggcctgccggagctgaccgacgtcggcgcgcgccgctgccacgatccgggcgagacgcgctgcctgctgccgcagctcggctccggtccggacaaccgctcgggcggcggctatctgacgcgcgacgattacgtcgcgctgctgcgctacgcggccgagcgcttcgtcgaagtgatccccgagatcgacatgcccgcgcactcgcgcgcggccgtcgtgtcgatggaggcgcgctatcgccgcctgcatgcggcggggcgagagcaggaagcgaacgcgtaccgcctgctcgatccgcaggacacgtcgaacctgctgaccgtgcagttctacgaccggcgcagcgatctgaacccgtgcatgccgggcgcgctgaacttcgcgtcgaaggtgatccgcgagatcgcgtcgatgcacgcggacgcgcaagcgccgctgcggatctggcacttcggcggcgacgaggcgaagaacatcctgctcggcgcgggcttccagccgctcgacggcgccgatcccggcaagggccgcgtcgatcttgccgcgcaggacaagccgtgggcgcgctcgcccgcctgtacggcgctgcttcggcgcggcgagatcaaatcgatcgacgagctgccgacgcgcttcgcgaagcaggtcagcgccgtcgtcaacgcgaacggaatcggcacgatggccgcatggcaggacggcatcaagcacgcgagcgggccgcaggatttcagcacgcgcagcgtgatggtgtcgctgtgggacacgatcttctggggcgcgtccgacagcgcgcgcgatctgagcgcgaagggctaccggaccgtgctcgcgctgcccgactacctgtacttcgattttccgtacacgcgcaatccgcgcgagcgcggctactactggggctcgcaggcgacggacgagtacaaggtgttctcgctcgcgccggagaacctgccgcagaacgccgaggtattcggcgatcgcgacggcaacccgttcgaggtgacgagcgcgggcgcggcgccgagcatcgagggcatacaggggcaggcgtggggcgaggtgatgcgcaacgggccactgctcgaatatatggtgtatccgcgcctgctcgcgctcgccgaacgcgcgtggcacaaggccgactgggaactgccctacgcggccggcgtgcgctacaggctcggcgacacgcatcatgtcgacacggccgcgctcgagcgcgactgggcgggcttcgcgacgctgctcaagcagcgcgagctgccgaagctcgagcgcgcgggcatcggctatcgcaagccgacgttcacgctgacgggcgaatga

SEQ ID NO: 981 - DNA, 2274 bp, Burkholderia sp.
gtgccgtgcgccgacctcggcgccgacggcgcggcctgcgcgacgggccgcctgatcctgcagaaccgcggccatcaggcgatcgccgacggcggctggaagctctacctgcacagcatccgccgcctgctgcgaatcgatcgccccggcttcgcgctgcggcggctcaccggcgacctgtacgagctgacaccgcaacccggctcggtgcggctggcaccgggcgaacgcatcgaactgccgttcgtcgccgaatactggctgctgcgctacagcgacgtgatcccgcgcccgtacgtggtcgtcgagggcgcgccgcccgccgtgctccgctacgacgacaccgacgacgagctgcgctacgtcgaatcgctgccggccgacgcgcagaacaactcgacgggcaacgcgccgcccgtggccgcacggcccgacccgagccgcgcgctgccaagtgtgaagcgcgagcagccgctgcccggcacgctcgagctgcgcggtgtcgagctcgccctgcccgatctgccggacgcgcaggtcgcggcgctgcgcgaacgtgcgacgacactcgggctcgacggcgcgcgcgtgtcggtgcggggcgccgtcgcgccgcgccggctgccggccgacatcgcgacgccgggcggctaccggctcgcgatcgggccgcgcggcgtgctgatcgagggctacgatcgcgccggcctctactacggcgtgcagacgctctactcgctcgcaccggccggcggcggcccgatcccggcgatgctcgtcgaggatgcgccgcgcttcacgcatcgcgggatgcacgtcgacctcgcacgcaacttcaagcacccggcgacgctgcgccgcctgatcgaccagatgagcgcgtacaagctcaatcgcctgcacctgcacctgtcggacgacgagggctggcgcatcgagattcccggcctgcccgaactgaccgggatcggctcgcgccgctgtcacgatccgagcgagacgcgctgcctgctgccgcagctcggctccggcccggacaaccgctcgggcggcggctacctgacccgcgacgactacgtggcgctcgtgcgttacgcggccgcgcatttcgtcgagatcgtccccgagatcgacatgcccgcgcatgcgcgcgcggccgtcgtgacgatggaggcacgttaccggcggctgcatgcggccgggcgcgagcaggaagcgaacgcataccggctgctcgatccgcaggacacgtcgaacctgacgacggtgcagttctacgaccgccgcagcgacctgaacccgtgcgtgccgggcgcgctcaatttcgcatcgaaggtgatccgcgagatcgcggcgatgcatgccgatgcgcaggcgccgctgcacatctggcattacggcggcgacgaggcgaagaacatcttcctcggcgcgggcttccagccgctgaacggcaccgatccgaacaaggggcgcatcgatctcgccgcgcaggacaagccgtgggcgcgttcgcccgcatgcacggcattgctccagcgcggcgagatcaagtcgatcgacgagctgccgacgcgtttcgcgcagcaggtgagcgcggcggtcaacgcgaacggaatcgacacgatggccgcgtggcaggacggcatcaagcatgcgaacgggccgcaggacttcagcacgcgccacgtgatggtgtcgctgtgggacacgatcttctggggggcgtcggacagcgcgcgcgacctgagcggcaagggctacctgacggtgctcgcactgccggactacctgtacttcgacttcccgtacacgctcaacccgcgcgagcgcggctactactggggctcgcacgcgacggacgagtacaaggtgttctcgctcgcgccggagaacctgccgcaaaacgccgaagtgatgggcgaccgtgacggcaacccgttcgaggtaaccggcacgggccccgcgccgcgcatcgaaggcatgcagggccaggcatggggcgaggtgatgcgcaacgacaccttcctcgaatacatggcctatccgcggctgctcgcgctcgccgagcgcgcctggcaccgcgccgactgggaactgccgtatgcggccggcgtgcgcttcaagcgcggcgacacgcatcacgtcgacgcggccgcgctgcagcgcgactgggccggtttcgcgacgctgctcacgcaacgcgaattgccgaagctcgaccgtgccggtgtcggctaccggaagccgaccttcacgctgacgaatccgtga

SEQ ID NO: 982 - DNA, 753 bp, Burkholderia sp.
atgtcgatccaattgttttccaagcaagcgaaacacgccagattcgcccggatgtttgcactgctgccgatctgcgcggccgcgctcacggccggcatgcaggaagccagcgcgcacggcgcgatcggtacgccgatcgcgcgtcagtatcaatgccggctcgagggcggctactgggatccggccgacggcagcggcatcgcgcataccgattgtcgcgccgcctaccagaacggcggcaactcggcctatccgttcacgcagtggaacgagttctcggccaacccgatcggccagggcgacgacctggagaagctgcagcaagccgtgcccgacggcctgctctgcgcgggcggcgacaagaagaaatccggcatcgacgtgccggccgtggcctggcgcaagacccgcgtgacgccggtgggcggcaagatcgacgtgacctgggaaaatacccagagccacacgccgtcggtgatgcgcatctacctgagcaagcccggctacaacccgcagcagccgctgcgctgggccgatctcgacaagatctacgacgcgccggcaccggctccgcagccggccaacggcggcggccgcctgcccggcaccgtcacctcgttctacaagctgagcgtgccgctgccggcgggacgcaccggcgacgccgtgctgtacagctactggcaacgccgcgatgcgggcaacgagggtttcttcaactgcagcgacatcacgatcctgccggggcgctga

SEQ ID NO: 983 - DNA, 753 bp, Burkholderia sp.
atgtcgatccaatcgttttccaaggaagcgaaacacgccaaattcgcccggatgtttgcactgctgccgatctgcgcggccgcgctcacggccggcatgcaggaagccggcgcgcacggcgcgatcggtacgccgatcgcgcgccagtatcaatgccggctcgagggcggctactgggatccggccgacggcagcggcatcccgcataccgattgccgcgccgcctaccagaacggcggcaactcggcctatccgttcacgcagtggaacgagttctcggccaacccgatcggccagggcgacgacctggagaagctgcagcaagccgtgcccgacggcctgctctgcgcgggcggcgacaagaagaaatccggcatcgacgtgccggccgtggcctggcgcaagacccgcgtgacgccggtgggcggcaagatcgacgtgacctgggaaaacacccagagccacaccccgtcggtgatgcgcatctacctgagcaagcccggctacaacccgcagcagccgctgcgctgggccgatctcgacaagatctacgacgcgccggcaccggctccgcagccggccaacggcggcggccacctgcccggcaccgtcacctcgttctacaagctgagcgtgccgctgccggccggacgcaccggcgacgccgtgctgtacagctactggcagcgccgcgatgcgggcaacgagggcttcttcaactgcagcgatatcacgatcctgccggggcgctga

SEQ ID NO: 984 - DNA, 420 bp, Burkholderia sp.
atgcaacaacaacacgtttcgaaattcctgcttgcggccgcgctggccttgggcctggcgggcggtgcctatgcgcagtccgggctgcccgacgtcaagcagcagggcgacgtcagctacgtgtcgggcggcgtcggcctcgacgagtcgaatgccttccagcgcgccgagcaccagtggccgctgtcgatccgcttcaccggcgcgggcggcgaatacctctcgggcgtgcacgtctcgatcatgggccacgacggcgaggtgctgaaggccgatacgcgcggcccttacatgctggtgcggctcgcaccgggcgcctacaaggtgagcgcgaattacaacggcaagaccgagatgcgcaatgtgacggtgccggccaagggtgacgcgaagctcgccttttcctgggcggcgcagtaa

SEQ ID NO: 985 - DNA, 429 bp, Burkholderia sp.
atgcaacatcaacgcatttcgaagtacgtgcttgccgtggcgctggctgtcggcctcgtcggcggagcctatgcgcagaccgacgccggcttgccggccgtgcagcagcagggcagcgtcggctacgtgtcgggcggcgtcggcctcgacgagtcgaccgcgttccagcgtgccgagcaccactggccgctgtcgctgcgcttcaccggccagggcggcgagttcctggcgggcgtacacgtgtcgatcgtcggccatggcggcgacgaagtgctgaaggccgacacgcgtggcccgtacatgctggtgcggctcgccccgggcagctacaaggtcagtgcgtcctacaacggcaagaccgagacgcgcagcgtgagcgtgcccgccaagggcggcgcgaaggtggcgttctcgtggaacgcgcagtga

SEQ ID NO: 986 - DNA, 423 bp, Burkholderia sp.
atgcgacagcagaccatttccaaacacctgatcgcggcggcgctggctttcggcctcgcgggcgtcgcgaacgcgcaatccggcttgcccgacgtgcagcaccagggcgacgtcgggttcgtgtcgggcggcgtggggctcgacgagtccaccgcgttccggcgcagcgaaagcaactggccgctcgcgctgcgcttcacgggcgcgggcggcgagtacctgtccgacgtgcacgtgtccgtgctcgacgcgcatggcggcgaagtgctgaagaccgatgcgcgcggtccatacatgctcgtcaggctgaagccggggcgctacaccgtgcatgcgagctacaacggcaacgagcagacccgcgcggtgacggtgccggcgaagggcggcgcgaaggcggcgttctcgtggaaagcgcagtga

SEQ ID NO: 987 - DNA, 423 bp, Burkholderia sp.
atgcgacagcagaccatttccaaacacctgatcgcggcggcgctggctttcggcctcgcgggcgtcgcgaacgcgcaatccggcttgcccgacgtgcagcaccagggcgacatcgggttcgtgtcgggcggcgtggggctcgacgagtccaccgcgttccggcgcagcgaaagcagctggccgctcgcgctgcgcttcacgggcgcgggcggcgagtacctgtccgacgtgcacgtgtccgtgctcgacgcgcatggcggcgaagtgctgaagaccgatgcgcgcggtccatacatgctcgtcaggctgaagccggggcgctacaccgtgcatgcgagctacaacggcaacgagcagacccgcgcggtgacggtgccggcgaagggcggcgcgaaggcggcgttctcgtggaaagcacagtga

SEQ ID NO: 988 - DNA, 1857 bp, Burkholderia sp.
atgcgtacccgcttaccgcgcctcgcatcgagcgcgctgctcgccctgccgctctgcctgaacctgccggcccatgccgataccgtggccgccaataccagcacgccgctggcggcgaccccgccgatgggcttcaacaactgggcccgcttccagtgcacggcccaggcgcccaccgacggcagcgcgcgcgccaattactcgttccagcatttcatgctcgaccaggccgaggcgatgcgcgcgacggggctggtcgcgtcgggctataccctgctgtgggtcgacgactgctggatgtcgcgcagcggcagcgggcagatccagggcgccgcgcgctggggcggctcccagcagcccggcttcgatcccgacctgggcgcctacgcgagcgcggtccatgccaagggcatgctcgccgccctgtacaacacctccggcgcgaagacctgccagggcgtggcggccggcgaacagggccatcagctgcaggacgcgcagacctacgtggcctggggcgtggatgccctgaagctcgacaattgcggcgccatcgacaatgccaccccgcagcagctcttcaagcagatggccgatgcgctgggccaggccagcgccggttcggcgcgcaagatcctgttcaacgaatccgcgccggccggctacgggcccaccgggtccgccaagtacgccacgctggactgggtgcggccgctcggccagatgtggcgcaccggccccgacattcggaccacctcgatgaccgcgagcggccaggcggccagcgatccatgggactactacaacgccaatgcctaccaggaaggcgtctatcagagctacaacgagacgatcgcgctgtcgcgctacgtgtcgccgggcaactggaacgatcccgaccagctcctgatcggcgacaacgggctcacgccggccgaggagcgcagccagatggcgctctggtcggcgatggccgccccgctcatcctcagcaccgacgttcgcaagttcgcggccaatccggccgatccccgctggcagcagtcgctcgccacgctgaacaacgccgaggtcgtcgcggtcgaccaggaccggctcggcatcggcgggtaccgcgtctcgcgcgacgatccctcgagcagcgccggcatcgaggtggtggcgaaaccgctcgccgaccatgcgctggccgtggtggtgctcaacaagggcgccgcgtcggccagcccgacgctgtcgttcgcgaacctgggctaccgcaacggcgcggacggcacgccctgcacgctggcggtgcgcgatctgtgggcgcattcgggctcgcagctcgccgcgcaggtgcccctgacgatcggcgcccatgacaacgcgatgctgaaactgagcggcacatgcggcggctgggcgccgaccggcgagatcgagacggtcggcgactggggcgcgacgccgttgtgcatcgccgccggcagcgcggcgcccggcgcggcgctcgccctcgccaactgcgacgcgggaccgaagcagcgctggagccgcaaggccgatcgcaccgtggagctggcgggcaccggtctgtgcctgagctcgacggcgcccggcgccacgctcggcggcgccgccggccagtgggccacgctcgccagttgcaatgcgcaggacacgaagcagcaattcagctaccggcgcaatggccagctcgcggcggccgccgacgggacctgcctcgacatctatcgcggcgtggtggacggcacgctcggcaaacccggcacgccgctcgacctgtatgcctgcacggccaaccaggtcaatcagatctgggccgcgccgcatgccgatgtcctgaacgactag

SEQ ID NO: 989 - DNA, 1707 bp, Burkholderia sp.
atgcagacagcacgcaaggcattgccgctcgcattgagcatcgcactgggtctcggcatggtgcatggcgtcgcggcacagtcgaagaccggcaacccgcaggccgagaacctgcgcgagagcctgacgcgcggcgtggccaagcccgccgccggcggcgaggccgcgccgagcagcaccggcgcggtgtcggtcacgctcgcgaatccggcttaccgcgtgaagaagaccgcctcgacgcccgaggcgaccgcccgcgatttcctggccacgcaggccgggcagctcggcctggacgcgaccgcgctggccggcctcgagctggtgtcccagcgccaggacccggatttcacggtggtgcggctgcggcaggtggtggcggggctgcccgtctacggcagcgagatcgccgtgacgatcggcaaggacggcagcgtgctgtacgtcgccagcaatgcgatcggcggcgtggcgcccaaggcgtccaagacgcaggcggtggaccagcagcaggcgctcgatcgcgcgcgcagctatctcggcatcggcgagctgcgcaacgccgaggcgcaactggtggcgttccgcgacgcggccggcacgcacacggcctggaaggtgcgcggccggcccgacggcggcccgaagggcgattgggaactgctgatcgacgcgaccagcggcgaggtgctgcgcgccgaggacaaggcgttctacgccgtcgacggctcgggttacgtgttccgccccgatccgctgtcctccaccaagagcagctacggcagcaccggctacaaggacaacaacaacgccgattccacccagttgaccgccgcgcgcgtgcgcgtgacgctgaaggacctgaagcaatcgggcgcgagctattcgctgtcgggaccgttcgcctcctgtgtcgacttcgatgcgccgcgcgacaacgcctgcccggtgcagtcctcgccggccttcgagttcacccgcggcaacctctatttcgaggctgtcaacgcctattaccacatcgataccttcctgcgctacgtgaaccagacgctgggcatcaaggcgctgccctaccagtacacgggcggcgtgcagttcgatccgcatggcgaatcgggcgacgacaactcggcctattcgtcgggcagcggccagctgaccttcggccagggcggcgtggacgacgccgaggacgccgacgtggtgatccacgaactgggccacggcatccacgactggatcaccaacggcgggctgtcgcaatcggaaggcctgtcggaaggcgtgggcgactacctggcggccggctacagccgcgacttcaaccagtggagcccgtccgacgcgcagtacaactgggtctacaactgggacggccacaacgaattctggccgggccgcgtgaccaactacaacgtcggccgcacctatgcgcagatccgcagctccgagatccacacggccggccagtactgggcctcgtgcaacctggtggcgcgcgacgcgatcggcggccaggcgatggacaaggccttcctgaagggcctgtcgatgaccaacggctcgaccaaccagaaggcggccgcgcaggccgtgatcacggcggcctcggcgctcggctacagcagcacgcagatcaacgcgatcgcgaacgcctacaacaagagctgcacctacgccgtgacggtgccgcagaagtcctga

SEQ ID NO: 990 - DNA, 1713 bp, unknown
  environmental sample
atgcagacatcacgcaaagcactgccgctcgccctgggtctcgcgctcggtttcggcatcgtcggcggcaccgcggccgatacgaaagtctcgaatccgcaggcaacgagcctgcgcgaaagcctgacacgcggcgtcgcgccaccggccgccaggtcggatacggccgccgggcagttccgcgcggacggcgtcgccgtcacgctgtacaaccccgcctatcgcgcgaagaaggccgccgcgacgcccgccgccaccgcgcgcgacttcgtcgcgtcgcaggccgcgcaactcgggctcgacgcgaccgcgctcgcgagcctcgtcgtcacgtcggagcgcagcgacgccgagttcaccgtcgtgcgcctgcagcagcaggcagccggattgcccgtgtacggcagcgaaatcgcggtgacggtcgcgaaggacggccgcatcctgtacgtcgcgagcaacacgatcaacggcgtggtcgcgaagtcgggcaaggcgcaggccgtcgaccagcagcaggcgctcgaccgcgcacgcgcgtatctcggcgtgagcggcttcacgaaccaggatgcgcagctcgtcgccttcgtcgacaaggccggcacgcataccgcgtggaaagtgcgcggccgcccgaacgacggcccgaagggcgactgggaactgctgatcgactcgggcagcggcgaagtgctgcgcgccgaggacaaggcgttctacgcgaccgacggcacgggcttcgtgttccggcccgacccgctgtcgccgaccaaaagcagctacggcagcacgggctacaaggacagcaacgacgtcgattcgtcgcaactcaccgccgcgcgcgtgcgcgtgacgctgaaggatctcgcgcagtcgggtgcgcgttattcattgtcgggcccgtacgcggcatgcgtcgatttcgacgcgccgcgcgacaacgcgtgccccgtgcagtcgacccccgcattcgaattcacgcgcggcaacctgtatttcgaggcggtgaacgtgtactaccacatcgacacgttcctgcgttacgtgaaccagacgctcggcatcaaggcgctgccgtaccagtacacgggcggcgtgcagtacgacccgcacggcgaatcgggcgacgacaactcgtcgtattcgtcgagcagcggccggctgaccttcgggcaaggcggcgtcgacgacgcggaggatgcggacgtcgtgatccacgagctcggccacggcatccacgactgggtgacgaacggcggcctgtcgcagcaggaagggttgtcggaaggcaccggcgactatctcgccgccgcgtacagccgcgacttcaaccagtggagcccgtcggatgcgcagtaccactgggtctacaactgggacggccacaacgaattctggggcggccgcgtgaccaactggaacgtcgggcgcacctatgcgcaggcacgcggcgcggagatccatacggccggccagtactgggcctcgtgcaacctcgtcgcgcgcgacgcgatcggtgcgcaggcgatggacaaggcgttcctgaaggggctgtcgatgaccaacggctcgaccaaccagaaggccgccgcgcaggcggtgctgacggccgcgtccgcgctcggctacagcagcgcgcagctgaccgcgatcggcaatgcgtacaaccagagttgcacgtacggcgtgaccgtaccgaagaagtcgtaa

SEQ ID NO: 991 - DNA, 1713 bp, Burkholderia sp.
atgcagacatcacgcaaagcattgccgctcgccctgagtctcgcgctcggtttcggcatcgtcggcggcaccctggccgatacgaaagtgtcgaatccgcaggccgccagcctgcgcgaaagcctgacgcgcggcgtcgcgccgccggccgcgaaagccgatacggccgccgggcaattccgcgcggacggcgtcgccgtcacgctgtacaacccggcctggcgcgtcaagaaagccgccgcgacgcccgccgccaccgcgcgcgacttcgtcgcgtcgcaagcggcgcagctcggcctcgacgcggcggcgctcgcgagcctcgtcgtcacgtcggaacgcaacgatgccgacttcaccgtcgtgcgcctgcagcagcaggctgccgggctacccgtgtacggcagcgacatcgcggtgaccgtcgcgaaggacggccgcatcctgtacgtcgcaagcaacacgatcagcggcgtggtcgcgacgacgcgcaagtcgcaggccgtcgaccagcagcaggcgctcgaccgcgcccgcgcgtatctcggcgtgagcggcttcacgcatctcgacgcccagctcgtcgcattcgtcgaccaggccggcacgcacaccgcgtggaaggtgcgcggccgcccgcaggacggcccgaagggcgactgggaactgctgatcgattcgggtagcggcgaagtgctgcgcgccgaggacaaggcgttctacgcgaccgacggcaccggcttcgtgttccgccccgatccgctgtcgccgacgaagagcagctacggcagcaccggctacaaggacagcagcgacgccgattcgacgcaactcacggccgcacgcgtgcgcgtgacgctgaaggagctcgcgcagtcgggcacgcgctacacgctgacgggcccgtacgcggcatgcatcgatttcgatgcgccgctcgacaaggcgtgcccgtcgcagtccacgcccgcgttcgaattcacgcgcggcaacctgtatttcgaggccgtgaacgcgtactaccacatcgacacgttcctgcgttacgtgaaccagacgctcggcatcaaggcgctgccgtaccagtacacgggcggcgtgcagtacgacccgcacggcgaatcgggcgacgacaactcgtcgtattcgtcgagcagcggccggctgaccttcgggcaaggcggcgtcgacgacgcggaagacgcggacgtcgtgatccacgagctcggccacggcatccacgactgggtcaccaacggcggcctgtcgcaacaggaaggcctgtcggaaggcaccggcgactatctcgccgccgcgtacagccgcgacttcaaccagtggagcccgtcggatgcgcagtatcagtgggtctacaactgggacggtcacaacgagttctggggcggccgcgtgaccaactggaacgtcgggcgcacctatgcgcaggcgcgcggcgcggagatccacacggccggccagtactgggcgtcatgcaacctcgtcgcgcgcgatgcgatcggcgcgcaggcgatggacaaggcgttcctgaagggactgtcgatgaccaacagctcgaccaaccagaaggcggccgcacaggccgtgctgacggccgccgccgcgctcggctacagcagcacgcagctcaccgcgatcggcaacgcgtacaacaagagctgcacgtacggcgtgaccgttccgcagaagtcgtaa

SEQ ID NO: 992 - DNA, 1713 bp, Burkholderia sp.
atgcagacatcacgcaaagcattgccgatcgccctgggtctcgcgctcggtttcggcatcgtcggcggcagcgcggccgatacgaaagtctcgaacccgcaagtcacgagcctgcgcgaaagcctgacgcgcggcgtcgcgccgccggccgcgaaagccgatacggccgccgggcagttccgcgcggacggcgtcgccgtcacgctgtacaaccccgcgtatcgcgcgaagaaagccgccgcgacgcccgcagccgccgcgcgcgacttcgttgcgtcgcaggccgcgcagctcgggctcgaccaggccgcgctcgcgagcctcgccgtcacgtcggagcgcagcgacgccgacttcacggtcgtgcgcctgcagcagcaggcggccgggctgcccgtgtacggcagcgacatcgcggtgacggtcgcgaaggacggccgcatcctgtacgtcgcgagcaacacgatcaacggcgcggtcgcgacgtcccgcaagtcgcaggcggtcgaccagcagcaggcgtacgaccgcgcacgcgcctatctcggcgtgagcggcttcacgaatctggacgcacagctggtcgccttcgtcgacaaggccggcacgcataccgcgtggaaagtgcgcggccgcccgcaggacggcccgaagggcgactgggaactgctgatcgacgcgggcagcggcgaagtgctgcgtgccgaggacaaggcgttctacgcgaccgacggcaccggcttcgtgttccggccggacccgctgtcgtcgacgaaaagcagctacggcagcacgggctacaaggacaacaacgacgccgattcgccgcagctcaccgccgcgcgcgtgcgcgtgacgctgaaggatctcgcgcagtcgggcgggagctatacgctgacgggcccgtacgcggcgtgcatcgatttcgacgcgccgctcgacaaggcgtgccccgcgcagacgacgcccacgttcgagttcacgcgcggcaacctgtacttcgaggcggtgaacgcgtactaccacatcgacacgttcctgcgttacgtgaaccagacgctcggcatcaaggcgatgccgtaccagtacaagggcggcgtgcagtacgacccgcacggcgaatcgggcgacgacaactcgtcgtattcgtcgagcagcggccggctgaccttcggccagggcggcgtcgacgatgcggaagatgcggacgtcgtgatccacgagctcggccacggcatccacgactgggtgacgaacggcggcctgtcgcaacaggaagggctctccgaaggcaccggcgactatctcgccgccgcgtacagccgcgacttcaaccagtggagcccgtcggacgcgcagtaccactgggtctacaactgggacggccacaacgagtactggggcggccgcgtgaccaactggaacgtcgggcgcacctacgcgcaggcgcgcggcgcggagatccacacggccggacagtactgggcgtcgtgcaacctcgtcgcgcgcgatgcgatcggtgcgcaggcgatggacaaggcattcctgaaggggttgtcgatgaccaacagctcgaccaaccagaaggccgccgcgcaggccgtgctgacggcggcgtccgcgctcggctacagcagcgcgcagctcaccgcgatcggcaatgcgtacaaccagagctgcacgtacggcgtgaccgtgccgaagaagtcgtaa

SEQ ID NO: 993 - DNA, 1713 bp, Burkholderia sp.
atgcaaacatcacgcaaggcactgccgttggcactgagcatcgcgctgggtttcggcgtcgcaaccagcgccgccgccgaccacaagaacggggacccgcaggcgtcgagcctgcgcgagagcctcacgcgcggcgtcgcgccgcccgccgcgaaatcggatgcgccgagcggtcagttccgcgcggacggcgtcgccgtcacgctgtacaacccgccctatcaggcgaagaaggccgccgccacgcccgcggcgaccgcgcgcgacttcgtcgcgtcgcaggccgcccggctcgggctcgacgcggccgcgctcgccagcctcgtcgtcacgtcggagcgcaaggatcccgacttcaccgtcgtgcgcttccagcagcaggcggccggcctgccggtctacggcagcgacatcgcggtcacggtcggcaaggacggccgcatcctgtacgtcgcgagcaacacgatcagcggcgtggccccgaagtccgccaaggcgcaggccgtcgaccagcagcaggcgctcgaccgcgcgcgtgcgtatctcggcgtgaacggcttcgtgaacgtcgacgcgcagctcgtcgtgttcgtcgatgccgccggcacgcataccgcgtggaaggtgcgcggcaagccgcagaacggcccgaagggcgactgggagctgctgatcgacgcgggcagcggcgaagtgctgcgcgccgaggacaaggcgttctacgcgaccgacggcaccggcttcgtgttccgccccgatccgctgtcgccgacgaaaagcagctacggcagcgccggctacaaggacggcaacgacgccgactccacgcagctgaccgcctcgcgcgtgcgcgtgacgctgaaggagctcgcgcaatcgggctcgacctacaagctcaccggcccctacgcgtcctgcgtcgattacgatgccccgctcgacaaggcgtgcccggtgcaggcgacgccgaacttcgagttcacgcgcggcaacctctatttcgaggcggtcaacgcgtactaccacatcgacacgttcctgcgctacgtgaaccagacgctcggcgtcaaggcgctgccgtaccagtattcgggcggcgtgcagtacgacccgcatggcgaatccggcgcggacaactcgtcgtactcgtcgggcagcggcaagctgacgttcggccagggcggcgtcgacgacgcggaggacgccgacgtggtgatccacgaactgggccacggcatccacgactggatcaccaacggcggcctgtcgcagcaggaaggcctgtcggaaggcacgggcgactacctcgccgccgcatacagccgcgacttcaaccagtggagcccgtccgacgcgcagtacaactgggtcttcaactgggacggccacaacgagttctggggcggccgcgtgaccaactggaacgtcggccgcacctatgcgcaggcacgcggcgccgagatccacacggccggccagtactgggcgtcgtgcaacctggtcgcgcgcgacgcgatcggcggcgcggcgatggacaaggcgttcctgaagggcctgtcgatgaccaacggctcgaccaaccagaaggcggccgcgcaagccgtgatcaacgccgccgccacgctcggctacagcgccgcgcagatcgccgcgatcggcaacgcgtacaacaagagctgcacgtacgccgtgaccgtgccggcgaagtcgtga

SEQ ID NO: 994 - DNA, 1704 bp, Burkholderia sp.
atgcagacatcccgtaaagcactgccgctcgcactgagtctcgccatcggtctcggcgccgcgctgcccgcgtgggcggattcgaaggcgccgaacccgcaggaggaaagccggcgcgcgagcctcacgcgcggcgtcgtgccgccttcggaaaaggcggacaagaccgggcagttccgccccggaaccgtcgccgtcacgctggcgagcccggcgttccacgcgaagaaggccgacgcggcagcgatggcgcgcgagttcatcgccgcgcgggcgacgcaactcggcctcgacaaggccgcgctcgcgaatctcgtcgtcgcgtccgaacgcgccgacgccacgttcaccgtcgtacgctttcagcagcgcgcggcggggctgcccgtctacgacagcgacatcgcgatcacggtcgctccggacggccgcgtgctctacgtcgcgagcaaggcggtgaacggcgtcgcggccgtgtcgagcaagacgcaggcggtcgacgagcagcaggccctcgaccgcgcgcgcgcgtatctcggcgtcagcggcttcgcgagcgtgcaatcgcaactcgtcgcgttcgtcgacggcacgggcacgcataccgcgtggaaagtgcgcggcaggccgcaggacagcctgcgcggcgactgggaactgatcatcgacgccaacagcggcgaagtgctgcgcgccgaagacaaggcatcctatgcaacggacggaaccgggctcgtgttccggccggacccgctgtcgccgaccaaaagcagctacggcagcaccggcttcaaggacaacaacgacgcggactcgccgcaactgagcgccgcgcgcgtgcgcgtgacgctcaaggatctgacgcagacgagcggcggctacaagctcgccggcccgtacgcgtcgtgcgtcgatttcgatgcgccgttcgacaaggcatgcccggttcagccttcgccgaccttcgatttcacacgctcgaacctgtacttcgaggccgtgaacgcgtactaccacatcgatacgttcctgcgctacgtgaacctgacgctcggcatcaaggcgttgccgtatcagtactcgggcggcgtgcagtacgacccgcacggcgaatccggcgacgacaactcgtcgtactcgtcgggctccggcaggttgtcgttcgggcaaggcggcgtggacgacgcggaagatgcggacgtcgtgattcacgaactcggccacggcatccacgactggatcaccaacggcgggctctcgcaggtcgaggggctgtccgagggcacgggcgattacctcgcggccgcgtacagccgcgacttcaaccagtggagcccttccgacgcgcaatatcactgggtctacaactgggacggccacaacgaattctggcccggccgcgtgacgaactacaacgtcggccgcacgtacgcgcaagtccgcaattccgagatccacacggccggccaatactgggcgtcgtgcaacatggtcgcgcgcgacgcgatcggcggcgcggcgatggacaaggcgttcctgaaagggctgtcgatgacgaacggctcgacgaatcagaaggccgcggcccaggcggtgctgaccgcggcggccgcgctcggctacagcagcgcgcagctcaacgcgatcggcaacgcgtacaacaagagctgcacgtacggcgtgaccgtgccgcagaagctgtaa

SEQ ID NO: 995 - DNA, 1704 bp, Burkholderia sp.
atgcagacatcccgtaaagcactgccgctcgcgctgggtcttgccatcggcctcggcgccgcgctgcccgcgtgggccgattcgaaggcaccgagcccgcaggaggaaagccggcgcgcgagcctcacgcgcggcgtcgtggcgcctgcggaacaggccggcaagaccgggcagttccgccccggggccgttgccgtgacgctggcgagcccggcgtttcatgcgaagaaggccgatgcggcggcgatggcgcgcgagtacgtcaccgcgcgcgcagcgcagctcggcctcgacaaggccgcgctcgcgaatctcgtcgtcgcgtccgaacgcgccgacgccgcgttcaccgtcgtgcgcttccagcagcgcgccgcggggctgcccgtctatgacagcgacatcgcggtcacggtcgcgccggacggccgcgtgctgtacgtcgcgagcaaggcggtgagcggcgtcgcggccgtgtcgagcaagacgcaggcggtcgacgagcagcaggcgctcgaccgcgcgcgcgcctacctcggcgtcggcggcttcgtgaacgtgcagtcgcagctcgtcgcattcgtcgacggcgcgggcacgcataccgcgtggaaggtgagcggcaggccgcaggacagcctgcacggcgactgggagctgatcatcgacgcgggcagcggcgaagtgctgcgcgcgcaagacaaggcatcctacgcaacggacggcagcgggctcgtgttccggccggatccgttgtccccgacgaaaagcagctacggcagccccggcttcaaggacaacaacgatgcggattcgccgcaactgagcgccgcgcgcgtgcgcgtaacgctcaaggatctgacgcagacgagcggcggctacaagctgagcggcccgtatgcatcgtgcatcgatttcgatgcgccgctcgacaaggcgtgcccggttcaggcgtcgacgaccttcgatttcacacgctcgaacctctatttcgaggcggtgaacgcgtattaccacatcgacacgttcctgcgctacgtgaacctgacgctcggcatcaaggcgttgccgtaccagtacgcgggcggcgtccagtacgatccgcacggccaatccggcgacgataactcgtcgtactcgccgagctccggcaggttgtcgttcgggcaaggcggcgtcgacgacgcggaagacgcggatgtcgtgattcacgagctcggccacggcatccatgactggatcaccaacggcggactgtcgcaggtcgaggggctgtccgaaggcacgggcgactacctcgcggccacatacagccgcgacttcaaccaatggagcccgtccgacgcgcagtatcactgggtcttcaactgggacggccacaacgaattctgggccggccgcgtcaccaattacaacgtcggccgcacgtacgcgcagatccgcaatgccgcgatccacaccgccggccagtactgggcgtcgtgcaacatggtcgcgcgcgatgcgatcggcggcgcggcgatggacaaggcgttcctgaaaggattgtcgatgacgaacggctcgaagaaccagaaggccgcggcgcaggcggtgctgaccgcggcggcggcgctcggctacagcagcgcgcagctcaatgcgatcggcgacgcgtacaacaagagctgcacgtacggcgtgaccgtgccgcagaagctgtaa

SEQ ID NO: 996 - DNA, 1683 bp, Burkholderia sp.
ttgccgttcgcactgagcctggccatcggcatcggcgccgcgctccccgcgtgggccgattcgaaggcgccgaatccgcaggaggaaagccggcgcgcgagcctcacgcgcggcgtcgtgccgcccgcggagaaggccggcaagaccggacaattccgcccgggcgccgtcgccgtcacgctggccagcccggcgttccacgcgaagaaggcagacgcggcgacgatggcgcgcgaattcatcgccgcgcgcgccgcgcagctcggcctcgacccatccgcgctcgcgaatctcgtcgtcgcggccgagcgcgccgacgccgacttcaccgtcgtccgcttccagcagcgcgcggcggggctgccggtctacgacagcgacatcgcggtcacggtcgcgccggacggccgcgtgctgtacgtcgcgagcaaggcggtgagcggcgtcgcggccgtgtcgagcaaggcgctggcggtcgacgagcagcaggcgctcgaccgcgcacgcgcgtacctcggcataagcggcctcgcgggcgtgcaatcgcagctcgtcgcgttcgtcgacggctcgggcacgcataccgcgtggaaggtgcgcggcaagccgcaggacggcctgcgcggcgactgggagctgatcatcgacgcgaacagcggcgaagtgctgcgcgccgaagacaaggcctcctatgcaacggacggaagcggtctcgtgttccggccggatccgctgtcgccgaccaaaagcagctacggcagcaccggcttcaaggacaacaacgacgccgactcgccgcaactgaacgccgcgcgcgtgcgcgtgacgctcaaggatctgacgcaaacgagcggcggctacaagctctccggcccgtatgcgtcgtgcgtcgatttcgacgcgccgcgcgacaacgcgtgcccggtgcagtcgtcgacgaccttcgacttcacgcgctcgaacctgtatttcgaggcggtcaacgcgtattaccacatcgacacgttcctgcgctacgtgaacctgacgctcggcatcaaggcgctgccgtatcagtactcgggcggcgtccagtacgatccgcacggcgaatccggcgccgacaactcgtcgtactcgtcgggctccggccagctttcgttcggccagggcggcgtcgacgacgcggaggacgcggacgtcgtgattcacgagctcggccacggcatccacgactggatcacgaacggcgggctctcgcaggtcgaaggcctgtccgaaggcacgggcgattacctcgcggccgcttacagccgcgacttcaatcaatggagcccgtccgacgcgcagtatcactgggtcttcaactgggacggccacaacgagttctggcccggccgcgtcaccaactacaacgtcggccgcacctactcgcaggtccgcaataccgagatccacacggccggccagtactgggcgtcgtgcaacatggtcgcgcgcgatgcgatcggcggcgcggcgatggacaaggcgttcctgaaaggactgtcgatgaccaacggctcgacgaaccagaaagccgcggctcaggcggtgctgaccgcggcggccgcgctcggctacagcagcgcgcagctcaatgcgatcggcgacgcgtacaacaagagctgcacgtacggcgtaaccgtgccgcaaaagctgtaa

SEQ ID NO: 997 - DNA, 780 bp, Burkholderia sp.
ttgagaagaacgatcttcaccgaaaccaccacgtaccgtcgcgccgtctcgcgcgcgatcgggcttgcggccggcgcggcgctcgtcggcggctgcacgatgacgccatggacggacaactggcagccgtcccagcaagcgcagccgagccgccagtcgcaggcgggcgtgctggccggctactaccgcgtgaaccccggcgacacgctgcccggcatcgcggcgggcttcggccagcgggtgcaggacctggcgaactggaaccacatcgcgtccaccgacatgctgacgccgggccaggtgctgcgcgtcgcgccgccgcccggcacgaccgcggtcacctcgccggtgccgggcggcacctcgccttcggcgtcggcgctgccgggcacgccgcccgccgaggcgcagccgatgctggcgtggcccgcgcagggcaccgtcacctcgcgcttcatcccgggccgcacgcgcggcatcaccatcacctccaccggcgacaagaccgtgcgcgcggcggcggcggggcgcgtggtctatgccggcaacggcgtggcgaagtacggcccgctcgtgatcctgaagcacgagagcgggctgattaccgcctacggccacaacggcaggctgctcgtgaacgacggtgacgccgtcagcgccggccagcccgtcgccgagatgcagaccgatgcggacggccgctcctcgttcgacttcgaggtgcgccaggacggcaagcccgtcgatccgatgacgttcctgccgcgcaacggcggctga

SEQ ID NO: 998 - DNA, 714 bp, Salinibacillus sp.
atgaccagatcctcgctccgcgtcctgtccgccgcgctcgtcgccggactcgccctcagcgccgccgcggcgcccgccctcgcgtcggagccggacctgcgggtcgtgacctgggaccgcggtgccgaccccgccgccgacgcccaggtctcgaccggcgagagctgtgcggtcgaggcgcagccgctcctgcccggccaggaccccgacacgctcccgcccgcgcccgaggtgtgcttcggctcgctcgaggaggcgctcgagttcgtctcgggcggcgacgtcgcctcgtcgcggctcgccgacgcgacgcccgcgcaggtcgagggtctcgtctcggagctcaacgcctcggcctcggtcgcaccccgcctcgccgggacggagcgtgcgacggccgccgcggcgagctcgctcgtcctgggcgtgctgtggcgcgacgccaactacaagggcgcctccaaggtgctctacgggtcgggcaccaacgggtgctacaccggctcgacctacggcttcccgaacctcgcgaacctgctcatgaacaacgtcgtcacctccgcgacgacctacgcgggctgctgggtgaccctgtacgactcctacaactacgcgggagccaagaagaactgcacgccgcactgctcgacgctgggcacgttcgacaaccgggcctcctcggtcgtctaccgccccgcgggccagctcggctga

SEQ ID NO: 999 - DNA, 717 bp, Cellulosimicrobium sp.
atgaccagaacctcgctccgcgtcctgtccgccgcgctcgtgagcggcctcctcctcaccgcggtcggctccggctccgccctcgcgtccgtgccggacctgcgggccgtcacgggggtgcgggacgtcgtcgcccccgcgggcgacgtgagcgtctcgaccggcgagagctgcgccgtcgaggcccagccgctcctgcccgggcaggacccggacaccctgcctcccgcgcccgagacgtgcttcgcctcgctcgccgaggcgctcgagttcgtctcgggctccgacgtcgcggcgtcgcgtctcgccgaagccacccgggccgacgtcgaggggctcgtcaccgagctcaacgcggccgcggcggcgccgcgcaccgcgggtgccgagcgggtcgcggcggccgcggcgagctcgctcgtgctcggggtgctgtggcgcgacgcgagctacaagggcgcgtccaaggtgctctacggttcgggcaccaacgggtgctacacgggctcgacgtacgggttccccaacctggcgaacctcctcatgaacaacgtcgtgtcgtcggccacgacgtacgccgggtgctgggtgacgctctacgactcctacagctacggcgggacgaagaagaactgcacgccgcactgcgcgacgctcggctcgttcgacaacaaggcgtcctccgtcgtctaccgcccggcgggcacgctcggctga

SEQ ID NO: 1000 - DNA, 717 bp, Cellulosimicrobium sp.
atgaccagcactccgctccgcgccctgtccgccggtctcgtggccggtctcgcgctggtgggcgccgtcgccgccccgtcgctcgcctcgccgtcgggcgtccgggccgccccggaggacgaccccgcggcggtccggctcgccgaccagcccgtcgcgaccggcgagagctgcgccgtcgaggcccagcctctcctccccggcgaggaccctgccgcgctgctcgccgcacccgaggtgtgcttcggctcgttggaggaggcgctggagttcgtgtccggggacgaggtggcgccgtcgcgcctcgcgcgcgccacgcgggccgacgtcgacggcctcgtcggcgagctcaacgcgaccacgacggcgggcccgcgggccgcggcggagcgggcgacgacggccgcggccggctcgatcgtgctcggcgtgctgtggcgggacccgagctacaagggcgcgtcgaaggtgctctacgggtcgggcaccaacgggtgccacaccggctcgacgtacgggttcccgaacctcgcgaacctcctcatgaacaacgtcgtctcctcggcgtcgacgtacgccgggtgctgggtgacgctctacgactcgtactcctacgcgggaacgaagaagaactgcacgccgcactgcgcgagcctcggctcgttcgacgaccgcgcgtcgtcggtcgtctaccgccccgcgggcaggctcggctga

SEQ ID NO: 1001 - DNA, 717 bp, Multievos46 sp.
atgaccagcactccgctccgcgccctgtccgccggcctcgtcgccggtctcgtgctggtgggcgccgtcgccggcccggcgctggcctcgccgtcgggcgtccgggccgccccgggggacgacctcgcggcagtcccgctcgccgaccagcccgtcgcgaccggcgagagctgcgccgtcgaggcccggcctctcctccccggcgaggaccctgcctcgctgcccgccgcacccgaggtgtgcttcggctcgctggaggaggcgctcgagttcgtctccggggacgaggtggcgccgtcgcgcctcgcgcgcgccacgcgggccgacgtcgacggcctcgtcggcgagctcaacgcgacgacgacggcgggcccgcgggccgcggcggagcgggcgacgacggccgcggccgggtcgatcgtgctcggcgtgctgtggcgggacccgagctacaagggggcgtcgaaggtgctctacgggtcgggcaccaacgggtgccacaccggctcgacgtacgggttcccgaacctcgcgaaccacctcataaacaacgtcgtctcctcggcgtcgacgtacgccgggtgctgggtgacgctctacgactcgtactcctacgcagggacgaagaagaactgcacgccgcactgcgcgagcctcggctcgttcgacgaccgcgcgtcgtcggtcgtctaccgcccggcgggcacgctcggctga

SEQ ID NO: 1002 - DNA, 1101 bp, Collimonas sp.
atgagattgacacgtcactcccgatggcagggagtcaagcgttatgcagcagtgacattaccagtgctgttcctggcggcctgcgcgacgcaagaaccaactacatccggcacgcaaaatgccgctagcaccggcaagccgatactggccccaaagccagccgcgccagcggtaacgccacagcaggcggagttgaagagcctggtcgcactgcaagaccgcttatacgacgtagcagctccactgctggtgaataacgccgtcctgtgccgcaacaacgcgcgcaacctgctcggcttcaccgccaagacaaaattctcttacaccgccgaattcatcgacgccgccacttcactcggactgaccgatcaattgcaagtgaccggcgtactgaccggcagcggcgcggccaaagtcggcttgcaacgcggcgacctgctggtggcgatccaggacaaaccggtgccgaccggcgccgatgccgagcgccaaaccgcactgatgctcggaccgttggttaacggccgcagtaacatcaaggtgacgatcgcacgcaacggcagcaaccagaccctgaacgtcccgctgacccgcgcttgcgcattcggcatcgaactgggcaacaccgacaacgtgatcagctatgctgacggtcgtcgcgtcctgatcagcgcgggcatgatgaaattcgtgcgtagcgacgatgaactggcctacgtgatcgccaaggaaatggcgcataacacgctgacccatccagccaggcaacgcctcaccgccacgctgtccggcgtgatcgacaacctggtccgcctgcgtccggataacgcgccattaagcggcgccgccggcgtcaagccatatccgcagcagcttgatgcagcagccgacaagctggccttgtacatggtagcgcgcgccggctacaaggtcgacgatgcctcggcattctggcaacgcctggccacgcaatatccagctacggtactcaacgggtacacggcgatccatcctgccaccacctaccgcatcgctgccatcgagcaagccgtctcggatatccaagccaagcaagcgagcggcagcactgtcctgccctaa

SEQ ID NO: 1003 - DNA, 1101 bp, Collimonas sp.
atggagaaaataatgagattgacgagcggcctcagatggcagggactcaaacgctatactgcgataaccttgcccatattattactggcagcttgcgccaacacagaaacggcatcacccgaggcagcaaaacccaccgcgacggtttcccccaagccggcggcagtcgtcgtgccgccgcagcaggcagaattgaaaaccctgatcggcttgcaggaccgcctgtatgacgtggctgccccattgctggtgaataacgcgttgctatgccgtaacaatgcccgcaacctgctcggcttcacagcaaaaaccaaatactcctttacggcggaattcctcgctgcagcaagctccctcggctttaccgatcagttgcaaatcacaggcgtgctggcaggcagcggcgctgccaagtccggcctgcagcgtggcgacctgctggtcgccattcaggacaaaccggcgccggtcggcgccgatgcggaacgtcaaaccgcaatgatgctgggtcctctggtcaacggccgcaacaacatcaaggtcaccgttgcccgcagtggcagcaacctgaccatgaacgtgccgctaacgcgcgcctgcgccttcggcatcgaactcggcaacactgacaatgtaatcagctatgccgacggccgccgcgtactggtcagcgccggcatgatgaagttcacccaaaacgacgatgaactggcgctggtgatcgccaaggaaatggcgcataactcgctgacccatgcttcgcgtcagcgcaatactgcgaccatgaccggcgttatcgacaatctgatccgcctgcggccggatgccaccccactcagcggcgctgccggcgtcaagccattcccgcagcagttggatgcctccgccgaccgtctggcgctctatatggttgctcgcgccggctacaaggtcgacgacgcaggcgcattctggcaacggctggcgacgcagtatcctgcaactgtcctgaacggctatacggcgatccaccccgccaccgactatcgcatgaaagcgatcgatcaaaccgtctcggatatccaggcaaaacaagccaccggaaccaccatccagccatag

SEQ ID NO: 1004 - DNA, 1098 bp, Collimonas sp.
ttgatggagaaactgatgagattgacgcgtaacaatggatggcggcaagcccggcgctgtgcaacgctggcgctgccagtgctgttgctggcagcctgtgccacacaggagccggccaccaccgcgccgcaagtcgtgccagtccctcccaaaccggtcgtactcacaccgccgccgcaacaggctgaactgaaagccctgatcggcttgcaagaccgcttgtacgacgttgccgcgcctttgctggtgaacaatgccctgctgtgccggaacaatgcgcgcaacctgctgggcttcaccgccaagaccaaatattcctttacctccgagttcattgaagcggcaagcgctctcggcctgagcgaccagctacaagtgaccggcgtgctggccggcagcggcgccgccaaggtcggcctgcagcgcggcgacctgctggtgagcatccaggacaagccggtgccggccggcgccgacgccgaacgccagactgccctgctgctcgggccgctagtgaacggccgcaacagcatcaaggtcgtcattgcgcgcaacggcgccaaccagaccctgaacatcccgctgacccgcgcctgcgctttcggcatcgaactcggcaacaccgagaacgtgatcagttatgccgacggccgccgcgtgctgatcagcagcggcatgatgaaatacaccaagaacaacgacgaactggcgctggtgatcgccaaggaaatggcgcataacacgctgacgcatccgtcgcgccagcgcaataccgccaccatgaccggcgtcatcgacaacctgatccgcctgaagccggataccgcggccctgaacggtatggccggtgtcaagccttatccgcagcagttggacgtggcggccgacaagctgtcgctgtacatggttgcccgcgccggctacaaggtcgacgacgccgcggctttctggcaacggctggcgaccagctatccggccagcgtgctcaatggttatacggcgatccatcccggcacggaatcccgcctgtcggcaatccagcaggctgtttcggacatccaggccaagcaggcgagcggcaccgccatacaaccttaa

SEQ ID NO: 1005 - DNA, 627 bp, Collimonas Sp.
atgaaacgcatatcgtcccgtctgattttaatgctggccttggcggcgccgctggcggcccaggcgcacggctacatcgatgcccctaaatcgcgcgctttcatgtgcaagacgcaagagaatacggcttgcggcgcgattcagtatgagccgcaaagcgtggagggtccgaagggctttcccgcagccggtccggccgacggtacgatcgcggctggcggcttggcgcaattttccgaattgaatgtgcaaacgccgacgcgctggaagaaggtggcgttgaagaccggggctctcgatttcagctggtactttaccgccggccacatgacgcaggactggcgctactacattaccaaacagggctgggatccgagccagaagctgagccgggacgcttttgatttgcagccgttctgcatcgtcaagggtggtttcgcgccacccagcaacagccacgccacgcatcgttgcaccattccggccaaccgcagcggctatcacgtgatcctgagcacctggaatatcgctgataccggcaatgccttctatcaggtcgtcgatgcccagattcaaggcggagccgcggtgaatccacagaaagtgatgatcaatccgttcaagtga

SEQ ID NO: 1006 - DNA, 1098 bp, Herbaspirillum sp.
atgataaagctcctatcggccacggcaacagccatggcacaaatcacggcacacaaatgcccttggcaatggcccgccataggcagccatgtacgacgcatgctcggtctggcgctattggctgcctgcttcctgtccggccatgcggccgtggctgcctgcctggacggcaagcggctggcaggtgtcaacctgagcgggccggagttcgccgccgacaaattgcctggaacggtcttcaaagactacggctatcccgatcccgacgacatgcgtcactttcaatccgcaggcatgaacgcattccgcttgccgttcctgtgggaaaggatacagccgcaattattcggtccactggatgaagcggaagtgcaacgaatggaacaaaccgtcgctaccgcccgttcgctaggcgcctgcatcatccttgatgtgcataactttggcgaatatcgcggcaagccgctcgactcgtcggcggtaccgcgcaaggcatttttcgacttgtggagccggcttctggcccgtttcaaggaccccgaaaacaccgctttcggcttgatgaacgagcccagcaaactgccgattgcagcatgggcaggagtggcacaggaaacgcttggcatcttgcgcaaaaacggatcgcgccatctgatcttggtcgccggcggcaactggagcggcgcccattcctggttcgcgaaagagcaaggtgtatcgaatgcggatgccttcagccagtttcacgacccggccaacaattacctgatcgaagtgcatcaatacgcggatgccgatttctccggcacccaaaaaagttgtatcgatcctggccgcctgaatgcggccatgagcgcgatcaccacatgggccaaggcgaccaaacagcgtttgttcctgggtgagttcggtgtcgccgccacgccaccctgcctgcaggcgttgagcgccatcgtgggaggcatgcaggaccgcgcagcctggggcggctggacctattggaccagcagcaaatggctgggcgactatccgttcaacctggaaccggacagcaatggcgacaagccgcagatggccattttgaaaaccggcctgtag

SEQ ID NO: 1007 - DNA, 1008 bp, Collimonas sp.
atgatcaaattcctgttctccgcattgaccctggcgtgcgccttgtctggccaggcttcgttcgccgcttgcatggacggcaagccgatggccggcgtcaacctgagcggcgccgaattcgccgcggaaaaactgcccggcaaggtatttaccgactacgtgtacccggacctggatgaaatgcgcctgttccaatccatgggcatgaacaccttccgcctgccgtttctgtgggagagggtgcagccgaagctgttcggcgaactggaccaggccgaactgcagcgtatcaaggatagcgttgcagccgccagttcgattggcgtgtgcatgatcctcgatgtgcacaactatggccaatatcgcggtcagcctatcggttcgccgcaagtgccgcgcgcggccctgaccgacctttggcagcgcctgctggccaatttcaaggatccggcgaacgtcgccttcggcttgatgaacgaaccggccaaactaccgaccgcggaatgggcggcaaccgcgcaggaaacgctgaacgccttgcgcaggaaaggctcgcggcacctgatcctggttcccggcggcggctggagcggcgcccattcctggtacgcaaaagacggcgtggtgtcgaatgcagacgctttccgtttctttcgtgatcccgccgataactacatgatcgaagtgcatcagtacgcggacgcgaatttttccggcaccggcaacgagtgcgtggagccggccggcctgagcgcaatcatggccaacgtcgccctgtgggccacttcgacccggcgccgcctgtttcttggcgaattcggggtgccggccaaccagcagtgcctggcggccttgacggcaatgatggatgccatcaagggcaattccgcctggggcggctggacctattgggccgccgggcagtggctggggacttatccgttcagcgtgcagcccgacggcaacggcgaacggccgcaaatgaccatcctgaaaaaaggcatgtag

SEQ ID NO: 1008 - DNA, 1068 bp, Collimonas sp.
atgatcaagatcctgccaatgagagcgcgtggcgacgccagtccgtcctccgacatgtggcggcgggcgctggccgtcgtggtgactgtcggatgcgtcttgttttgcaatctggcggttgccggttgcctcgatgataagcgcagggtcggcgtcaacctgagcggcgccgagttcgctgcggaaaaattgccgggaacagtctttaaggattacgtttatcccgatccggccgacatgcgtcatttccaatcgctgggcatgaatacctttcgcctgccttttctgtgggagcggatacagccacaattattcggcgcgcttgatccgggagaattgcaacggataaaagacactgtcgcgactgcgcaatcgctcggagtgtgcattattctcgacgtacataatttcggacagtatcgcggcaatcctattggttcgtccggcgtgccgcgtgctgcctttatcgatttgtgggcgcgtctgctgacaacgttcaaggatcctgccaacactgcgttcgatttgatgaatgaacctgcaaaaatgtcagtggcggcctgggcatcgaccgcgcaggagacgcttaacgttttgcgtaaacgcggttccaagcatttgatcatgattccgggcggtggctggagtggcgcgcattcctgggatacgaaagatatcggcgtgtcgaatgccgatgctttccggtcatttcgcgatcccgaaaacaattacatgattgaaatgcatcagtacgctgacgccgattcctccggtaccagcaacacttgtgtcgatcccgttcgcttgagtgcggtgatggcaaacgtcacggtatgggccaattcgaccaagcagaaattgtttctcggtgaattcggcgttgccgtcaatggtccctgcttaaaggcgttgatggcaatcatggaaggcatgaaaggcagttctgcctggggcggctggacctactggtccgctggcaagtggctagggagctatccgttcagtatcgaaccagatgataacggtgacaagccgcaaatggcgattttgaaaaattacatgccttag

SEQ ID NO: 1009 - DNA, 1074 bp, Herbaspirillum sp.
atgataaagcgcctatcgatcacggcacgtaagtgcccttggcaatggtccgccctggccagccatgtacgacgcatgctcggtctggcgctattggctgccggcttcctgtccggccatgcggccgtggccggctgcctggacggcaagcggctggcaggcgtcaacctgagcgggccggagttcgccgccgaaaaattgcccggaacggtcttcaaggactacggctatcctgatcccgacgacatgcgttactttcaatccgcgggcatgaacacattccgcttgccgttcctgtgggaaaggatacagccgcaattattcggtccactggatgaagcggaagtgcaacgaatagaacaaaccgtcgctaccgcccgttcgctaggcgcctgcatcatccttgatgtgcataactttggcgaatatcgcggcaagccgctcgactccccggcggtaccgcgcaaggcatttttcgacttgtggagccggcttctggcccgtttcaaggcccccgaaaacactgctttcggcttgatgaacgagcccagcaaattgccgattgcagcatgggcaggagtggctcaggaaacgcttgatatcttgcgcaaaaacggatcgcgtcatctgatcctggtcgccggtggcagctggagcggcgcccatgcctggttcgcgaaagagcaaggtgtatcgaatgcggatgccttcagccagtttcacgaccccgccaacaattacctgatcgaagtgcatcaatacgcggatgccgatttctccggcacccaaaaaagttgtatcgatcctggccgcctgaatgcggtcatgaacgcgatcaccacatgggccaaggcgaccaagcagcgtttgttcctgggcgagttcggcgtcgcccccacgccaccctgcctgcaggcgttgagcgccatcgtgggaggcatgcaggaccgcgcagcctggggcggctggacctattggaccagcagcaaatggctgggcgactatccgttcaacctgggacccgacagtaatggcgacaagccgcagatggccattttgaaaaccggcctgtag

SEQ ID NO: 1010 - DNA, 864 bp, Dickeya sp.
atgtcaataaaagttgatattactgcatcatcagacaaccatcaaacgatagccacagctacaggaaatgatattgccgttatcagcaatgaagaaagaggtacttttcagctaaacgatcaacagctaaagagggcggttgaagtttattttggcagaaaaccgaatgatgcatacctttctagccctacgccctggggggatttatataagacctacaattggcagcaggttatgagaaccttacagccggtaagcacaagggtcattagccaaaactcaacaccggttattgttatggaacaggattttgttaataacagctctgttcctgctgtttataatgtaaaaatctcacaaagtgttcagaataccgtaaaatccagctggaataccggaggaaagttaaccgtagggcagaaagttaagtatggcatatcctttctgggaacgggtggagggggcgagtcatctatatcgtatgaacagtcgtggggaattggcggtgaacaatcgacgactataacgttaggaactgaatccggcttgcaggttactctacagccaggccaggccgttacagcagagctggtcgcatccagaggatcgatgaaagttcaggtagattatcaggcgtctctttctggaatcagtgcggttaattataaccccacctataaagaccatcatttctggggacttcccatcactcagatcatgagaagttcaaatataagtaactcgatagtttcatctgaaataatcgacatcggattttacgctgactcaaaagttattcttcgcgacaaaaataccggtggggtgttcagaacgtttaatcttttcgacaaacacaccgactag

SEQ ID NO: 1011 - DNA, 336 bp, Janthinobacterium sp.
atgaagcgaatactaggccttgcgctgctgggcgccgccgcggcggcgcaggccggcgacatcacgctgtacacgcgcgcgcacttcggcggcccggcgctgcagctgcacggctcggagcccgacctggacaagctgggcttcaacgaccgcgcctccagcgtgatcgtgcagaacggcacctgggaagtgtgcgagaacaagcactacaagggcaagtgcctgatcctggaaaagggcgagtacgccgaactgaagaactttaacgacatgatgtcgtcggtgcgcgaaatcgaggccaagccggcgtccagggacaagcccgggcataagtga

SEQ ID NO: 1012 - DNA, 366 bp, Duganella sp.
atgcgggacaccgccactctcgggagtaccgttcatgaagcgaattctaggccttgcgctgctgggcgccgcgcggcgcaggccggcgacatcacgctgtacacgcgcgcgcacttcggcggcccggccctgcagctgcacggctcggagcccgacctggacaagctgggcttcaacgaccgcgcctccagcgtgatcgtgcagaacggcacctgggaagtgtgcgagaacaagcactacaagggcaagtgcctgatcctggaaaagggcgagtacgccgaactcaagaactttaacgacatgatgtcatcggtgcgcgaaatcgaggccaggccggcgtccaaggacaagcccgagcataagtga

SEQ ID NO: 1013 - DNA, 1365 bp, Janthinobacterium sp.
atgcattgcaagccactcatcttgaccgccctgagcgtgttggccatcgcgcccgccgttgcggccggccctgacaccagccgtcaccaggcccagatcgaccagatcgtcaaggaaatctcgcctgcccgcatcgagggttatatcaacaagctggtcggctttcgcacgcgccacacgatgtcggacacggtctccgaaaccgaaggcataggcgcggcccggcgctggatcaagagcgagctggagcgctgcggcgcggcccagggcggacgcctgcaagtggcgttcgacagccacatcgcgcccgtctccgcgcgcatcagccggccgaccgagatcgtcaacgtggtggcgaccttgccgggcacgcaggccgcgtccgtggaccgcatgtatgtggtgagcggccactacgactcgcgcaacaccgacgtcatggacgccaagggcgacgcgcccggcgccaacgacgacgcttccggcaccgccgccgtgatggaaatggcgtgcgtgatggccaagtacaaattcgacgccacgctggtcttcatgacggtggcggcggaagagcagggcttgctgggcgcggcgcactgggccgagctggccaggcagaagaacctgaacatcgccggcatgttcaccaacgacatcatcggcagctcgcgtgacgagcacggcaagatcgacaatacgcaagtgcgcttgttcgccgaaggcttgccggtgcaaaaggaaaacagcgacaccgtgcgtacgctgatccagaccggcggcgagaacgattcgctgtcgcgccagctggcgcgggcggtgaaggaggcgggcgagcgttacgtgcccaagttcaaggtcaacgtcatccagcgccgcgaccgttacctgcgcggcggcgaccacatgccgttcctggagcgcggctatgcggccttgcgtttcaccgagccggccgaggacttcaaccaccagcaccagaacatccgcaccgagaatggcgtgctgatcggcgacctgccgcagtacgacgatttcaactacatcgcccaggtggcgcgggtgaacgcggcggccttgtcgtcgctgtcgctggcgccggccgcgccggccaaagtgcaggtgcgcaccgccaaattgcagaacgataccgagctggtgtggcaagccaatgccgagccggacctggcgggttaccgcatcgtctggcgcgacacctcggccgccgaatggcagggcagccagttcgtcggcaaggccaccgagttcacggtgccgctgtcgaaggacaactactacttcggcgtccaggccatcgacaccgaaggcaacgccagccccgccagctacccgacgccgctgcgctaa

SEQ ID NO: 1014 - DNA, 1365 bp, Oxalobacteraceae sp.
atgcataaaaattcgctcatcttgtccgccctgaccgtgctggccgccgtgcccgccgtcgcggccacgcccgacaccacccgccaccaggcccagatcgaccagatcgtgcagcagatctcgccggcccgcatcgaaggctacatcaacaagctggctggcttccgcacgcgccacacgatgtcggatacggtttccgagaccgaaggcatcggcgctgcgcggcgctggatcaagagcgagctggaacgctgcggcgcggcccagggcggccgcctgcaagtggcgttcgacagccacatcgcgccggtctcggcgcgcatcagccgcccgaccgagatcgtcaacgtggtggcgaccttgccgggcgcgcagtccgcctcggtggaccggatgtacgtggtcagcggccactacgattcgcgcaacaccgacatcatggacgccaagggcgacgcgcccggcgccaacgacgacgcctccggcaccgccgccgtgatggagatggcctgcgtgatggccaggtataaattcgacgccaccctggtcttcatgacggtggcggcggaagagcagggcttgctgggcgcggcgcactgggccgagcaggccaaacagaaaaacctgaacatcgccggcatgttcaccaacgacatcatcggcagctcgcatgacgagcacggcaaggtcgacaacacgcaagtgcgcttgttcgccgaaggcctgccggtgcaaaaggaaaacagcgacgccgtgcgcagcttgatccagaccggcggcgagaacgattcgctgtcgcgccagctggcgcgggcggtgaaggaggcgggcgagcgttacgtgccgaagttcaaggtcagcgtcatccagcgccgcgaccgttacctgcgcggcggcgaccacatgccgttcctggagcgcggctacgcggcgctgcgcttcaccgagccggccgaggacttcaagcaccagcaccagaacatccgcaccgagaagggcgtgctgatcggcgacctgccgcagtacgacgacttcaactacatcgcccaggtggcgcgggtcaacgcggcggccctctcctcgctgtcgctggcgccggccgcgccggccagggtgcaggtgcgcaccgccaagctgcagaacgataccgagctgttatggcaagccaacgccgagccggacctggcgggctaccgcatcgtctggcgcgacactacgtcggccgaatggcagggcagccagttcgtcggcaaggccaccgagttcaccgtgccgctgtcgaaggacaactactacttcggcgtgcaagcgatcgacaacgacggcaacgccagcccggccagctacccgacgccgttgcggtga

SEQ ID NO: 1015 - DNA, 1356 bp, Janthinobacterium sp.
atgggacggattttgacggcaatgacggcagcaatgctgtcggcgggcgcggcggcggcgccgggcgccgaaccggcgcagcagcagatcaggcaggtggtggccgacatttcgccacagcgcatcgaggcgcatgtgcgcaagctcgtgggtttccagacgcgccacacgatgtcctataccgtgtccgacacgcgcggcattggcgcggcccggcgctggatcaaggccgagctggagcgctgtggcgcgcaggcgggcggacggttgcaggtggcgttcgacagccatatcgcgcccgtgtcgaaacgcattgcgcggccgacggacatcgtcaacgtggtggcgaccttgcccggcactcagccgcagtcggccgggcgcatctatgtcgtcagtggccattacgattcgcgcgccaccgacgtgatggatgcgcagggcgacgcgcccggcgccaacgatgacgcgtccggtacggcggccgtgatcgagacggcttgcgccatggcgcgctaccagttcgacgccaccatcgtcttcatggccgtggcggccgaggaacagggactattgggttccggccattgggcgcagcaggcaaaattgaaaaatctcaatatcgccggcatgctcaataacgacatcatcggcagttcgcgcgcggaagacggcacggtcgatggcggccaggtgcgcctgtttgccgaaggcatcccggccgtgaaggagatgagcgacggcgtgcgcgccctggtggcgacgggcggcgaaaacgattcgatttcgcgccagctggcgcgccatgtgaaacaggtgggcgagcgctatgtgcccggctttacggtcaacgtcatccagcgcgccgaccgctacctgcgcggcggcgaccatatgcctttcctcgcgcaagggtacgcggcgctgcgtttcacggaaccgcacgaagattttgcccatcagcaccaggatgtacgcgtggaaaacggcgtgcagtacggcgacttgccgcaattcgtcgactatgactacgtggcgaaagtggcgcgcgtgaatgcggcggcgctcgcgtcgctggccttggcgccggccgcgcccgccggcgtgcaggtgcggacggcccagctggaaaacgccacctcactggtctggcagccgaatacggaaccggacctggccggttaccgcatcgtctggcgcgccacgacggcggaccagtggcagggcgcgcaggacgtgggcaatgtcaccgaggccagggtgaagctgtcgaaagacaactatttctttggcgtccaggccatcgaccgcgacggcaatgtcagcgtggccacgtatcccatgcccttgcgttaa

SEQ ID NO: 1016 - DNA, 1365 bp, Janthinobacterium sp.
atggcagggattgtgacggcaatgacggcaatgacggcagccatgctgtcggcgagtgtggcggctgcgccgggcgccgaaccggcgcagcagcagatacggcaagtggtggccgacatctcgccgcagcgcatcgaggcgcatgtgcgcaagctggtcagtttcgggacgcgccacaccatgtccgataccgtgtccgacacgcgcggcatcggcgcggcccggcgctggatcaaggcggagctggagcgctgcggcgcgcaggcgggcggacgactgcaggtggcgttcgacagccatgtggcgcccgtgtcgaaacgcattgcgcggccgacggaaatcgtcaacgtggtggcgaccttgccgggcagccagccgcagtcggccgggcgcatctatgtcgtcagcggccattatgactcgcgcgccaccgacgtgatggatgcgcagggcgacgcgcccggggccaacgatgacgcctcgggcacggcggccgtcattgaaatggcttgcgcgatggcgcgccaccagttcgacgccacgctcgtcttcatggccgtggcggccgaggaacagggtttgttgggttccggccactgggcgcagcaggcaaagttgaacaagctcaacatcgccggcatgctcaataacgacatcatcggcagttcgcgcgcggaagacggcaccgtcgatggcggccaggtgcgcctgtttgccgagggtatcccggccgtgaaggagatgagcgacggcgtgcgtgccctggtggcgacgggcggcgaaaacgattcgctctcgcgccagctggcgcgccatgtgaaacaggtgggcgagcgctacgttcccggtttcaaggtcaacgtcatccagcgcgccgaccgctacctgcgcggcggcgaccatatgccgttcctggcgcaaggctacgcggcgctgcgctttacggaaccgcacgaggattttgctcaccagcaccaggatgtgcgcgtggaaaatggcgtgcagtacggcgacctgccgcaattcgtcgatgacgagtatgtggcgaaagtggcgcgcgtgaatgcggcggcgctcgcgtcactggccctggcgccggccgcgcccgccggcgtgcaggtgcgcacggcccagctggaaaacgccactgcactggtctggcagccgaacacggaaccggacctggccggttaccgcatcgtgtggcgcgccacgacggccgaccagtggcagggcgcgcaggatgtgggcaaggtcaccgaggccaaggtcaagctatcgaaagacagctatttctttggcgtccaggccatcgacaacgacggcaatgtcagcgtggccacctatcccatgcccttgcgctag

SEQ ID NO: 1017 - DNA, 1365 bp, Janthinobacterium sp.
atggcagggattgtgacggcaatgacggcaatgacggcagccatgctgtcggcgagtgtggcggcggcgccgggcgccgacccggcgcagcagcagatacggcaggtggtggccgacatctcgccgcagcgcatcgaggcgcatgtgcgcaagctggtcagtttcgggacgcgccacaccatgtccgataccgtgtccgacacgcgcggcatcggcgcggcccggcgctggatcaaggccgagctggagcgctgcggcgcgcaggcgggcggacgactgcaggtggcgttcgacagccatgtggcgcccgtgtcgaaacgcattgcgcggccgacggaaatcgtcaacgtggtggcgaccttgccgggcagccagccgcagtcggccgggcgcatctatgtcgtcagcggccattatgatacgcgcgccaccgacgtgatggatgcgcagggcgacgcgcccggcgccaacgatgacgcctcgggcacggcggccgtgatcgagatggcctgcgcgatggcgcgccaccagttcgacgccacgctcgtcttcatggccgtggcggccgaggaacaggggctgctcggttccggtcactgggcgcagcaggcaaagttgaacaagctcaacatcgccggcatgctcaataacgacatcatcggcagttcgcgcgcggaagacggcacggtcgatggcggccaggtgcgcctgtttgccgagggtatcccggccgtcaaggagatgagcgacggcgtgcgcgccctggtggcgacgggcggcgaaaacgattccctctcgcgccagctggcgcgccatgtgaagcaggtgggcgagcgctacgtgcccggtttcaaggtcaacgtcatccagcgcgccgaccgctacctgcgcggcggcgaccatatgccgtttctggcacaaggctacgcggcgctgcgtttcacggaaccgcacgaggattttgctcaccagcaccaggatgtgcgcgtggaaaatggcgtgcagtacggcgacttgccgcaattcgtcgactatgactacttggcgaaagtggcgcgcgtgaatgcggcggcgctcgcttcgctggccctggcgccggccgcgcccgccggcgtgcaggtgcgcacggcccagctggaaaacgccaccacgctgttgtggcagccgaatacggagccggacctggccggctaccgcatcgtctggcgcgccacgacggccgaccagtggcagggcgcgcaggatgtgggcaatgtcaccgaggccaaggtcaagctatcgaaagacagctatttctttggcgtccaggccatcgaccgcgacggcaatgtcagcgtggccacgtatcccatgcccttgcgctga

SEQ ID NO: 1018 - DNA, 1377 bp, Massilia sp.
atgcctcgttcccgcatttcttcccgcctgctggcagccctgctggccgcagccagcgcctcgaccgccgccgctccggcagccgcccccgacatcagccgcgagcaggcccagatcaggaagatcgtcgccgagatctcgcccaagcgcatcgaagcctacgtccgcaagctggtcggcttcggcacccgccacacgatgtcggacaccggatccgagacccgcggcatcggcgccgcgcgccgctggatcaaggccgagctggaacgctgcggcgccggcacccccctgcaggtcgccttcgacagccacgtggccccggtctcgccgcgcatctcgcgtccgaccgagatcgtcaacgtggtcgccaccctgccgggcgcccaggatgccgcgaaggaccgctactacgtggtcagcggccactacgactcgcgcgccacggacgtgatggacgccacctcggaggcgcccggcgccaacgacgacgcctccggcaccgccgccgtcatggagctggcctgcgtgatggcgaagtacaagttcgacgccagcctggtgttcatggcggtcgccgccgaggagcagggcctgatcggcgcacgccactgggcggtgcaggcgcgcgagaagaacctgaacgtggccggcatgttcaccaacgatatcatcggcagctcgcgcgccgacgacggcaagatcgacaacaagcaggtgcgcctgttcgcccagagtatcccggcgacgaaggaaatgagcgaggccgtgcgccagctggttgccaccggcggcgagaacgactcgatctcgcgccagctggcgcgccataccaaggagcagggcgagcgctacgtgaagggcttcaaggtctcggtgatccagcgccacgaccgctacctgcgcggcggcgaccacatgcccttcctggagcagggctatgccgcgctgcgcttcaccgaaccgaacgaggacttcgcccaccagcaccaggacctgcgcaccgagaacggcaaggtgtacggcgacctgatcgagttcgtcgacttcgactacatcgccagggtcgccagggtgaacggcgcggccctggcctcgctcgcgctggcaccggccgcaccgcgcgaggtcaggctgcggaccgacaagctgaccaacgactcgaccctggtctggcagccgaacccggagcccgatgtcgccggctaccgcatcgtctggcgcgacaccaccgccgccaactggcagggcgccaagtgggtcggcaacgtgaccgaggccaccgtcgacctgtcgaaggacaatgtgttcttcggcgtgcaggcggtcgacagggacggcaacgtcggcgtcgccacctacccgtcgccgcaacgctga

SEQ ID NO: 1019 - DNA, 1392 bp, Massilia sp.
atctcttcctccctgctggccgcactgcttgccgttagcgccggcgccgcatgggtgcgccctgcagcggccgcctccccggcccctgcagccccggcggcacccgatttcaagcgccagcagccccagatcaacaagatcctcgccgagatctcgcccaagcgcatggagggctatgtcgccaagctggtgagcttcggcacccgccacacgatgtcggaaaccgaatcggacacgcgcggcatcggcgccgcgcgccgctggatcaaggccgagctggagcgctgcggcgccggcacgccgctgcaggttgctttcgacagccacatcgctccagtgtcggcgcgcatttcgcgcccgaccgagatcgtcaacgtggtcgccaccctgccgggtacccaggaagcctccaaggaccgcatctacgtggtcagcggccactacgattcgcgcgtcagcgacgtgatgaactacaccgccgacgccccgggcgccaacgacgacgcctccggcaccgcggccaccatggaactggcctgcgtgatggccaagcacaagttcgacgccaccatcgtcttcatggccgtggccgccgaagaacagggcctgctgggcgcgcgccattgggccactcaggcgcgccagaagaacctgaacattgccggcatgtacaccaacgacatcatcggcagctcgcgcgccgacaatggcaaggtggacaacaagcaggtgcgcctgttctcgcagagcatcccggccaccaaggagatgagcgaggccgtgcgccagctggtggccaccggcggcgacagcgattcgctctcgcgccagctggcccgccacaccaaggagatgggcgagcgctacgtgaagggcttcaaggtgacggtgatccaccgcgccgaccgctacctgcgcggcggcgaccacatgcccttcctggagcagggctacgccgcgctgcgcttcaccgagccggccgaggacttcgcccaccagcaccaggacctgcgtaccgaaaacggcaaggtctacggcgacctgatcgagtttaatgattacgactacatcgccaaggtgaccaaggtgaacgccgcggcactggcctcgctggcgctggcgccaggcgcgccgcagaacgtcaagctgcgcaccgacaagctgaccaatgattcgaccctggtatggcaggcgaacgccgagccggacgtggcgggctaccgcatcgtctggcgcgagaccaccgccgccgactggcagggttcgaagtgggttggcaacgtcaccgaggcgacggtcgacctgtcgaaggacaatgtgttctttggcgtgcaggcagtcgacaaggatggcaacgtgagcgtcgccacctacccgctgccgcagcgctga

SEQ ID NO: 1020 - DNA, 1383 bp, Massilia sp.
atgcctcacgcccgcatctcttcctctctgctggccgcactgctcgccgttagcgccggtggagcaagcgccgcaccggccaccccggcagcgccagacttcaagcgccagcagccccagatcaacaagatcctcgccgagatctcggccaagcgcatggaaggctacgtcgccaagctggtcagcttcggcacccggcacacgatgtcggaaacggaatctgacacccgcggcatcggcgccgcccgccgctggatcaaggcggaactcgagcgctgcggcgccggcacgaagctagaggtgtctttcgacagccacattgccccggtatcggcacgcatctcgcgcccgaccgagatcgtcaacgtggtcgccacgctgccgggcatccaggaagcctcgaaggaccgcatctacgtggtcagcggccactatgattcgcgcgtcagcgacgtgatgaactacacggcggacgccccgggcgccaacgacgacgcttccggcaccgcggccaccatggaactggcctgcgtgatggccaagcacaagttcgacgccaccatcgtcttcatggcggtggccgccgaagagcagggcctgctgggtgcgcgccactgggccacccaggcgcgccagaagaacctgaacatcgccggcatgtacaccaacgacatcatcggcagctcgcgcgccgacaatggcaaggtggacaacaagcaggtgcgtctgttctcgcagagcatcccggccaccaaggaaatgagcgagaccgtgcgccagctggtggccaccggcggcgacagcgactcgctctcgcgccagctgggccgccacaccaaggagatgggcgagcgctacgtgaagggcttcaaggtgtcgctgatccaccgcgccgaccgctacctgcgcggcggcgaccacatgcctttcctggagcagggctacgccgcgctgcgcttcaccgagccggccgaggacttcgcgcaccagcaccaggacctgcgtaccgaaaacggcaaggtctacggcgacctgatcgagtttaatgattacgactacatcgccaaggtgaccaaggtgaacgccgcggcgctggcctcgctggcgctggccccggccgcgccgcagaacgtcaagttgcgcaccgacaagctgaccaacgactcgaccctggtgtggcaggcgaatgccgaaccggacctggcgggctaccgcatcgtctggcgcgacaccaccgccagcgagtggcagggttcgaagtgggtcggcaacgtgcttgaagcgaccgtcgacctgtcgaaggacaacgtgttcttcggcgtgcaggcagtcgacaaggacggcaacgtgagcgtcgccacctatccgctgccgcagcgctga

SEQ ID NO: 1021 - DNA, 1368 bp, Duganella sp.
atggctgacaataagtatgctcgcatgctggccgccgggctggcgctggctgccgcctccggcatcgcacgcgccgcagcgccggatgtggaacgccgccagccgcaagttgaaaagatcgtcgccgacatctcgccgcaacgcatcgaagccgcggtgcgcaagctggtcggattcaggacgcgccacagcatgtcggagacggaatccgacaccatcggcatcggcgctgcgcggcgctggatcaagtcggaacttgagcgctgcggcagcggcaagctgcatttgagtttcgatagccatatcgcgcccgtctcggcccgcatcagccacccgaccgaaattgtgaacgtggtcgccatgcttcccggcgcgcaagccgaatccagggagcggctctacgtggtgagtggacactatgactcgcgcaatagcgatgtgatggatgccagcggcgccgcgccgggcgccgatgacgacgcttccggcgttgcggcggtcatggaaatggcctgcgtcatggccaggtacaaattcgacgccaccctggtcttcatggcggtcgccggagaagagcagggcctgctgggcgcgcgccactacgccgtacaggcgaagcagcagggcctgaatatcgccggcatgttcaccaatgacatcatcggcagcgcgcgcgacgagaatggcaacctcaataaccggatggtgcgcttgtttgccgagggcctgccgctggagaaggaaaccagcgagagcacgcgcctattgctttccaccggcggtgaaaacgactccttgtcgcgccagctggcgcgccatgtgaaggagcagggcgagcgctatgtgcccggcttccaggtgaatgtggtgcagcgccgcgaccgctatttgcgcggcggcgaccatctgcccttcctggagaatggctatgcggccctgcgctttaccgaagcggcggaggacttcagccaccagcatcagaacctgcgcagcgaaggcggcaaggtgtacggcgacctgcccgaatttaacgactacgactacatcgcccaggtggcgcgcgtgaatgcggccgcgctggcgaccttggctaatgcgccggccgcgcctagcagggtgcagctgcgcaccgcggagctggaaaacggctccagcgttctctggcagcccaacagggagccggatatcgccggctaccggattgtgtggcgggagaccagcgccgcggactggcagggcagcctgttcgtcggcaatgtgacggacgccaaaatcagcctgtccaaggacaacgtctgcttcggcatccaggcggtcgacaaggacggcaacgtcagccctggcacctacccggcgccgctgcgttag

SEQ ID NO: 1022 - DNA, 1227 bp, Duganella sp.
atgacaacaaccacagcacccaaactggcgctggccgccgccatcctgctggcctacagcgcacccagcctggccgcagccacctgcgatcgctacgcgtcctacccggtcaagggcgggacctataccgtcatcaccaacttctggaacgacaaggccagcggttcgcaatgcgtcaacgtcaaccaggaaagcggcgagtggagcgtgagcagcgcgccgtcatcgccggacagcacgccggccgcctatcccgccatctacaagggctgccactgggcctcgtgcaccaaggacagcggcttgccgttgcaggccaaggccatcacctacgcgccgacgcgctggcgcgtcacgcccggcgccggcggcgactgggacatcgcctatgacatctggttctcgtccggccgggaggcgccgcccagcggccagcccgacggcgccgagatcatgatctggattaaccacagcggctcggtgcaaccggccggcaccaagaccgccaacgtcaacatcaacggcatgaactgggatgtgtggaccgcctggaacaacccgtccggctggccgcgctggaacatcgtctcctacgtcgccacttcgccggtcaacgccgtcaacttcgacctggtgccgttcttccgcgactcggtcgggcgcaaggcggtcgacaacaactggtacctgctggacgtggaagcgggcaccgaactctggcgcaacggcgccggcttcgccagcggcgatttcgacgtgcagttccacaccgatccggtcaaggggatcgatccgaacaagtggtacagcgtcgtcaacaagaacagcggctcttgcgtcgacgacgccgatttctcgaccagtaacggcgccgtggtccatcaatgggcgtgcgacagccggggcgcggccaaccagcagtggaagttcacgcctaccgatagcggcaactaccgcgtcagcacccagcaggcaccggggctggcctgggatgtcgcgggctggggcacggccaacggttcgctggtccagctgtggacctacggcggcggcagcaaccagcaatggcaggcggtggacctgggcgacggctactacaagttcgtcggccgcggcagcggcaagtgcctcgacgtgccggccgcttccacctccaacggcgtgcagctgcaggtctacgactgcaatggcacgccggcgcaatccttcaagctgatcgcacagtaa

SEQ ID NO: 1023 - DNA, 1227 bp, Janthinobacterium sp.
atgacaacaaccacagcacccaaactggcgctggctgccgccatcctgctggcctacagcgcacccagcctggccgcttccacctgcgatcgctatgcttcctacccggtgaagggcggaacctacaccgtcatcaccaacttctggaacgacaaggccagcggcgcgcaatgcgtcaacgtcaaccaggacaacggcgaatggagcgtgagcagtgcgccgtcatcgccggacagcacgccggccgcctatcccgccatctacaagggctgccactgggcctcgtgcaccaaggacagcggcctgccattgcaggccaaggccatcacctacgcgccgacgcgctggcgcgtcacgcccggcgccggcggcgactgggacatcgcctacgacatctggttttcgtccggccgggaggcgccgcccagcggccagcccgacggcgccgagatcatgatctggattaaccacagcggctcggtgcaaccggccggcgccaagaccgccaacgtcaacatcaatggcatgaactgggatgtgtggaccgcgtggaacaacccgtccggttggccgcgctggaacatcgtctcctacgtcgccacctcgccggtcaacgccgtcaacttcgacctggtgccgttcttccgcgactcggtcggccgcaaggcggtcgacaacaactggtacctgctggatgtggaggcgggcaccgaactctggcgcaacggcgccggcttcgtcagcggcgatttcgatgtgcagttccacaccgacccggtggtcgggatcgacccgaacaagtggtacagcgtggtcaacaaaaatagcggttcctgcgtcgacgacgccgatttctcgaccagtaacggcgccgtggtccatcaatgggcgtgcgacagccggggcgccgccaaccagcagtggaagttcacgcctaccgacagcggcaactaccgcgtcagcacccagcaggcgccggggctggcctgggatgtcgcgggctggggcacggccaatggttcgccggtccagctgtggacctacggcggcggcagcaaccagcaatggcaggcggtggatcagggcgacggctactacaagttcgtcggccgcggcagcggcaagtgcctcgatgtgccggccgcttccacctccaacggcgtgcagctgcagatctacgactgcaacggcacgtcggcgcaatccttcaagctgatcgcacagtag

SEQ ID NO: 1024 - DNA, 1227 bp, Oxalobacteraceae sp.
atgccatacaccacgttttccaaattgacgctcgcggcagccatcacgctcgcctacagcgcacccggcatggccgcatcgagctgcgagcgttacgcctcgtatccggtgctgggcgagacctacaccgtcatcaccaacttctggaacgacaaggccggcggctcgcagtgcatcaacgtcaatcccgacaccggcgaatggagcctgagcagcgcgccgtcgtcgccggacagcacgccggcctcgtacccggccatctacaagggctgccactggggctcgtgcaccaaggacagcggcctgccgctgcaagcgaaggcgctgacctacgcgccgacccgctggcgcatcgcgcccggcgcggccggcaactgggatgtggcctacgacatctggttctcgtccggcccgaccgcgccggccagcggccagccggacggcgccgagatcatgatctggattaaccacaacggcccggcgcagccggccggcagcaagaccggcaacgtcaatatcaacggcatgaactgggacgtgtgggtcgactggaaaaatccgggcggctggccgggctggaacatcatttcctacgtcgccacctcgccggtgaacgaagtcaacttcgacctggcaccgttcttccgcgactcgctcggccgcaacgtggtcgacaacaactggtacctgctggacgtcgaagcgggcaccgagatctggcgcaacggcgccggcttcgccagcagcgccttcgacgtgcagttccacaccgacccggtcaagggcatcgaccccggcaagtggtacagcgtggtcaacaagaacagcggctcctgcatcgacgacgccggctactcgaacagcaacggcgcggcggtccagcaatgggcctgcgacagccgcggcgccgccaaccagcaatggcagttcacgcccaccgacagcggcaactaccgcgtcagtacccaacaggcgccggcgctggcgtgggacgtggccggctggggcacggccaacggttcgccggtgcagctgtggacctacggcggcggcagcaaccagcaatggcaggcggtggacctgggcgacggctattacaaattcgtcggccgcgccagcggcaagtgcctggacgtgccggccgcctccacctccaacggcgtgccgttgcagctctgggactgcaacggcacaccggcgcagtcgttcaagctgatcgcccaatag

SEQ ID NO: 1025 - DNA, 813 bp, Janthinobacterium sp.
atgaacaagcccctcaacatcgcaatggccatcgccaccctgacgctggcgtcgcaagccatggcccagatcacgttctacgaacatgacggctggcgcggccgcaccttcaccgccaaccagcaggtgcgcgacttcacccgcaacggcttcaacgaccgtgcttcgtccgtcgtggtcgaccgcggacagtgggaagtctgcgacgacgccaacttccgcggcaactgcatggtgctgcgccacggcagctacgaatcgctggccggcatgggcctgaacgaccgcatctcgtcggtgcgcccggtgggcaagcgcaacagctacgccaacgaagcgccggcgccgctgccgcagccgacctatgaataccgccgccgtccaagggagcgtctggtcgaagtgcctgtgacctcggtacgcgccgtggtcggcacgccggaacaacgctgctgggtcgaacgccagcaagtggccgaaccggcccgtaacggcgccaacgtcggcggcgtcatcgccggcgccctgatcggcggcatcctgggccaccaggttggcggcggcacgggtcgcgatgtggcgacggccggcggcgcggtcgcgggcgcggccatcggcaacaacatggccaacaacagtggccagcaaagctatgcgcgcgacgtgcgccgctgtgaaaacgtcagcaatcccaagcctgaatactgggatgtgacgtacaactaccgcggccaggagcatcgcgtgcagatgagcacgcctccgggccagtccatcgccgtcaacagcaacaccggcgaaccacgcatgtaa

SEQ ID NO: 1026 - DNA, 819 bp, Oxalobacteraceae sp.
atgaacatgaaccagcccctccaactcgccatcgcactcgccgcactgactttgacgtcgcaagccatggcccagatcacgttttacgaacatgacggctggcgcggccgtgccttcaccgccagccgtccggtcaacgacttctcgcgcaccggtttcaacgaccgtgcctcgtcggtggtggttgagcgcggccaatgggaagtctgcgacgacgccagcttccgcggcaaatgcatggtgctgcgccgcggcagctatgattccctgggcggcatgggcatgaacgaccgcatctcgtcggtgcgcccggtaagccgtcgcaaccgctatgcccacgaggcgccggctccgctgccgcaacccacttatgaataccgccgccgtccaagcgaacgcgtggttgaagtgccgatcagttcggtacatgccgtggtcggcacgccggagcagcgctgctgggtcgagcgccagcaagtgactgaaccggcccgcagcggcaacaatgtcggcggcgtcatcgccggcgcgctgatcggcggcatcctgggtcaccaggtgggcggcggcacgggacgcgacgtggccacggccggcggcgcagtagccggcgcggccatcggcaacaacatggccaaccgcagcaactcgcagagctatgcacgcgacgtgcgccgctgcgaaaacgtcagcaacccgacgccgcaatactgggacgtgacatataactatcgcggccagcaacaccgcgtgcagatgagcaccgcccccggccagaccatctcggtcaacgccaagaccggcgaaccacgcatgtaa

SEQ ID NO: 1027 - DNA, 387 bp, Streptomyces sp.
atgaggaacagtctctctgcactactcgtggcggtagccgctgcgaccgccaccgtggtgccgacttccacggcacacgcagctgacggatacgaccggtgcgccgacggctactactgcatgttctcgggcctcgacgggaccggcgacatgatcatgctcaggggaagcgccccagatctcgcggcgctcggcatgaacgaccgggccaagtcggattggaaccggacgagttcgaccatccacctctggtctgacacgaactacagcggctgtacggccgtgacctcttccggaccgaccggcaagggcaactacttccccgcctaccagaacttcttcagctcggtgcagttcgacgggccggacggtccaagctgcggctag

SEQ ID NO: 1028 - DNA, 402 bp, Streptomyces sp.
atgagggaaacgttgcgtgcgctgctggttccagtggtcgccggggctgccatgacgctgccggtcaccacggcccatgcggccagcgggtatgaccgatgcccggccggctactactgcatgttctcgggcctggacggcaccggcgacatgatcaggctgacggggagcacgccggacctcgcggcgctcggaatgaacgaccgggcgaagtcggattggaaccggaccgcttcgaccgtccacctgtggtccgacgcgaactacaccggctgcacggcggtcacctccagcgggccgactggcagggggaacttcttcccggactaccagaacttcttcagctcggtgcagttcgacggtccgggcggcccgagctgcggcactgcgtccggcgactga

SEQ ID NO: 1029 - DNA, 510 bp, Streptomyces sp.
atggcccgcgcaccgctgttccagtggtcgcgcctcgcgcactcgtgggcccggatgacagcccggatgacagaggggatcgccatgcgcagggtcatcgcgacgcgaaggaagctctccgtgctggtggcggtgctggccgcggccggtgcctccgtggtgccggtctccacggcgcacgcggccgatgggtacgaccggtgccccgacggctactactgcatgttctcggggctggacggcaccggcgacatgatcgccctgaggggaaacactccggatctggcggcgctcggcatgaacgaccgggccaagtcggactggaaccggacgccctcgaccatctacctctggtccgatctccactactccggctgtacggcggtgacgtcttccggcccgacgggcaagggcaacttcttccccacctaccaggacttcttcagctcggtgcagttcgacggcccgggcggcccgagctgcggcaccccgcccggcgagggcggctga

SEQ ID NO: 1030 - DNA, 1809 bp, Pseudomonas sp.
atggcgatattcgactacaagggccaagacggccgcgtgctcatttcagatgcctggaaccttgccacctacaccagcggtgtagcgacggtaggggcgctctacaacctgcccggggcagtcctgggcgaaggcaacacctttgtcctgcccaagggctggcgcgagatcagcgccagcgacctgggcatcgacggcagccacctcgacctgacaggcagcttcaagggcgagaacgtatccggctcccaggccaaggtattcggccaatacgacgagagcggcaagctggtcaaaatgggcttttcgattgccggcaccaactcgccgatggacctgctgggctacccggcgatgatcgacaactcctatatccacggctacgactacctgctcgactcgatcaagaactacgccaccagccataacctgacgggcaaggatgtactggtcaccggctacagccagggcggctccgtgaccaacagcatgtacctgggcaaggacaccctggccgacggctttttcaaggattcggactacttcggcatggcctcgcccaaggccagcaacagcgacggcatcttcaacttcggcttcgaaaacgacatcgtgcatcggctgatcggcgaacagaccgacctgagcggcgccattctcgcggccctcaaaggcagtgatgccaactacacctcgaccaccgacaacatcgtgctgttcgacacggtctacgccctgcccacctggcccaacggccccttctccgtggtcaatcccaacggctgggtggcgcacctcgaaggcatcttcatcaaccctatccagcgcatcggccagtcgacgttctacgactacatcgagcgcgacagcaccatcatcatcagcaacctcgacccggtcagccgcagctttacctgggtcagcgacaaatactccgccacctccaaccacttcggcactccggcctttctcctcggcacggacagcgcggacaagctgcaggatggccgcaacgatgacttcctggacggcttcgccggcaacgacagcttcaaggtcagcaccggcaccgacatcgtcgcgggcggggtgggcgacgacaaagtcttcctgcagggtacggtctccagctacgaagccgtgcgcctgagcgatggcagcctgtttctcaacgacaccggcgggcgttacggcctcaaggagctgcacgacgtcgaacatgtcgagttcgaaggcctcctgggccaggccttgaccccggcctataccgtgaccagcagcaagctcaacttcgaaggcctgttcggatcggacaagagctacgccaaggccaccgaaggcacgcagttggccgacctcctgaaggggaccgccggccgcgacctgatcttcggccagggcggtgacgaccttattgaaggcggcgcgggccatgatctgctgcacggtggcagtggcaacgacaccctgctcggcggcagtggcaacgacgccctctacggcggcgcacagaacgacatcctggtcggtggcctgggcaacgacaccctcagtggtggcgtgggcagcgatctgtttgtcttcgacctgggcggcttcggccatgacctgatcagcgacttcaacgttcaccagaacggcttcgatcagttggtgttctccaaatccctgttcgcctccgcggccgcggtcatcagcgccaccagccagcaaggcagcgacagcctgatcgtcgcgggagacagcagcatcaccctggtagggttcaaccccgcgcaactcagtgcggacatgatcagcctggtctga

SEQ ID NO: 1031 - DNA, 1809 bp, Pseudomonas sp.
atggcgatattcgactacaagggccaagacggtcgcgtgctcatttcagatgcctggaaccttgccacctacaccagtggtgtagcgacggtaggggcactctacaacctacccggggcggtcctgggcgaaggcaacacctttgccctgcccaagggctggcgcgagatcagcgccagtgaccttggcatcgatggcagccacctcgacctgacaggcagcttcaagggcgagaacgtatccggctcccaggccaaggtgttcggccagtacgacgagagcggcaagctggtcaaaatgggcttttcgattgccggcaccaactcgccgatggacctgctgggttatccggcgatgatcgacaactcctatatccgcggctacgactacctgctcgactcgatcaagaactacgccaccagccataacctgacgggcaaggatgtactggtcaccggctacagccagggcggctccgtgaccaacagcatgtacctgggcaaggacaccctggccgacggctttttcaaggattcggactacttcggtatggcctcgccaaaggccagcaacaacgacggcatcttcaacttcggcttcgaaaacgacatcgtgcatcggctcatcggcgaacagaccgacctgagcggcgccattctcgcggccctcaaaggcagtgacgccaactacacctcgaccaccgacaacatcgtgctgttcgacacggtctacgccctgcccacctggcccaacggccccttctccgtgatcaatcccagcggctgggtggcgcacctcgaaggcatcttcatcaatcccatccagcgcatcggccagtcgacgttctacgactacatcgagcgcgacagcaccatcatcatcagcaacctcgacccgatcagccgcggcttcacctgggtccacgacaaagcgtccgccacctccaaccacttcggcaccccggcctttctcctcggcacggacagcaacgacaagttgcaggacggccgcaacgatgacttcctggacggcttcgccggcaacgacagcttcagggtcagcaccggcaccgacatagtcgcgggcggggtgggcgacgacaaagtcttcctgcagggtacggtctccagctacgaagccgtgcgcctgagcgatggcagcctgtttctcaacgacaccagcggacgttacggcctcaaggagttgcacgacgtcgagcatgtcgagttcgaaggcctcctgggccagaccttgaccccggcctttaccgtgaccagcggcaagctcgactacgaaggcctgttcgggtcgaacaagagctacgccaaggccaccgaaggcacgcagctggcagacctcctgaagggtacctccagccgtgacctgatcttcggccagggcggtgacgatcttattgaaggcggcgcgggcaatgatctgctgcacggtggaagtggcaacgacaccctgctcggcggcaatggcaacgacgccctctatggtggcgcccacaacgacattctggtgggcggcctgggcaacgacacactcagtggtggcgtgggcagcgatctgtttgtcttcgaccagggcgggttcggccatgacctgatcagcgacttcaacgttcaccagaacgggttcgatcagttggtgttctccaaatccctgttcgcctccgcagccgccgtcatcagcgccaccagccagcaaggcagcgacagcctgatcgtggcgggagacagcagcatcaccctggtagggttcaaccccgcgcaactgagcgcggatatgatcagcctggtctga

SEQ ID NO: 1032 - DNA, 1809 bp, Pseudomonas sp.
atggcgatattcgactacaagggccaagacggtcgcgtgctcatttcagatgcctggaaccttgccacctacaccagtggtgtagcgacggtaggggcactctacaacctacccggggcggtcctgggcgaaggcaacaccttcgccctgcccaagggctggcgcgaaatcagcgccagcgacctgaacatcgacagcagtcacctcgacctgacgggcagcttcaagggcgagaacgtatccggctcccaggccaaggtgttcggccagtacgacgagagtggcaagctggtcaaaatgggcttttcgattgccggcaccaactcgccgatggacctgctgggttatccggcgatgatcgacaactcctatatccgcggctacgactacctgctcgactcgatcaagaactacgccaccagccataacctgacgggcaaggatgtactggtcaccggctacagccagggcggctccgtgaccaacagcatgtacctgggcaaggacaccctggccgacggctttttcaaggattcggactacttcggcatggcctcgccaaaggccagcaacaacgacggcatcttcaacttcggcttcgaaaacgacatcgtgcatcggctcatcggcgaacagaccgacctgagcggcgccattctcgcggccctcaaaggcagtgacgccaactacacctcgaccaccgacaacatcgtgctgttcgacacggtctacgccctgcccacctggcccaacggccccttctccgtgatcaatcccagcggctgggtggcgcacctcgaaggcatcttcatcaatcccatccagcgcatcggccagtcgacgttctacgactacatcgagcgcgacagcaccatcatcatcagcaacctcgatccgatcagccgcggcttcacctgggtccacgacaaagcgtccgccacctccaaccacttcggcaccccggcctttctcctcggcacggacagcaacgacaagttgcaggacggccgcaacgatgacttcctggacggcttcgccggcaacgacagcttcagggtcagcaccggcaccgacatagtcgcgggcggggtgggcgacgacaaagtcttcctgcagggtacggtctccagctacgaagccgtgcgcctgagcgatggcagcctgtttctcaacgacaccagcggacgttacggcctcaaggagctgcacgacgtcgagcatgtcgagttcgaaggcctcctgggccagaccttgaccccggcctttaccgtgaccagcggcaagctcgactacgaaggcctgttcggatcgaacaagagctacgccaaggccaccgaaggcacgcagctggcagacctcctgaagggtacctccagccgtgacctgatcttcggccagggcggtgacgatcttattgaaggcggcgcgggcaatgatctgctgcacggtggaagtggcaacgacaccctgctcggcggcaatggcaacgacgccctctatggtggcgcccacaacgacatcctggtgggcggcctgggcaacgacaccctcagcggtggcgtgggcagcgatctgtttgtcttcgaccagggcggcttcggccatgacctgatcagcgacttcaacgttcaccagaacgggttcgatcagttggtgttctccaaatccctgttcgcctccgcagccgccgtcatcagcgccaccagccagcaaggcagcgacagcctgatcgtggcgggagacagcagcatcaccctggtagggttcaaccccgcgcaactgagcgcggatatgatcagcctggtctga

SEQ ID NO: 1033 - DNA, 1734 bp, unknown
  environmental sample
agcggcgtagcgacggtaggcgcgctctaccacttgcccggggcggtcctgggcgaaggcaacacctttgtcctgcccaagggctggcgcgagatcagcgccagcgacctgggcatcgacggcagccacctcgacctgacaggcagcttcaagggcgaaaacgtctccggctcccaagccaaggtattcggccaatacgatgagagcggcaagctggtcaaaatgggcttttcgattgccggcaccaactcgccgatggacttgctgggatacccggcaatgatcgacaactcctatatccacggctacgactacctgctcgactcgatcaagaactacgccagcagccataacctgacgggcaaggatgtgctggtcaccggctacagccagggcggctccgtgaccaacagcatgtaccagggcagggaaaccctggccgacggctttttcaaggattcggactacttcggcatggcgtcgccaaaggccagcaacagcgacggtatcttcaacttcggcttcgaaaacgatatcgtgcaccggctgatcggcgaacagaccgacctgagcggcgccattctcgcggccctcaaaggcagtgacgccagctacacctcgaccaccgacaacatcgtgctgttcgacacggtctacgctttgcccacctggcccaacggccccttctccgtgatcaatcccaacggctgggtggcgcacctggaaggcgttttcatcaaccctatccagcgcatcggccagtcgacgttctacgactacatcgagcgtgacagcaccatcatcatcagcaacctcgacccggtcagccgcagctttacctgggtcagcgacaaatactccgccacctccaaccacttcggcacgccggcctttctcctcggcacggacagcgcggacaagctgcaggacggcaggaacgacgacttcctcgacggtttcgccggcaacgacagcttcaaggtcagcaccggcaccgacatcgtcgccggtggcgtgggcgacgacaaagtcttcctgcagggtacggtcaccagttacgaagccgtgcgcctgagcgatggcagcctgtttctcaacgacaccaacgggcgttacggcctcaaggagctgcacgacgtcgagcatgtcgagttcgaaggcctcctgggccaggccttgaccccggcctttaccgtgaccggcagcaagctcgacttcgaaggcctgttcgggtcggacaagagctacgccaaggccaccgaaggcacgcagttggcagacctgctgaagggtaccgcctcccgcgacctgatcttcggccagggcggcgacgatcttatcgaaggcggcgcgggccatgatctgctgcacggtggaagcggcaacgacaccctgctcggtggcaatggcaatgacgcactctacggcggcgcgcacaacgacatcctggtgggtggcctgggcaacgacaccctcagcggcggagtgggcagcgatctgtttgtcttcgacgtgggcggcttcggccatgacgtgatcagcgatttcaacgttcaccagaacggcttcgatcagttggtgttttccaagtcgctgttcgcttccacggccgccgtcctcagcgccaccagccagcaaggcagcgacagcctgatcgtggcgggagacagcagcattaccctggtcggccttaaccccgcgcaactcagtgcggacatgatcagcctggtctga

SEQ ID NO: 1034 - DNA, 1860 bp, Pseudomonas sp.
atggcgatattcgactacaagggccaagacggccgcaccctgatttcagatgcctggaacctggccacctacaccagtggcgtggcgacagtgggggtgctctacaacttgcccgggatggtcctgggcgaaggcaataccttcgccctgcccaagggctggcgcgaaatcagcgccagcgaccttggcatcgacagcagccacaccgacctcaccggcagcttcacgggcgagaacgtcttcggctcccaggccaaggtgttcggccagtacaacgacagcggccagttgatcaagatgggcttttcgattgccggcaccaactcgccgatcgacctgctgggctggccggcgatgatcgacaactcctatatccgcggctacgactacctgctcgacgccatcaaggactacgccaccggccataacctgacaggcaaggacgtgctcgtcaccggctacagccagggcggctccgtgaccaatagcatgtacctgggcaaggacaccctggccgacggcttcttcaaggattcggactacttcggcatggagtcgccgaaagccagcaacagcgacggcatcttcaacttcggcttcgaaaacgacatcgtgcaccggctcatcggcgaggaaaccgacctgggcagcgccatcatcgacgccctgcaaggcagcgacgccagctacacctcgagcaccgacaacatcgtcctgttcgataccgtctacgccttgcccacctggcccaacgggcccttctccatcgtcaacccgagcggctgggtaccgcacctcgaaggcatcttcatcaaccccatccagcgcatcggccaatcgaccttctacgactacatcgagcgcgacagcaccatcatcatcagcaacctcgaccccatcagccgcagcttcacctgggtcagcgacaaacagaccgccacctccaaccacttcggcaccccggccttcctgctcggcaccgacagcgccgacaagttgcaggacggcagcaacgatgacttcctcgacggttttgccggcgacgacagcttcagggtcagcaccggcaccgacatcgtcgccggcggcaccggcgacgacaaagtcttcctcaagggcgcggccgcaaactacgaagcggttcgcctgagcgacggcagcctgttcctcaacgacaccacgggcacgtatggcctcaaggagctgcacggcgtcgagcatgtcgagttcgaaaccagcctggccaatgccctgggcgagctgcccatcatcggcggtatcttcggcagcctgggccagatactgaccccggcctataccgtgaccagcggcaagctcgacttcgaaggcctgttcggcgcggacaagagctacgccaaggccaccgaaggcacgcaactggcggacaccctgaaaggcaccgccgcccgcgacctgatctttggccagggcggcaacgatcgtctcgacggcggcgccggcaacgacctgctgcacggcggagacggcaacgataccctgctcggcggcagcggcaacgacgccctctacggcggcgcgggcaacgacatcctggtgggcggcctgggcaacgacaccctcagcggcggggtcggcagcgatctgttcgtcttcgaccagagcggcttcggccacgaccggatcagcgacttcaacgtccaccagaacggtctggaccagttggtcttttccaagtccctgttcgcctccacggacgccgtcctcaacgccaccagccagcaaggcagcgacagcctgatcgtcgccggcaacagcagcatcaccctcgtgggcttcagccccacgcaactgagcgcggagatgatcagcctggtttga

SEQ ID NO: 1035 - DNA, 1860 bp, unknown
  environmental sample
atggctatattcgattacaaggggcaagatgcccgcgtcctgatttcagatgcctggacccttgccacttacaccagtggtgtcgcgaccgtcggcgcgctctacaacattccgggacttgtgctgggcgagggcaacaccttcgcgctgcccaagggctggcgtgaaatcggcgcgagcgaactgcaggtggatagcagccacatcgacatcactggaagttttaccggtgacggcgtgttcggctcccaggccagggtgtttggtcaatacgatgacagcggccaattagtcaaaatgggtttttccattgccggtactaactcacccattgatctgctgggttggccggcgatgatcgataactcttatatcaacggctacgactacctgctcaattcaatcaaggattacgccaccggccataacctgagcggcaaggatgttctggtcaccggctatagccagggtggctccgttaccaacagcatgtatatcggcaaggacactttggcagacggttttttcaaggattcggactactttggcatggagtcgcccaagtccagcaacagcgacggaatcttcaacttcggttttgaaaacgatgtggtccaccgcctcacggggcaagagaccaacgtgggcagcgccattatcgatgcgcttcaaggcagtgacgccagttacacttcgacgactgacaacattgtgctgttcgacacgatctacgcgctgccaacctggcccaatggtccgttctcaattgccaacctgtcaggctgggccgcgcatctggaaggcattttcatcaaccctatccagcgtatcgcccaatcgaccttctacgattacatcgaacgcgacagcaccatcatcatcagcaatctcgacgccatcagccgcagctttacctgggtcagcgacaaacagaccgccacctccaaccattacggcacaccggccttcctgctgggcaccgacagttcggacaagctgcaggacgggcgcagcgatgacttcctcgacgggttcaagggtgacgacagtttccgcgtgagtaccggtaccgatattgtcgccggcggtgaaggcaacgacaaagtcttcctcaaaggcactgcatcttcctacgaagcggtgaaactcagcgatggcacgttgtttttgaacgacagcagcggccaatacggcctcaaggaattgcacggcgtagagcatgtggagttcgaaaccggcctggccaatagcctcggccaggtgcccgtgttcggcgggctcttcggtggcattggcgaggtcctcacgccggcctatacggtgaccagtggcaaactcgacttcgaaggcctgttcggcgccgataaggcgtatgccagatccatcgaaggcagccaactggccgacaccctcaaaggcaccgccgcgcgtgacctgatattcggccagaacggcaatgaccggctcgacggtggcgccggcaacgacctgctgcacggcggcgacggcaacgacacactgctgggcggcacgggtaacgacgcgctgtatggcgccagcggcaatgacgtcctgatcggcgggttgggcaatgaccaactcagcggtggcgtgggcagcgacctgtttgttttcgatcaacgcgggtttggccacgacgtgatcagcgacttcaacattcaccagaatgggcaggacctgctggtgttcgccaagtcgctgtttgccagcgccgatgccgtgctcggtgccactacccagcatggcagtgacagcgtaattctggcgggggacagcagtgtcaccttggtggggttcaatgcggcgcagttgagtgcagagatgatcagcgtggtgtga

SEQ ID NO: 1036 - DNA, 1860 bp, Pseudomonas sp.
atggctatattcgattacaagggtcaagatgcccgtgtgctgatttcagatgcctggaacctcgccacttacaccagcggtgtcgcgaccgtaggcgcgctctacaaccttccaggggcggtactgggggagggcaacacctttgcattgcccaaaggctggcgtgaaatcggcgccaatgaactgagcgttgatagcagtcacaccgatatcaccggaagcttcaccggcgatggcgtgttcggttcccaggccagggtgtttggtcaatacgatgacagtggtcaattgctgaaaatggggttttccattgccggcaccaactccctgactgatctgctgggctggccggccatgatcgataactcgtatatcaacggctatgagtacctgctcaattcaatcaaggattacgcgataggccacaacctgagcggcaaggatgtgctggtaaccggctacagccagggtggctcagtcactaacagtatgtatatcggcaaagacacgctggcagacggtttcttcaaggattcggactactttggcatggagtcacccaagtccagcaacagcgacggaatctacaacttcggttttgaaaacgatgtggtgcaccgcctcaccggtcaggaaaccaacgtgggaagcgccatcatcgacgctcttcaggggagtgacgccagttacacctcgacgaccgacaatatcgtgctgttcgatacgatctacgccctgccaacctggcccaacggtccgttttccatcgccaacttgtcaggatgggccgcgcacctcgaaggtattttcatcaaccccatccagcgcatcgcccagtcgacgttctacgattacatcgagcgcgatagcaccatcgtgatcagcaacctcgacgcgatcagccgcagcttcacctgggtcagcgacaaacagaccgccacctccaaccattacggtacaccggccttcctgctgggcaccgacagtgcagacaagctgcaggatggtcgcagcgatgacttcctcgacgggttcagtggtaacgacagtttccgggtcagtaccggtaccgatatcgttgctggcggtgcaggcgatgacaaagtctttctcaaaggtacggcgtccgcctacgaagccgttaaactgagcgacggtacgttgtttttgaacgatagcagcggccaatacggccttaaagaactgcatggcgtagagcatgtcgagttcgaaacgggccttgccaacacgctcggtcaactgcctgttatcggtggcatcttcagcggtatcgggcagacgctgacgccgtcttatacggtcaccaacggcaagctggatttcgatggcctgttcggcgccgacaaggcttacgccagatccattgaaggtagccaactggccgacaccctgaaaggcactgcagcacgcgacctgatattcggccagaacggcaatgatcggctcgacggtggcgccggcaatgacctgctgcacggcggtgacggcaacgacacgttgctgggcggcatgggtaacgactcgctgtatggcgccagcggtaatgatgttttgatcggcgggcagggcaatgaccagctcagtggtggcgtgggcagcgacttgtttgtgttcgatcagcgcgggttcggccacgacgtgatcagcgacttcaacatccatcagaacgggcatgatctgctggtgttcgccaagtcgttgtttgcgagcgccgatgctgtaatcgggtccaccacccagaacggcagtgacagcgtgattctggcgggggacagcagtgtcaccctggtggggttcaatgcggcacaactgagcgcagagatgatcagcgtggtttga

SEQ ID NO: 1037 - DNA, 1860 bp, Pseudomonas sp.
atggcgatatttgattataaaggacaggacgcacgtacactcatctcggatgcctggaccctggctacctacaccagtgggaccgccaccgtgggggccctgtacaacatacccggggcgatccttggagagggcaacagcttttccctgcccaaaggttggcgtgagattaatgccagtgagctggatgtcgataacagccgtctggacattacggggagtttcacgggtgggggtgttttcggtgcccaggccagggtgttcgggcaatacgacagtagtggccagttgactaaaatggcgttctccatagccggcactaactcaccgatcgatctgattggttggccagcgatgatcgataactcctatatcaacggttttgattacctgctcgatgccatcaaggattacgccgttgcaaagaacttgagtggtaaggacgtgctggttaccggttacagccagggaggtgcggtgaccaacggtatgttcctgaccaaggacacgctggcagacggtttcttcaaagactcggattactttggcatggagtcgcccaaagtcggcaacgacagcggcatcttcaacttcggctttgaaaacgacgtggtgcatcgacttatcggcgaagaaaccaacctgggcagcgccgccatcgatgccctgaccggcagtgatatcaactacacctcgaccaccgacaacatcgtgctgtttgacacgatctatgcactgcctacctggcccaacggccctttctccattgccaacctgacaggctgggctgcccacctcgaaggcattttcatcaaccccatccagaccatcagccagtcgacgttctacgatcatatcgagcaggacagcaccatcatcatcagcaatctcgaccccatcagccgcagcttcacctgggtcagcgataaagccaccgcgacctccaaccactacggcacgccggcgttcctgctagggactgccagcggcgataagctacaggatggtcgcagcgatgacttcctcgatggatttgccggcgacgacagcttcagggtcagcactggaaccgatatcgttgccggcggcgcgggcagcgataaggtgtttctcaaaggtgccgtggcgaactacgaagcggtcaagctgagcgacggcacgttgtttctcaacgacacgaccggccaatacgggctcaaggaactgcacagcgttgagttcgttgagtttgaaacggccttggccactgcaaccagccaattgccctttgtcggcggctttctcagcagcgtcggtcaagtgttgaccccggcctatgccgtgaccagcgacaagctggattatcaaggctggttcggctcagacaagtcgtacaacaaagccattgaaggcacggcgcaggccgacagcctcatcggtaccagcggccgtgacctgatgtttggccaggccggtaacgacacactgagcggtggcgccggcaatgacctgctccacggtggcgagggcaatgacacattgctgggcggcactggcaatgaccagctctacggcggcgccggcaacgatatcctggtgggcggccagggcaatgacctgctcagtggtggcgttggcagtgacgtgtttgtattcgaccaggcaggctttggccaggatcggatcagcgacttcaacattcaccagaacgggctggatgtactggtgttttccaagtcgctctttgcctctgtcgatgccgtgctcagtgctgccagccagcaagacaatgacacggtgatccagacgatagacggtagcgtcactctggtgggcttcagcccggcgaatctgaccgcggatatgctcagcctggcttaa

SEQ ID NO: 1038 - DNA, 1065 bp, Erwinia sp.
atgagcacgggaagcccagtatttaaatttagccgtatcgcggcagtttcgcttgttggtttttggttggcaggttgctctaacgactctacgcaggctccgattagcagcgttggcggtgactctggcatcagcagcccatcttccagcggcggtatgctggcggggcgcgcaccggccagcaccatggggtctgcgcaaaacatgggttccgcggaaagcaacgtgcagactcagaatggtcgtattgtctacaaccggacgtatgggaacattcctaaaggcagttacagcgggcagacctacacggtcaaacgcggcgacacactgttctatattgcctggattaccggcaatgatttccgtgatttagcacagcgtaacaatgtcgctgaaccttatagcctcaatgtcggccagactttgcaggttagtaatggctcaggttcttcaattaccggcggcaatgcgatcactgttgctgatgcaactcagggcggcgtacccacgccaccgagctccacgcaaattaaatcttcaacggttgcacaacaaccggttattacgtattctgaagattctggtaaatcaagtggaggcaaaatgttgccttcgtcgggaacaactgttgcaacgacaacagccccggttaccgctccgacagtcagtagcaccacgaatagctcaaccccggttgggagctggcgttggcctactgatggtaagatcatcgataacttctctgcttccgaaggtggcaataaaggcgtcgatatcgcgggttcacgtggtcagcctgttgtatcaaccgcttcagggcgtgttgtctacgcaggaaatgccttacgtggatacggtaatctgattatcatcaaacataacgatgattacctcagtgcatatgcgcataacgacacaatgctggtccgcgagcagcaagaagtgaaagcgggtcagaagattgcgacgatgggcagcaccggtaccagttcagttagattacattttgaaattcgttacaaggggaaatccgtcaacccgttgcgttatttaccgcagcgataa

SEQ ID NO: 1039 - DNA, 1062 bp, Pantoea sp.
atgagcacgggaagcccagtattcacattgagccgtattgcggccgtttcacttgttagtttttggctggctggctgttccagttcagacaacacgcaggcacccatcagcgccgtgggtagtcgcagcgacgccgcttcggcaaacagcggcctggttacccgccctgccatttccactaacgcttcctccggcaatatcgccagtaacaatggcaacgttgtgacgcaaaatggacgcattgtttacaatcgatcttatgggaatattcctaaaggtagctacagcggccagacttataccgtcaaacgcggcgacactttgttctatatcgcctggattaccggcaacgatttccgcgatttagctcaacgaaataacattccagcgccctacgaactgaatgtgggccagcagttgcaggttagtaacagctcaggtggcacgcttaccggcggcaatgctattaccgcggcggatgactccgcaggcggcgttccggcgaccccgggcagtgcacaaattaaaggcggaacggttgcaccgccgccggttattacgtattctgggaattcaggtaaatcaaatgaaggcaagatgttgccatcatccggtacaaatactgttgcaacgacaacagcgccggttaccgctccgaccgttagcagcacaacgagcagttcaaccccagtggggagctggctctggccgacaaacggtaagattatcgataacttttctgcttctgaaggaggcaataaaggggttgatattgcggggtcgcggggtcaggccgtcatttcaaccgcttccgggcgggtggtttatgccggtaatgcgcttcgcggttacggtaatttgattatcatcaaacataatgatgactacctgagtgcctatgctcacaacgatacgatgctggtccgcgaacagcaggaagtcaaagcgggtcagaaaatcgccacgatggggagcacagggacaagttctgttagattgcactttgaaattcgttacaaggggaaatccgtaaacccgttgcgttatttaccgcagcgataa

SEQ ID NO: 1040 - DNA, 1110 bp, unknown
  environmental sample
atgagcacgggaagcccagtatttaaattgcgccgtattgcggccgtttcattggtaggattttggctggcaggttgttccagcagcgataacacgcaggcccccatcagctccgttggcggaaatgactccggcatgatgagcagcaatcccgcgatgagcagcgcatcaggcgccagttccggcggcagcaacggcgggtttattcccccggctcgccccccgtctactggcggtatggtcaccccttctgccgcccctgagcagaacgtaaccactgaaaatggccacatcgtctacaaccgtagttatgggaatattccgaaaggtagctacggcggcgacagctataccgtgaaacgcggcgatactttgttctatattgcctggattaccggcaacgatttccgcgaccttgcacagcgcaacaatatcgccgcgccttacagcctcaacgtcggccagcagctgcaggtcgctaacggtactggtacgcctattaccggcggcaatgcggttacggcagccgatgcgaccgctggcggtgtcagcacgccgccatccggtgcgcaaatgacaaccgcaacggttgcacaccagccggtaatcacgtattctgaggattcaggtacacaaagtggaggcaaaatgctgccttcgtccggtaaaactgctgcaacgacaacagtgccggttaccgccccgaccgtaagtagcacgacggacagcactacccctgtgggaagctggcgttggccaacagatggtaagatcattgataacttctctgcttccgaagggggcaacaaaggtatcgatatcgcgggatctcgtggtcagtccgtcgtttccaccgcctccggtcgcgtggtgtacgccggtaacgcgctacgcggatacggtaatttgattatcatcaaacataatgatgactacctgagtgcttatgcccataacgatacgatgctggtccgtgaacaacaagaagtgaaagcgggccagaagattgcaaccatgggcagtaccggcacaagctcggttagattgcactttgaaattcgttacaaggggaaatccgtaaatccgttgcgttatttaccgcaacgttaa

SEQ ID NO: 1041 - DNA, 1101 bp, unknown
  environmental sample
atgagcacgggaagcacaatttttcagttacgccgtctggcggcgctttcactggtaggtttttggctggcaggctgtagctccagcgacaacacacaagcacccattagccgcgttggtgatggcggcggcatgagcagcagccagagtggcgcagcaagcgcctctggtggtgttcccgcgatgccttcacagggaggaatgttaagcggaagtgcagcatctgcctctggcaatggcggaatggttagtgccaataataatgtggagacgcaaaatggccgaatcgtgtacaaccgcagttatcagaatattcctaaaggtagctactccggcgaaacatataccgtaaaacgtggcgacacattgttttacatcgcctggattaccggcaacgatttccgcgatttagcccagcgtaacaacgttccggcgccgtatagcctgaatgtcgggcaaactttgcagattggcaacggttccggtcagccgattactggcggtaatgccattaccgttgctgatgcaacgcagggcggcgttccgaccacgccacaaattaaatctgccgctgttgcacagcaacctgttattacgtattctgatgattcgggtagttcgagcggcagtaaactgttgccttcgaaaggagcaaatgttgcaacgacaacagctccagtggttaccgcacccccaacggttagcagcacaaccaatagctcgacgccggtaggaagctggcgttggccgaccgatgggaagatcatcgataacttctctgctgccgaaggcggcaataaaggtatcgatatcgccggcacgcgtggacagtctgtcgtcgctaccgcttcaggaagggtggtgtacgcaggtaacgcgctccggggttacggtaatctgatcatcatcaaacacaatgatgattacctgagtgcctacgcccataacgatacaatgctggtccgggaacaacaggaagttaaggcggggcagaagatcgcaaccatgggtagcaccggaaccagttcagtaagattacactttgaaattcgttacaaggggaaatccgtaaacccgttgcgttatttaccgcagcgataa

SEQ ID NO: 1042 - DNA, 1101 bp, unknown
  environmental sample
atgagcacgggaagcacactttttcagttacgccgtctggcggcgctttcactggtaggtttttggctggcaggctgtagctccagcgacaactcacaggcacccatcagtcgcgttggcgataatggtggcatgaacactaaccagtctggagcagacatgagttcaggcggcgttcctgccacgccagcccagggacaaatgttaagcaaaaattcagcatctgcccccgctagtggtggaatgattagtaccaacagcaatgttgagacgcagaatggccggattgtttacaatcgcagttatcagaacattcctaagggtagctactccggtgaaacttataccgttaagcgtggcgacacattgttttacatcgcctggattaccggcaacgatttccgtgatttagcccagcgcaacaatgttccggcgccatatggcctgaatgtcggacaaactttgcagattggcaatgggtcgggtcagccgattaccggcggcaatcccattaccgttgctgatgcaacgcagggcggcgttccggcggcaccacaaattaaatcgcctgctgttgcacagcaacctgttattacgtattctgatgattcaggtaattcgggtggcagcaaaatgttgccttcgaatggagcaaatgttgcaacgacaacagctccagtcgttaccgcacccccaacggttagcagtacaaccaacagttcaacgccggtcggaagctggcgctggccgactgacgggaagatcatcgataacttctctgccgccgaaggtggcaataaaggtatcgatatcgccgggacgcgcggacaatctgtggtcgccactgcttcaggacgagtggtttacgcaggtaacgcactccggggttacggtaatttaatcatcattaaacacaacgatgattacctgagcgcctacgcccacaacgatacaatgctggtccgggaacaacaggaagttaaggcggggcaaaagatcgctaccatgggtagcaccggaaccagttcagtcagattacactttgaaattcgttacaaggggaaatccgtaaacccgttgcgttatttaccgcagcgataa

SEQ ID NO: 1043 - DNA, 1101 bp, unknown
  environmental sample
atgagcacgggaagcacactttttcagttacgccgtctggcggcactttcactggtaggattctggcttgcaggctgcagctccggcgacaactcacaggcacccatcagtcgcgttggcgatgatggtggtatgatgaacagccaggctggcgcaggcccggtttcgggtggcgttcctgccgcgccgtctcagggacaaatgttaagcagaaattcagcatctgttcccagcaatggtggaatgattagtaccaacagtaatgttgagacgcagaacggccggatagtgtacaaccgcagttaccagaatattcctaagggtagctactccggtgaaacgtataccgttaagcgcggagacaccttgttttacattgcctggattaccggcaatgatttccgtgatttagcccagcgcaataacgttgccgcgccatatagcctgaatgtaggccagactttacagattggtaacggatcgggccagccgattaccggtggaaatcccattaccgttgctgatgcaacgcagggcggcgtgccggccgcgccacaaattaaatcgcctgctgttgcacagcaacctgttattacgtattctgatgattcaggtaattcgggtggcagcaaattgttgccttcgaaaggagcaaatgttgcaacgacaacagctccggtgattaccgcacccccaacggttagcagtactaccaacagttcaacgccggtcggaagctggcgctggccgactgacgggaagattatcgataacttctctgccgccgaaggtggcaataaaggtatcgatatcgccgggacgcgcggacaatctgtggttgccactgcttcaggacgagtggtttacgcaggtaacgcactccggggttacggtaatttgatcatcattaaacacaacgatgattacctgagcgcctacgcccacaacgatacaatgctggttcgggaacaacaggaagttaaggcggggcaaaagatcgctaccatgggtagcaccggaaccagttcagtcagattacactttgaaattcgttacaaggggaaatccgtaaacccgttgcgttatttaccgcagcgataa

SEQ ID NO: 1044 - DNA, 1116 bp, Pantoea sp.
atgagcacgggaagcacaatttttcagttacgccgtctggcggcgctttcactggtgagtttttggctggcaggctgtagttcaggcgataatactcaggcgccgataagcaatatcggcgacagcaacagcgttaatgacaacagtaatatggctggctctggtactgcgccagccaccggcggcgtgccctctgtgccaccgcagggcggaatgttaagccgtagtacacctttaccgcagaacaatccgggaatcattagtgccaataataataatgtgcaaactgaaaatggccggattgtgtacaacagaagttatcagaatattcctaaaggtagctattctggccagacctacaccgtaaaacgtggggataccttgttctatatcgcctggattacgggcaatgacttccgcgatttagcgcagcgcaacaatgttcaggccccttacagcctgaatgtgggacagacgctacaggttgacaacggctcgggtcagcccattaccggtggcaacgccatcaccgctgcagatgcaacgcaaagcggcgttgtgagtgcaccacaaataaaacaggcccctgttgcacagcagcctgttattacgtattctgatgattcgggtgaatcgagtggcagcaaattgttgccttcgaagggagcaaatgttgcaacgacaacagctccagccgttaccgcaccgcctacggttagcagtacaactaacagttcaacccctgtgggaagctggcgttggccaactgaaggtaagatcatcgataacttctctgccgccgagggtggcaacaaaggcatcgatatcgcaggttcgcgcggacagccaattgtagccactgcttcaggaagggtggtttacgcaggcaatgcgcttcgtggttacggtaatttaatcatcatcaaacacaatgatgattacctgagtgcctacgcccataacgatacaatgctggtccgggaacaacaggaagttaaggctgggcaaaagatcgctaccatgggtagcaccggaaccagttcagttagattacactttgaaattcgttacaaggggaaatccgtaaacccgttgcgttatttgccgcagcgataa

SEQ ID NO: 1045 - DNA, 1125 bp, Pantoea sp.
atgagcacgggaagcacaatttttcagttacgccgtctggcggcgctttcactggtaagtttttggctggcaggctgtagttcaggcgacaatacacaagcgccaataagtaatatcggcgacggcagcagcatgaatgataacggtaatatggccagcactggtactgcgcctgttgccagtggtgtgccgacgacgccatcgcagggcggcatgttaagccgaaatacgcctgtgccgcagaataagccgggaatcattagtaccggtaataatacaagtaatgaagttgaaacccagaacgggcgaattgtgtacaacagaagttatcagaatattcctaaaggaagctattctggacaaacgtacaccgtaaaacgcggcgataccctcttctatattgcctggattaccggcaatgacttccgcgatctggcgcagcgcaacaacgtacagccaccgtacagcctaaatgttgggcaaaccttgcaggtcgacaacggctccggccagcctattaccgggggcaacgcgattaccgcggcggatgcatcacaaagcggcatcgtcaccgcaccacaaataaaacaggcccctgttgcacagcagcctgttattacgtattctgatgattcaggtaactcgaatggcagtaaattgttgccttcgaagggagcaaatgttgcaacgacaacagctccagccgttaccgcaccaccgacggtgagcagtacaacaaacagttcaacgcctgttggaagctggcgttggccgaccgaaggtaagatcatcgataacttctctgccaccgagggtggtaacaaagggatcgatatcgcaggttcgcgcggacagccggttgtggccactgcttcaggaagggtggtttatgcaggcaacgcgcttcgtggttacggtaatttaatcatcatcaaacacaatgatgattacctgagtgcctacgcccacaacgatacaatgctggtccgggaacaacaggaagttaaggctgggcaaaagatcgctaccatgggtagcaccggaaccagttcagttagattacactttgaaattcgtttcaaggggaaatccgtaaacccgttgcgttatttaccgcagcgataa

SEQ ID NO: 1046 - DNA, 1143 bp, Pantoea sp.
atgagcacgggaagcccaacatttcagttacgccgcattgcggcgctttctctggtaacgctttggctggcagggtgtagctctggggataatacccaggcgcccatcagcagcgtaaatgacaactcaggcatgagccagtcaggtatgctttctggcaattcatccggcattccgcgccagggtggtgggatgctaagtggaggcgttccagcgaccccttcccgaggcggaatgctaagcggaacttcatcttccgtacctgcgcaaggcggaatgattagcgaaaacaataatgtgacaacggaaaatggtcgaatagtatacaaccgcaactatcagaatattccgaaaggtagctatggcggcaatacttataccgttcgccgtggtgataccttgttctatattgcctggattaccggcaatgatttccgcgatctggctcagcgtaataacatctccgcgccttactccttgaatgccgggcaggttttgcaggttgaaaacggtggcggacaaccgatcaccggaggcaatgccatcaccaccgcagatgcccgtcagcagggcgtgacgccaccgcctgaaacgacgcaaattcatacagcccctgttgcacagcaacctgttattacgtattctgaagattcagatgacacgggtggtagtaaattgttgccatcccgaggagcaaatgttgcaacgacaacagctccagtggtaaccgcaccgccaacggcaagtagcacaacggacagctcaaccccagtgggtagctggcgctggccaaccgaaggtaagatcatcgataacttctctgcctcggaaggtggaaacaaagggatcgatattgcgggttcacgtggtcaacctgttgtcgccaccgcatcgggaagggtggtatatgcaggtaatgcgctacgtggctacggtaatcttattatcatcaaacataacgatgattatctgagtgcctatgcccacaacgacacgatgctggtccgggaacaacaggaagttaaagcgggtcaaaagatcgctaccatgggtagcactggaaccagctctgtcagactgcattttgaaattcgttacaaggggaaatccgttaacccgttgcgttatttaccgcagcgataa

SEQ ID NO: 1047 - DNA, 903 bp, Pantoea sp.
atgattagcaacactgtaccttccgcgcccagcagcggtgcaatggttagcggcaatgataatgttcagacgcaaaacggccgcatcgtatacaaccgcagttatcagaatattccgaaaggtagttacgccggcgatacttataccgttaaacgcggcgacacgctgttctatatcgcctggattaccggcaacgatttccgcgatctggcgcagcgcaacaacgtgcaggccccgtacggcctgaatgtcggccagacgctgcaggttggcaacggctcaggccagccgattacgggcggcaatgcgattaccgcagccgacgcaacgcagggcggcgtcccgaccgcgccgcaaattaaaccagcgcctgttgcacagcaaccagttattacgtattctgatgattcgggtaactcgtctggtagcaaaatgttgccgtcgaagggaacaaatgttgcaacgacaacagctccccccgtggttgccgcaccgcccacggttagcagtacaacgaacagttcgacgccggttggaagctggcgttggccgaccgatgggaagattatcgataacttctccgcctctgaaggggggaacaaaggaatcgatatcgctggttcgcgtggacaacctgtcgtcgctaccgcatcaggaagagtagtgtacgcaggcaacgcgcttcggggttacggcaacctgatcatcattaagcacaatgatgattacctgagtgcctacgcccataacgatacaatgctggtccgggaacaacaggaagttaaggcggggcaaaagatcgctaccatgggtagcaccggaaccagttcagttagattacattttgaaattcgttacaaggggaaatccgtaaacccgttgcgttatttgccgcagcgataa

SEQ ID NO: 1048 - DNA, 1107 bp, Enterobacter sp.
atgagcgcgggaagcccgaaattcaccgtaagccgtattgcggcattgtcactggtttcgctgtggctggcagggtgttcaaattccactaatgctccagccccggtcagttctgttggcggcaacgccagttcaaattccagttccggcagctccggaatgttgatcacgccgccgccaaaactaggcacatcatcgcagcagaaaattcagcccgcgcagccaacgcagattcagccggtggcgcagacgcctgttgaaactgttaacgggcgcatcgtctataaccgccagtacggcaatattcccaaaggcagctataccggcggtagtacctatacggtgaagcgtggcgatacactattttatattgcgtggattaccgggaacgatttccgtgatctggcgcagcgtaataatgtcgccgcgccttataaccttgaagtcgggcaaacgttgcaagtgggtaatgcatccggcacaccaattacgggtggaaatgccattactcgggctgatgattcagcacaaggaatagtctcaaaacctgcacaaaattccagcgtagtggttgcttcgaaaccgacaattacgtattctgaggattcaggtgaacaaagtgctaacaaaatgttgccaaacaacaagcctgcgacaaccatcacagcgcctgttacggcaccttctgtaagctcaaccgaaccgactgccagcagtacatctaccagcgcgcctattgcttcatggcgctggccgactgagggcaaagttatcgacaacttctctgctaccgaaggtggcaataaaggcgtcgatatctccggcagcaaaggacaggctattgtcgcgaccgcagatgggcgcgttgtatatgccggtaacgcgctgcgcggttacggtaatctgatcatcataaaacataacgatgattacctgagtgcctacgcccataacgacacaatgctggtccgggaacaacaagaagttaaggcggggcaaaaaatagctaccatgggtagcaccggaaccagttctacacgcttgcattttgaaattcgttacaaggggaaatccgtaaacccgctgcgctatttgccgcagcgataa

SEQ ID NO: 1049 - DNA, 1656 bp, Erwinia sp.
atgaagtttggtttggtactggcacttttactgacgacgtttagttcgcttgcagccaatttatccgacattaaagtctccaatggtgatgataaagctaccgtcaccctcagctttaacggccagccggtgtatggctttttcccgttgcacaatcccgatcgcgtggtgctggatattcgccagagcggcgttatcaaaggcctgccgttaacgtttagcggtgaaaatatcgttaagcgcattcgctccagcacgccgaaagacaagcaaagcattcgtctggtgtttgagttgacccaggcgagcaaaacgcgggcggtcacccagcgcgaaggtaacaattacaatgtggtcttcactatcgccggcacccgtccggccgccacggcttcccgccgtccggctgaggtaagctctgcctccagcagcgcgccatcagcgccggttgagaatccttttaaaggcaacccggtgaccgctgtcagcagcggcaatgacgttgtcagaccgggcagaacgccggtgtcggccaacgaagcggtgattgtggcgattgatgccggtcacggcggacaggatcccggcgcgattggcgcgggcggtctgaaagagaagaacgtgaccatcgccatcgcccgtaagctgaaggcgctgctgaatgccgatccgatgttcaaaggggtgatgacccgcgacggggattactttatctccgtgatgggccggtccgatgtagcgcgtaagcaaaacgccaacgtgctggtttccatccacgccgatgcggcacctaaccgcagtgcgtctggcgcttccgtttgggtcctgtcaaaccgccgcgctaacagtgaaatggcgggctggctggagcagcacgagaaacagtccgagctgctgggcggcgcaggggatctgctggccaacagtcaggccgatccttacctcagccaggcggtgctagacttgcaattcggtcactcgcaacgcgtgggttatgatgtggcagtaaaagtgattgcgcagcttcagcgtgtgggttcgctgcacaaacgtcggccggaacatgccagcctgggcgttctgcgctcgccggatattccttccctgctggtggaaaccggcttcatcagtaatccttcggaggagcgactgcttggcagtagcgcataccagcagaagattgccgagtcgatttataaaggacttcgcaactacttcctggcgcatccgctgcaatccatcccaaaggaggaaaaccgtcccttgcagtccgcagcgacggttaatgttgaacccaacccggcaccagacaccacccaatacactggggcgatccagcgtcatgtggtaaaacggggcgagacagcatccggtattgccgcccgttatggcatcagcatggcaaccctgcggtcaatgaacaccctgaagaaagatgtggtctgggttggacaacgactgaaggtgccggcgggcagccagcccgccgccgtgactaaagccaaaacgccggtgcgccacaaagtggttcgcggcgattctcttaccgcgattgccgcccattacggcgtcagtccaaaggccattcagcaggccaataagatgaaatcgcaaaacgtgatgctgggccagaccttaactatcccgacttcgtaa

SEQ ID NO: 1050 - DNA, 1671 bp, Erwinia sp.
atgttgcggatgaagtttggttttttactggtactgatactggcgactttttcgagtctggcggcaaatcttgctgatattaaggtggcaaacggcaacaaccaggcaacggtaaccctcagtttcaatggtcagccggtatatggttttttcccgttgcataacccaaatcgggtcgtgctggacattcgtcaaagtggcgttgtgaagggcctgccgctgacgttcagtggcgagaacattgttaaacgcatccgttcaagccagcctaaagacaatcagagcattcgtctggtgtttgagctgactcagcctgctaaaacccgagcggtgacacagcgccagggcagtagttataacgtcgtattcaccattagtggaactcagccagtaaaagcttcatcagcgccggctgaagtcagctctgtttcccgtccggcatcctctgcgcctgcggaaaatcctttcaagggtaatcctgtcaccgcagtgaccagcggcgaccgcgttgtggcaccgggacggagcgctcgttcggccaatgatgtggtaatcgtggctattgatgccggccatggcgggcaggaccccggcgcgattggggccggtggcctgaaggagaaaaatgtcactattgccattgcccgtaaacttaaggcattgctgaatgacgaccccatgtttaaaggcgtgatgacccgtgatggtgactatttcatctctgtgatgggccgttctgatgtggcacgtaaacaaaatgctaatctgctggtgtcaattcatgccgatgccgcccctaaccgcagcgcttccggtgcatcggtatgggtattgtccaaccgccgcgctaacagtgagatggcggggtggctggaacagcatgagaagcagtcagagctgttaggtggtgcgggtgacttgctggcgaacagtcaggcggatccttacctcagccaggcggtacttgatttgcagttcggccactcccagcgggttggttatgatgtggcggtaaaagtcatcgcccagcttcagcgtgttggtgcactgcacaagcgccgaccagaacacgccagtctgggcgtattgcgttcgccggatatcccttcattgctggtggaaaccggttttatcagtaacccttcggaggagcgactgctcggcagtagcgcttaccagcagaagattgccgagtcgatttataaaggactccgtaactacttcctggcgcatccgctgcaatctgtcccaaaggaggaaaaccggccgttgcagtccgcagcggtggttaacgttgaaactaaccctgctccggtgaacacgcaatattctggggtggttagccgccatgtggtaaaacgcggggaaacgttgtcagggattgcggcccattatggcgtcagcaccgcaacgttgcgtggcatgaatacgttgaaaaatgatgtggtctgggtaggccagcggttgaaagtacctgcgggcagcagcatatccaaagctgccagtgtgtcgcaggcgaaaaaacctgtcaggcataaagtggttcgaggggattcgctaacggcgatcgcggcgcattatggcgtcagcccaaaggcgattcagcaggcaaataatatgaagtcgcagaacgtcatgctggggcagacgttgattattccggcctcgtaa

SEQ ID NO: 1051 - DNA, 1668 bp, unknown
  environmental sample
atgatgctgcgatttaaagcctggtgcctgctggccctgttttgctgttccttcagcgcagtggcggcgaatttatccgatattaaagtttctaatggcagtaacgaagcccgggtcacgctgagctttgccgggcaaccggtatatgcattctttccgttacataacccggatcgtgttgtgctggatatccgccagagcggtatcgtacaggggctgcccctgactttcagcggtgagaacattgtgaagcgcatccggtcaagcaccgccaaagacagccagagtatccggctggtgtttgagctgacccagcggggtaagacccgcgcggttacgcagcgtaacggcagtcattacaatgtggtgttcaccatttccggcacgcagccatcccaggcaagccgccaggccgcggtaagcagcgtgtcaccttcccgtccggtcagtacaccgccaaaaagtccgtttgatgccaatccggtaacgtcggtcagcagtggcaatgaggtggcgcgcccacgcagcgctcgtagcagcaatgacaccgtgatcgtggcgattgatgccggtcacggcggacaggatccgggcgccattggcggcggaggcctgaaagaaaaaaacgtgacgattgcgattgcgcgcaagttgaaagcgctgctgaacgccgacccgatgtttaaaggcgtgatgacccgtgatggcgactattttatttccgtcatgggccgctctgaagtggcgcgcaagcaaaacgccaatctgctggtgtccattcacgccgatgccgcacccaaccgcagcgcatccggtgcttccgtgtgggtgctgtcgaaccgtcgtgcgaacagtgaaatggcgggctggctagaacagcatgagaagcagtcagaactgttaggcggtgccggtgacctgctggccaacagccaggcggatccgtacctcagccaggcggtgctggatctgcagttcgggcattcgcagcgcgtgggttatgatgtggcagtgaaagtaattgcgcagctgcaacgcgtcggcgcgctgcacaagcgccggccggaacatgccagcctcggcgtactccgctcgccagatatcccttctctgctggtggaaaccggctttatcagtaacccttcggaggagcggctgctgggcagcagtgcttaccagcagaagattgccgagtcgatttataaaggcctgcgcaactacttcctggcgcacccgttacaatccatcccaaaggaggaaaaccgaccgttgcaggccgcaacggcggttgaagtccaggctaacccggctcccgccagcacagaatataccggcgcggttgagcgccatgtggtgaaacgcggagagacactttccggtattgccgccagctatggggtcagtatggaaacgctgcgtaccatgaacacattaaaaaaagatgtggtttgggtggggcagcgtctgaaggttcctgccgggagtaaaacggcttctgcggcggcagtgagcagccgcaaacccgccaggcataaagtcgtgcggggagattcgctgacggcgattgcagcgaaatacggcgtgagcccgcaggcaatccagcaggcaaataagatgaagtcgcagaatgtaatgctggggcagacgttaaaaatcccgacctcataa

SEQ ID NO: 1052 - DNA, 1677 bp, unknown
  environmental sample
atgatgctgcgttttaaatcctggtgcctgctggccctgttctgctgctcgtttagcgcgctctccgccaatctttccgatatcaaagtctcgaacggcagtaatcaggcggaagtgacgctcagctttagctcacagccgatctacgctttcttcccgctgcataatccggagcgcgtggtgctcgacatccgccagagtgcggtggtgcagggattaccgctgaccttcagcggtgagaatatcgtgaagcgcatccgctccagcaacgcgcaggacagccagagcatccgcctggtgtttgaactgacccagcgcggcaaaacgcgggcggtcaccaagcgcagcggcagcaattacaacgtggtgttcaccatttccggcacgcagccggcgcaaacggccagccgcagtgcgccggtcagcagcgctaccgcctcacgcccggtcagcagcactccgcctaaaagcccattcgatgccaacccggtgacggcagtgagcagcggtaatcaggtggcacggccgcgcagcgctgccagcagcaatgacacggtgattgtggcgatcgatgccggtcacggtggtcaggatccgggcgcgattggcggcggcgggctgaaagagaagaatgtgaccatcgccattgcccgcaagctgaaggcattgctgaatgccgacccgatgtttaaaggggtgatgacgcgcgatggcgactactttatctcggtgatgggccgttcggacgtggcgcgtaagcagaacgccaacctgctggtctcgattcacgccgacgccgcgccaaaccgcagcgcctccggtgcatcggtatgggtgctgtcgaaccgccgcgccaatagtgaaatggcaggctggttagagcagcatgagaaacagtctgaactgcttggcggggccggagatctgctggcaaatagccaggcggatccctacctcagccaggcggtgctcgacctgcagttcggccactcgcagcgggtgggatatgatgtcgcggtaaaagtgattgctcagctgcagcgcgtgggcgcactgcacaagcgccgaccggaacatgccagcctgggcgttctgcgctcgccggatattccttccctgctggtggaaaccggctttatcagtaatccttcggaggagcgactgctaggcagtagcgcataccagcagaagattgccgagtcgatttataaaggcttacgcaactacttcctggcgcacccgctgcaatcaatcccaaaggaggaaaaccgtccgttgcagtccgcagcggcggttgaggtagaagctaacccggccccggcaggcacagagtacagcggcccgacgcagcgccacgtggtgaaacgcggtgagacgctctccggtatcgccgcgaactacggcgtcagcatggcgacgctgcgtgcgatgaacaccctgaaaagagacgtggtgtgggttggacagcggctgaaagtgccggcaggcagcagcggtgcggcaacggccagcgtggccaggagtaaaaagccgctgcgccataaagtggtgcgcggtgactcgctcacggcgattgcggccaaatacggcgtcagcccgcaggcgatccagcaggcgaacaaaatgaagtcgcagaatgtgatgctgggccagacgctgaagatcccgacgtcataa

SEQ ID NO: 1053 - DNA, 1677 bp, unknown
  environmental sample
atgatgctgcgttttaaatcctggtgcctgctggccctgttctgctgctcgtttagcgcgctctccgccaatctttccgatatcaaagtctcgaacggcagtaatcaggcggaagtgacgctcagctttagctcacagccgatctacgctttcttcccgctgcataatccggagcgcgtggtgctcgacatccgccagagtgcggtggtgcagggattaccgctgaccttcagcggtgagaatatcgtgaagcgcatccgctccagcaacgcgcaggacagccagagcatccgcctggtgtttgaactgacccagcgcggcaaaacgcgggcggtcaccaagcgcagcggcagcaattacaacgtggtgttcaccatttccggcacgcagccggcgcaaacggccagccgcagtgcgccggtcagcagcgctaccgcctcacgcccggtcagcagcactccgcctaaaagcccattcgatgccaacccggtgacggcagtgagcagcggtaatcaggtggcacggccgcgcagcgctgccagcagcaatgacacggtgattgtggcgatcgatgccggtcacggtggtcaggatccgggcgcgattggcggcggcgggctgaaagagaagaatgtgaccatcgccattgcccgcaagttgaaggcattgctgaatgccgacccgatgtttaaaggggtgatgacgcgcgatggcgactactttatctcagtgatgggccgttcggacgtggcgcgtaagcagaacgccaacctgctggtctcgattcacgccgacgccgcgccaaaccgcagcgcctccggtgcatcggtatgggtgctgtcgaaccgccgcgccaatagtgaaatggcaggctggttagagcagcatgagaaacagtctgaactgcttggcggggccggagatctgctggcaaatagccaggcggatccctacctcagccaggcggtgctcgacctgcagttcggccactcgcagcgggtgggatatgatgtcgcggtaaaagtgattgctcagctgcagcgcgtgggcgcactgcacaagcgccgaccggaacatgccagcctgggcgttctgcgctcgccggatattccttccctgctggtggaaaccggctttatcagtaatccttcggaggagcgactgctaggcagtagcgcataccagcagaagattgccgagtcgatttataaaggcttacgcaactacttcctggcgcacccgctgcaatcaatcccaaaggaggaaaaccgtccgttgcagtccgcagcggcggttgaggtagaagctaacccggccccggcaggcacagagtacagcggcccgacgcagcgccacgtggtgaaacgcggtgagacgctgtccggtatcgccgcgaactacggcgtcagcatggcgacgctgcgtgcgatgaacaccctgaaaagagacgtggtgtgggtcggacagcggctgaaagtgccggcaggcagcagcagtgcggcgacggccagcgtggccagaagtaaaaaaccgctgcgccataaagtggtgcgcggtgactcgctcacggcgattgcggccaaatacggcgtcagcccgcaggcgatccagcacgcgaacaaaatgaagtcgcagaatgtgatgctgggccagacgctgaagatcccgacgtcataa

SEQ ID NO: 1054 - DNA, 1677 bp, Erwinia sp.
atgatgtttcgcgttaaattagcgtttattctggcatgttgtctggtttcattctcttcagttgcagcaaatctgtctgatattcaggtctccaatggcggcagtcaggcgacggtgacattgagttttaacgggcaacccgtttatggtttcttcccgctcagcaagcccgaccgggtggtgctggatattcgtcaaagcggcgtaattaaggggatcccgctgaactttagcggcgacaatatcgtcaagcgcattcgttccagtacgccaaaagacagcaacagcattcgtctggtatttgaactgacccagccagcgcgcacccgcgcggtaacgcagcgtaatggcaataattacaatgtggtgttcaccatcaatggcacgcaaaccgcgcaacgcagcagttcgcgcccggctgaggtgagcagcgcaacgcgcaatccggtgacgtcgagcgcaccggcggaacccgtcagtaatccgtttaatggcaacaaagttacggcggtgaccagcggcaatacgcgcgtggagccaggccgtcgcgccagtgctaacgataccgtggtggtggcgatcgatgccggacacggtggccaggatccgggggcgattggcgctaacggcctgaaagagaagaatgtcactatcgccattgcgcgtaagctgaaagcgctgctgaatgatgacccgatgtttaaaggggtattaacccgcgatggcgactactttatttcagtaatgggccgctcggacgtggcgcgtaagcagaacgccaatgtgctggtatcgattcacgctgacgccgcgccaaaccgcagcgcctccggcgcatcggtctgggtgctgtctaaccgccgcgctaacagtgagatggccaactggctggagcagcatgagaagcagtcagaactgctgggtggcgccggtgatctactggccaacagccaggctgacccctacctgagtcaggcggtgctggatctgcagtttggtcattcgcagcgcgtcggttatgacgttgcggtaaaagtgattgctcagttacaaagtgtgggttcactgcataaacgccgtcctgagcatgccagccttggcgtgctgcgttcgccagatattccgtctctgctggtggaaaccggctttatcagtaacccttcggaggagcgactgcttggcagtagcgcgtatcaggagaagattgcccagtcgatttataaaggactgcgtaactacttcctgtcacacccgctacagtccttcccaaaggaggaaaaccgaccgttgcagtcagcagcggcggttaatgtcgaggcaaacagtgcgcctgcgggcaccacttatactggcgcgacaacgcgccatgtagtgcagcgtggcgaaacgctgtccgggattgctgcgcgctatggcgtcagtatgtcgaccatgcgttcgctgaataatctgaaaaaagatggcgtctgggtcggccagcgtttaaaagtcccggctgacgccacccgcaccgctgctgtcagcagcaaaccgaaaaagcataaagtggtgcgcggtgactcactgacggcgattgccgcccattatggcgtcagctcgaaagccattatgcaggcgaataatatgaagagcgctaatgtgatgctggggcagacgctgacgataccggcttcataa

SEQ ID NO: 1055 - DNA, 1662 bp, Erwinia sp.
atgatgcgacgcctgatgtgctggtggatgctggcgctgttttgctgctcgttcgcctccgtagccgccaatttgtcagatatcaacgtgtctaatggcagcaacgaagcgcaaatcaccctgagctttgccggtcagccggtttatgcctttttcccgttgcataatcccgaacgcgtggtgttggacgttcggcaaagcgccattgtgcgcgggctgccgctggatttcagcggtgataatatcgttaaacgcattcgagccagcacggcaaaagacagtcacagcattcgcctggtatttgatctcacccggcccggcaaaacccgtgcggttacccggcgtgaaggtagccattacaacgtggtgtttaccatcagcggcagccgaaccgcagccgtggcaagccgcaatataaatgccagcggcaacgttaatacgcgtaccagcagcccgccaaaaagtccgtttgatgaaaatcgcgtgacgcgggtcagcagcggcaatgaggtcgcccgcccgcgcagggcgcgcagcagcaacgatacggtgattgtcgccattgatgccggacacggcggacaggatcccggcgcgattggcggcggcggtctgaaagaaaaaaacgtgaccattgccatcgcccacaaactgaaagcgttgctgaatgccgacccgatgtttaaaggggtgatgacccgtgacggcgactactttatttccgtaatggggcgttcggacgtggcgcgtaagcagaatgccaatctgctggtatccattcacgcagacgctgcgcctgctcgcagcgcttccggtgcctcggtctgggtgctgtctaaccggcgtgccaatagcgaaatggcgggatggctggagcaacatgagaagcagtccgagctgctgggcggtgccggagacctgctggccaacagccagacggatccgtatctgagccaggcagtgctggatctgcaattcggtcactcgcagcgcgtgggttatgatgtggcaataaaagtgatcgcgcagctgcaacgtgtaggcgccctgcacaagcgtaaaccggaacatgccagcctgggcgttctgcgctcgccggatattccctcactgctggtagaaaccggctttatcagcaacccttcggaggagcggctgcttggcagcagcgcttaccagcagaagattgccgagtcgatatataaaggtttgcgcaactacttcctggcgcacccgctgcaatctgtcccaaaggaggaaaaccgaccgttgcagttcgcagcggcggttgaaccagtgattaacccggttcctgcaggtacgctgtctgctgctgccagccagcgccatatggtgaaacgcggggagacattgtccggcattgccgcccattacggcgtcagcatggcgactctgcgggcgatgaatacccttaaaaatgatgtggtatgggtggggcagcggctgaaagtaccggcagcaagcaaggccgtgagcgtggcaaagcgtgaaaagtcagtaaagcacaaagtggtgcgtggtgactcgctcacggccattgccgctcattacggcgtcagtccacaggctgtccagcaggcgaataagctgaagtcgcagaatgtgatgctggggcagacgctgaccatacccacttcataa

SEQ ID NO: 1056 - DNA, 1668 bp, Pantoea sp.
atgatgttgcgggtaaaattggtgatattcatgctgctcagcctgatggctttttcatcgctggcggcaacgttgtcagatattcaggtagccaacggcgatcgggtcgctacggtgacgctgcgtttttcaggtcagccggtatacggctatttccctctgcgcaatcccaatcgcgtggtgctggatattcgacagagcggcgtgattaaaggcctgccactgaccttcagcggcgataatctggttaaacgcatccgcagcagtcagccaaaagatagccaaagcctgcgtctggtgttcgaacttacccagccagcgaaaacccgggcggtcacccagcaaaccagcaacggttatcaggtggtatttactatcaccgggccagccgccagccgggtcagcacaccggtaagccagccggcgcgcaatccggtcactgccgctcccgcaccggttacctcgcagggcaatccgtttgagggcaataaggtcaccgccgttagcagcggcaacgatcgcgcggtcagcggcgccaccatcagcgacaacgacaccattgtggtggcgattgatgccggtcacggcgggcaggatccgggtgccatcggtcagcgtggtttgaaagagaaaaatgtgaccattgccatcgcccgcaagctgaaggtgctgttaaacaacgaccggatgtttaaaggcgtactgacccgtaacggcgactattttatctcggtgatgggacggtcagacgtagcccgtaaagaaaatgccaacctgttgatttcaattcacgctgactctgcaccaagtcatagcgccagcggggcttcggtctgggttctgtcaaaccgccgtgccaacagtgaaatggcaggctggctggaacagcgcgagaagcagtctgaactgcttggcggcgcaggcgatctgctggcgaacagtcaggccgatccctatctgagccaggcggtacttgacctgcagtttggtcattcgcagcgcgtcggttatgacgttgcggtgaaagtgattcaacagctgcagggcgtatcgccactgcataagcaccgcccggaacacgccagcctcggcgtgctgcgttcgccggatattccgtcattattggtggaaaccggctttatcagtaattcatcggaggagcgactgctcggcagtagcgcttaccaggataaaattgccgcctcgatctaccgaggcctgcgcaattatttcctggcgcatccgctacaatctgccccaaaggcggaaaaccgtcctctggagtccgcagaggcggttaacgtacagcccaacgtggcatccgataccacgcagtacaccggcagcaccacgcgccacgtggtgaaaagaggggaaaccctgtccgggatcgccgcgcattacggcgtaagtatgtcgacgctgcgctcgctgaaccgcctgaaaaaagatgtggtatgggtgggacagcggctgaaagtgcctgctggcagcgcggtaagcgcgacggcaagctcggcgccaaaacgccacaaggtagtacgcggtgattcactgaccgctatcgccgtgcattacggtgtgagcgccaaagcgattatgcaggtgaacaatatgaaatcgtctaatgtcatgttgggacagacgttaaccattcctgcttcctga

SEQ ID NO: 1057 - DNA, 1677 bp, unknown
  environmental sample
atgatgacatggatgaaaatgctcgttgtggcaggattgctactcattaccggccccctgtttgccgctaacctgtctgatattcaggtatcgaatggcggaaatcaggccacggttacgctgagtttttccggccaaccggtttatgcctactttccgctacacaatcccgaccgtgtggtgctggatattcgtcaaagcggcgtcatcaaaggcttacccctgacgtttagcggcgataacatcgttaaacgcattcgtaccagtaccccaaaagataaacaaagcatacgtctggtctttgagctgacgcagtctggaaaaacccgcgccgttacgcaacgcaacggcagtcagtacagcgtggtctttaccatacagggtaaacatccggccgttacgcgcagcgcgcccgtggttgcagccgagcctgcgccgacacgagcacgggaaaccgcagccagtaatccgttcaatgctaacccggtgaccacggtcaccaacaccaacagcacggtccgtcccggtggggttgccagccgaaacgacacggttattgtagccattgatgccggacacggaggccaggatcccggggcgataggccagcacggacttaaagagaaaaacgtcaccatcgccattgcgcgtaaactgaaagtgttgttaaacgacgatcccatgttcaaaggggttctgacgcgtgacggcgactattttatctctgtaatgggccgttcagacgttgcgcgcaaagcgaatgctaacgtgctggtgtcaattcacgccgatgcggcacccagccatgcggcaaccggagcctctgtttgggtattgtctaaccgccgcgcgaacagtgagatggcaaactggctggagcagaaagagaaacagtcagaactgttaggcggagcaggcgatctgctggcgaacagtcaggccgatccctatctgagtcaggccgtgctggatttgcagtttggtcactcgcagcgcgtcgggtatgacatcgcgacgaaggtgattcagcagctgcgtggcgtcacgtctttacacaagcgtttacctgagcatgccagtcttggcgtgttacgttcgccggatattccttccctgttggtggaaaccggttttattagtaatgcctcggaggagcgactgctcggcagtagcgcacaccaggataagattgctcagtcgatatataaaggactgcgcgcttatttcctggcgcacccgctacaatcggtcccaaaggaggaaaaccggccgctggctacgtcgccagcggtcagcgtagtcagtaatccggcgaccggagagacgcagtatacgggcgccattcagcggcatactgtaacgcgcggcgaaacgctctcaggaatcgcggcaaaatatggcgtgagcatggcaacactgcggcagatgaacaccctgaagcgcgatgttgtctgggtggggcagcggctgaaagttccggccagtgcggtggccagccgtaccgcaccggcttcctcaggggcgcatcgcccggtgcggcataaagtggtgcggggagactcgctgagcagtatcgccgcgcattatggcgtcagccctaaatcgattctccaggcgaataacctgaaatccaccaacgtgatgttgggtcagaacctgaaaatccctgcatcctga

SEQ ID NO: 1058 - DNA, 1671 bp, Plautia sp.
gtgcagggaaccggcatgatgtcacgcgttaccgggattatgctcgccctgctgtgtctgttctcctcgtcggcgctggccgcgacgctatcggatatgaaagtcgataacggtgacagccaggcgacggtgaccctgagcttcaacggccagccggtgtatggcttctttccgctacacaacccgaaccgggtggtgctggatattcgccagagcggcaatattcaggggctgccgctcaactttagcggcgaaaacatcgttaaacggattcgtaatagccagccgaaggataatcagagcatccggctggtgtttgagctgacccaggcggcgaaaacgcgcgccagtacgcagcgcgacggcaatcagtaccgcgtggtcttcaccatcagcggcacccagcctgccagacgcagcaccgcggccgcaccggtgacgcgtgcgcgccagagcgacagcgctacgaccagccagggcaatccgttcaacgccaatccggtgacggcggtgaccagcagcaacaccacggtgcgtccgggcggtgccgtcagccgtgatgaggtgatcgtggcgattgatgccggacacggcggtcaggatcctggcgcgtcgggccagcacggcttacatgaaaagaatgtcaccatcgccatcgcgcggaagctcaaagcgctgatggatcaggacccgatgtttaaaccggtgctgacgcgtaacggcgactactttatttcggtgatgggccgttccgaggtggcgcgtaaagagaacgctaacctgctggtgtcgattcacgccgacgccgcaccgaatcactctgccaccggggcttcggtttgggtgctgtccaaccgccgcgccaacagcgaaatggctaactggctggagcagaaagagaaacagtctgagctgctgggcggtgcgggcgatctgctggcgaacagccaggccgatccctacctgagccaggcggtgctggatctgcagtttggccattcacagcgcgtcggctatgacgtggcggttaaagtgctgcagcagctgcgcggcgtgacgccgttgcacaagcgtctgccggaacatgccagcctcggcgtgctgcgttcgccggacatcccttctttactggttgaaaccggctttatcagtaacgccggggaggagcggctgcttggcagcagcgcgtatcaggaaaagattgcacagtcgatttacaaaggactgcgcaactatttcctcgcgcatccgctgcaatcggtcccaaaggaggaaaaccggccgctggatcgcgcaccagcggttagcgtcgccagcaacccggcgaccggcaccgtgcagtacaccggtgctacccagcgccataccgtgacgcgcggcgagacgctgtccggcattgccgcccgatacggtgtcagcatggcgacgctgcgcgagctgaataacctgaagcgcgatgtggtgtgggtcggccagcggctgaaagtgccggccggttccggcgtcagcaccgcggctagccgtccggcgcggcacaaagtggtgcgcggtgattcgctgacagcgattgccgcgaagtacggcgtcagcccgaaagccatcatgcaggcgaataacatgaagtcgagcaacgtgatgctggggcaaaatttaaagattccacaatcctga

SEQ ID NO: 1059 - DNA, 1671 bp, Pantoea sp.
atgaagtcacggatgaaattagccttagtgaccctgctgttgctggtctgcgcgccgctgtttgcggccaccctgtctgatatcaaagtcgccaacggcgatagccaggccacggtgaccctgagctttgccgggcagccagtgtatggtttcttcccgctacgcaacccggaccgggtggtgctggacgtgcgccagagcggagtggtgcagggactgccgctgaacttcagcggagaaaacattgtaaagcgcatccggaccagcacggcgaaagacaaacagagcgtacggctggtgtttgagctgacgcagccgggcaaaacccgggcggtgacgcagcgtaacggcagcagctacagcgtggtgtttaccattaccggctcacggccggccgtaacccgcccgacgccgacgcccgatcctgcgccggtccgcgccccggttcagagcgcagccgccgcgaacccgtttaacgccaatccagtcaccgccgtcaccagcacagccagcacggtacgtccgggcagcgcggtcagccgcaacgacacggtgatcgtggcgattgatgccggacacggcggtcaggaccccggcgctatcggacagcgcgggctgaaagagaagaatgtcaccatcgctatcgcccgtaagctgcgggtgttactgaataacgatccgatgttcaaaggcgtactgacccgtgatggcgactattttatttcggtgatgggccgttctgacgtggcgcgtaaagcgaatgccaacgtgctggtctcaattcacgccgatgccgcgccaagccatgcggcgaccggtgcgtcggtctgggtgctgtcgaaccgtcgcgccaacagtgaaatggctaactggctggagcagaaagagaaacagtctgaactgctgggcggcgcaggcgatctgctggcgaacagtcaggcggacccttatctcagccaggcggtgctcgacctgcagtttggtcattcacagcgtgtcggttatgacattgcccagcgcgtgttgcagcaattacgcggcgtcacttcgctgcataaacgcttaccagagcatgccagccttggcgtgctgcgttcgccggatattccttcgctgttagtggaaaccggttttatcagtaattcctcggaggagcgactgcttggcagtagcgcacaccaggataagattgcgcagtcgatctataaaggtctgcgcacttatttcctggcgcacccgctgcaatccatcccaaaggaggaaaaccggccgctgggctcgtcgccagcggttagcgtcgccagcaacccggcgaccggcgtgacgcaatataccggtgccactcagcgccacacggtgacgcgcggcgagacgctgtctggcatcgccgcgaagtatggcgtcagcatggccaccctgcgtgagatgaatacgctgaagcgcgatgtggtatgggttgggcaacgccttaaagtcccggccagcgctgccgtcagccggaccacgcgagccaccacgcgcggtgtggtccgtcataaagtggtacgtggcgactcgctgaccggcattgccgcccactacggcgtcagcccgaaggcgataatgcagaccaataatctgaagtcgaccaacgtaatgttggggcagaacctgaaaattcctgcatcctga

SEQ ID NO: 1060 - DNA, 1671 bp, unknown
  environmental sample
atgatgtcacggatgaaaatagcactggtatcactgctgctgctggtctgtacgcccctgtttgccgccacgctgtctgatatcaaagtggccaatggcgatagtcaggctaccgttacgttgaactttgccggacagccggtctatgcctttttctctctgcacaacccgaatcgtgtagtgctggatgtgcgccagagcggcgtggttcaggggctgccgttaaatttcagcggcgaaaacatcgtaaagcgaattcgcaccagcacccctaaagataaacagagcgtgcggctggtgtttgagctgacgcaggcgggtaaaacccgggcggtcacccagcgcaatggcaacagctacagcgtagtcttcaccattaccggtaagccacctgctgttacgcgcagtgtgcctgcgcccgtcacagcaccgacgcgcgtacccacccagagtgccgctgcggctaacccctttaattcgaatccggtgacgtccgtgaccagcacagccagcaccgtgagtcctggccgggccgtcagccagaacgataccgtgattgtggcgattgatgccggacatggcggtcaggatcccggcgccatcgggcagcgcggactgaaagagaagaacgtcacgatcgcgattgcacgtaaactgcgggtgttgctgaataacgatccgatgtttaaaggcgtcctgacgcgtgatggcgactattttatctcggttatgggccgctcagacgtggcgcgtaaagccaacgccaacgtgctggtttcaattcatgctgacgccgcgccgagccatgcggcgaccggtgcatcggtctgggtattatcaaaccgccgggccaataacgagatggctaactggctggagcagaaagagaaacagtctgagctgctgggcggcgcaggtgacctgctggctaacagtcaggccgacccctacctcagccaggcggtacttgacctgcaattcggtcactcgcagcgggtcggttatgacatcgcccagaaagtgttgcagcagatgcgtagcgtgacgtcgctgcataaacgtctgcctgagcatgccagtcttggcgtgctgcgttcacccgatattccttctttgctggtggaaaccggctttatcagtaattcctcggaggagcgactgcttggcagtagcgcacaccaggataagattgcgcagtcgatctataagggtctgcgcacttatttcctggcgcacccgctgcaatccatcccaaaggaggaaaaccggccgctgggctcgtcgccagcggttagcgtcgccagcaacccggcgacaggtgtgacacaatataccggagcaacgcagcgccatacggtaacgcgtggtgagacactttccggtattgccgcgcagtatggcgtcagcatgaacaccctgcgtgagatgaacaccctgaagcgggatgtggtgtgggtcggacagcggctcaaagtgccggccagtgcagtcgccagtcgcaccacgcgcgctacgccgcgcggcgttgtgcgccacaaagttgtggtgggcgattcattaaccggcattgccgcacactacggcgtcagtccgaaagcgataatgcagaccaataatctgaagtcgaccaacgtcatgttggggcagaacctgaaaattcctgcatcctga

SEQ ID NO: 1061 - DNA, 1671 bp, unknown
  environmental sample
atgatgtcacggatgaaaatagcactggtatcactgctgctgctggtctgtacgcccctgtttgccgccacgctgtctgatatcaaagtggccaatggcgatagtcaggctaccgttacgctgaactttgccggacagccggtctatgcctttttctctctgcacaacccgaatcgtgtagtgctggatgtgcgccagagcggcgtggttcaggggctgccgttaaatttcagcggcgaaaacatcgtaaagcgaattcgcatcagcacccctaaagataaacagagcgtgcggctggtgtttgagctgacgcaggcgggtaaaacccgggcggtcacccagcgcaatggcaacagctacagcgtagtcttcaccattaccggtaagccacctgctgttacgcgcagtgtgcctgcgcccgtcacagcaccgacgcgcgtacccacccagagtgccgctgcggctaacccctttaattcgaatccggtgacgtccgtgaccagcacagccagcaccgtgagtcctggccgggccggaagccagaacgataccgtgattgtggcgattgatgccggacatggcggtcaggatcccggcgccatcgggcagcgcggactgaaagagaagaacgtcacgatcgcgattgcacgtaaactgcgggtgttgctgaataacgatccgatgtttaaaggcgtcctgacgcgtgatggcgactattttatctcggttatgggccgctccgacgtggcgcgtaaagccaacgccaacgtgctggtttcaattcatgctgacgccgcgccgagccatgcggcgaccggtgcatcggtctgggtattatcaaaccgccgggccaataacgagatggctaactggctggagcagaaagagaaacagtctgagctgctgggcggcgcaggtgacctgctggctaacagtcaggccgacccctacctcagccaggcggtacttgacctgcaattcggccactcgcagcgggtcggttatgacatcgcccagaaagtgttgcagcagatgcgcagcgtgacgtccctgcataaacgtctgcctgagcatgccagtcttggcgtgctgcgttcacccgatattccttctttgctggtggaaaccggctttatcagtaattcctcggaggagcgactgcttggcagtagcgcacaccaggataagattgcgcagtcgatctataagggtctgcgcacttatttcctggcgcacccgctgcaatccatcccaaaggaggaaaaccggccactgggctcgtcgccagcggttagcgtcgccagcaacccggcgacaggtgtgacacaatataccggagcaacgcagcgccatacggtaacgcgtggtgagacactttccggtattgccgcgcagtatggcgtcagcatgaacaccctgcgtgagatgaacaccctgaagcgggatgtggtgtgggtcggacagcggctcaaagtgccggccagtgcagtcgccagtcgcatcacgcgcgctacgccacgcggcgttgtgcgccacaaagttgtggtgggcgattcattaaccggcattgccgcacactacggcgtcagtccgaaagcgataatgcagaccaataatctgaagtcgaccaacgtcatgttggggcagaacctgaaaattcctgcatcctga

SEQ ID NO: 1062 - DNA, 987 bp, Geobacillus sp.
atgcgcaggcaattggtcctggctctgttgctcggcgggagcgttttcgcggcaggcgctcgcgccgagcaagcagaagcgagcgtgaactacgatcacatcgttccggcggcaaagcagtacatcggcgtcccataccggtggggcggcacgacggctaagggattcgactgctcgggattcatccggcatgtctaccagtcgatcggcattgatacgccaaggacggcggccgatatgtaccggatgggcaaacgtgtcgacaaaagcgctttgcgcgtcggtgatctcgtctttttcaatacgagcggaaaaggagtttcccatgcgggaatatacataggaaacaaccggtttattcattcttcttcttccaaaggtgtgacgatttcatcactgaatgattcatattggaaaaaaacatatatcggggcaaagcgggtgctagcgtaccgcttggcgccggggcagtttcaagatgtttccccgtcccattgggcgttcgatgaggtgcgcaccctgtcggaacaagagcttgtcatcggatatgaagacagctactttaagccggacgagccgattacccgcgcggaagtcgccgcgtatttggcagagtatctggatttgaatttgtctgaccgctcggtcccgtttaatgatgtgccggacggctactgggcgcttggagcgattcgggcggtgcaaaaacaagggattatgaacggaagcaatggacaatttcatccggaagacacgttgacgcgcgcgcagctggccgcggtgctgacgagagcatttcgcttacagccgccagctgcggcaaaatcgtttaccgatgtgccgccaagcttttgggcgtttcgcgacattcaagcactggcggcagcgggaattgcgacggggcgcacggatggctcgtttggcccgaacgatcctgtcacccgcgtgcaattcgccgcctttttgtaccgcgctatgcatcagtag

SEQ ID NO: 1063 - DNA, 1122 bp, Duganella sp.
ttgaaaacgaaaatctggtttgccacgatggctacgggcgtgctgcttcttggcacggcacaggcgcaatcgtatgtttataaaaacctgactctgcccgacggcgatggggttgcgagggcgatcaacaaccagggccagatcgtgggttccagctatttcgaaggcgttggcaaccatgccaccctgtggagcggatcaacgactatcgacctcggctcgctcgggccctccagcagcgccgcgagggcgatcaatagcagtggccaggccgtgggctattccttgtatacctccacgtccctgacagccagctcctggaatactgccaccggcagcatgctcgctctctcgcccggcactcaaagcaatgcgagagcgataaataatgcaggccagatcgccggctatacaacggcggccgatggttcctcaagagcgacgatctggaacggcaacagcacgacctacctgtccacccttggcggcaacgactacgccctcggcatcaataaccacggcgtggtggtcggcgacgcctactttaccggaagtgaggcgtcgcacgccatggtatgggacggcgacggcgcgcgcgcactgggcacactagggggcgccggcagcgacgcgtcggcggtaaacgacaacggcaagatagtcggctcctcgcagctggccaatggcagctggcaagcgacactatgggatggcgacaccatcagccagcttggagcgtccggctacgatggcggacaggcttgggcgatcaacaatcgcaaccaggtcgtaggctacacctatatggacaacaacaacgacaacggcacacggcgcgcgatgctgtgggacggcgggcgcatggtcgatctcaccagctttgtcgatagcgaatccagagcggggggctgggtgctgacgcaggcatacggcatcaacgacaacggctggattgtcggcgaagctttcaacctgcagaccaaccaccggcgcgccttcctgctgtcggtcagtgcggtgcccgagccatccgcttacgccctgctgctgatgggcctggcgtgcatgggcatgctcaacggccgccgcgtttggggggcgaaaaaaagcccgccggcctga

SEQ ID NO: 1064 - DNA, 873 bp, Janthinobacterium sp.
atgaatcgcccgttcgcctttgctctgctgtgtgccagttcgctgtttgtccacctcgcggcgcaggccggcgagatccgcctgtacaccgatgacaatttcaaggggcgcgtagtcgtcttgcgcgatacgacggacgacttgtcgcgcgttaatttcaatgacaccgtctcgagcatccaggtcgattcgggcagttgggaagtgtgcacgcatgccgatttcaagggcgattgcaagacgctggaacggggcgactaccactcgatgccgggcatgaacgataaaatctcgtctgtgcgggaaaccggcgccgggcagggcagcggcagcggcggtggacgccgcgcggcgctggagttgttcgccgacggcggccagcgcggcgcgtcggccggcgtgaactcggaccgcgacgacctggtcgacatcagcttcaacgaccgcgccagcagcgcgcgtgtcgaatatggctactggcagttgtgcagcgattccaactaccgtggcagctgccgcgtgtttgggcctggcagccatgatgacctgggcagcctgagtggacgcgtgtcgtcggcgcgcctggtcgatccgcgcgaagagaatcgtccgcaaaatgacgagggcctggtggtgctgtatggccgcgcgttcctgaaggggcctgggctgcaggtgaaccgcgacgtcagcgacctggtacgcctgaacttcaacgaccaggctgcatccctcgccatcaatgaaggcacctgggaagtttgcacggactcgcagttcaacggtagctgcgagcgcatggggccgggcaagtatgaagtgctgaacacgacgctcgacaagcgtatttcctcgctgcgccggctgtactga

SEQ ID NO: 1065 - DNA, 873 bp, Janthinobacterium sp.
atgaatcgcccattcgcctttgcactgctgtgcgccagctcgctgtttgtccatctcgcggcgcaggccggcgaaatccgcctgtacaccgatgataatttcaagggacgcgtagtcgtcttgcgcgatacgacggatgacctgtcgcgcgtcagcttcaatgacaccgtgtcgagcatccaggtcgatgcgggcagctgggaagtgtgcacgaacgccgatttcaagggcgattgcaagacgctggaacggggcgactatcgctcgctgccgggcatgaacgacaagatctcgtccgtgcgcgaaatcggcggcgggcagggtagcggcggcagcggtggccgccgcgcggcgctggaactgtatgccgacggcggccagcgcggcgcctcggccggcgtgaatgcggaccgcgacgacctggtcgacatcagtttcaatgaccgcgccagcagcgcgcgcatcgagcatggctactggcagctgtgcagcgattcgaattaccgtggcagctgccgcgtgttcggacctggcagccacgatgacctgggcagcctgaacgggcgcgtatcgtcggcgcgcctggtcgatccgcgcgaagagaaccggccgcaaaacgacgaaggcctggtggtgctgtacggccgcgcattcctgaagggcccggggctgcaggtgaaccgcgacgtcagcgacctggtgcgcctgaatttcaacgaccaggccggctccatgaccatcaacgaaggcacctgggaagtgtgcacggactcgcagttcaacggcacctgcgagcgcatgggcccgggcaagtatgaaaccctgggcacgacgctggacaagcgcatttcctcgctgcgccgcctgtattga

SEQ ID NO: 1066 - DNA, 873 bp, Janthinobacterium sp.
atgaatcgcccgttcgcctttgctctgctgtgcgccagttcgctgtttgtccatctcgcggcgcaggccggcgagatccgcctgtacaccgatgacaatttcaagggaagggtcgtggtcttgcgcgatacgacggacgacttgtcgcgcgtcaatttcaatgacaccgtctcgagcatccaggtcgattcgggcagctgggaagtgtgcacgcatggcgatttcaagggcgattgcaagacgctgcaacggggcgactaccgctcgatgccgggcatgaacgataaaatttcatccgtgcgcgaaatcggcgccgggcagggcggtggcagcggcaatggacgccgcgcggcgctggagctgtacgccggcggcggccagcgcggcgcgtcggcgggcgtgaatgcggaccgcgacgacctggtcgacatcggcttcaacgaccgcgccagcagcgcgcgcgtcgagtacggctactggcagctgtgcagcgattccaactaccatggcagctgccgcgtattcgggcctggcagccacgatgacctgggcagcctgaatgggcgcgtgtcatcggcgcgcctggtcgatccgcgcgaggagaaccgtccgcaaaatgacgagggcctggtggtgctgtatggccgcgcgttcctcaaggggcggaggctgcaggtgaaccgcgacgtcagcgacctggtgctcctgaacttcaacgaccaggccgaatccatcgccatcaacgaaggcacctgggaagtctgcaccaactcgcagttcaacggcacctgcgagcgcatggggccgggcaggtatgaagtgctggacacggcgctcgacaagcgcatttcctcgctgcgccgcctgtactga

SEQ ID NO: 1067 - DNA, 465 bp, Janthinobacterium sp.
atggcaccagacagacgcggtaccttgaacctggcggcggtaatgctggccgccgggctgttgctgggaagtgcggcgcaggcccaaaccgacagcgcactgccgcccgtgcagaaaagcggggcggtggaatacctgagcggcggcatcggcctcgacgagtcgacggccatccagagcgccagtccgcattggcccttgagcctcgtgttttccgtgcaggcggcgggcaaggcggaatttgcctccgacgtgaagctggagatacgcgacgccaagggtggcgtggcgctggaaacgacggccagcggaccgttcctgctggcaaagctgccgccaggccgctacagcctgcgcgccacgctggccggcaaggcactggaacgcaaggtgcaggtcaaggcgggatcgtccgcgcgcgtggaactggtctggccggcgggaacgaaccagggccggccttga

SEQ ID NO: 1068 - DNA, 465 bp, Janthinobacterium sp.
atggcattaaacagacgcggtaccctgggcctggcggcggcgatgctggccgccgggctgttgctgggaagtgcggcgcaggcgcaaaccgacggcgcactgccgcccgtgcagaagaacggggcggtggagtacctgagtggcggcatcggcctcgatgagtcgacggccatcaagagcgccagccggcattggcctttgagcctggtgttttccgtgcaggcagcgggcaaggcggaatttgcttccgacgtgaagctggaaatacgcgatgccaagggcgcttcggtgctcgatacgacggccagcggaccgttcctgctggcgaaactgccgccaggcagctacagcctgcgcgccaccctggccggcaagacgctggagcgcaaggtgcagatcaaggcgggcagttccgcgcgcgtggagctggtctggccggcgggaacgaaccagggccggccttga

SEQ ID NO: 1069 - DNA, 465 bp, Janthinobacterium sp.
atggcattaaacagacgcggtaccctgggcctggcggcggcgatgctggccgccgggctgttgctgggaagtgcggcgcaggcgcaaaccgacggcgcactgccgcccgtgcagaagaacggggcggtggagtacctgagtggcggcatcggcctcgatgagtcgacggccatcaagagcgccagccggcattggcctttgagcctggtgttttccgtgcaggcagcgggcaaggcggaatttgcttccgacgtgaagctggaaatacgcgatgccaagggcgctccggtgctcgatacgacggccagcggaccgttcctgctggcgaaactggcgccgggcagctacagcctgcgcgccaccctggccggcaagtcgctggaacgcaaggtgcagatcaaggcgggcagttccgcgcgcgtggagctggtctggccagcgggaacgaaccagggccggccttga

SEQ ID NO: 1070 - DNA, 471 bp, Janthinobacterium sp.
atggcatcaaacagacgcagacgcggtaccctgggcctggcggcggcaatgctggccgccgggctgttgctgggaagtgcggcgcaggcccaaaccgacagcgcgctgccgcccgtgcagaagagtggggcggtggaatacctgagcggcggcatcggcctcgacgagtcgacggccatcaagagtgccagccggcattggcccttgagtctcgtgttttccgtgcaggcggcgggcaaggcggaatttgcctccgacgtgaagctggaaatacgcgacgccaagggcgcgccggtgctggaaacgacggccagcggaccgttcctgctggcgaaactggcgccgggcagctacagcctgcgcgccaccctggctggcaagacgctggaacgcaaggtgcaaatcaaggctggcagttccgcgcgggtggagctgatctggccggcgggaacgaatcaaggtaaatcctga

SEQ ID NO: 1071 - DNA, 1317 bp, Lysobacter sp.
atgagccacaatccgctgcttgaactgatgtaccgcggcgaatccggcgcggccggttacaacgcgtacaaccgcggcacctatatcggcacggacggcaaggagcacatccgcggccccaatggtccgatcgatttttcgcagatgaccgtcggccagttgatggacaggcaggcgctgcccaacggcaacgccgatcgcgtatttgcggtcggcaagtaccagatcattcccgacaccatgagcgactcggtcagcgcgctgggtatcgatcgcaacgcccgcttcacgccggagttgcaggacaagatcttcaaggaatacctgatcgtcgacaaacgccccgaaatcgccgactacatcaccggcaagcccggcgcgaccctggccgaggcgcaacacggtctgtccaaggaatgggcgagcttcggcgatccgaacaagaacggcgccagccattacggcggcgcgaaccacgccagcatcaccctgcagcagtcggccgacgcgctcaaccagatgcgcaccgagtacaaggccaatatcgacaagggcctgtcgccggccgatgcgtggaaggcgaccaccggcgacgatccgaaccgcaccttgcccgcgtcgatcaccagcccgggttcgtcgcagcgcgcgccgcgcgacgcgatggccgacggcgtgctcaagcccgacgagcgcggcccggcggtgacctcgctgcaggaacagttgaacaaggccggtttccgcgacgcgcagggcaacgagctcaagcccgacggccactatggcaagcacaccaaggaagcggtcgaagccttccagcgcgccaacaatctggaagtcgacggcaaggccggtcccaagaccctggaagcgctgaagaacgcgcaaccggccggtccgcagaccgagaagccggccgagaagcccggcgaggtgcaactgtccaatccggcgcatccggaccacgcgatgtacaagcaggccgtcgccggcctggagaagctcggcccgcaggccgggttcaaggaccacgccgcgctcgagcgcgcggctgggacgatgacctacgaggcgcgggtcagcggcatgaccaagatcgaccacgtcgtgcccaacgccagcggcaccggtctgttcgcggtgcagggcgaactgcgcgatccggccagccagcgcgtggtggtggacaaggcgcaggccagcagccagagcatcgagcagtcgacccagcagctcaagcaggacgcgccgacgcagaaccagacccaggaaccggcgcaggaacggcagcagcccaagacgatgatggcgtaa

SEQ ID NO: 1072 - DNA, 372 bp, Paenibacillus sp.
atggacaacaaagcatatgtatctcaaacgtatccacgtcttacagtttacaacgaagaaaattttcggggttccaggagagtattcagaggaaacctaggcattcgtaataccgataacattctcgacggcatcgaaagtctgcgtttcttttctaccagcagcaatgctacactggtactctttacaggcacgcggtttagaggtaacttccgtgtgtttagaggcaatcgcagcatcgccgacctggatgatctgattcgtgggaatgatgtggaatctattatctctaccaatcaacgtttgacgttgcaacaaatccgtaatatccgcagtagcggtagacttccatctggctaccgaatcatctaa

SEQ ID NO: 1073 - DNA, 372 bp, Paenibacillus sp.
atggacaacaaagcatatgtatctcaaacgtatccacgtcttacagtttacaacgaagaaaattttcggggttccaggagagtattcagaggaaacctaggcattcgtaataccgataatattctcgacggcatcgaaagtctgcgtttcttttctaccagcagcaatgctacacttgtactctttactggcacgcggtttagaggtaacttccgtgtgttcagaggcaatcgcaacattgccgacctggatgatctgattcgcgggaatgatgtggaatctattatctctaccaatcaacgtttgacgttgcagcaaatccgtaatatccgcagtactggcagactgccagctggctatcggatcatctaa

SEQ ID NO: 1074 - DNA, 372 bp, Paenibacillus sp.
atgactaataaagcatacgtatctcaaacgtatccacgccttacagtctacaatgaagaaaattttcggggttctcgaagagtattcagaggaaacctaggtatccgcaacaccgataatattctcgacggcatcgaaagtctgcgtttcttttctaccagcagcaatgctacacttgtactctttactggcacgcggtttagaggtaacttccgtgtgtatagaggcaatcgcagcatcgccgacctggatgatctgattcgcgggaacgatgtggaatctattatctctaccaatcaacgtttaacgttgcagcaaatccgtaatatccgcagtacgggcagactgccatccggctatcggatcatctaa

SEQ ID NO: 1075 - DNA, 372 bp, Paenibacillus sp.
atgactaataaagcatacgtatctcaaacgtatccacgccttacagtctacaatgaagaaaattttcggggttctagcagagtattcagaggaaacctaggtatccgcaacaccgataatattctcgatggcatcgaaagtctgcgtttcttttctaccagcagcaatgctacacttgtactctttactggcacgcggtttagaggtaacttccgtgtgtatagaggcaatcgcagcatcgccgacctggatgatctgattcgcgggaatgatgtggaatctattatctctaccaatcaacgtttgacgttgcagcaaatccgtaatatccgcagtactggcagactgccatccggctatcggatcatctaa

SEQ ID NO: 1076 - DNA, 372 bp, Paenibacillus sp.
atgactgacaaagcatatgtatctcaaacgtatccccgtctgacagtctacaacgaagaaaactttcggggttccagcagagtattcagaggaaacctaggtattcgcaacactgataacattcttgacggcatcgaaagcctgcgtttcttttctacaagcagcgatgctacacttgttctctttaccggcacgcggtttagaggtaatttccgtgtgtatagaggcaatcgtcgcatcgccgacctggatgatctgattcgcgggaatgatgtggaatctattatctctaccaatcaacgtttgacgttgcagcaaatccgtaatatccgcagtagcggtagacttccatctggctatcgaatcatctaa

SEQ ID NO: 1077 - DNA, 372 bp, Paenibacillus sp.
atgaaaaaagaagttcatgtatcgcagacttaccctcgcttgaccgtgtacgatgaagaaaacttcaatggacgccgtagaatatatactggcaacctgggtattcgtaatacggacaacatcctcgatggtattgagagccttcggttcttctctactagcagcaatgctacactggtacttttcactagaacacggtttagagggaacttccgtgtacttcgcgggaaccgcaacattagggatctggatgatttcatttcaggtaatgacgtggagtccattatttctactaaccaacgcttaaccctcgaacaaatccgtaatatccgcagcagcggtaacttgccttcgggatatcgtttgatctaa

SEQ ID NO: 1078 - DNA, 432 bp, Paenibacillus sp.
atggtccatagaaattcaggtcattctctagcactgctccagaagcccgaaagttgcaagctcctgaaacagtcttgtaaaatggtttatgaagtcgaaataaggccgttagatgattcgatagccagatggcagtctaccggtactgcggatattacggatttgctgcaacgtcaaacgttgattggtagagataatagattccacatcattcccgcgaatcagatcatccaggtcggcaatgctgcgattgcctctatacacacggaagttacctctaaaccgcgtgccagtaagaggacaagggtagaattgctgctagtagaaaagaaacgcagactttcgatgccgtcgagaatgttatcggtattacgaatgcctaggtttcctctgaatactctcctggaaccccgaaaattttcttcgttgtag

SEQ ID NO: 1079 - DNA, 372 bp, Paenibacillus sp.
atgaaaaaagaagttcatgtatcccagacttatccacgtttaactgtttacgatgaagaaaactttaggggtagaagtagaatctatactggcaacctaggcattcgtaatacggacaacatcctcgatggtattgagagtcttcgtttcttctctaccagcagcaatgcaacactggtactgttcacaagaactaggtttagagggaacttccgcgtgctccgtggaaaccgcagcatccgtgatttggacgatttcatttccggcaatgatgtggaatccattatttcaaccaatcagagattaactctcgaacagattcgcaatatccgtagaaccggcaacttaccttcaggatatcgtttgatctaa

SEQ ID NO: 1080 - DNA, 372 bp, Paenibacillus sp.
atgatcagcaaagcatttgtatctcaaacatatccgcgccttaccgtctttagtgaagaaaattttcggggggccagcagagtatatacgggaaatttaggtattcgcgatatggataccgttctcgatggtatagagagcctgcgtttcttttctacaagcagtgatgctacactggtactctttaccggcacgcggtttagaggtaattttcaagtctttagaggcaatcgccgcttcgccgacctggatggtctgattcgtggaaatgatgtagaatctcttgtctctaccaatcaacgtttgacgttgcagcaaatccgtaatatccgaagtaccgggaaacttccatccggctatcgtttgatctaa

SEQ ID NO: 1081 - DNA, 372 bp, Paenibacillus sp.
atgaataaagaggttcatatctctcagacttatccaagactaacggtgtacagcgaagaaaacttccggggaagaagcagaatctacagaggcaatctcggtatccgcgatacggacaatattctggatggcatcgaaagcctccgcttcttctccaccagtagcaatgctacgctcgtcctgttcagcagaacccggttcagaggcagcttccgcgtgcttcgcggcaaccacagtatccgtgatctggatgacttcatctccggcaatgacgtagaatcgatcatctctaccaaccagagactgacgctggaccagatccgccgtatccgcagcagcggggaacttcctccaggctaccgcttaatctaa

SEQ ID NO: 1082 - DNA, 372 bp, Paenibacillus sp.
atgaataaagaggtgcacatctcgcagactttcccaagactgaccgtgtacagtgaagaaaactttcggggaagaagcagaatctacagaggcaatctcggtatccgcaatacggacaatattctggatggcatcgaaagcctccgcttcttctcgaccagcagcaatgctacgctcgttctgttcagcagaacccgcttcagaggcagcttccgcgtgcttcgcggcaaccacagcctccgcgatctggatgacttcatctccggcaatgacgtagagtcgatcatctccaccaaccagagactgacgctggatcagatccgccgtatccgcagcagcggggagcttcctgcaggctaccgcttaatctaa

SEQ ID NO: 1083 - DNA, 372 bp, Paenibacillus sp.
atgagaaaactagttcatgcttcacagacttaccctcgccttacggtgtatgaggatgagaattacagagggcgtagcagggtatacacaggtaatcttggcattcgtaataccgatgcgatcctggacggaattgagagcctgcgcttcttctcgaccaacagcaatgctactcttgtactgttcacgagaacccgcttcagaggcaacttccgcgtgctgcgtggcaaccacagcatcagcgacctagaggactatatcaacggcaatgatgtggaatctctgattgccaccaaccagcgacttacacttacccagatacggaatattcgtagtagtggcgatttgccttctggataccgtctgatctga

SEQ ID NO: 1084 - DNA, 372 bp, unknown
  environmental sample
atgagaaaaccagttagtatcttgcaaacttacccgcggttgaccgtctacgacgaagaaaacttccgtggtcggagccgtatcctgaggggcaacctggggatacgggatctggataatgttttggatggtattgagagtcttcgcttcttctctaccagttccaatgcgactttggtgctgttcacccgcacacgctttcgcggcaacttccgtatcttgcgcggcaatcgcagcatccgcgacctggacgatctgatcggcggcaacgatgtcgagtcgctgatctccaccaatcaacgcctgaccgcagctcaggtgcgcgcgattcgccggagcggccaattgccgagcggctaccgactcatttaa

SEQ ID NO: 1085 - DNA, 372 bp, Paenibacillus sp.
atgcagccaaaagcatatgtatcgcaaacgtaccccagactgaccgtctatgaggatgaaggttttacaggcaggagccgggttttcaccggaaatgtaggaatttccaatacagaccgcatcgttgacggtattgaaagcttgcgcttcttctccacaagcagcaatgcaactttggtgctgtttacccgtaccggttttagaggcaactttcggatcttgcgcggaaaccgcagtatccgggacctggacgatttgattgccggtaacgatgtagaatcgattatttcgacaaaccagcgcttaaccgtggagcaggtgcgcgcgatccgcaatgccggccagctgccagccggttatacgcgcgtataa

SEQ ID NO: 1086 - DNA, 372 bp, Paenibacillus sp.
atgaaaaaacaagtaagcatctcccaaacgtaccctcgtctgagagttttcgacgaggagaacttccgcggtcgcagacgtacattgcgtggcaacctggggattcgggacctcgacaacatcctcgatggcatcgagagcctgagtttcttctccaccaaccccaatgcaacgcttgtcctgttcacaagaacccgcttccggggcaacttccgtattctgcgcggcaaccgcagtattcgtgatctggatgatctgattggcggcaatgacgtggagtccttgatctccaccaaccagcgcctcaccatcgctcaggttcgtgagatccgtcgtactggacggctgccccaaggctaccgtttaatctaa

SEQ ID NO: 1087 - DNA, 450 bp, Paenibacillus sp.
atgaacattgagttggtgttgactgctaacaacatcccattctcccatacagttcctctcatcattcgagtatgtaggtcgcgtgtacaaatagagagactgtcccaaaagcccgaaagttgcaagctcctgaaacagtcttgtaaaatggtttatgaagtcgaaataaggccgttagatgattcgatagccagatggcagtctaccgctactgcggatattacggatttgctgcaacgtcaaacgttgattggtagagataatagattccacatcattcccgcgaatcagatcatccaggtcggcgatgttgcgattgcctctaaacacacggaagttacctctaaaccgcgtgccagtaaagagtacaagtgtagcattgctgctagtagaaaagaaacgcaaactttcgatgccgttgagaatgttatcggtattacgaatgcctag

SEQ ID NO: 1088 - DNA, 372 bp, Paenibacillus sp.
atgaaaaaaacagtcaacgtcagtcagacgtatccacgtcttaccgtgtattcagaagagaactacagagggagaagccgcatctatcgtggcaacacgggtcttcgtaacctggacaatattttggatggggtggagagcctgcgctttttctcaacaagttctaatgcaacactggttgtgtttacacgtcctaacttccaaggtggattccgggtcttccgaggcaacaccaacttgagagatttggatgatctgatccgtggcaatgatgtggaatccctgatctccaccaatcaacggttaacgctggctcagattcgcgcaatccgcagggatcgcagtctgcctagtggttataacctcgtttaa

SEQ ID NO: 1089 - DNA, 378 bp, Paenibacillus sp.
atgatagaatcccaaaaagtaagcatatctcagaggtttcctcttcttactgtgtattctgaagagaattttcgtggagctagaagaattttcacaggcaacttaggtattaggaacttagatagagttctaggcggtattgaaagtctcagattcttctccaccaatcccaatgcgacgttagtcttgtttacgagaactagattccgtggaaacttccgaattcttcgggggaatcgtagtatccgcgacttagacgatcttattgcagggaatgatgtagaatcattgatttcaacgaatcaaagattaaccgtggctcaagtcagaaacattcgtaacaccggcactttaccgcctggatatcgtgtaatttaa

SEQ ID NO: 1090 - DNA, 1047 bp, Paenibacillus sp.
atgttggctaccttctcggccgcgcttcaagtgaaaaagcggatggccaagcgagtcttaaaaatgtccggtgtccacggcattggcgtaggatacagggaccctgcccatcccaaaaagggagccgctgtcattgtgtatacggaccgtctagcgtcggcctctactggactcctgtcggccaccgcattaggaaagaaaacgaacgttccagtccgaattgttaaaactggaaagatcagagccaatgccacggactacaaagtgcgcatacgcccggtcatcgccggctacagtgtcgggacgattgaaggctccggttcaaccggactcatcgttgccccaactggagcgccggcgacgcgttatctttttagcaataaccatgtcctcaatccctccaatacagacaatcgggaggctacaatacagccaggcggagccgatggggggacggttactcaggatcgtataggaaggctgtatcgttacgtacgcttgaatcccaccggtacaaacctgattgatgcggcgctttcgcttccaacccgtaacaacctactcaatccgcgttacgctacggtaggagcgattccaggtcatgttaccgcatatcgcataggagaaagattgaagaaggttgggcgtacgaccggacgggtcaatggcacggtagagtccgtctatacggacctgcaaatcaattatggcggagagttgggcctgctgaccttcgaagatcagacggttattagaggtacgactcccgtatcactacctggggattctggctctgtatggctcagacagtcagataattatgcagctgcggtcaactatgcaggcacggcagatggtcgcttatctatagcctttccggtgcagtgggcgatgcaggtattcaacacacgggtagcccgccccaatggggcaggcagggtgctcagggtagatacaggttcttcccctcgctcctatactaggcaactcaccagtgaggaactggttcgcttaagaccaagaacgacacgcattagacgaagctaa

SEQ ID NO: 1091 - DNA, 1047 bp, Paenibacillus sp.
atgttggctaccttctcggccgcgcttcaagtgaaaaagcggatggccaagcgagtcttaaaaatgtccggtgtccacggcattggcgtagggtacagggaccctgctcatcccaaaagaggagccgctgtcattgtgtacacggaccgtttagcgtcggcctctactggactcctgtcggccaccgcattaggaaagaaaacgaacgttccagtccgaattgtaaagactggaaagatcagagccaatgccacggactacaaagtgcgcatacgcccggtcatcgccggctacagtgtcgggacgattgaaggctccggttcaaccggactcatcgttgccccaactggagcgccggcgacacgttatctttttagcaataaccatgtcctcaatccctccaatacagacaatcgggaggctacaattcagccaggcggagccgatggggggaccgttacccaggatcgtataggacggctttatcgttacgtacgcttgaatcccaccggaacgaacctgattgatgcggcgctttcgcttccgacccgcaacaacctgctcaatccgcgttatgctacagtaggagcgattccgggtcatgtgaccgcatatcgcataggggaaagattgaagaaggtagggcgtacgaccgggcgggtcaatggcacggtagagtccgtctatacggacctgcaaatcaattatggtggagagttgggcttactaaccttcgaagatcagacggttattagaggtacgactcccgtatcactacctggggattccggctctgtatggctcagacagtcagataattatgcagctgcggtcaactatgcaggtacggcagatggtcgcttatccatagcctttccggtgcagtgggccatgcaggtattcaacacacgggtagcccgccccaacggggcaggcagagtactgagggtagatacaggatcttcccctcgctcctatactaggcaactcactagtgaggaactggttcgcttaagaccaagaacgacacgcattagacggagctaa

SEQ ID NO: 1092 - DNA, 1044 bp, Paenibacillus sp.
ttggctaccttctcggccgcgcttcaagtgaaaaagcggatggccaagcgagtcttaaaaatgtccggtgtccacggcattggcgtagggtacagggaccctgctcatcccaaaagaggagccgctgtcattgtgtacacggaccgtttagcgtcggcctctactggactcctgtcggccaccgcattaggaaagaaaacgaacgttccagtccgaattgtaaagactggaaagatcagagccaatgccacggactacaaagtgcgcatacgcccggtcatcgccggctacagtgtcgggacgattgaaggctccggttcaaccggactcatcgttgccccaactggagcgccggcgacacgttatctttttagcaataaccatgtcctcaatccctccaatacagacaatcgggaggctacaattcagccaggcggagccgatggggggaccgttacccaggatcgtataggacggctttatcgttacgtacgcttgaatcccaccggaacgaacctgattgatgcggcgctttcgcttccgacccgcaacaacctgctcaatccgcgttatgctacagtaggagcgattccgggtcatgtgaccgcatatcgcataggggaaagattgaagaaggtagggcgtacgaccgggcgggtcaatggcacggtagagtccgtctatacggacctgcaaatcaattatggtggagagttgggcttactaaccttcgaagatcagacggttattagaggtacgactcccgtatcactacctggggattccggctctgtatggctcagacagtcagataattatgcagctgcggtcaactatgcaggtacggcagatggtcgcttatccatagcctttccggtgcagtgggccatgcaggtattcaacacacgggtagcccgccccaacggggcaggcagagtactgagggtagatacaggatcttcccctcgctcctatactaggcaactcactagtgaggaactggttcgcttaagaccaagaacgacacgcattagacggagctaa

SEQ ID NO: 1093 - DNA, 1047 bp, Paenibacillus sp.
atgttggctaccttctcggccgcgcttcaagtgaaaaagcggatggccaagcgagtcttaaaaatgtccggtgtccacggcattggcgtaggatacagggaccctgcccatcccaaaaggggagccgctgtcattgtgtacacggaccgtttagcgtcggcctctactggactcctgtcggccaccgcattaggaaagaaaacaaacgttccagtccgaattgtaaagactggaaagatcagagccaatgctacggactacagagtgcgcatacgcccggtcatcgccggctacagtgtcgggacgattgaaggctccggtacaaccggactcatcgttgccccaactggagcgccggctacacgttatctttttagcaacaaccatgtcctcaatccctccaatacagacaatcgggaggctacaattcagccaggcggagccgatggggggacggttgctcaggatcgtataggacggctatatcgttacgtgcgcttgaatcctaccggaacgaacctgattgatggggcgctttcgcttccgacccgtaacaacctgctcaatccgcgttatgccacagtaggagcgattccgggtcatgtgaccgcttatcgcataggggataggttgaagaaggtagggcgtacgaccgggcgggtcaatggcacggtagagtccgtctatacggacctgcaaatcaattatggtggagagttgggcttactgaccttcgaagatcagacggttattagaggtacgactcctgtatcactacccggggattctggctctgtatggctcagacagtctgataattatgcagctgcggttaattatgcaggcacggcagatggtcgcttatccatagcctttccagtgcagtgggccatgcaggtattcaacacacgggtagcccgccccaacggggcaggcagggtgctgagggtagatacaggatcttcccctcgctcttatactaggcagctcaccagtgaggaactggctcgcttaagaccaagaacgacacgcattagacggagctaa

SEQ ID NO: 1094 - DNA, 1047 bp, Paenibacillus sp.
atgttggctaccttctcggccgcgcttcaggtgaaaaagcggatggccaagcgagtcttaaaaatgtccggtgttcacggcattggcgtaggctacagggaccctgcccatcccaaaaggggagccgctgtcattgtgtacacggaccgtctagcgtcggcctctactggactcttgtcggccactgccttagggaagaaatcgaacgttcctgtccgaattgtaaagactggaaaaatcagggctaatgctacggactacaaagtgcgcatccgcccggtcatcgccggctacagtgtcgggacgattgaaggctccggtacaaccggacttatcgttgccccaactggagcgccggctacacgttatcttttaagcaataaccatgtgctcaatccctccaatacagacaatcgggaggctacaattcagccaggcggagccgatggggggacggttgcccaggatcgtataggacgactgtatcgttacgtacgcttaaatcccactggaacgaacctgattgatgcagcgctttcgcttccgacccgcaacaacctgctcaatccccgttatgctacagtgggagcgattccgggtcatgttaccgcctatcgcataggagaaagattgaagaaggtagggcgtacgagcgggcgggttaatggcacggtagagtccgtctatacggacttgcaaatcaattatggtggtgagttgggcctgctgaccttcgaagatcagacggttattagaggtacgactcctgtatcactacccggggattccggctctgtatggctcagacagtccgataattatgcagccgcggtcaactatgcaggcacggcagatggtcgcttatccatagcctttccagtgcagtgggtcatgcaggtattcaacacacgagtagcccgccccagcggggcaggcagggtactcagggtagatacaggatcttcccctcgttcctatactagacaactcaccagtgaggagctcgttcgcttaagaccaagaacgacacgtattagacgaagctaa

SEQ ID NO: 1095 - DNA, 1047 bp, Paenibacillus sp.
atgttggctaccttctcggccgcgcttcaagtgaaaaaacggatggccaagcgagtcttaaaaatgtccggtgtccacggcattggcgtagggtacagggaccctgcccatcccaaaagaggagccgctgtcattgtgtacacagaccgtctcgtttcggcctctaccggactcctatcggccaccacattaggaaagaaaacgaacgttccagtccgaattgtaaagactggaaagatcagagccaatgctacggactacagagtgcgcatacgcccggtcatcgccggctacagtgttggaacgattgaaggctccggtacaaccggactcatcgttgccccaactggagcgccggcgacacgttatctttttagcaacaaccatgtcctcaatccctccaatacagacaatcgggaggctacaattcagccaggcggagccgatggggggacggttactcaggatcgtataggacggctttatcgttacgtacgcttgaatcccaccggaacgaatctgatagatacggcgctttcgcttccgacccgtaacaacctgctgaatccgcgttatgctacagtaggagcgcttccgggtcatgtgaccgcttatcgcataggggataggttgaagaaggtagggcgtacgaccgggcgggtcaatggcacggtagagtctgtctatacggacctgcaaatcaattatggcggagagttgggcttactgaccttcgaagatcagacggttattagaggtacgactcccgtatcactacctggggattctggctctgtatggctcagacagtcagataattatgcagctgcggtcaactatgcaggcacggtagatggtcgcttatccatagcctttccagtgcagtggttcatgcaggtattcaacacacgggtagcccgccccaacggggcaggcagggtgctgagggtagatacaggatcttcccctagctcctatactaggcagctcaccagtgaggaactggctcgcttaagaccaagaacgacacgcattagacggagctaa

SEQ ID NO: 1096 - DNA, 1047 bp, Paenibacillus sp.
atgttggctaccttctcggccgcgcttcaagtaaaaaagcggatggccaagcgtgtcttgaaaatgtctggtgtccacggtattggcgtaggatacagggaccctgctcatcccaaaaggggagccgctgtcattgtgtacacggatcgtctagcgtcggcctctactggactcttgtcggccactgccttaggaaagaaatcgaacgttcctatccgaattgtaaagactggaaagatcagagctaatgccacggactacagagtgcgcatccgcccggtcatcgccggctacagtgtcgggacgattgaaggttccggtacaaccggactcatcgtttccccaactggagagccggctacacgttatctttttagcaataaccatgtcctcaatccctccaatacagacaatcgggaagctacaattcaaccaggcggagccgatggggggacggttgcccagaatcgtataggacgactgtatcgttacgtgcgcttaaatcccaccggaacgaacctgattgatgcagcgctttcgcttccgacccgcaataacctgctcaatccgcgttatgctacagtgggagccattccgggtcatgttaccgcttatcgcgtaggagaaaaattgaagaaggtagggcgtacaaccgggcgggttaatggcacggtagagtccgtctatacggacctgcaaatcaattatggtggagagttgggcttactgaccttcgaagatcagacggttattagaggtacgactcctgtatcactacccggggattccggctctgtatggctcagacagtccgataattatgcagccgcggtcaactatgcaggcacggcagatggtcgcttatccatagcctttccggtacagtggttcatgcaggtattcaacacacgagtagcccgccccagcggggcaggcagggtgctcagagtagatacaggatcttcccctcgctcctatactagacaactcaccagtgaggagcttgttcgcttaagaccaagaacgacacgcattagacggagctaa

SEQ ID NO: 1097 - DNA, 1047 bp, Paenibacillus sp.
atgttggctaccttctcggccgcgcttcaagtaaaaaagcggatggtcaagcgtgtcttgaaaatgtctggtgtccacggcattggcgtaggatacagggaccctgctcatcccaaaaggggagccgctgtcattgtgtacacggatcgtctagcgtcggcctctactggactcttgtcggccactgccttaggaaagaaatcgaacgttcctatccgaattgtaaagactggaaagatcagagctaatgccacggactacagagtgcgcatccgcccggtcatcgccggctacagtgtcgggacgattgaaggttccggtacaaccggactcatcgtttccccaactggagagccggctacacgttatctttttagcaataaccatgtcctcaatccctccaatacagacaatcgggaagctacaattcaaccaggcggagccgatggggggacggttgcccagaatcgtataggacgactgtatcgttacgtgcgcttaaatcccaccggaacgaacctgattgatgcagcgctttcgcttccgacccgcaataacctgctcaatccgcgttatgctacagtgggagccattccgggtcatgttaccgcttatcgcgtaggagaaaaattgaagaaggtagggcgtacaaccgggcgggttaatggcacggtagagtccgtctatacggacctgcaaatcaattatggtggagagttgggcttactgaccttcgaagatcagacggttattagaggtacgactcctgtatcactacccggggattccggctctgtatggctcagacagtccgataattatgcagccgcggtcaactatgcaggcacggcagatggtcgcttatccatagcctttccggtacagtggttcatgcaggtattcaacacacgagtagcccgccccagcggggcaggcagggtgctcagagtagatacaggatcttcccctcgctcctatactagacaactcaccagtgaggagcttgttcgcttaagaccaagaacgacacgcattagacggagctaa

SEQ ID NO: 1098 - DNA, 1044 bp, Paenibacillus sp.
atggctaccttctcggccgcccttcgagtgaaaaagcggatggccaagcgcgtattaaaattatccggtgtccatggtattggcgtagggtacaaagaccctggtcatcccaaaaagggagccgctgttattgtgtatgcagaccggctggcttcggcctccaccggacttctgtctgccacagcattgggcaaaaaaacgaatgtccctgtccggattgtaaaaacaggaaagatcagagccaatgccacggattacagggcacgcatacgcccggtcatcgccggctacagtgtcggaacgattgaaggctccgggacaaccggattgatcgttgcgccaactggagcgccggctacacggtatcttttcagcaacaaccatgtccttaatccctccaatacagacaatcgggaggctacgattcagccgggcggagccgacgggggaacggttccccgggatcgtattggacggctgtatcgttacgtacgcttgaatccaagtggaacgaacttgattgatacagcgctttccctgccgacccgcaacagcttgcttagtccgcgttacgccacagtaggaacgattccaggccatgtgaccgcttatcgcataggagaaaggttaaaaaaggtagggcgtacaaccgggcgggtcaatggtacggtagagtctgtctatacagacctgcaaatcaattatggcggaagcctggggttgctgaccttcgaggatcagaccgtcataagaggcacgaatcctgtatcactgccgggcgattccggttctgtctggctcagacagtcggataattatgcagctgcggtcaactatgcaggtacggcagatggccgtctctccattgccttcccggtgcagtggttcatgcaggtgttcaacacacgcgtagcccgccccaatggggcaggcagagtactcacggtagatacaggctcttccccaagttcctatacaaggcagctcactagtgaggaactggctcgcttaagaccgagaacgacgcgcattagaaagggctaa

SEQ ID NO: 1099 - DNA, 1047 bp, Paenibacillus sp.
atgatggctaccttctcggccgcccttcgagtgaaaaagcggatggccaagcgcatattaaaattatctggtgtccacggtattggcgtagggtacaaagaccctgctcatcccaaaaagggagccgccgttattgtgtatgcagaccagctggcctcggcctccaccggactcctgtctgccacagcactgggcaaaaaaacgaatgtccctatccggattgtaaaaaccggaaagatcagagccaatgccacggactacaaaacgcgcatacgcccggtcatcgccggctacagtgtcggaacgattgaaggctccgggacaaccggattgatcgttgcgccaactggagcgccggctacacggtatcttttcagcaacaaccatgtccttaatccctccaatacagacaatcgggaggccacgattcagccgggcggagccgacgggggaacggtttcccaggatcgtattggacggctgtatcgttacgtacgcttgagtccaagcgggacgaacttgattgatacagcgctttccctgccgaccaggaacagattgctcaacccgcgttacgctaccgtaggggtagtcccgggccatgtcaccgcttatcgtgtgggagaaagacttaaaaaggtagggcgtacgaccgggcgggtcaatggtacggtagagtctgtcaatacggacctgcaaatcaattatggcggaagcctggggctgttgacctttgaggatcagaccgtcgttagaggtacgactcctgtatcgctaccgggggattccggttctgtctggctcagacagtcggataattatgcagctgcggtcaactatgcaggtacggcagatggtcgtctatccattgcctttccggtacagtggttcatgcaggtgtacaacacacgggtagcccgccccaacggggcaggcagggtactcacagtagatacgggctcttccccaagttcctatacaagacagcttaccagtgaggaactggctcgcttaagaccaagaacgacgcgcattagaaagagctaa

SEQ ID NO: 1100 - DNA, 1047 bp, Paenibacillus sp.
atgttggctaccttttcggccgcccttcaagtgaaaaagcggatggccaagcgcatattaaaattatccggtgtccacggtattggcatagggtacaaagaccctgctcatcccaaaaagggagcggctgtcattgtgtatacagaccggctggcctcggcctccgccggactcctgtccgccaccgcattgggcaagaaaacgaatgtccctgtccggattgtaaaaaccggaaaaatcaaagcccatgctgcggactacaggaagcgcatacgcccggtcgtcgccggctacagtgtcggaacgattgaaggctccgggacaaccggattgatcgttgcgccaactggagcgccggctacacggtatcttttcagcaacaaccatgtccttaatccctccaatactgacaatcgggaggctacgattcagccgggcggagcagacgggggaacggttgcccgggatcgtattgggcggctgtatcgttacgtgcgcttgaatccaaacggaacgaacctgattgacacggcgcttgccctgccgaccagcaacagcttgctcagtccgcgttatgccacagtaggagcagttccgggccatgtgaccgcttatcgtgtgggagaaaaattaaaaaaggtagggcgtacaagcggacgggtcaatggcacggtagagtctgtctatacggacctgcaaatcaattatggcggaagcctggggctgctgaccttcgaggaccagacggtcatcagaggcacgactcctgtatcgctgccaggagattccggctccgtctggctcagacagtcggataattacgcagctgcggtcaactttgcaggcacggcagatggccgtctatccattgctttcccggtgcagtggttcatgcaggtgttcaacacacgggtagcccgccccaacggggcaggcagggtgcttacggtagatacaggctcttcccctcgtttctatacaaggcagcttaccagtgaggagctggctcgcttaagaccaagaacgacgcgcattagaaagagctaa

SEQ ID NO: 1101 - DNA, 1047 bp, Paenibacillus sp.
atgttggctaccttctcggccgcccttcaagtgaaaaagcggatggccaagcaagtcttaaaaatgtccggtgtccacggcatcggcgtagggtatagggaccctgctcgtcccaaaaggggagccgctgtcattgtgtacacagatcggttggccacggcctctaccggacttctgtcggccacagcgctaggcaagcaaacgagcgttcctgtccggattgtaaagtctggaaagatcaaagcccatgccacggactacaaagtgcgtatacgcccggtcatcgccggctacagcgtcgggacgattgaaggctccggtacaaccggactgatcgtcgccccaactggagcgccggctacacgttatcttttcagcaataaccatgtactcaacccctccaatacagacaatcgggaggccacgattcagccaggcggagccgatgggggggcagctacccgagatcgtataggacggttatatcgttatatacgcctaaatccaacgggaaccaatttcattgatgcggcgctttccttgccaccccgcaacagctcgctcagtccgcgttatgctacagtaggagcggttccgggccatgtgaccgcttatcgtgttggcgaaaaattcaaaaaggtgggacgtacgaccgggcgggtcaatggcacggtagagtccgtctatacggatttgcaaatcaattacggcggaagcctggggctgctgaccttccaggatcagaccgttattagaggtaccacccctgtatcgctgcccggggattccggctctgtctggctcagacagtcggataattatgcggcagcggtcaattttgcaggcacgacagatgggcgtctgtccattgctttcccggtgcagtggttcatgcaggcgtttaacacacgggtagcccgccccgtcggggcaggcagggtgcgcagagtagatacaggatcatctccacgctcttatacaagacagctcaccggcgaggaattggcacgtttgaagccaagaacaacgcggattagacggagctaa

SEQ ID NO: 1102 - DNA, 1050 bp, Paenibacillus sp.
atgatgttggctaccttctcggccgcccttcaagtgaagaagcggatggccaagcgagtcttaaaaatgtccggtgtccacggcatcggcgtagggtacagggaccctgctcatccaaaaaggggggccgctgtcattgtgtacacagaccggctgaccacagcctctaccggacttctgtcggccacagcactaggcaagcaaacgagcgttcctgtccgaattgtaaagtctggaaagatgaaagcccatgccacggactacatgacgcgtatacgcccggtcatcgccggctacagtgtcgggacgattgaaggctccggtacgaccgggctggtcgtcgcggtaactggaacgccggctacacgttatcttttcagtaataaccatgtactcaacccttccaatacagacaatcgggaggccacgcttcagccaggcggagccgatgaggggacggctacccgagatcgtatagggcggttgtatcgttatgtacgcttaaacccaacggggaccaattttattgatgcggcgctttccttgccgactcgcaacagcttgctcagtccgcgttacgctacggtaggagtagtcccgggacatgtgaccgcttatcgtgtgggagaaagattcaaaaaggtagggcgtacgaccggattggtaaatggcacggtagagtctgtctatacggatttgcaaattaattacggcggaagcttggggctgctgaccttcgaggatcagaccgttattagaggtaccacccctgtatcgctgcctggggattccggctctgtctggctcagacagtcggataattatgcggcagcggtcaattttgcaggcacggcagatggtcgtctgtccattgctttcccggtgcagtggttcatgcaggcgttcaacacacgggtagcccgccccgtcggggcaggcagggtgcgcagagtagatacaggatcatccccccgctcttatacaagacagctcaccagcgaggaattggcacgtttgaagccaagaacaacgcggattagacggagctaa

SEQ ID NO: 1103 - DNA, 1047 bp, Paenibacillus sp.
atgttggctaccttctcggccgcccttcaagtgaaaaagcggatggccaagcaagtcttaaaaatgtccggtgtccacggcatcggcgtagggtatagggaccctgctcgtcccaaaaggggggccgctgtcattgtgtacacagatcggctggccccggcctctaccggacttctgtcggccacagcactaggcaagcaaacgagtgttcctgtccggattgtaaagtctggaaagatgaaagcccatgctacggactacatgacgcgtatacgcccggtcatcgccggctacagtgtcgggacgattgaaggctccggtacgaccgggctgatcgttgccccaactggagcgccggctacacgttatcttttcagcaataaccatgtactcaatccctccaatacagacaatcgggaggccacgcttcagccaggcggagcagatggggggacggatacccgagatcgtatagggcggttgtatcgttatatacgcctgaacccaaagggaaccaatttcattgatgcggctctttccttgtcgacccgcaacagcatgctcagtccgcgttacgctacggtaggagttgttcccgggcatgtgaccgcttatcgtgtgggagaaaaattcaaaaaggtgggacgaacgaccggggtggtgaatggcacggtagagtctgtctatacggatttgcaaatcaattacggcggaagcttggggctgctgaccttccaggatcagaccgttattagaggtaccacccctgtatctctgcccggggattccggctctgtctggctcagacggtcggataattatgcggctgcggtcaattttgcaggcacggcagacggtcgtctgtccattgctttcccggtacagtggttcatgcaggcgtttaacacacgggtagcccgccccgtcggggcaggccaggtgcgcagagtagatacaggatcatccccacgctcttatacaaggcaactcaccagcaaggaattggcacgcttacagccaagaacaacgcggattaaaaagagctaa

SEQ ID NO: 1104 - DNA, 1038 bp, Paenibacillus sp.
atgagccgctttgctccgctgttcactgcacctgttgcccgtatgtctgccctgaacataggaacttgtgaagaggagggcgtcaatgtctccctacttgatcaggcagaccgtgaaatccaagccaagtttcctaaaatgcacagcttcctgctactacgccacggcaaactgatctgggaacgctattataacgggcatgaagtaagctctctgaacgatttgcgatccgcgaccaaaagcttcacttccacgctcatcggcatagctatggctcgcggtgatatgcccgggccagagacggctgtgcataagctgttgcctgagtatttacctaggcggaaggaaacactgctagagcagattacgattcgccatctgttgaccatgacatccggcttgtattggcagacgggtaaaaagctcggagaagcttttatccaccgttttcatcgcagcaaaagctggccgtcctttgccctgcgcttacctgtacaggaggatcaactcggtgtattccaatatcgtagtgttgattcgcacctgttgtccgtgctgctgacccattgttgtgggattgacgcctatacgtacgctctccagtatctgttcgaacccttaggtttcgggagaagtggttgggcacaagatccagagggctacaccatgggacacatcgggctatatctgacatcgcgtgacatggctaaattcggcgattgctgccttcatcaaggcagctggaacggaacagaattgattccggccgattggctgcatcaggcgacacagcgacaggttgaagggtatccagaattcggagattacggattccaatggtggacaggacgactccatggcatcaactatgcgtgtgcgcacggacatggaggacagcaaatttatcttgtgccagaagcgaatgcagtcgcaatatttacagcagatagcaaggtgagccgttggaaaaatccgcgaacactgctggagcgctacgttttgccagccgtatcctccctcaacttggaacgttcctga

SEQ ID NO: 1105 - DNA, 1038 bp, Paenibacillus sp.
atgagccgctttgctccgctgttcactggacctgttgcccgtatgtctgccctgaacataggaacttgtgaagaggagggcgtcaatgtctccctacttgatcaggcagaccgtgaaatccaagccaagtttcctaaaatgcacagcttcctgctactacgccacggcaaactgatctgggaacgctactataacgggcatgaagtaagctctctgaacgatttgcgatccgcgaccaaaagcttcacttccacgctcatcggcatagctatggctcgcggtgatatgcccgggccagagacggctgtgcataagctgttgcctgagtatttacctaggcggaaggaaacactgctagagcagattacgattcgccatctgttgaccatgacatccggcttgtattggcaaacgggtaaaaagctcggagaagcttttatccaccgttttcatcgcagcaaaagctggccatcctttgctctacgcttacctgtacaggaggatcaactcggtgtattccaatatcgtagcgttgattcgcacctgttgtccgtgctgctgacccattgctgtgggattgacgcctacacgtatgctcttcagcatctgttcgaacccttaggtttcgggagaagtggttgggcacaagatccagagggctacaccatgggacacatcgggctatatctgacatcgcgtgacatggctaaattcggcgattgctgccttcatcaaggcagctggaacggaaaagaattgattccggccgattggctgcatcaggcgacacagcgacaggttgaagggtatccagaattcggagattacggattccaatggtggacaggacgactccatggcatcaactacgcgtgtgcgcacggacatggaggacagcaaatttatcttgtgccagaagcgaacgcagtcgcagtatttacagcagatagcaaggtgagccgttggaaaaatccgcgaacactgctggagcgctacgttttgccagccgtatcctccctcaacttggaacgttcctga

SEQ ID NO: 1106 - DNA, 1038 bp, Paenibacillus sp.
atgagccgctttgctccgctgttcactgcacctgttgcccgtatgtctgccctgaacataggaacttgtgaggaggagggcgtcaatgtctccctacttgatcaggcagaccgtgaaatccaagccaagtttcctaaaatgcacagcttcctgctactacgccatggcaaactgatctgggaacgctattataacgggcatgaagtaagctctctgaacgatttgcgatccgcgaccaaaagcttcacttccacgctcatcggcatagctatggctcgcggtgatatgcccgggccagagacggctgtgcataagctgttgcctgagtatttacctaggcggaaggaaatactggtagagcagattacgattcgccatctgttgaccatgacatccggcttgtattggcagacgggcaaaaagcttggagaagcttttatccaccgttttcatcgcagcaaaagctggccgtcctttgccctgcgcttacctgtacaggaggatcaactcggtgtattccaatatcgtagtgttgattcgcacctgttgtccgtactgctgacccattgttgtgggattgacgcctatacgtacgctctccagcacctgttcgaacccttaggcttcggaagaagtggttgggcacaagatccagagggctacaccatgggacacatcgggctatatctgacatcgcgtgacatggctaaattcggcgattgctgccttcatcaaggcagctggaatggaaaagaattgattccggccgattggctgcatcaagcgacacagcgacaggttgaagggtatccagaattcggagattacggattccaatggtggacaggacgactccacggcatcaactacgcgtgtgcgcacggacatggaggacagcaaatttatcttgtgccagaagcgaacgcagtcgcagtatttacagcagatagcaaggtgagccgttggaaaaatccgcgaacactgctggagcgctacgttttgccagccgtatcctccctcaacttggaacgttcctga

SEQ ID NO: 1107 - DNA, 1038 bp, Paenibacillus sp.
atgagccgctttgctccgctgttcactgcacctgttgcccgtatgtctgccctgaacataggaacttgtgaagaggagggcatcaatgtctccctacttgatcaggcagaccgtgaaatccaagccaagtttcctaaaatgcacagcttcctactgttgcgccacggcaagctgatctgggaacgctattacaatggtcatgaagcaagctctctgaacgatttgcgatccgcgaccaaaagcttcacttccacgctcatcggcattgccatggctcgcggtgatatgcccgggccagagactgctgtgcataagctgttgccggagtatttacctagacggaaggaaacactgctagagcagattacgattcgccatctgctgaccatgacatccggcttgtattggcagacgggcaaaaagctcggagaagcttttatccaccgttttcatcgcagcaaaagctggccgtcctttgccctgcgcttacctgtacaggaggatcaactcggtgtattccaatatcgtagtgttgattcgcacctgttgtccgtgctgctgacccattgttgtgggattgacgcctatacgtacgctctccagcatctgtttgaacccttaggtttcgggagaagtggttgggcacaagatccagagggctacactatgggacacatcgggctatatctgacatcgcgtgacatggctaaattcggcgactgctgccttcatcaaggcagctggaacggaaaagaattgattccggccgattggctacatcaggcgacacaacgacaggttgaaggctatctagaattcggggattacggattccaatggtggacaggacgactccacggcattaactacgcgtgtgcgcacggacatggaggacagcaaatttatcttgtgccagaagcgaacgcagtcgcggtattcacagcagacagcaaggtgagccgttggaaaaatccgcgaacactgctggagcgctacgttttgccagccgtatcctccctcaacttggaacgttcttga

SEQ ID NO: 1108 - DNA, 1038 bp, Paenibacillus sp.
atgagccgctatgctccgctgttcactgcacctgttgcccgtatgtctgccctgaacataggaacttgtgaagaggagggcatcaatgtctccttacttgatcaggcagaccgtgaagttcaagccaagtttcctaaaatgcacagcttcctgctgctgcgccacggtaaactgatctgggaacgctattacaacggtcatgaagcaagctctctgaacgatttgcgatccgcgaccaaaagcttcacttccacgctcatcggcatagctatggctcgcggtgatatgcccgggccagagacggctgtacataagctgttgcctgagtatttacctaggcggaaggaaacactgctagagcagattacgattcgccatctgttgaccatgacatccggcttgtattggcagacaggcaaaaagctcggagaagcttttatccaccgttttcatcgcagcaaaagctggccgtcctttgccctgcgcttacctgtacaggaggatcaactcggtgtattccaatatcgcagtgttgattcgcacttgctgtccgtgctactgacccattgttgtgggattgacgcctatacgtacgctctccagcatctgttcgaacccttaggttttgggagaagtggttgggcacaagatccagagggctacaccatgggacatatcgggctatatctgacatcgcgtgacatggctaaattcggcgactgctgccttcatcaaggcagctggaacggaaaagaattgataccggccgattggctgcatcaggcgacacagcgacaggtcgaaggctatccagaattcggggattacggattccaatggtggacaggacgactccacggcatcaactacgcgtgtgcacacggacatggaggacagcaaatttatcttgtgccagaagcgaacgcagtcgcggtatttacagcagacagcaaggtgagccgttggaaaaatccgcgaacactgctggagcgttacgttttgccagccgtatcctccctcaacttggaacgttcctga

SEQ ID NO: 1109 - DNA, 1038 bp, Paenibacillus sp.
atgagccgctatgctccgctgttcactgcacctgttgcccgtatgtctgccctgaacataggaacttgtgaagaggagggcatcaatgcctccttacttgatcaggcagaccgtgaagttcaagccaagtttcctaaaatgcacagcttcctgctgctgcgccacggtaaactgatctgggaacgctattacaacggtcatgaagcaagctctctgaacgatttgcgatccgcgaccaaaagcttcacttccacgctcatcggcatagctatggctcgcggtgatatgcccgggccagagacggctgtacataagctgttgcctgagtatttacctaggcggaaggaaacactgctagagcagattacgattcgccatctgttgaccatgacatctggcttgtattggcagacaggcaaaaagctcggagaagcttttatccaccgttttcatcgcagcaaaagctggccgtcctttgccctgcgcttacctgtacaggaggatcaactcggtgtattccaatatcgcagtgttgattcgcacttgttgtccgtgctactgacccattgttgtgggattgacgcctatacgtacgctctccagcatctgttcgaacccttaggttttgggagaagtggttgggcacaagatccagagggctacaccatgggacatatcgggctatatctgacatcgcgtgacatggctaaattcggcgactgctgccttcatcaaggcagctggaacggaaaagaattgataccggccgattggctgcatcaggcgacacagcgacaggtcgaaggctatccagaattcggggattacggattccaatggtggacaggacgactccacggcatcaactacgcgtgtgcacacggacatggaggacagcaaatttatcttgtgccagaagcgaacgcagtcgcggtatttacagcagacagcaaggtgagccgttggaaaaatccacgaacactactggagcgttacgttttgccagccgtatcctccctcaacttggaacgttcctga

SEQ ID NO: 1110 - DNA, 1038 bp, Paenibacillus sp.
atgcgccgctatgctccgctgttcactgcacctgttgcccgtatgtctgccctgaacataggaacttgtgaagaggagggcatcaatgtctccctacttgatcaggcagaccgtgaaatccaagccaagtttcctaaaatgcacagcttcctgctgctgcgccacggcaaactgatctgggaacgctattataatgggcatgaagtaagctctctgaacgatttgcgatccgcaaccaaaagctttacttccacgctcatcggcatagctatggctcgcggtgatatgcccgggccagagacggctgtgcataagctgttgtctgagtatttacctaggcggaaggaaacactgctagagcagattacgattcgccatctgttgaccatgacatccggcttgtattggcagacgggcaaaaagctcggagaagcttttatccaccgttttcatcgcagcaaaagctggccgtcctttgccctacgtttacctgtacaggaggaccaactcggtgtattccaatatcgtagtgttgattcgcacctgttgtccgtgctgctgacccaatgctgtgggattgacgcctatacgtacgctctccagcatctgttcgaacccttaggttttggaagaagtggttgggcacaagatccagagggctacaccatgggacacatcgggctatatctgacatcgcgtgacatggctaaattcggcgattgctgccttcatcaaggcagctggaacggaaaagaattgattccggccgattggctgcatcaggcgacacagcgacaggttgaaggctatccagaattcggagattacggattccaatggtggacaggacgactccacggcatcaactacgcgtgtgcgcacggacatggaggacagcaaatttatcttgtgccagaagcgaacgcagtcgtggtatttacagcagacagcaaggtgagccgttggaaaaatccgcgaacactgctggagcgctacgttttgccagccgtatccttcctcaacttggaacgttcctga

SEQ ID NO: 1111 - DNA, 1038 bp, Paenibacillus sp.
atgagccgttatgctccactgttcactgcacctgttgcccgtctgtctgcgctgaacctcggaacttgtgaagaggaaggcatcgatgcctccctacttgatcaggcagatcatgaaatccgagctaaatttccgaaaatgcacagctttctcctgcttcgccacggcaagctgatctgggagcgctattacaacggtcatgaagcaagcgctctgaacgatttgcgttccgcgaccaaaagcttcacttccacgctcgtcggcatggctatggcacgtggggatatgcccggaccagatacggctgtgcataagctgttgcctgagtatttgccccggcggaaggaaacactgctagagcggattacgattcgtcatttgttgactatgacgtcaggcttgtattggcagacgggcaaaaagctcggcgaagcctttatccaccgttttcatcgcagcaagagctggccgtcctttgcccttcgcttacctgtacaggaggatcaaatcggggtattccaatatcgcagtgttgattcacatctgctgtccgtgctcctgacccgttgctgtggcatggacgcctatacgtacgctctccagcatttattcgaaccgttaggtttcgggagaagtggttgggcacaagatccagagggttacaccatgggccatatcggactgtatctgacgtcgcgagacatggctaaattcggcgattgctgccttcatcaaggcatctggaatggaagagaattgattccagccgattggctgcatcaggcgacgcagcgacagattgaaggctatccagaattcggagattacggattccaatggtggactggacgactccacggcattgactatgcgtgtgcacacggacatggaggacagcaaatatatctgataccggaagcgaatgcagtcgtggtatttacagcagacagcaaggtgagccgttggaaaaacccacgaacactgctagagcgtttcgtcttgccagccgtatcctccctcaacttggaacgttcctaa

SEQ ID NO: 1112 - DNA, 1038 bp, Paenibacillus sp.
atgagccgttatgctccactgttcactgcacctgttgcccgtctgtctgcgctgaacctcggaacttgtgaagaggaagacatcgatgcctccctacttgatcaggcagaccacgaaatccgagccaaatttccgaaaatgcatagctttctgctgcttcgccacggcaagctgatctgggaacgctattacaacggtcatgaagcaagctccctgaacgatttgcgttccgcaaccaaaagcttcacttccacgctcgtcggcattgctatggcacgtggggatatgcccggaccagagaccgctgtgcataagttgttgcctgagtatttacccaagcggaaggaaacactgctagaacggattacgattcgtcatctgttgactatgacgtcaggcttgtattggcagacgggcaaaaagctcggtgaagcctttatccaccgttttcatcgcagcaaaagctggccgtcctttgccctacgcttacctgtacaggaggatcaaatcggcgtattccaatatcgcagtgtggattcacatctgttgtccgttctgctcacccgttgctgtgggattgacgcctatacgtatgctctcaagcatttattcgaaccgttagggttcgggagaagtggttgggcacaagatccagagggctacaccatgggccacatcggactgtatctgacatcgcgagacatggctaaattcggcgattgctgccttcatcaaggcatctggaatggcagagaattgattccagccgattggctgcatgaggcgacacagcgacagattgaaggctatccggaattcggagattacggattccaatggtggactggacgactccacggcattgattatgcgtgtgcacacggacatggaggacagcaaatttatctgataccggaagcgaacacagtcgtggtatttacagcagacagtaaggtgagccgttggaaaaacccacgaacactgctagagcgtttcgttttgccagccgtatcctccctcaacttggaacgttcctaa

SEQ ID NO: 1113 - DNA, 1038 bp, Paenibacillus sp.
atgagccgttatgctccactgttcactgcacctgttgcccgtctgtctgcactgaacctcggaacttgtgaagaggaaggcatcgatgcctccctacttgatcaggcagatcatgaaatccgagctaaatttccgaaaatgcacagctttctcctgcttcgccacggcaagctgatctgggagcgctattacaacggtcatgaagcaagcgctctgaacgatttgcgttccgcgaccaaaagcttcacttccacgctcgtcggcatggctatggcacgtggggatatgcctggaccagatacgtctgtgcataagctgttgcctgagtacttgccccggcggaaggaaacactgctagaacggattacgattcgtcatctgttaaccatgacatccggcttgtattggcagacgggcaaaaagctcggtgaagcctttatccaccgttttcatcgcagcaagagctggccgtcctttgccctccgcttacctgtacaggaggatcaaatcggggtattccaatatcgcagtgttgattcgcatctgttgtccgtgctgctgacccgttgctgtggcatggacggatatacgtacgcgctccagcatttattcgaaccattaggcttcgggagaagtggttgggcacaagatccagagggctacaccatgggccacatcggactatatttgacgtcgcgagacatggctaaattcggcgattgctgccttcatcaaggcatctggaatggaagagaattgattccagccgattggctgcatcaggcgacgcagcgacagattgaaggctatccagaattcggagattacggattccaatggtggactggacgactccacggcattgactatgcgtgtgcacacggacatggaggacagcaaatatatctgataccggaagcgaatgcagtcgtggtatttacagcagacagcaaggtgagccgttggaaaaacccacgaacactgctagagcgtttcgtcttgccagccgtatcctccctcaacttggaacgttcctaa

SEQ ID NO: 1114 - DNA, 1038 bp, Paenibacillus sp.
atgcgccgctatgctccgttgttcaccgccccggtcgcccgtctatctgtcctgatcaccggaacttgtgaagaggagggcgtcaatgcctccctactcgatcaggctgaccatgaaatcgagaaaaaatttactaaaatgcgcagcttcctgctgcttcgccgcggtaagctgatctgggaacggtattacaacggtcacgaagcaagcgctctgaacgatctgcgctctgcgaccaaaagcttcacttccacgctcatcggtattgccatggcacgtggcgatatgcctgggccggagacggctgtgcataagctgttgcctgagtatctgccacggcgggagagcccgctgctggagcggattacgattcgccatctgctgacgatgacatccggtctgtattggcagacgggcaaaaagcttggagaggcttttatccgccgttttcatcgcagcaaaagctggccgtcctttgccctgcgcctgccagtgcaggcggatcagctcggcgttttccaataccgcagtgtggattcgcatctgttgtccgtattgctgacccaatgctgcgggactgacgcctatacgttcgcgctacaccatctcttcgagccgttaggcttcgggagaagccgatgggctcaagaccctgagggctatactatgggacacatcggtctgtatctcacatcacgtgatatggctaaattcggcgattgttgccttcatcaaggctgctggaatggacaggagctgatctcggcggactggctgcgtcaagcgacgcagcgacaggttgaaggctatccggaattcggggactacggattccaatggtggaccggacgactccatggcatcaattacgcatgtgcgcacggacatggaggacagcaaatttatgttgttcctgaagcagatgcagtcgtggtatttactgcagacagcaaggtcagccgctggaaaaatccacgctcactactggagcgctacattttgccagccatatcctccctcagcctggaacgttcctga

SEQ ID NO: 1115 - DNA, 780 bp, Paenibacillus sp.
atgaaccatcgtacgaaccatagccctaaggataaaagaacagcacggcgtaacctttcccatgcggttccctccccccgtgttaacaaggagagagcggcttcgacttccggcagtcataaatcgaaccagcgtggaacggcaacggtccctgcccccgtagagaaggacacatcggttcaagctatagaggaagcggcatggaagaagcataagctccccaaaacgctagaggaagcgatgcagatgaatcgagcatctgtactgctgttgtctgtgcctgagtcagatacggaatacaggacggataacgacatatcgtctattacgacggaagaacaggcagagcaagattcgttactggattgttccataaccagtattcacattgctgaaggaagaccgcgcctaaagcaacgcatggtcttgtctgagcaagatatcgatctagctttcgatacggagaaagaattaaacctgaatgccattcacgacggatcagcgaccagtgacgaggcttctgacgatcatatagcttcacctcaatatgggagcatttcttttcacctccccgcacaagcggataggggtgaagtgagcgttgtatttgagaagccttttatagatacacagtatgtaatcactgccaatgcgagtataccgggagtgatggtatccgtcacacaacgtcagaggtattcagcagtacttactgtggaacgcatacactcaggtccgctatgtgaagggttggtcctttggattgcgatggggcaataa

SEQ ID NO: 1116 - DNA, 780 bp, Paenibacillus sp.
atgaaccatcgtacgaaccatagccctaaggataaaagaacagcacggcgtaacctttcccatgcggttccctccccccgtgttaacaaggagaaagcggcttcgacttccggcagtcataaatcgaaccagcgtggaacggcaacggtctctgcccccgtagagaaggacacatcggttcaagctatagaggaagcggcatggaagaagcataagctccccaaaacgctagaggaagcgatgcagatgaatcgggcatctgtactgctgttgtctgtgcctgagtcagatacggaatacaggacggataacgacatatcgtctattacgacggaagatcagtcagagaaagattcgttactggattgttccataaccagtattcacattgctgaaggaagaccgcgcccaaggcaacgcgtggttttgtctgagcaagatatcgatctagctttcgatacggagaaagaattaagcctgaatgccattcacgacggatcagcgaccagtgacgaggcttctgacgatcatatagcttcacctcaatatgggagcatttcttttcacctccccgcacaagcggataggggtgaagtgagcgttgtatttgagaagccttttatagatacacagtatgtaatcactgccaatgcgagtataccgggagtgatggtatccgtcacacaacgtcagaggtattcagcagtacttactgtggaacgcatacactcaggtccgctatgtaaagggttggtcctttggattgcgatggggcaataa

SEQ ID NO: 1117 - DNA, 780 bp, Paenibacillus sp.
atgaaccatcgtacgaaccatagccctaaggataaaagaacagcgcggcgtaacctttccaatgcagttccctcaccccgtgttaacaaggagaaagcggcttcgacttccggcagtcatagaccgagccagcgcgggacggcaacggtccctgtccctgtagagaaggatacctcggttcaagctgtagaggaagcggcatggaagaagcataagcttcccaaaacgctagaggaagcgatgcagatgaatcgagcatctgtactgctgttgtctgtgcctgagtcagatacggaatacaggacggataacgacataccgtctattacgacggaagatcaggcagaacaagattcgttactggattgttccataaccagtattcacattgcggaaggaagacaccgcccaaagcaacgcgtggttttgcctgagcaagatatcgatctagctttcgatacggagaaagaattagacttgaatgccattcacgacggatcagcgaccagtgacgaggcttctgacgatcatatagcttcacctcaatatgggagcatttcttttcacctccccgaacaagcggataggggtgaagtgagcgttgtatttgagaagccttttatagatacacagtatgtaatcactgccaatgcgagtataccgggagtgatggtatccgtcacacaacgtcagaggtattcagcagtacttactgtggaacgcatacactcaggtccgctatgtgaaggattggtcctttggattgcgatggggcaataa

SEQ ID NO: 1118 - DNA, 780 bp, Paenibacillus sp.
atgaaccatcgtacgaaccatagccctaaggataaaagaacagcgcggcgtaacctttccaatgcagttccctcaccccgtgttaacaaggagaaagcggcttcgacctccggcagtcatagactgagccagcgcgggacggcaacggtccctgcccccgtagagaaggatacctcggttcaagctatagaggaagcggcatggaagaagcataagcttcccaaaacgctagaggaagcgatgcagatgaatcgagcatctgtactgctgttgtctgtgcctgagtcagatacggaaggcaggatggataacgataaaccgtctattacgacggaagatcaggcagagcaagattcgctactggattgttccataaccagtattcacattgcggaaggaagacaccgcccaaagcaacgcgtggtcttgcctgagcaagatatcgatctagctttcgatacggagaaagaattaaacttgaatgccattcacgacggatcagcgaccagtgacgaggcttctgacgatcatatagcttcatctcaatatgggagcatttcttttcatctccccgcacgagcggataggggcgaagtgagcgttatatttgagaagccttttatagatacacaatatgtaatcactgccagtgcgagtataccgggagtgctggtatccgtcacacaacgtcagaggtattcagcagtacttactgtggaacgcatacactcaggtccgatatgtgaagggttggtcctttggattgcgatggggcaataa

SEQ ID NO: 1119 - DNA, 780 bp, Paenibacillus sp.
atgaaccatcgtacgaaccatagccctaaggataaaagaacagcgcggcgtaacattccccatgcagttccctcaccccgtgttaacaaggagaaagcggcttcgacttccggcagtcatagaccgagccagcgcgggagggaaacggtccctgcccccgtagagaaggatacctccgttcaagctatagaggaagcggcatggaagaagcataagcttcccaaaacgctagaagaagcgatgcatatgaatcgagcatctgtactgctgttgtctgtgcctgagtcagatacagaatacaggacggataacgacataccgtctattacgacggaaggtcaggcggagcaagattcgttactggattgttccataactagcattcacattgctgaaggaagacaccgcccaaagcaacgcgtggtcttgcctgagcaagatatcgatctagctttcgatacggagaaagaattagacttgaatgccgttcacgacggatcagcgaccggtgatgaggcttctgacgatcatatagcttcatctcaatatgggagcaattcttttcacctccccgcacgagcggataggggcgaagtgagcgttgtatttgagaagccttttatagatacacaatatgtaatcactgccaatgcgagtataccgggagtgatggtatccgtcacacaacgtcagaggtattcggcagtacttactgtggaacgcatacactcaggtccgatatgtgaagggttggtcttttggattgcgatggggcaataa

SEQ ID NO: 1120 - DNA, 849 bp, Paenibacillus sp.
atgattcccagccgggtgaatgaagcggagcgaccgctggttcactcctgtgccaaaggagcgatcaccatgaaccatcgtacgaaccatagccctaaggataaaagaacagcgcggcgtaacattccccatgcagttccctcaccccgtgttaacaaggagaaagcggcttcgacttccggcagtcatagaccgagccagcgcgggagggaaacggtccctgcccccgtagagaaggatacctccgttcaagctatagaggaagcggcatggaagaagcataagcttcccaaaacgctagaagaagcgatgcatatgaatcgagcatctgtactgctgttgtctgtgcctgagtcagatacagaatacaggacggataacgacataccgtctattacgacggaaggtcaggcggagcaagattcgttactggattgttccataactagcattcacattgctgaaggaagacaccgcccaaagcaacgcgtggtcttgcctgagcaagatatcgatctagctttcgatacggagaaagaattagacttgaatgccgttcacgacggatcagcgaccggtgatgaggcttctgacgatcatatagcttcatctcaatatgggagcaattcttttcacctccccgcacgagcggataggggcgaagtgagcgttgtatttgagaagccttttatagatacacaatatgtaatcactgccaatgcgagtataccgggagtgatggtatccgtcacacaacgtcagaggtattcggcagtacttactgtggaacgcatacactcaggtccgatatgtgaagggttggtcttttggattgcgatggggcaataa

SEQ ID NO: 1121 - DNA, 777 bp, Paenibacillus sp.
atgaaccatcgtatgaaccatggtcataaggataaaaaaatagcacggcgtaacctttccaatacagttccctctccccgtgtaagcaaggagaaacctgcttcgcttgctggcagtcacagaaccactcagcgtggaacggcaagtgcagctgtccctgtagagaaggatcccccggttcaagctatagaggaagcagcatggaaaaagcataagcttcccaaaacgctggaggaagcgatgcagatgaatcgagcatctgtgctgctgttgtctgtgcctgagtcagataccgaatacggaacgggtaatgacatgacgtctatgaaggcggaagatcagaacgagcaagattcgttgctggattgttccataaccagtattcatattgcggaaggaagacagcgtccaaagcagcgaatgcaattgcctgagcaagatctagcttttcacgatgaaaaagaattaggtcggaatgccattcacgatggctcaccgaccaatgacaggactacggacagtaaagcgacttcaccccaatttggcagcatttctttttatctagctgcacaggcggttacaagtgaagtaaacgttgtgtttgagaagccctttatagacacacaatatgcaatcaccgctaatgcgagcgtaccgggagtgacggtatctgttacacagcgacagaggtattcgggagtgcttacagtggaacgcagacaatcgggtcagatatgtgaggggtggattctctggattgcgatggggacatcatag

SEQ ID NO: 1122 - DNA, 852 bp, Paenibacillus sp.
atgattcccacctgggtgaatgaagcggagcgaccgctggttcactcctgtgtcaaaggagcggtcatcatgaaccatcgcacgaaccatagccctaaggataaaaaaatagcacggcgtaacctttccaatacagtcccctctccccgtgtaaacaaggaaaaaacggcttcgcctgctggcagtcccagacccactcagcgtggaacggcaaaggtacctgttcccgtagagaaggataccccggtgcaagctatagaggaagcagcatggaaaaagcataagcttcccaaaacgctggaggaagcgatgcagatgaatcgagcatctgtgctgctgctgtctgtgcctgactcagataccgaatacggaacggatcacgacatggcgtctatgaagacggaaggtcagaccgagcaagactcgttattggattgctctataaccagtattcatattgcggaaggaagacagcgttcaaagcagcgaatgcgcttgccagagcaagatacccatctagtttctcagactgaaaaagaattaggtcggaatgccattcatgttggctcagtgaccgatgacgggactactgacagtgaagtgactttacctcaatttggcagcacttctttttatctttctgcacaagaagttacaagcaaagtgaacgttgtgtttgataagccttttatagacacgcaatatgcaatcaccgccaatgcgagcgtaccgggagtgatagtgtccgtcacacaacgacagaggcattcggcagtgcttacagtggaacgcagacaaccgggtcagatatgtgagggatggattctctggattgcgatggggacatcatag

SEQ ID NO: 1123 - DNA, 786 bp, Paenibacillus sp.
atgaaccatcgcacgaaccataaccctaaggataaaaaaatagcacggcgtaaccattccaatactgtcccctctccccgtgtaaacaaggagaaaacggtttcgcctgctggcgctggcagtcacagacccactcagcgtggaacggcaagtatacctgtccccgtagagaagaatacctcgcttcaagctgtagaggaagcggcatggaaaaagcataagcttcccaaaacgctagaggaagcgatgcagatgaatcgagcatctgtgctgctgttgtctgtgcctgactcagataccgaatgcggaacggaacacgacattgcatctatgaagacggaaggtcagaccgagcaagattcgttattggattgttccataaccagtattcacattgcggaagggagacagcgtccaaagcagcgaatgcgcttgctagagcaagaaaaccatctagcttctcagactgaaaaagaattaggtcggaatgccattcatgatggctcagtgaccgatgacgggactactgacagtgaagtgacttcacctcaatttggtagcacttctttttatcttcctgcacaagaagttacaagcaaagtgaacgttgtgtttgagaagccttttatagatacgcaatatgcaatcaccgccaatgcgagcttaccaggaataaccgtatctgttacccagcgacagaggtattcggcagtgcttacagtggaacgcagacaatcgggttcgacatgtgagggatgggttcattggattgcaatgggacactag

SEQ ID NO: 1124 - DNA, 1767 bp, Paenibacillus sp.
atgaagaaattattgtcgtgtttgatctcgttaggaatgcttgtctatatattgccgaccacgattgtaagcgctaacaatgatggagttactaatctagcgcttgattcaacaccgtctgcccaatcggatataatttcagatgctatttacaaaattacggcacagcatagtggaaaaaatctggaagttgaagggggatcaaaggatgacggagcgaatgttcaacaatggaccgataacggaaaggagcaacagaagtggagagtggtcgacgttggtgatggatattataagctgatctcgcaatctagtggtaaagcattagatgtagccggtggtaatacccatgacggagcgaacgttcaacaatggaccgacaacgggaacgctcagcagaagtggaaaatcattgacgctggtggtggatattataagctgatctcgcaatctagtggtaaagcattggatgttgtcggtggtaatacccatgacggtgcaaacgttcaacaatgggccgacaacggtagcgctcagcaaaggtggagattcacgcagattgatacgacagcagatacgacaccaccaacctccccaacaaacctccaaagctcatccaagacgagtacatctgtcactcttacatggacgacctcaaaagacaatgtaggtgtaactggctacgttatttataacggaacagatctggtaggcacgagcaccacaacaaattatacagtgacgggtctcactgcgaacacatcctacaatttcactgtaaaagcgaaagatgcagcaggcaatgtttcggaaccaagtagtgtcttaaaagtaacaacaagttccgactcctctcaaaatacaggattttatgttaaaggtacgacgctttatgatggcaagggaaatccctttgtcatgagaggaattaatcacgcttacacttggtataaaggtcaagagtcggttgcgatacctgcaattgccaaaacaggagcgaacacgattagaatcgtgctgtcagacggtcagcaatggacgaaagatgatttgtcagcgttgcaaagcctgatcactttatcagaacaaaacaaattggttgttatccttgaagtacacgatggtacgggaagtgataatgctgctgtgttgaataaaatcgcagattactggattgaaatgaagagcgcactgattggaaaagaaaatacagtcattctcaacattgcgaatgaatggtttggtacttgggatggaaacggctgggcccaggggtataaatcagttattccaaagctaagaaatgctggcatcaaaaataccattatggttgacgccgctggttggggtcaatatccgaagtcgatttttgactacggaacgcaagtgtttgatgccgatccgcttaaaaatacgatgttctccattcatatgtacgaatacgctggaggaaatgccgaaacagtaaaaagcaatattgacaatgtattaaacaaaaatctagctgtcatcattggagaattcggaatcaagcatacaaatggtgatgttgacgaggccactattatgagttacgcccaacaaaaaggtgtgggttatctcgggtggtcttggaaaggaaatggatcgggtctagaatatttggatatgtcaaacgactggggaggatcgagctatactgaacaaggacgtgctattattgaaggtccgaatggcatcagagcaacatccaagttaagcacggtttatagcagcggtaaacagtaa

SEQ ID NO: 1125 - DNA, 1767 bp, Paenibacillus sp.
atgaagaagttattgtcgtgtttgatctcgttgagtatgcttgtttatatattgccgaccatgattgtaagcgctaacaatgatggagttactaatctagcgcttgattcaacaccgtctgcccaatcggatattatttcagatgctgtttacaaaattactgcacagcatagcggaaaaagcctggaagttgaagggggatcaaaggatgacggagcgaatgttcaacaatggaccgataacggaaaggagcaacagaagtggagagtggttgacgttggtggtggatattataagctgatctcgcaatctagtggcaaagcattggatgtagccggtggtaatacccatgacggagcgaacgttcaacaatggacagacaacgggaacgctcagcaaaaatggaaaatcattgacgttggtggtggatattataagctgatctcgcaatctagtggtaaagcattggatgttgtcggtggttatacccatgacggtgcaaacgttcaacaatgggccgacaacggtagcgctcagcaaaggtggagattcacacagattgatacgacaacagatacgacacctccaaccgccccaacaaacctccaaagctcatccaagacgagcacatctgtcactcttacatggacgacctcaatagacaatgtaggtgtaactggctacgttatttataacggaacagatctggtaggtacgagcaccacaacaagttatatagtgacgggtctcactgcgaacacatcctacaacttcactgtaaaagcgaaagatgcagcaggcaatatttcggaaccaagtaatgtcttaaaagtaacaacaagttccgactcctctcaaaatacaggattttatgttaaaggtacgacgctttatgatggcaacggaaatccctttgtcatgagaggaattaatcacgcttacacttggtacaaaggtcaagagtcagttgcgatacctgcaattgccaaaaccggagcgaacacgattagaatcgtgttgtctgacggtcaacaatggacgaaagatgatttgtcagcgttgcaaaacctgatcactttatcagaacaaaacaaattggttgttatccttgaagtacatgatggtacgggaaatgataatgctgctgtgttgaataaaatcgcagattactggattgaaatgaaaagtgcactgattggaaaagaaaatacagtcattctcaacatcgcgaatgaatggtttggtacttgggatgggaacggctgggcacaggggtataaatcagttattccaaagctaagaaatgctggcatcaaaaataccattatggttgacgccgctgggtgggggcaatatccgaagtcgatttttgactacggaacgcaagtgtttgatgccgatccgcttaaaaatacgatgttctccattcatatgtacgaatacgctgggggaaatgccgaaacagtaaaaagcaatattgacaatgtattaaacaaaaatctagctctcatcattggagaattcggaatcaagcatacaaatggtgatgttgacgaggccaccattatgagttatgcccaacaaaaaggtgtaggttatctcggatggtcttggaaaggaaatggatcaggtctagaatatttggatatgtcaaacgactgggcaggatcgagctatactgaacaaggacatgccattattgaaggtccgaatggcatcagagcaacatccaagttaagcacgatttatagcaacggtaaacagtaa

SEQ ID NO: 1126 - DNA, 1740 bp, Paenibacillus sp.
atgaagaaaattttaacaagtttgatttttttggggatgcttgttgatatgttgtctgtcataactgtaagcgccatcacaaatacgaccggttctgctaactcggaaattacttcgggtgccgtttacaaacttacggcacagcatagcggcaaaaacctggacgtagaaggggggagaaccacggatggagcgaaagtacaacagtggacggacaatggaaacgcccagcagaagtggaaagtgattgacgtcggcagcggatattataagctaatcgtacaatcaagcggcaaagtactgaccgtggccgaaggctctactgctgatggcgatagtgtgcaacagtggacggacaacggctcatcgaaccaaaagtggaaaattattgacgtcggtggcggatattttaagctgatcgcacaatcaagtggtaaagcactggatgtggtcggtggttataccaatgacggagcgatcgttcaacagtggaccgacaacggcaacgcgcagcaaaaatggaaattcacgcggattgacaccgcagcagatacgacaccaccaaccgcaccaacgaacctgcagaacccttccaagacaagcacgtcggtaaatcttacatggactgcatcaactgataatgtaggtgtaaccggctacgatatttataatggaacagccttagcgggctcgagcaccacaacaagttatacggtgactggtctctccgcccatacatcgtacagcttcacgataaaagcgagggatgccgccggcaatgtttcgccagccagcaagatcttaaatgtcacaacggatcccgcctccacccacacaggattttatattaaaggcacgactctttatgatgccaacggaaatccttttgtaatgagaggaataaatcacgcctacacatggtataagggtcaagaatcagttgcgatccccgcgatagccaaaacgggagcgaacaccattagaatcgtattgtctgacggtcagaaatggacgaaagacaatttgtccgcgatacaaaacctaatcactttatcggaacaaaacaaattggtcgttgttcttgaagtacatgatggtacgggatccgatagtgccacggtgttggataatatcgcaaattactggattgaaatgaaaagtgcacttatcggaaaagaaaaaacggtcatcctgaacatcgcaaatgaatggtttggtacttgggatggaacaggctgggcacaaggctataagtcggttattccgaagctcagaaatgccggcatcaaaaacaccattatggttgacggcgccggatggggccaatatccacaatcgatttttgactacggaacggaagtatttaacgctgatccgctaaaaaatacgatgttttccattcatatgtacgaatacgccgggggaaatgccgccacagtaaaaagcaatatcgataatgttttgaataaaaatctagctctcgtgattggagaattcggaatcaagcatacgaatggcgatgtggacgaggccaccattatgagttatgcccaacaaaaaggcgtaggatatctcggatggtcttggaaaggtaacggagccggtctcgaatatttggatatgtcaaccgactggcaaggatcgagttataccgagcaaggacgcgccattattgagggtccaaatggcatcaaggcaacatccaagttaagcacggtttatagcggtacaacccagtaa

SEQ ID NO: 1127 - DNA, 2409 bp, Paenibacillus sp.
atgaaaaaaaccataacatgcttgattttgtttggactgctgatgagtatgttgccgttcaaaaatgtgagcgctttcgaaaatgctaggcttacccaatcggcaaccgcaagctccgtcgaagattcaagtaaagcggctgattttgcgattgatggtgacccgcaaactagatggtcctcacaatattcagatccgcagtggataagtgtagatcttggtagcaccaccaaaatcaatggcgttacgctcaactgggaagccgcttatgcgaagtcctaccaagttcagacatcgacggatgatgatcattggactaccgtctattccaccacgactggagatggaggaatcgataagatatctttcgaagtaacagacgctagatatgtaaaaatgaacggtatcgaaagagctaccagctacggatattccctttgggaatttgaagtgcattcagctgatgaaccggaggataactcacctccaacagctccctccaacctgactagttcctcggtatcagatacaacagtaagcttgcagtggacggaatctacagataatgtaggtgtttccagctacgacatctacaaaggatcagacctcgtaggatccagtgcgtcgacatccttcatcgttaccggtctaacagccaacatggcgtacagcttttatgtgaaagccagagataccgcaggtaatgtgtcagatgcaagcaatgtgattgatgttaccaccagcgcagctgacacaaatattgtctcaggtgaaacttataaactaacggcacagcatagcggaaaaaatctggaagcaggagactcaactgccgatggagcgaaggtgcagcagtggacgaacaacggtagcgctcggcaaagatggaaagtcattgacgttggcgatggatattataaattgattgtgcaatccagcggtaaagcattaacagtggtcggaggctcttcagaagatggggctagtgtacagcaatggacagacagcgatttaactaatcaaaaatggaaaatgattgacgtcggcggtggatattataagctgcttgtacaatctagcggtaaagcgctggatgtaatcggaggttatactaatgacggggcaaatgtgcagcaatggacggataacggaaatgatcagcagaaatggaagtttacgcttgttgactcaacccctgatacaacggcaccaacagcaccagcaaacctgaaaagctactccaaaacaaacacttcggtaagccttgtatggacagcatcaacagacgatgtcgatgtcaccagctatgatgtgtataatggaacaactttggtcgattcaacccccacgacaagttatacggtgacagggcttagcgccaatacaacatacagcttcactgtcaaagccagggatgcagcaggaaatatttcaacagcaagcaatgtcctaaaggttacgacgaattctacaacggagaatacaggtttttatattaatggaacaacgctttacgatgccaaggggaatccgtttgttatgaggggaatcaatcacgcttatacctggtataaggggcaagagtctgtagcgatccctgccattgcaaaaacgggagcgaacaccatcagaatcgtactgtcggatggtcagcaatggacaaaagatgatctgtctgcgatacaaaatttaatcactttatcagagcagaacaaattggtcgttgttctagaagtacatgatggcacagggtctgacagcgctactgtattggataatattactaattactggattgaaatgaaaagtgcactcattggaaaagaaagcaccgtcatcctcaatatcgcgaacgaatggtatggaacttgggatggcggaggctgggcgcaaggttataagtctgttatacctaagctcagaaatgctggcatcaaaaacacaatcattgttgatggtgcaggatggggacagtatccgcaatctatttttgactacggaaaagaagtctttaatgcagatccgcttaaaaatacgatgttctccattcatatgtacgaatatgccggaggtaatgccgccacagtaaagagcaatatggataatgtactgaataaaaacctagctctgctgattggagaattcggcattaagcatacgagcggtgatgtggatgaggctaccattatgagttacgctgagcaaaagggagtcggttatcttgcatggtcttggaaaggaaacagtccgggtcttgattatctggatatgactactgactggcaaggatcaagcttaacggaacaaggtcgtattatcattgaaggtcccaatggtattagggcgacatcaaagttaagctcggtttatagcgattcatccaacaaacagtcatccagtaaaccatga

SEQ ID NO: 1128 - DNA, 2394 bp, Paenibacillus sp.
atgaaaaaaaccataacatgtttggttttgtttggtctgcttattagtctgttgccgatcaaaaatgtgagcgcttccgaaaaccttgttctgaccaaatcggcaactgcaagctccgtcgaagattcgactaaggcggctgattttgcgattgacgggaattcactaactagatggtcttcacaatattcagatccacagtggataagtgtagatctcggcaatactaccgaaatcaatggggttacgcttaactgggaagccgcttatgcgaagtccttccaagttcaaacatcaacggataatgatcattggactaccgtctattccactacgactggagagggaggaatcgagaagatatctttcgaagcaacaaacgcaaggtatgtaagaatgaacggcatcgaaagggctactagctacggatattctctctgggaattcgaagtgcattctgccgacgaaccggaggataacacacctccaacagcgccatccggtctgactagttcctctatatctgatacgacggtaagcttagagtggacggaatctacagacaatgtaggggtttccgaatacgacatctacaacggatcaaagctaataggctccagtgcgtcaacgtcctttatcgttactggcttaacagctaacatggcgtatagcttttatgtgaaagccagagatgctgctgggaacgcgtcggctgcaagcaatgtgattgatgtgaacactagcgcgtccgacacaagtattgtttcaggtgaactttataaactaacagcacaacatagcggaaaaaacctagaggtagcaggaaactccactgccgatggagccaaggtgcagcagtggacggacagcggcagaccccagcagaaatggaaagtgatcgacgttggcgacggatactataaactgattgtgcaatccagcggtaaagcattaacagtagctggaggttctctcgaagatggtgctaatgtgcagcaatggacagacaacgacttatctaatcaaaagtggaagattattagcgtcggcggcggatattataagttgctcgttaaatctagcggtaaagcgctggatgtaatcgggggttatactaatgatggggcaaatgtacagcaatgggtggataacggaaatgatcagcagaaatggaagtttacgcttgtcgaatcaaccgctgatacgacagcaccaacggcaccagcgaacctgaaaagcttttccaaaacaaacacttcggtaagtcttatatgggatgcttcaacagacgatgtaggggttaccagctacgatgtgtataatggaacaacattagtcgattcaaccgacacgacaagttatacggtgacaggacttaccgccaatacaacgtatagcttcacagtaaaagccagggatacggcagggaatgtttcaacagcaagcaatatcacaaatgtgacgacaaatgctacttctgagaatacaggcttttatattaacggaacaacgctgtacgatgccaacggaaatccgttcgtaatgagaggaatcaatcacgcttatacatggtataagggtcaagagtcagcagcgatccctgccattgcgagaacgggagcgaacaccatcagaatcgtactgtcggatggtcagcaatggacgaaagacaatctgtctgagctacagaatttaatcactttgtcagagcaaaacaaattggttgttgtccttgaagtacatgatggtacagggtctgatagcgctactgtattgaataatattgcgaattactggattgaaatgaaaggtgcactcattggaaaagaaagcaccgttatcctcaatattgcgaacgaatggtatggaacatgggatggcggaggctgggcgcaaggctataagtctgttatacccaagcttagaaatgccggcatcaaaaacacaatcatggttgacggagcaggatggggacagtacccgcaatctatttttgactacggaacagaagtctttaatgcagatccgctaaaaaatacgatgttctctattcatatgtatgaatatgccggtggaaatgctgctacagtaaaaagcaacatggataatgtactgaataaaaacctggctcttgtgattggcgaattcggcatcaagcatacgagtggtgatgttgatgaggctaccattatgagttacgctgagcaaaagggggtaggttatctagcatggtcttggaaaggaaacagcgcgggtctcaattatttggatatggctactgactgggaaggaacaagttttacggaacaaggtcgtattattattgaaggtcccaatggtattagggcgacatcgaaattaagcacagtttatagtggttcagccgacaaatag

SEQ ID NO: 1129 - DNA, 798 bp, Paenibacillus sp.
atgaagcgaatatttaccttgtggctatgcgttgcagttatagggatgttgacagttacggcagaacccgcatgggctactcagactgttggcggacagccttatcattttgggttcaaaaaaagtaagggaggggagctgccttccatcgcacaagaaggctttatgcaactaatcgaaaggcaaggtggcatctttctgggggataccactaaaaaagaattatttctcactttcgacaacggctatgagaatgggtatactcccaaagtgctggatgtattgaaggccaaaaaggttccagccgccttctttgtgacggggcattttgtaaaagaccagcctgatttgatgcgacgcatggccagtgagggccatattatcggaaaccattcatggagccatcctgatatgagcaccatttcttcgacagagatccggtctgagctagatcgggtacgaaatgcatcggcagagctaaccgggcaaaaagaaatgaaatacgtccggccgcctcgcggcatttttagtgaaaaagcattggcttcctgtcgagaagccggatatacgagcgtattctggtccgtggcttacaaggactgggacacaaatatccatcaaggaacggactatgcctatcgtcaagtgattggtcagctccaccctggtgcggttattctgctccactccgtatccaaggacaatgccgaggcgcttggttccatcatcgatgaggctcgcaagcaagggtatgagtttaaaagtctagacgaccttaaggtgaagcattatcactaa

SEQ ID NO: 1130 - DNA, 798 bp, Paenibacillus sp.
atgaagcgaatatttaccttgtggctatgcattgcagttatggggatgttgacagttacggcagaacccgcatgggctactcagactgttgacggacagccttatcattttgggttcaaaaaaagtaagggaggggagctgccttccatcgcacaagaaggctttatgcaactaatcgaaagacaaggtggcatctttctgggggatacgactaaaaaagaactatttctcactttcgacaacggctatgagaatgggtatactcccaaagtgctggatgtattgaaggccaaaaaggttcccgccgccttttttgtgacagggcattttgtaaaagaccagcctgatttgatgcgacgcatggccagtgagggtcatattatcggaaaccattcatggagccatcctgatatgagcaccatttcttccacagagatccggtctgaactagatcgggtacgaaatgcatcggcagagctaaccgggcaaaaagatatgaaatacgtccggccgcctcgcggcatttttagtgaaaaagcattggcttcctgtcgagaagccggatatacgagcgtgttctggtctgtggcttacaaggattgggacacaaatatacagcaaggaacggactatgcctatcgtcaagtcattggtcagctccaccctggtgcggtcattctgctccattccgtatccaaggacaatgccgaggcgcttggttccatcatcgacgaggctcgcaagcaagggtatgagtttaaaagtctagacgagcttaaggtgaaacattatcactaa

SEQ ID NO: 1131 - DNA, 798 bp, Paenibacillus sp.
atgaagcgaatatttaccttgtggctatgcgttgcagttatggggatgttggcagttacggcggaacccgcatgggccactcagactgttgacggacagccttatcattttggatttaaaaaaagtaagggaggggagctgccttctatcgcacaagaaggctttatgcacctgatcgaaagacaaggtggcatctttctgggggatacgactaaaaaagaattatttctcactttcgacaacggctatgagaatgggtatactccgaaagtgctggatgtattgaaggccaaaaaggtcccagccgccttctttgtgacagggcattttgtaaaagaccagcctgctttgatgcgacgcatggcaagtgagggtcatattatcggaaaccattcatggagccatcctgatatgagcaccatttcttcggcagagatccggtctgagctggatcgggtacgaaatgcatcggcagagctaaccgggcaaaaagaaatgaaatatgtccggccgcctcgcggcatttttagtgaaaaagcattggcttcctgtcgagaagccggatatacgagcgtattctggtctgtagcttacaaggactgggacacaaatatacagcaaggaacggactatgcctatcgtcaagtcatgcgtcagctccatcctggtgcggttattctgctccattccgtatccaaggacaatgccgaggcgcttgcttctatcatcgacgaggctcgcaagcaagggtatgagtttaaaagtctagacgaccttaaggtgaaacattatcactaa

SEQ ID NO: 1132 - DNA, 798 bp, Paenibacillus sp.
atgaagcgaatatttaccttgtggctatgcattgcagttatgggaatgttggcagttacggcggaacccgcatgggccactcagactgttgacggacagccttatcattttgggtttaaaaaaagtaagggaggagagctaccttctatcgcacaagaaggctttatgcacctgatcgaaagacaaggtggcatctttctgggggatacgactaaaaaagaattatttctcactttcgacaacggctatgagaatgggtacactccgaaagtgttggatgtattgaaggccaaaaaggtcccagccgccttctttgtgacagggcattttgtaaaagaccagcctgctttaatgcgacgcatggcaagtgagggtcatattatcggaaaccattcatggagccatcctgatatgagcaccatttcttcggcagagatccggtctgagctggatcgggtacgaaatgcatcggcagagctaaccgggcaaaaagaaatgaaatatgtccgcccgcctcgcggcatttttagtgaaaaagcattagcttcctgtcgagaggccggatatacgagcgtattctggtctgtagcttataaggactgggacacaaatattcagcaaggaacggactatgcctatcgtcaagtcatgggtcagctccaccctggcgcagttattctgctccattccgtatccaaggacaataccgaggcgcttgcttctatcatcgacgaggctcgcaagcaagggtatgagtttaaaagtctagacgaccttaaggtgaaacattatcactaa

SEQ ID NO: 1133 - DNA, 798 bp, Paenibacillus sp.
atgaaacgaatatttaccttgtggctatgcgttgcggttatagggatgttagcagttacgggtgaatccacacaagctgctcagactgttgacggacagccttatcattttgggtttaagaaaagtaagggaggcgagctgccctctatcgcacaagagggctttatgcatctgattgaaagacagggtggcatctttctgggggatactactaaaaaagaattatttctcacgttcgataacggctatgagaatggttatacgcccaaggtgctggatgttttaaaggctaagaaggttccagccgccttctttgtaaccgggcattttgtgaaggaccagcccgctctgatgcgccgcatggcgagtgagggtcatattatcgggaaccattcatggagccatcctgatatgagcaccatttcttcagcagagattcggtccgagctggatcgggtacgaaatgcatcggcggagctaaccggacagaaggaaatgaaatacgttcggccgcctcgcggcatattcagcgaaaaagcattggcctcctgccgagaagcgggatatacgagcgtattttggtctgttgcttataaggactgggatacaaatatccagcagggcgcagattatgcctaccaacaagttatacgtcagcttcaccccggagcggtcattctgcttcattctgtatccaaggacaacaccgaggcgcttggttcgattatagacgaagcacgtaagcaagggtacgagttcaaaagcctggatgacctcaaggttaagcattaccactaa

SEQ ID NO: 1134 - DNA, 798 bp, Paenibacillus sp.
atgaagcgaatattaaccttgtggctatgcattgcaatgatgggaatgtccacagttatgggagaatcggcatcagctacccaagctgtggacggacaaccgtatcattttgggtttaaaaaaagcaaaggaggcgagctgccctccatcgcacaagaaggctttatgcacctgattgaaagacaaggcggcatctttttgggggatacgactaagaaagaattatttcttactttcgacaacggttacgaaaatggatatactcccaaggtactggatgtattgaaagcaaaaaaggttccggccgccttctttgttactgggcattttgtaaaagaccaaccagatttgatgcgccgcatggcgagtgaaggccatatcatcggaaaccattcatggagccatcctgatatgagcaccatttcttcggcagagattcgatctgagctggatcgggtacgaactgcatctgcagagctgaccgggcaaaaggaaatgaaatatgtccgaccaccgcgcggcatttttaatgaaaaagcattggcatcctgtcgagaagccggatatacgagtgtgttctggtcggtagcctacaaggactgggacacgaatattcagcaggggacggactatgcctatcgtcaagttatgcagcagcttcaccctggagcggtcattttgctccattctgtatccaaggataatgccgaggcactgggctcgatcattgacgaggcacgcaagcaaggatatgagttcaaaagcctagatgatcttaaagttaagcactatcattaa

SEQ ID NO: 1135 - DNA, 798 bp, Paenibacillus sp.
atgaagcgaatattgaccttgtggctatgcattgcaatgatgggaatgtccacagttatgggagaatcggcatcagctacccaagctgtggacggacaaccgtatcattttgggtttaaaaaaagcaaaggaggcgagctgccctccatcgcacaagaaggctttatgcacctgattgaaagacaaggcggcatctttttgggggatacgactaagaaagaattatttctaactttcgacaacggttacgaaaatggatatactcccaaggtactggatgtattgaaagcgaaaaaggttccggccgccttctttgttaccggacattttgtaaaagaccaaccggatttaatgcgccgcatggcgagtgaaggccatattatcggaaaccattcatggagccatcctgatatgagcaccatctcttcggcagagattcgatctgagctggatcgggtacgaactgcatctgcagagctgaccgggcaaaaggaaatgaaatatgtccggccaccacgcggcatttttaatgaaaaagcattggcatcctgtcgagaagccggatatacgagtgtgttctggtcggtagcctacaaggattgggacacgaatattcagcgaggaacggactatgcctatcgccaagtcatgcagcagctccaccctggagcggtcattttacttcattctgtatccaaggataatgccgaggcacttggctcgatcattgacgaggctcgtaagcaaggatatgagttcaaaagcctggatgaccttaaagttaagcattatcactaa

SEQ ID NO: 1136 - DNA, 798 bp, Paenibacillus sp.
atgaagcaaatttttaccttgtggctatgcattgcattgatggggatgtccacagttatgggagaatcagcatcagctacccaagctgtggacggacagccgtatcattttggatttaaaaaaagtaagggaggcgagctgccttccatcgcacaagaaggctttatgcacctgattgaaagacaaggcggcatctttttgggggatacgactaagaaagaattgtttcttactttcgacaacggatacgaaaatggatatactcccaaggtgctggatgtattgaaagccaaaaaggttccggccgccttctttgtaaccgggcattttgtaaaagaccaaccggatttgatgcgccgcatggccagcgaaggccatattattggaaaccattcatggagccatcctgatatgagcaccatttcttcggcagagattcggtctgagctggatcgggtacgaactgcgtctgcagagctgactgggcaaaaggaaatgaaatatgtccggccaccgcgcggcatttttaatgaaaaagcattggcatcctgtggagaagccggatacacgagtgtgttctggtcggtggcctacaaggactgggacacgaatattcagcgaggaacagactatgcctatcgccaagttatgcagcagctccaccctggagcggtcattttgctccattctgtatccaaggataatgccgaggcacttggctcgatcattgacgaggctcgcaagcaaggatatgagttcaaaagcctggatgaccttaaagttaagcactatcactaa

SEQ ID NO: 1137 - DNA, 798 bp, Paenibacillus sp.
atgaagcgaatgtttgccttatggttatgcactgcggttgttggcatgttagtagttacgggtcaacccgcactagctacgcaggctgttgacggacagccttatcattttggatttaaaaaaagcaagggaggcgagctgccttccatcgcgcaagagggctttatgcacttgatcgaaagacagggaggcatctttttgggggatacaaccaaaaaagaactgtatctcacctttgacaacggctatgagaatggatttacccccagagtgctggatgtattgaaggctaaaaaagtcccggctgccttctttgtgaccgggcattttgtaaaagaccagcctgctttgatgcgccgtatggcaagtgaaggccacatcatcgggaaccattcatggagccatcctgatatgagtacaatttcttcggcacagatccggtccgagctggataaggtacgaagcgcatcggccgaactgaccggacaaaaagaaatgaaatacgtccgaccgccacgcggcatttttagcgaaaaagccttggcttcctgccgggaagccggatatacaagcgtattctggtctgtggcttacaaggactgggatacgaatatccagcaaggagcagactatgcctatcgtcaggtcataaagcagctccaccccggagcggtcattctgctccattccgtgtccaaggacaatgccgaagcgctcggttctatcattgacgaagctcgcaagcaagggtatgaattcaaaagtctggacgaccttaaggtcaagcattaccactag

SEQ ID NO: 1138 - DNA, 798 bp, Paenibacillus sp.
atgaagcgaatattagccttgtggctatgcgttgcggttatggggatgttagcagttacgggtaaacccctactcgctgcccaggctgttgacggacagccttatcattttgggttcaaaaaaagcaagggaggcgagctgccttctatcgcacaagagggctttatgcacctgattgagagacagggaggcatctttctcggagatactacgaaaaaagaattatttctcacgttcgacaacggctatgagaatggatacacgcccaaggtgctggatgttttaaaggccaaaaaggtgccagccgccttctttgtaaccgggcattttgtaaaggaccagccagctttgatgcgccgtatggcgagtgagggccatattatcggcaatcattcttggagccatcctgatatgagcaccatttcttcagcggatattcggtccgagctggatcgggtacgaaatgcatcgacagagctaaccggacaaaaggaaatgaaatacgtccggccgcctcgcggcattttcagcgaaaaagcattggccacctgtcgagaagcaggatatacgagtgtattttggtctgtagcttacaaggactgggacacgaatatccagcaaggagcagactatgcctatcagcaggtcatgcgtcagctccatcccggagcagtcattctactccattctgtgtccaaggataatgccgaggccttgggttcgattatcgacgatgctcgcaagcaaggctatgaattcaaaagcctgaacgacctgaaggttaagcattaccactaa

SEQ ID NO: 1139 - DNA, 309 bp, Paenibacillus sp.
atgccaaatcaaggcggaagttctttcacgaacaaaggcttcaaggcaagcacaggaaatcagttcaaagcggaatttgcacaagacaatacggtaggtgtcgtttcacaaaaggtaaagcagtctgaacaaaataaaattcaagacaacttccagacaccaaatgagaagtatgatgaagaatttgcaacagatcaaggcggtacaggtgcagtagcacaaaaagttcaaaactccagtcgtaacaaaattcaaaataatgctcaaacaccgaacgaaaagttcgacgaaaactttaacacgaaataa

SEQ ID NO: 1140 - DNA, 309 bp, Paenibacillus sp.
atgccaaatcaaggcggaagttctttcacgaacaaaggcttcaatgcaagcacaggaaatcagttcaaagcggaatttgcacaagacaatacggtaggtgttgtttcacaaaaggtaaagcagtctgaacaaaataaaattcaagacaacttccagacaccaaatgagaagtatgatgaagaatttgcaacagatcaaggcggtacaggtgcagtagcacaaaaagttcaaaactctagtcgcaacaaaattcaaaacaatgctcaaacaccgaatgaaaagttcgacgaaaactttaacacgaaataa

SEQ ID NO: 1141 - DNA, 309 bp, Paenibacillus sp.
atgccaaatcaaggcggaagttctttcacgaacaaaggcttcaaggcaagcgcaggaaatcagttcaaagcggaatttgcacaagacaatacggtaggtgtcgtttcacaaaaggtaaagcagtctgaacaaaataaaattcaagacaactttcagacaccaaatgagaagtatgatgaagaatttgcaacagaacaaggcggtacaggtgctgtagctcaaaaagttcaaaactccagtcgcaacaaaattcaaaacaatgctcaaacaccgaacgaaaagttcgacgaaaactttaacacgaaataa

SEQ ID NO: 1142 - DNA, 309 bp, Paenibacillus sp.
atgccaaatcaaggcggaagttctttcacgaacaaaggcttcaaggcaagcgcaggaaatcagttcaaagcggaatttgcacaagacaatacggttggtgtcgtttcacaaaaggtaaagcagtctgaacaaaataaaattcaagacaactttcagacaccaaatgagaagtatgatgaagaatttgcaacagaacaaggcggtacaggcgctgtagctcaaaaagttcaaaactccagtcgcaacaaagttcaaaacaatgctcaaacaccgaacgaaaagttcgacgaaaactttaacacgaaataa

SEQ ID NO: 1143 - DNA, 309 bp, Paenibacillus sp.
atgccaaatcaaggcggaagttctttcacgaacaaaggcttcaaggcaaacacaggaaatcagttcaaagcggaatttgcacaagacgatacggtaggcgttgtttctcaaaaggtaaagcagtctgaacaaaataaaattcaagacaacttccaaacaccaaatgagaagtatgacgaagaatttgcgacagatcaaggcggtacaagtgcagtagcgcaaaaagttcaaaactccagtcgcagcaaaattcaaagcaatgcacaaacaccgaacgaaaagttcgacgagaactttaacacaaaataa

SEQ ID NO: 1144 - DNA, 309 bp, Paenibacillus sp.
atgccaaatcaaggcggtagttctttcatgaacaaaggcttcaaggcaaacacaggaaatcagttcaaagcggaatttgcacaggacgatacggtaggcgttgtttctcaaaaggtgaagcagtctgaacaaaataaaattcaagacaacttccaaacaccaaatgagaagtatgatgaagaatttgcaacagatcaaggcggtacaagtgcagtagcgcaaaaagttcaaaactccagtcgcagcaaaattcaaagcaatgcacaaacaccgaacgaaaagttcgacgagaactttaacacaaaataa

SEQ ID NO: 1145 - DNA, 309 bp, Paenibacillus sp.
atgccaaatcaaggcggtagttctttcatgaacaaaggcttcaaggcaaacacaggaaatcagttgaaagcggaatttgcacaagacgatacggtaggcgttgtttctcaaaaggtgaagcagtctgaacaaaataaaattcaagacaacttccaaacaccaaatgagaagtatgatgaagaatttgcaacagatcaaggcggtacaagtgcagtagcgcaaaaagttcaaaactccagtcgcagcaaaattcaaagcaatgcacaaacaccgaacgaaaagttcgacgagaactttaacacaaaataa

SEQ ID NO: 1146 - DNA, 315 bp, Paenibacillus sp.
atgccaaatcaaaatcaaggcggaagttctttcacgaacaaaggattcaaagcaaacgttggtaaccagtttaaagcggaatttgcgcaagacaattcggtaggtgttgtttctcaaaaggtgaagcagtctgaacaaaataaaattcaagacaacttccaaacaccaaatgagaaatatgatgaagaatttgcgacagatcaaggcggtacaagcgtagtagcgcaaaaagtacaaaactccagtcgtagcaaaattcaaagcaatgctcaaacaccgaaccaaaagttcgatgaaaactttaacacgaaataa

SEQ ID NO: 1147 - DNA, 282 bp, Paenibacillus sp.
atgaacaaaggcttcaaggcaagcacaggaaatcagttcaaagcggaatttgcacaagacaatacggtaggtgtcgtttcacaaaaggtaaagcagtctgaacaaaataaaattcaagacaacttccagacaccaaatgagaagtatgatgaagaatttgcaacagatcaaggcggtacaggtgcagtagcacaaaaggtacaaaactccagtcgcagcaaaattcaaaacaatgctcaaacaccgaatgaaaaatttgacgaaaactttaacacgaaataa

SEQ ID NO: 1148 - DNA, 309 bp, Paenibacillus sp.
atgccaaatcaaggcggaagctcgaacatgaaccaaggcgccaaagcaagcgcaggcaatcagtttaaagcagaatttgcacaagacaattcggtaggtgtcgtttctcaaaaggtgaaaaagtctgaacaaaataaaattcaagacaactaccagacaccaaatgagaagtatagtgaagaatttgcaacagatgtggcaggtacaagtgcagtagcgcaaaaagtacaaaacgccagtcgcaacaaaattcaaagcaatgctcaaacaccgaaccaaaagttcgatgaaaactttaacacgaaataa

SEQ ID NO: 1149 - DNA, 309 bp, Paenibacillus sp.
atgccaaatcaaggcggaagctcgaacatgaaccaaggcgccaaagcaagcgcaggtaatcagtttaaagcagaatttgcacaagacaattcggtaggtgtcgtttctcaaaaggtgaagaagtctgaacaaaataaagttcaagataactaccagacaccaaatgagaagtatagtgaagaatttgcaacagatgtggcaggtacaagcgcagtagcgcaaaaagtacaaaacgccagtcgcaacaaaattcaaagcaatgctcaaacaccgaaccaaaagttcgatgaaaactttaacacgaaataa

SEQ ID NO: 1150 - DNA, 309 bp, Paenibacillus sp.
atgccaaatcaaggcggaaattcttacatgaatcaaggcaacaaagcaaacgcagggagtcagtacaaagcagaatttggccaagataactccgtaggagtcgtttctcaaaaggtgaaaaagtccgagcaaaataaaattcaggacaacttccagacaccaaatgagaaatatgacgaagaattcgcagcagatcaaggcggcacaaactctgtagcacaaaaggtacaaaactccagccgcagcaaagttcaaaacaatgctcaaacaccgaacgaaaaattcgacgaaaactttaacacgaaataa

SEQ ID NO: 1151 - DNA, 309 bp, Paenibacillus sp.
atggcaaatcaaggcggaaattcttacatgaatcaaggcaacaaggcaaacgcaggaagtcagtataaagcggaatttgcccaagacaactcggtaggtgtcgtttctcaaaaggtgaagaagtccgagcaaaataaaattcaggacaactaccagacaccaaatgagaaatatagcgaagaattcgcagcagatcaaggcggcacaagctctgttgcacaaaaggtacaaaactccagtcgcagcaaagttcaaaacaatgctcaaacaccgaacgaaaaattcgacgaaaactttaacacgaaataa

SEQ ID NO: 1152 - DNA, 2163 bp, Paenibacillus sp.
gtgaagcaattgaaaacaaagcaagtgcttcgtaaaagcatgaagtatgcttttgcgctatcactcgtcgcaagcagctttctaccaggtgcaggatttacggataaaatacatgcagaatcccatgtggacaatccttaccaaggggcgacaaaatacattagccctgattatgcggctagtgtcgacacatcgattgccaaaattacggatgccaatctgaaagcaaaaatgcaaacggtcaaaacattcccgacagccgtatggcttgatcgtatcgctgctattaacggcggtggaggcaagcttggcctggaagcgcatttggaccaagtattggcgcaaaagaaaggcagcacaccgattacggcggaatttattgtgtatgatctgcccggacgggattgtcatgccttggcttccaatggtgaattgccactgacccaggcaggtctggaaacgtataaaaaggattatattgacaaaattgctgctattttttcgaatcccaaatataaggatattcgtattgtaacgatcattgaaccagatagtttgccaaatctggtaactaatctggatgatccgaaatgtgcacaagccaagtctacagggatttatgaagctggcgtgaagtacacaatgaataagctgaacgagattcctaacgtgtacaaatacgtagatatcggtcactctggttggttaggttgggataacaaccgttcagcaacggtatccctgtttacaaccattttcaaagatactagcaaaggtctggccagtgtagatggctttatcacgaatacagccaatacttcaccgctgacagagcctaatctgcctgatccaaatctgaatatcggcggacaaccgatcaaatcgtccaagtactatgaatggaatcctaatttcgatgaatcggatttcgcagaggcattgcatagagattttgtcagcgcaggctggccgagctcactcggtatgttaattgatacaggccgtaatggatggggaggacctaaccgtccgacttccgcagtcggcaatgatattaactcctatgtaaactcaggccgtgttgacaaacgctcgcaccgtggtaactggtgtaataacagcggagcaggtatgggaacgccgccacaaacggctccagctggccatattgatgcctatgtatgggcgaaacctccgggtgattccgatggttccagctcactcattccgaacgatgagggtaaaggctttgaccgtatgtgtgatcctacctatacaaccaaggatggcacattaacagatgctttaccgaatgcacctatttcaggagcatggttccatgatcagtttgtgatgctggtacaaaatgcgtaccctgctatcgtgccttccactggtggtgtggacccagcgcctacagctccagctgtaccgtcaggcttaaaggctgttgtgggcaatgctcaagtaacgctgacttggaatgcgtctactggtgccgatagctacacggtcaaacgtgccactagcgaagcaggtccttttacagccgttgcgcctcttgtaacggaaagagagtacacggataagggactgacgaacggaacaacttacttctatgttgtaagtgctacgaatgcgaaaggaacaagtaaggattccgcagcggtaagcgctgaacctaaaggtacaccgactgatccaacagaccctacagatcctacagaaccagcgggtgatctggttgtaatgtaccgggccggggacaccgatccagcgaataacgcagtcaagcctttcttcaacttgaaaaataaaggaacaacacctgtgaagctgagtgagctgaaaatccgttactatttcacgaaagatggcagccaggagctgcaatctgcagtagactatgcgcaagtaggtaatgataacgtgctgcgcaccattaaagacaactatattgaaattggtttcagtcctgctgccggtacgcttgctgccggagcgcaaacaggtgatattcagatccgcatgaacaatagcgactggtccaacctggacgaatccaatgattactccttcgatccaaccaaaacctcttatgcagaatggaacaaagcaacgttgttccacaatgataagctggtgtggggaatcgagccttag

SEQ ID NO: 1153 - DNA, 2124 bp, Paenibacillus sp.
atgaagtatgcttttgcgctatcactcgtcgcaagcagctttctaccaggtgcaggatttacggataaaatacatgcagaatcccatgtggacaatccttaccaaggggcgacaaaatacattagccctgattatgcggctagtgtcgacacatcgattgccaaaattacggatgccaatctgaaagcaaaaatgcaaacggtcaaaacattcccaacagccgtatggcttgatcgtatcgctgctattaacggcggtggaggcaagcttggcctggaagcgcatttggaccaagtattggcgcaaaagaaaggcagcacaccgattacggcggaatttattgtgtatgatctgcccggacgggattgtcatgccttggcttccaatggtgaattgccactgacccaggcaggtctggaaacctataaaaaggattatattgacaaaattgcttctatttttgcaaatcccaaatataaggatattcgtattgtaacgatcattgaaccagatagtttgccaaatctggtaactaatctggatgatccgaaatgtgcacaagccaagtctacagggatttatgaagctagcgtgaagtacacaatgaataagctgaacgagattcctaacgtgtacaaatacgtagatatcggtcactctggttggttaggttgggataacaaccgttcagcaacggtatcgctgtttacaaccattttcaaagatactagcaaaggtctggccagtgtagatggctttatcacgaatacagccaatacttcaccgctgacagagcctaatttgcctgatccaaatctgaatatcggtggacagccgatcaaatcgtccaagtactacgaatggaatcctaatttcgatgaatcggatttcgcagaggcattgcatagagattttgtcagcgcaggctggccgagctcactcggtatgttaattgatacaggccgtaatggatggggaggacctaaccgtccgacttccgcagtcggcaatgatattaactcctatgtaaactcaggccgtgttgacaaacgctcgcaccgtggtaactggtgtaataacagcggagcaggtatgggaacgccgccacaaacggctccagctggccatattgatgcctatgtctgggcgaaacctccgggtgattccgatggttccagctcactcattccgaacgatgagggtaaaggttttgaccgtatgtgtgatcctacctatacaaccaaggatggcacattaacagatgctctaccgaatgcacctatttcaggagcatggttccatgatcagtttgtgatgctggtacaaaatgcgtaccctgctatcgtgccttccactggtggtgtggacccagcgcctacagctccagctgtaccgtcaggcttaaaggctgttgtggggaatgctcaagtaacgctgacatggaatgcgtctacgggtgccgatagctacacggtcaaacgtgccactagcgaagcaggtccttttacagccgttgcgcctcttgtaacggaaagagagtacacggataagggactgacgaacggaacaacttacttctatgttgtaagtgctacgaatgcgaaaggaacaagtaaggattccgcagcggtaagtgctgaacctaaaggtacaccgacagatccaacggaccctacagatcctacagaaccagcgggagatctggttgtaatgtatcgggccggggacactgatccagcgaataacgcagtcaagcctttctttaacttgaaaaataaaggaacaacacctgtgaagctgagtgagctgaaaatccgttactatttcacgaaagatggcagccaggagctgcaatctgcagtagactatgcgcaagtaggtaatgataacgtgctgcgtacctttactgacaactatattgaaattggtttcagtcctgctgccggtacgcttgctgccggagcgcaaacaggtgatattcagatccgcatgaacaatagtgactggtctaatctagacgaatccaatgactactccttcgatccaaccaaaacctcttatgcagaatggaacaaagcaacgttgttccacaatgataagctggtgtggggaatcgagccttaa

SEQ ID NO: 1154 - DNA, 2154 bp, Paenibacillus sp.
gtgaagcaattgaaaacaaagcaagtgcttcgtaaaagcatgaagtatgcttttgcgctatcactcgtcgcaagcagctttctaccaggtgcaggatttacggataaaatacatgcagaatcccatgtggacaatccttaccaaggggcgacaaaatatgttagtcctgattatgcggctagtgttgatacatcgattgccaagattacggaggccaatctgaaagcaaaaatgcaaacggtcaaaacattcccgacagccgtatggcttgatcgtatcgctgctattaacggcggtggaggcaagcttggcctggaagcgcatttggaccaagtattggcgcaaaagaaaggcagcacaccgattacggcggaatttattgtgtatgatctgcccggacgggattgtcatgccttggcttccaatggtgaattaccgctgactcaggcagggctggaaacatataaaaaggattatgttgacaaaattgcttctattttctcaaatcccaaatataaggatattcgtatcgtagcgatcattgaaccagatagtttgccaaacctggtaaccaatctggatgatcctaaatgtgcgcaagccaagtctacagggatttatgaagctggtgttaagtacacaatgaataagctgaacgagattccgaatgtgtacaaatacgtagatatcggtcactctggctggttaggttgggataacaaccgtgcagcaacggtatccctgtttacaactatcttcaaagacactagcaaaggtctgtccagtgtagatggctttatcacgaatacagccaatacttcaccgctgacagaacctaatttgcctgatccaaatctgaatgtcggcggacaaccgatcaaatcgtccaagtactatgaatggaatcctaatttcgatgaatcggatttcgcagagtcattgcatagagattttgtcagcgcaggctggccgagctcactcggtatgttaattgatacaggccgtaacggatggggcggacctaaccgtccgacttccgcagtcggcaatgatattaactcctatgtaaactcaggccgtgttgacaaacgctcgcaccgtggtaactggtgtaataacagcggagcaggtatgggaacaccgccacaaacggctccagctggccatattgatgcctatgtatgggcgaaacctccgggtgattccgatggttccagctcactcattccgaacgatgagggtaaaggctttgaccgtatgtgtgatcctacctatacaaccaaggatggcacattaacagatgctttaccgaatgcacctatttcaggagcatggttccatgatcagtttgtgatgctggtacaaaatgcgtaccctgcaatcgtgccttccactggtggtgtggacccagcgcctacagctccagctgtaccgtcaggcttaaaggctgttgtgggcaatgctcaagtaacgctgacttggaatgcgtctactggtgccgatagctacacggtaaaacgtgccactagcgaagcaggtccttttacagccgttgcgcctcttgtaacggaaagagagtacacggataaggggctgacgaacggaacaacttacttctatgttgtaagtgctacgaatgcgaaaggaacaagtaaggattccgcaacggtaagcgctgaacctaaaggtacaccgactgatccaaccgaccctacagaaccagcgggtgatctggttgtaatgtaccgggctggtgacaccgacccagctaataacgcagtcaagcctttccttaacctgaaaaataaaggtacaacacccgtgaagctgagtgagctgaaaatccgctattacttcacgaaggatggcagccaagagctgcaatctgcagtagactatgcgcaagtaggcaatgataacgtgctgcgtaccattacagacaactatattgaaattggtttcagtgctgctgccggctcgcttgctgctggagcgcaaacaggtgatattcagatccgcatgaacaatagcgactggtctaacctgaacgaatccaatgattactccttcgatccaacgaaaacctcttatgcagaatggaacaaagtaacgttgttccacaatgataagctggtgtggggaatcgagccttag

SEQ ID NO: 1155 - DNA, 2145 bp, Paenibacillus sp.
ttgaaaacaaagcaagtgcttcgtaaaagcatgaagtatgcttttgcgctatcactcgtcgcaagcagctttctaccaggtgcaggatttacggataaaatacatgcagaatcccatgtggacaatccttaccaaggggcgacaaaatatgttagtcctgattatgcggctagtgttgatacatcgattgccaagattacggaggccaatctgaaagcaaaaatgcaaacggtcaaaacattcccgacagccgtatggcttgatcgtatcgctgctattaacggcggtggaggcaagcttggcctggaagcgcatttggaccaagtattggcgcaaaagaaaggcagcacaccgattacggcggaatttattgtgtatgatctgcccggacgggattgtcatgccttggcttccaatggtgaattaccgctgactcaggcagggctggaaacatataaaaaggattatgttgacaaaattgcttctattttctcaaatcccaaatataaggatattcgtatcgtagcgatcattgaaccagatagtttgccaaacctggtaaccaatctggatgatcctaaatgtgcgcaagccaagtctacagggatttatgaagctggtgttaagtacacaatgaataagctgaacgagattccgaatgtgtacaaatacgtagatatcggtcactctggctggttaggttgggataacaaccgtgcagcaacggtatccctgtttacaactatcttcaaagacactagcaaaggtctgtccagtgtagatggctttatcacgaatacagccaatacttcaccgctgacagaacctaatttgcctgatccaaatctgaatgtcggcggacaaccgatcaaatcgtccaagtactatgaatggaatcctaatttcgatgaatcggatttcgcagagtcattgcatagagattttgtcagcgcaggctggccgagctcactcggtatgttaattgatacaggccgtaacggatggggcggacctaaccgtccgacttccgcagtcggcaatgatattaactcctatgtaaactcaggccgtgttgacaaacgctcgcaccgtggtaactggtgtaataacagcggagcaggtatgggaacaccgccacaaacggctccagctggccatattgatgcctatgtatgggcgaaacctccgggtgattccgatggttccagctcactcattccgaacgatgagggtaaaggctttgaccgtatgtgtgatcctacctatacaaccaaggatggcacattaacagatgctttaccgaatgcacctatttcaggagcatggttccatgatcagtttgtgatgctggtacaaaatgcgtaccctgcaatcgtgccttccactggtggtgtggacccagcgcctacagctccagctgtaccgtcaggcttaaaggctgttgtgggcaatgctcaagtaacgctgacttggaatgcgtctactggtgccgatagctacacggtaaaacgtgccactagcgaagcaggtccttttacagccgttgcgcctcttgtaacggaaagagagtacacggataaggggctgacgaacggaacaacttacttctatgttgtaagtgctacgaatgcgaaaggaacaagtaaggattccgcaacggtaagcgctgaacctaaaggtacaccgactgatccaaccgaccctacagaaccagcgggtgatctggttgtaatgtaccgggctggtgacaccgacccagctaataacgcagtcaagcctttccttaacctgaaaaataaaggtacaacacccgtgaagctgagtgagctgaaaatccgctattacttcacgaaggatggcagccaagagctgcaatctgcagtagactatgcgcaagtaggcaatgataacgtgctgcgtaccattacagacaactatattgaaattggtttcagtgctgctgccggctcgcttgctgctggagcgcaaacaggtgatattcagatccgcatgaacaatagcgactggtctaacctgaacgaatccaatgattactccttcgatccaacgaaaacctcttatgcagaatggaacaaagtaacgttgttccacaatgataagctggtgtggggaatcgagccttag

SEQ ID NO: 1156 - DNA, 2145 bp, Paenibacillus sp.
ttgaaaacaaagcaagtgcttcgtaaaggaatgaagtatgcttttgcgctatcactcgtcgcaagcagctttctaccaggtgcaggatttacggataaaatacatgcagaatcccatgtcgataatccataccaaggagcgacaaaatacgttaaccctgattatgcggctagtgtcgacacatcgattgccaaggttacggatgcgaacctgaaggcaaaaatgcaaacggtcaaaacgttcccgacagccgtatggcttgatcgtattgctgctattaacggcggtgggggcaagcttggcttggaagcacatttggaccaagtattggcgcaaaagaaaggcaacacaccgattaccgcggaattcattgtgtatgatctgcccggacgagattgtcatgccttggcttccaatggtgaattgccgttgacccaggcaggtctggaaacgtacaaaaaggattatattgacaaaatcgcttctatttttgcgaatcccaaatataaggatattcgcatcgtagcgatcattgaaccggacagtttgccaaatctggtaaccaatctggatactccccaatgtggacaagccaaatctacaggaatttatgaggctggcgttaaatacacaatgaataagctgaacgagattccgaatgtgtacaaatacgtggatatcggtcactctggctggttaggttgggataacaaccgtgcagcaacggtatctctgtttacaactatcttcaaagatactagcaaaggtctggccagtgtggatggctttatcacgaatacagccaatacttcaccgttgacagaaccgaatctgcctgatcccaacctgaatattggcgggcagccgatcaaatcgtccaaattctacgaatggaatcctaatttcgatgaatcggatttcgctgagtccttgcatagagattttgtcaatgcaggctggccaagctcgctcggcatgttaattgataccggccgtaatggatggggaggacctaaccgtccgacttccgcagtcggcaatgatattaactcctatgtaaactcaggtcgtgtggacaaacgttcgcaccgtggtaactggtgtaatagcagcggagcagggatgggaacaccgccacaaacggctccagctggccatatcgatgcctatgtctgggcgaaacctccgggtgattccgatggttccagctcactcattccgaacgatgagggtaaaggctttgaccgtatgtgtgatcctacctatacaaccaaggatggcacattaacagatgctttgccgaatgcacctatttcaggagcatggttccatgatcagtttgtgatgctggtacaaaatgcgtaccctgcaatcgtgccttccagtggtggtgtggacccagcgcctacagctccagctgtaccttcaggcttaaaggctactgtgggtaatgcacaagtaacgctgacttgggatgcgtctacgggtgccgacagctacaccgtaaaacgtgccactagcgaagcaggtccttttacagccgtggcgcctcttgtaacagcaagagaatacacggataagggactgacgaacggaacaacgtacttctatgttgtaagtgctacgaatgcgaaaggaacaagtaaggattcagcaacggtaagcgctgaaccaaaaggtacaccgacagatccaaccgaccctacagatccagcgggtgatctggtggtaatgtatcgtgctggggacacggatccagcgaataacgctgccaagcctttctttaacctgaaaaataaaggtacaacacccgtgaagctgagcgagctgaaaatccgctattacttcacgaaagatggcagccaagagctgcaatctgcggtagactgggcgcaagtaggtaatgataatgtgctgcgcaccattaaagacaactatattgaaattggattcagtgcggctgccgggacgcttgctgctggagcgcaaacaggtgatattcagatccgcatgaacaatagcgactggtctaatctgaacgaatccaatgactactccttcgatccaaccaaaacttcttatgctgaatggaacaaagtaacgttgttccacaacgataagctggtatggggaatcgagccttag

SEQ ID NO: 1157 - DNA, 2154 bp, Paenibacillus sp.
gtgaagcaattgaaaacaaagcaagtgcttcgtaaaagcatgaagtatgcttttgcgctatcactcgtcgcaagcagctttctaccaggtgcaggatttacggataaaatacatgcagaatcccatgtagacaatccttaccaaggggcgacaaaatatgttagtcctgattatgcggctagtgtcgacacatcgattgccaaaattacggatgccaatctaaaggcaaaaatgcaaacggtcaaaacattcccgacagccgtatggcttgatcgcatcgctgctattaacggcggtggaggcaggcttggcctggaagcgcatttggatcaagtgttggcgcaaaagaaaggcagcacaccaattacggcagagtttattgtatatgatctgcccggacgggattgtaaagccttggcttccaacggtgagctgccgctgacccaagcggggctggaaacgtacaaaaaggattatgtcgataaaattgctgctatttttgccaatccgaagtatcaggatatccgcattgtagcgattattgaaccagatagcttacctaacttggtaaccaatttggatactcctcagtgtgcgcaagccaaatctacaggaatttatgaagccgggatcaagtatacaatgaataagctgaacgagattccgaatgtgtacaaatacgtggatatcggtcactctggatggttaggttgggataacaatcgttcagcaacggtatccctgtttacaactatcttcaaagatacgagcaaaggtctgtccagcgtggacggctttatctcgaatacagccaatacttcaccgctgacagaacctaacttgcctaatccagatttgaatatcggtggacaaccgatcaaatcgtccaagttctacgaatggaatcctaattttgatgaattgcatttcacagagtcattgtataaagattttgtcaatgcaggctggccaagctcgctcggtatgttaattgatacgagtcgcaatggatggggaggacctaaccgtccgacttctgcagtcggcagtgatattaactcctatgttaattcaggccgtgtagacaaacgggcgcaccgtggtaactggtgtaatagcagcggagcaggtatgggaacaccaccacaaacggctccagctggccatattgatgcctatgtatgggcgaaacctccgggtgattccgatggttccagctcactcattccgaacgatgagggtaaaggctttgaccgtatgtgtgatcctacctatacaaccaaggatggcacattaacagatgctttaccgaatgcacctatttcaggagcatggttccatgatcagtttgtgatgctggtacaaaatgcgtaccctgcaatcgtgccttccactggtggtgtggacccagcgcctacagctccagctgtaccgtctggcttaaaggccgtagctggtaatgctcaagtgacgctgacttggaatgcatctacgggtgccgatagctacacagtcaaacgtgccactagcgaagcaggtccttttacagccgttgcgcctcttgtaacggcaagagagtacacggataagggactgacgaacggaacaacttacttctatgttgtaagtgctacgaatgcgaaaggaacaagtaaggattccgcaacggtaagtgctgaacctaaaggtacaccgacggatccaacagaccctacagaaccagcgggtgatctggttgtaatgtaccgggccggggacaccgatccagcgaataacgctgctaagcctttctttaacctgaaaaataaagggacaacaccagtgaagttgagtgagctcaaagtccgctattacttcacgaaagatggcagccaagagctgcaatctgcagtagactgggcgcaagtaggtaatgataacgtgctacgcaccattaaagacaactatattgaaattggtttcagtgctgctgccggcacgcttgctgctggtgcgcaaacaggtgatattcagatccgcatgaacaatagcgactggtctaacttgaacgaatccaatgattattcctttgatccaacgaaaacctcttatgcagaatggaacaaagtaacgttgttccacaatgataaactggtgtggggaatcgagccttag

SEQ ID NO: 1158 - DNA, 2145 bp, Paenibacillus sp.
gtgaagcaattgaaaacaaagcaagtgcttcgtaaaggcatgaagtatgcttttgcgctatcactcgtcgcgggcagctttctaccaggtgcaggatttacggataaaatacatgcagaatcccatgtggacaatccttatcaaggggcaaccaaatatgttagtcctgattatgcggctagcgtcgacacatcgattgccaaggttacggattctacactgaaagcgaaaatgcaaaccgtcaaaacgttcccgacagccgtatggctcgatcggatcgctgctattaacggcggtggaggcaagcttggtctggaagcgcatttggatcaagtattggcacaaaagaaaggcaacacaccaattacggcagagtttattgtatatgatctgcccggacgggattgtaaagccttggcttccaacggtgagctgccgctgacccaagcggggctggaaacgtacaaaaaggattatgtcgataaaattgctgctatttttgccaatccgaagtatcaggatatccgcattgtagcgattattgaaccagatagcttaccaaacttggtaaccaatttggatactcctcagtgtgggcaagccaaatctacaggaatttatgaagccgggatcaagtatacaatgaataagctgaacgagattccgaatgtgtacaaatacgtggatatcggtcactctggatggttaggttgggataacaatcgttcagcaacggtatccctgtttacaactatcttcaaagatactagcaaaggtctgtccagcgtggacggctttatctcgaatacagccaatacttcaccgctgacagaacctaacttgcctaatccagatttgaatatcggtggacaaccgatcaaatcgtccaagttctacgaatggaatcctaattttgatgaattgcatttcacagagtcattgcataaagattttgtcaatgcaggctggcccagctcgctcggtatgttaattgatacgagccgtaatggatggggaggacctaaccgtccgactgccgctgttggcagtgatattaactcctatgtaaactcaggccgtgtagacaaacgctcgcatcgcggcaactggtgtaatagcagcggagcaggtatgggtacgccgccgcaaacagctccagcttcccatgtcgatgcttatgtatgggcgaaacctccgggtgattccgatggttccagctcactcattccgaacgatgagggtaaaggctttgaccgatactgtgatcctacctataccactaaggatggcacattaacagatgctttaccgaatgcacctatttcaggagcttggttccatgatcagtttgcgatgctggtgcaaaatgcatatccagcgattgtcccttcatctggtggtgtggatccatcacctacagctccagctgtaccgtcaggcttaaaggcagttgcgggcaatgctcaggtaacgctgacctggaatgcgtccactggggctgacagctacacggtaaaacgtgcaaccagtgaagcaggtccttttacagccgttgcgcctcttgttactgagaaagagtacacggataaagggttgaccaacggaacaacctatttctatgttgtaagtgctacgaatgcgaaaggaacaagtaaggattccgctgcggtaagcgctgaacctaaaggaacaccgacagatcctacagaaccagcgggtgatctggttgtgatgtatcgggctggagacactgatccggccaataatgcaatcaagcctttctttaacctgaaaaataaaggtacaacacccgtgaagctgagtgagctgaaaatccgttactatttcacgaaagatggcagccaagagctgcaatctgcagtagactatgcgcaagtaggtaatgataacgtgctgcgtacctttacagacaactatattgaaattggtttcagtcctgctgccggtacgcttgctgctggagcacaaacaggtgatattcagatccgcatcaacaatagcgactggtctaacctggacgaatccaatgactactccttcgatccaaccaaaacctcttatacggaatggaataaagcaacgttgttccataacgataagctggtgtggggaatcgagccttag

SEQ ID NO: 1159 - DNA, 2124 bp, Paenibacillus sp.
atgaagtatgcttttgcgctatcactcgtcgcaagcagctttctaccaggtgcaggatttacggataaaatacatgcagaatctcatgtggacaatccttaccaaggggcgacaaaatacgttagtcctgattatgcggctagtgtcgacacatcgattgccaaaattacggatgccaatctgaaagctaaaatgcaaactgtcaaaacattcccgacagccgtatggcttgatcgcatcgctgccattaacggcggtggaggcaagcttggcctggaggcgcatttggatcaagtgttggcgcaaaagaaaggcaacacaccaattacggcagagtttattgtatatgatctgcccggacgggattgtaaagccttggcttccaacggtgagctgccgctgacccaagcggggctggaaacgtacaaaaaggattatgtcgataaaattgctgctatttttgccaatccgaagtatcaggatattcgcattgtagcgattattgaaccagatagcttaccaaacttggtaaccaatttggatactcctcagtgtgcgcaagccaaatctacaggaatttatgaagccgggatcaagtatacaatgaataagctgaacgagattccgaatgtgtacaaatacgtggatatcggtcactctggatggttaggttgggataacaatcgttcagcaacggtatccctgtttacaactatcttcaaagatactagcaaaggtctgtccagcgtggacggctttatctcgaatacagccaatacttcaccgctgacagaacctaacttgcctaatccagatttgaatatcggtggacaaccgatcaaatcgtccaagttctacgaatggaatcctaattttgatgaattgcatttcacagagtcattgcataaagattttgtcaatgcaggctggcccagctcgctcggtatgttaattgatacgagccgtaatggatggggaggacctaaccgtccgactgccgctgttggcagtgatattaactcctatgtaaactcaggccgtgtagacaaacgctcgcatcgcggcaactggtgtaatagcagcggagcaggtatgggtacgccgccgcaaacagctccagcttcccatgtcgatgcttatgtatgggcgaaacctccgggtgattccgatggttccagctcgctcattccgaacgatgagggtaaaggctttgaccgatactgtgatcctacctataccactaaggatggcacattaacagatgctttaccgaatgcacctatttcaggagcttggttccatgatcagtttgcgatgctggtgcaaaatgcatatccagcgattgtcccttcatctggtggtgtggatccatcacctacagctccagctgtaccgtcaggcttaaaggcagttgcgggcaatgctcaggtgacgctgacttggaatgcgtctaccggtgctgatagctacacggtaaaacgtgccactagcgaagcaggtccttttacagccgttgcgcctcttgttactgagaaagagtacacagataaggggctgaccaacggaacaacttacttctatgttgtaagtgctacgaatgcgaaaggaacaagtaaggattccgcaacggtaagcgctgaacctaaaggtacaccgactgatccaacagaccctacagatcctacagaaccagcgggtgatctggttgtaatgtaccgggccggggacaccgatccagcgaataacgctgctaagcctttctttaacctgaaaaataaagggacaacacctgtgaagctgagtgagctcaaagtccgctattacttcacgaaagatggcagccaagagctgcaatctgcagtagactgggcgcaagtaggtaatgataacgtgctgcgtaccattaaagacaactatattgaaattggtttcagtgctgctgccggcacgcttgctgctggagcgcaaacaggtgatattcagatccgcatgaacaatagcgactggtctaacctgaacgaatccaatgattactccttcgatccaactaaaacttcttatgcagaatggaacaaagtaacgttgttccacaatgataagctggtgtggggaatcgagccttag

SEQ ID NO: 1160 - DNA, 2229 bp, Paenibacillus sp.
ttgaaaacaaagcaagtgcttcgtaaaggcatgaagtatgcttttgcgttatcactcgtcgcaggtagttttttaccaggtacaggattgacaggaaaaataaatgcagaatcccatgtggacaacccttatatcggggcaacaaaatatattagtcctgattacgccgctttcgtcgattcgtcaattgccaaggttaccgatgctaatctgaaagcgaaaatgcaaactgtcaaaacgttcccgacatccgtatggctcgatcgcatcgctgccattaaagggacgccaggcaatcttggtctggaagagcatctggatcaagtattggcccaaaagaaaggcgacacgccgattacggcagagtttattatatatgatctgcccggacgggattgtcatgccttggcttccaatggtgagcttccgctgacccaggcaggtctggaaacgtacaaaaaggattatgtcgacaagattgctgagatccttgccaaccccaaatataaggacattcgtatcgtaacgatcattgaaccggacagtttaccgaacctggtaaccaatatgagcgatccaaaatgtgctcaagccaaatccaccggtatctatgaaaccggtattcagtacacaatcaacaaactgaacgaaattcctaacgtatacaaatacgtagatatcggtcactccggctggctcggttgggataacaaccgttcagcaacagtttctctgtataccaacgttttcagaaacacatctaaaggattgtccagcgtagacggctttatcaccaatacagccaacactacgccgctggttgagcctaatctgcctgattccaacctgaatattaacggacagccgatcaagtcttccaagtattacgaatggaacccttacttcgatgagctgcatttcacagaaggtctgcacagagattttgtaaatgcaggctggccaagttctctcggtatgctgattgataccggccgtaacggctggggtggaccgaaccgtccaactaaagctacaggtaacgatatcaattcgtacgtgaactcaggccgtgtggacagacgcgaccatcgcggtaactggtgtaacaacagtggcgcaggtatggggacacctcctcaaaccgctccggcttcccatgtcgatgcatatgtatgggcgaagcctccgggtgcttccgacggctccagctcgctcattccgaacgatgagggcaaaggctttgaccggatgtgtgatcctacttacacaaccagtgacggcgtattgacaggcgcattgccaaatgctccgatttccggtgcttggttccatgatcagttcgttatgctcgtgaacaatgcatatccagcaatcaaagctgctgatggtagcgtagacccagcacctacgccaacacctacaccaaccccagaagctccggcagtaccggcagacttacagggaaaattgggtgtgaagctgacttgggctgcttccactggtgcccaaagctacacagtgaagcgtgctaccagtgaggaaggtccttttacaacgattgcgtcacgtgtaacaggtacagaatacacggatacagatttgacgaatggaacgacttactattatgtaataagtgctacgaatgcaaatggttcaagcaaggattcggctgtagtgaaagtgactgttggatcgaaggctactacaccaacaaatcctacagatccaacaccaacaccagatccaacccctacaccagaaccaacaccagatccgactccaactccaacagaacctgcaggtgacctggctgttctgtaccgggctggagataccgatccaacgaataatgcaattaaaccattttttaacgtaaaaaataacggaacaactcctgtgaagctgagtgatctgaaaatccgctactacttcactaaagagggtaaccaagacatgcagtctgcagtggactgggcacaaataggtaatgataacgtgctgcgtacctttacagacaaatatattgaaattggtttcagtcctgctgccggcacgcttgctgctggagcacaaacaggtgaaattcaagtccgtattaacaaaaacgactggtctaatcacgatgaatccaatgactactcgttcgatccaaccaaaacctcttatacagaatggaacaaagtaacgttgttccaaaatgatgagctggtatggggaatcgagccttaa

SEQ ID NO: 1161 - DNA, 1896 bp, Paenibacillus sp.
gaccgcacccctgccattaacggcggtggaggcaagcttggcttggaagcgcatttggaccaagtattggcgcaaaagaaaggcaacacaccaattacggcagagtttattgtatatgatctgcccggacgggattgtaaagccttggcttccaacggtgagctgccgctgacccaagcggggctggaaacgtacaaaaaggattatatcgacaagattgctacgatctttgccaatcccaaatataaggatattcgtatcgtagcgatcattgaaccagacagtttgccaaacctcgtgaccaatctgaatgaccctaaatgtgcggaagccaaatctacaggaatttatgaagccggcatcaagtatacaattaataagttgaacgatattcctaacgtctacaaatatgtagatatcggtcactccggctggctgggttgggataacaatcgcacagcaaccgtatcgttgttcacgaatgttttcagagatacgagcaaaggactgtccagtgtggatggctttatcacgaatacagccaattcttccccgctgacagagcctaatctgcccgatccaaacctgaatatcggcggacagccgatcaaatcttccaaatactacgaatggaatcctaatttcgatgaatctgatttcgcagaggcattgcacagagactttgtgagtgcaggctggccgagctcactcggtatgttaattgatacgggtcgtaacggctggggaggacctaaccgtccgactgccgctgtcggcagtgatattaactcctatgtgaactcaggccgcgtagacaaacgctcgcatcgtggtaactggtgtaataacagcggagcaggtatgggtacgccgccgcagacagctccagcttcccatgtcgatgcttatgtatgggcgaaacctccgggtgattccgatggttccagctcgctcattccgaacgatgagggtaaaggctttgaccgatattgcgatcctacctatacaaccaaggatggcacattaacagatgctttaccgaatgcacctatttcaggagcttggttccatgatcagtttgttatgcttgtgcaaaatgcatatccagcgattgtcccttcatccggtggcggaacaactcctacaccatccgctccggcagtaccagcgggcttaaaggcgacagcgggtaatgcggaagtgaagctgacctggaatgcgtccactggggccgacagctacacggtaaaacgtgcaaccagcgaagcaggtccttttacaaccgttgcgcctcttgttactgagaaagagtacacggataagggactgaccaacggaacaacttatttctatgtcttaagtgctacgaatacgacaggaacaagcaaggattccactgcggtaagcgccgaaccaaaaggtacaccgatagatccaacggaccctacagatcctacagaaccagcgggtgatctggttgtaatgtatcgggccggggacaccgatccagctaataactcagccaagcccttcttaaatctaaaaaataaaggtacaacacccgtgaagctgagtgagctgaaagtccggtattatttcacgaaagatggcagccaggagctgcaatctgcagtagactatgcgcaagtaggcaatgataatgtgctgcgtaccattacagacaactatattgaaattggtttcaatgctgctgccggcacgcttgctgctggagcgcaaacaggtgatattcagatccgcatcaacaatagcgactggtctagcctggacgaatccaatgactactccttcgatccaaccaaaacctcttatacagagtggaataaagtaatgttgttccataacgataagcaggtgtggggaatcgaaccttag

SEQ ID NO: 1162 - DNA, 2256 bp, Paenibacillus sp.
gtgaaacaattgaaaacaaagcaagtgcttcgtaaaggcatgaagtatgcttttgcgttatcactcgtcgcaggtagtcttttaccaactacaggatttacaggaaaaataagtgcagaatctcatgtggacaacccttatatcggggcaacaaaatatattagtcctgattacgccgctttcgtcgattcatcaattgccaaggttaccgatgctaagctgaaagcgaaaatgcaaaccgtcaaatcgttcccgacatccgtatggctcgaccgtatcgctgccattaacgggactgcagacaatcttggcctggaagcgcatttggatcaagtattggcccaaaagaaaggcgacactccaattacggcagagtttattatatatgatctgcccggacgggattgtcatgccttggcttccaacggtgagcttccgctgacccaagcaggtctggaaacatacaaaaaggattatgtcgacaagattgctgagatccttgccaaccccaaatataaggacattcgtatcgtaacgatcattgaaccggacagtttaccgaacctggtaaccaatatgagcgatccaaaatgtgctcaagccaaatccaccggtatctatgaaaccggcattcagtacacaatcaacaaactgaacgaaattcctaacgtatacaaatacgtagatatcggtcactccggctggctcggttgggataacaaccgttcagcaacagtttccctgtataccaacgttttcagaaacacatctaaaggactgtccagcgtagacggctttatcaccaatacagccaactctacgccgctggttgagcctaatctgactgattccaacctgaatattaatggacagccgatcaagtcttccaagtattacgaatggaatccttacttcgatgagctgcatttcacagaaggtctgcacagagattttgtaaatgcaggctggccaagtactctcggtatgctgattgataccggccgtaacggctggggtggaccgaaccgtccaactaaagctacaggtaacgatattaattcgtacgtgaactcaggccgtgtggacagacgtgaccatcgcggtaactggtgtaacaacagtggcgcaggtatggggacacctcctgaaaccgctccagcttcccatgtcgatgcatatgtatgggcgaaacctccgggtgcttccgacggctccagctcgctcattccgaacaatgagggcaaaggctttgaccggatgtgtgatcctacttacacaaccagtgacggcgtattgacaggcgcattgccaaatgctccgatttctggtgcttggttccatgatcagttcgttatgctcgtgaacaatgcatatccagcaatcaaagctgccgatggtagcgtagacccagcacctacgccaacacctacaccaacaccaaccccagaagctccggcagtaccggcagacttacagggaaaattgggagtgaaggtgacttgggctgcttccactggtgcccaaagctacacagtgaagcgtgctaccagtgaagcaggtccttttacaacggttgcgtctcgtgtaacaggcacagaatacacggatacagatttgacgaatggaacgacttactattatgtaataagtgctacgaatgcaaatggttcaagcaaggattcggctgtagtgaaagtgactgttggatcgaaggctactacaccaacaaatcctacagatccaacaccaacaccagatccaacccctacaccagaaccaacaccaacaccaacaccagatccaactccgactccaacagaacctgcaggtgacctgtctgttctgtaccgggctggagataccgatccaacgaataatgcaattaaaccattttttaacgtaaaaaataacggaacaactcctgtgaagttgagtgacctgaaaatccgctactacttcactaaagagggtaaccaagacatgcagtctgcagtggactgggcacaaataggtaatgataacgtgctgcgtacctttacagacaaatatattgaaattggtttcagtcctgctgctggcacgcttgctgctggagcacaaacaggtgaaattcaagtccgtattaacaaaaacgactggtctaatcacgatgaatccaatgactactcgttcgatccaaccaaatcctcttatacagaatggaacaaagtaacgttgttccaaaatgatcagctggtatggggaatcgagccttaa

SEQ ID NO: 1163 - DNA, 1035 bp, Paenibacillus sp.
atgaagcaacgaaggcaaacatggacgagaattgtgtttcttatcatctcttgcttattgcttttcgtgatctccggatttgtgtatgagtggattgcatccaagaaggataaatcacaatacccacctccgggggaattggtcgatgccgggggctatcgacttcatattcgtaaactcggtaacggttctccaacaatattgcttgaatcagggagcggggaaagtagcctctcctggagagatattcccgaaaagctgtcatcattcgccaccgttgtatcctatgatcgggcaggctatgcatggagcgaggaggcaaatacaccacgcaccggggaaaacatcgttcgggagcttcatactgctttaaagaatgcggacatccgacctccttatatccttgtaggtcattccctcggggggatgtactcaagactgtacgcgcagacgtacagagacgaagtggcaggattggttctggtggatgccaggcctgagaatgacgcccgacggacaaataagatctatgccaaggaacggcctaaggccaatccctccccgttaatatccattctcctagaaaaatcaggggcttttcgcctgttccccaattttatgctgacgggtcgggtcgaatatcaagatagaaaatcttttgtgaatattgtcgcttcttctaaatactttcggtctgttgcagaggagggtgacctagcgagcactaccgaagatgccatacggggacaacatctgggtaatctccctgtacgtgtaattgctcggggcattcaacaagatttggctcagttcggtattagtaaacgcggaaatgatcagattgaacaaagctggcaaatcggacagcgcgagatgcttaacatctctacaaacagcaaattaattgttgccaagaaaagcgagcatatgatcatccatgatcaaccggagcttgtcatccaagtcatccgtgaactcatcaccaacaccagtcactttcagtcaaccacgtctaaagcatacacagatgattag

SEQ ID NO: 1164 - DNA, 1035 bp, Paenibacillus sp.
atgaagcaacgaaagcgaacatggacgagaattgtgtttcttatcatctcttgcttactacttttcgtgatctctggatttgtgtatgagtggattgcatccaaaaaggataaatcacaatacccgcctccgggggaattagtcgatgccgggggctatcgacttcatattcgtaaactcggtaacggctctccgacaatattgcttgaatcagggagtggggaaagtagcctgtcctggagagatattcccgaaaagctgtcatcattcgccactgttgtatcctatgaccgggcaggctatgcctggagcgaggaggctgctactccacgaaccggggaaaacatcgttcgggagcttcatctcgccttaaaaaacgcagacatccaagctccttatatcctggtaggccattctctcggagggatgtactcaagactgtacgcgcagacctacaaagacgaagtggcaggattggttctggtggatgccaggcctgagaatgacgctcgccggacaaatgagatctatgccaaagaacgacctaaggtcaatccctccccgttaatatccattctcctagaaaagtcaggagcatttcgcctgtttcccaattttatgctaacgggtcgagtcgaatatcaagatagaaactcttttgtgaatattgtcgcttcttctaagtactttcgatctgttgcggaggaaggtgatctagcaagcactaccgaagatgccatacggggacagcatctgggcaacctccctgtacgtgtaattgcccggggcgttcaacaagatttgactcagttcggtattagtaagcgcggaaatgatcagatcgaacaaagctggcaaatgggacagcgcgagatgcttaacatctctacaaacagcaaatttattgttgccaagaagagcgagcatatgatcatccatgatcaaccggagcttgtcatccaggtcatccgtgaactcatcaccgacaccagtcattttcagtcaaccatgtctaaagcatacacagatgattag

SEQ ID NO: 1165 - DNA, 1035 bp, Paenibacillus sp.
atgaagcaacgaaggcgaacatggacgagaattgtgtttcttatcatctcttgcttattgcttttcgtgatctctggatttgtgtatgagtggattgcatccaaaaagaataaatcacaatacccacctccgggggaaatggtcgatgccgggggctatcaacttcatattcgcaaactgggtagcggctctccgacaatattgcttgaatcagggagcggggaaagtagcctgtcctggagagatattcccgaaaagctgtcatcattcgctaccgttgtatcctatgaccgggcaggctatgcctggagcgaggaggctgctactccacgaaccggggaaaacatcgttcgagagcttcatgtcgccttaaagaacgcagacatccaagccccttatattctggtaggccattctctcggagggatgtactcaagactgtacgcgcagacctacaaagacgaagtggcaggattggttctggtggatgccaggcctgagaatgacgctcgccggacaaatgagatctatgccaaggaacgacctaaggtcaatccctccccgttaatatccattctcctagaaaagtcaggagcttttcgcctgtttcccaattttatgctaacaggtcgagtcgaatatcaagatagaaaatcttttgtgaatattgtcgcttcctctaaatactttcgatctgttgcggaggagggtgacctggcgaacactaccgaagatgccatacggggacagcatctgggtaacctccctgtacgtgtgatagcccggggcattcaacaagatttgactcagttcggtattagtaaacgcggaaacgatcagatcgaacaaagctggcaaatgggacaacgcgagatgcttaacatctctacaaacagcaaatttattgttgccaagaagagcgagcatatgattatccatgatcaaccagagcttgtcatccaagtcatccgtgaactcatcaccgacactagacactttcagtcaaccatgtctaaggcaaatacagatgattag

SEQ ID NO: 1166 - DNA, 1035 bp, Paenibacillus sp.
atgaagcaacgaaggcgaacatggacgagaattgtgactcttatcatctcttgcttactgcttgtcgttatctctggatttgtgtatgagtggattgcatccaaacaggataaattgcagtacccccctctgggggaaatggtcgacgccggggaatatcgacttcatattcacaaacttggtagcggctctccgaccatactgcttgaatcggggagtggggaaagtagcctgtcctggagagatattcccgaaaagctgtcatcattcgccaccgttgtatcctatgaccgggcaggctatgcctggagcgaggaggctgctactccacgaaccggggaaaacatcattcgggagcttcatgtcgccttaaagaatgcaaacattcaggctccttatattcttgtaggccattccctcggggggatgtactcaaggctgtatgcacaaacgtacagagacgaggtggcaggattggtcctggtggatgccaggcctgagaatgacgcccgtcggacaaatgagatctatgccaaggaacgacctaagggcaatccctcgccgttactatccattctcctagaaaagtcgggggctttccgtctgttccccaattatatgctaacgggtcgtgtcgagtatcaagatagaaaatcttttgtgaatattgtcgcttcccccaaatactttcgatctgttgccgaggagggtgatctggcgagcactaccgaagatgccatacgagggcagcatctgggtaacctccctgtacgtgtgattgcccggggcatccaacaagatttgactcagttcggtattagtaaacgcggaaatgatcagatcgaacaaagctggcaaattggacagcgcgagatgcttaacatctctacaaacagcaaatttattgttgccaagaagagcgagcatatgattatccatgatcaaccggagcttgtcatccaagtaatctgtgaactcatcaccgacaccagtcactttcagtcaaccatgtctaaagcatacacagatgattag

SEQ ID NO: 1167 - DNA, 1035 bp, Paenibacillus sp.
atgaaacaacgaaggcgaacctggacaagagtcgtatttggggttatctcttgcttactgcttgttgttatctctggatttgtgtatgagtggattgcatccaaacatgataagtcgcaacatcctcctctggggagaatggtcgacgctggaggctatcgtctccatattcataaaataggtgctggctctccgacgatcgtgcttgaatcaggaagcggggaaagtagcctgtcctggagggatattcccgagaagctgtcatccttcgccaccgttgtatcttatgatcgggcaggctatgcatggagcgaggaggcaaatacaccacgcaccggtgaaaacatcgttcgggagcttcatactgctctaaagaatgcagacatccaacctccttatatctttgtaggtcattctctcggggggatgtactcaaggctttatgcacaaacatacagaaaagaagtagcaggactggttctagtggatgctaggcctgagaatgatgctcgccggaccaataagatctatgccaaagaacgacctaagggcaatccctcgccactcatatccattctcctagaaaaagcaggggctttccgtctgtttcccaattttatgctaaacggacgggtggagtatcgagatagaaaatcttttgtgaatattgttgcttcccctaagtacttccgctctgttgccgaggagggtgatctggcgagcactaccgaagatgccatacgcggccagcatttgggtaacctccctgtgcgtgtgatagcccgaggcatccagcaagatttgactcagtttggtattagcaagcgtggaaatgatcagatcgaacaaagctggcaaattgggcaacgcgagatgctcaatatctctaccaatagtaaatttattgttgccaagaagagcgagcatatgattattcatgatcaaccagagcttgtcattcaagtcatccgtgagctcatctccaatatccattattctcggtcaaccgttgctaaaacaaacactgatcattag

SEQ ID NO: 1168 - DNA, 1035 bp, Paenibacillus sp.
atgaagcaacgaaggcaaacttggacgaaaattatgttttgggtcatctcttgcttactgcttgtcgttatctctggatttgtgtatgagtggattgcatccaaacaggataaatcgcaatatcctcctccgggggaaatggtcgatgccgggagccatcaacttcatattcgaaaacttggtagcggctctccgacaatactgcttgaatcggggagtggggaaagcagcttatcctggagggatattcccgaaaagctgtcaacattcgcaactgttgtatcctatgaccgggcaggctacgcctggagcgaggaggctgctactccacgcaccggagaaaatatcgttcgagagcttcatgtcgccttaaagaatgcagacatccaagctccttatatccttgtaggtcattccctcggagggatgtactcaagattgtacgcacaaacgtacgacgatgaggtggcaggaatgattctggtggatgccaggcccgagaatgacgctcgccggacccaggagatctatgccaaggaacggcctaaggtcaatccctcgccgttaatatccattctcctaaaaaggtcaggggcttttcgtctgttccctaattttatgctaactggtcgtgtcgagcatcaggatagaaaatcgtttgtgaatattgttgcttcccccaaatactttcgatctgttgccgaggaaggggatttggcgaacacaaccgaaaatgccatacgtgggcagcatttgggaaacctccctgtgcgtgtgattgcccggggcatccagcaagatttgactcagttcggtattagcaagaacggaaatgatcagatcgaacaaagctggcagatggggcagcgtgaaatgctcaacatctctacaaacagcaaatttattgttgccaagaagagtgaccatatgattatccatgatcaacccgagctggtcattcaagtcatccgtgaactaatctccaacaccagtcacccgcggtcaacctttgctaaatcaaagacagatgattag

SEQ ID NO: 1169 - DNA, 1035 bp, Paenibacillus sp.
atgaaacaacgaaggctgacctggacgaaagttgtgttttgggttatctcttgcttactgcttgttgttatctctggatttgtgtatgagtggattgcatccaaacatgataagtcgcaacatcctcctctggggagaatggtcgacgctggaggttatcgtctccatattcataaaatgggtgccggttctccaacgatagtgcttgaatcagggagcggggaaagtagcctttcttggagagatattcccgagaagctatcatcctttgccaccgttgtatcctatgatcgggcaggctatgcatggagcgaagaggcaaatactccacgtaccggggaaaacatcgttcgggagcttcataccgctctaaaaaatgcagacatccaagctccatatatccttgtaggccattccctcggggggatgtactcaagactctatgcacagacgtacagagacgaagtcgcaggattggttctggtggatgctaggcctgagaatgatgcccgccggacaaataagatctatgccaaagaacggcctaaggttaatccctcgccgctcatatccattctcctagaaagatcgggggcttttcgtctgttccccaacttaatgctaaacggtcgggtggagtatcgagatagaaaatctttcgtgaacattgttgcttcccccaagtactttcgctctgttgccgaggagggtgatctggcgagcactaccgaagatgccatacgcgaccagcatttgggcaacctctctgtacgcgtaattgcccgaggcattcagcaaaatttgactcagttcggtataagtaagcgtggaaatgatcagatcgaacaaagctggcaaatcgggcagcgcgagatgctccacatctctaacaacagcaagcttatcgtcgccaaaaagagcgaacatatgattatccatgatcaacctgagctcgtcattcaagtcatccgtgatctcatctccaatatccattattctcggtcaaccattgctaaaacaaacactgatcattaa

SEQ ID NO: 1170 - DNA, 1602 bp, Paenibacillus sp.
ttgacacgtaacaaacgcttaagaagattgtccaccgccatgttaacggtgcctatgctcacgatgttcgcttcaggtgcaatggcagagcaggaattgaacagacataagcctccggtttctactggaagcggcgtattttatgaaatttatatcaattctttttatgattcgaatggagacggacacggtgatttgaaaggaatcacacaaaaacttgattacttaaacgatggcaaaccccattcgggtaaggatttgcaggtcagcggcctctggcttatgcccctaaatccatctccaagctaccataaatatgatgtaactgattactatcagttggacccgcagtatgggagtctaaatgattttcgcaccttgatgaaagaagcggaccgaaagggcgtcaaggtgatcatggaccttgttatcaatcattcgagcagcgagcacccatggtttaaggaggccagtgccaacccacaaagcaaataccacaactattacgtatgggcggatgagaacacggatctggaagaaaagggatcgtggggtcagcaggtatggcataagaatccgaacggcgaaggatatttctacggtacattctggtcgggcatgccggatctgaactttgacaatcccgaagtccgcaaagaaatgatcaaagtaggcaagtattggctgcagcagggtgcagacgggttccggcttgacgcggcgatgcatatttttagaggacagacgaaggatggtgcggataagaacatcgcctggtggaatgaattccgttccgagatggagaaggtgaatccaaatgtatatctggcaggagaggtatgggacaaaccggagaccatagctccttatttcggaccactccactccctatttaattttgacctgggtggaacgattttgaactccgtgaaaaacggccgagatcagggtatcgcgacattcgccgagaaaacgctgcaactgtacaaatcgtataataaggcagcactcgatgctccgttcttgagcaaccatgaccagacccgtgtcatgagcgaactgggcggggatgtgcgaaaagccaagctggccgcttccattcttttgacgcttccgggtcagcctttcctgtattacggggaagaaatcggcatgaagggagagaagcctgatgagtatcttcgtgagcctatgcgctggtacaagggagatggccctggtcaaacgacgtgggagaaacccaaatacaacacaggcgaggtatcggtggaagcgcagctgagggacgatgattccttactggagagctatcgcacactcatccgtctgagggaagaacatgaagctttacgtagcgacagtctgcaacctatacaagcaggttctgccagcgtgaccgcgtttaaacgtacttcaggcaaagaaacaatgtatgtatatcataacctgtctggagagtcggttaccttgcagataaaagatttcgataagggtaaatggaaagtgatcttttccacctcaaaggatgtaaaggtgaagaaaggaacagttacaattccggcttacagttctctaattaccgaagaagacagaaagagctga

SEQ ID NO: 1171 - DNA, 1602 bp, Paenibacillus sp.
ttgacacgtaacaaacgcttgagaagattgtccaccgccatgttaacggtgcctatgctcacgatgttcgcttcaggtgcaatggcagagcaggaattgaacagacataagcctccggtttctactggaagcggcgtattttatgaaatttatatcaattctttttatgattcgaatggagacggacacggtgatttgaaaggaatcacacaaaaacttgattacttaaacgatggcaaaccccattcgggtaaggatttgcaggtcagcggcctctggcttatgcccctaaatccatctccaagctaccataaatatgatgtaactgattactatcaggtggacccgcagtatgggagtctaaatgattttcgcaccttgatgaaagaagcggaccgaaagggcgtcaaggtgatcatggaccttgttatcaatcattcgagcagcgagcacccatggtttaaggaggccagtgccaacccacaaagcaaataccacaactattacgtatgggcggatgagaacacggatctggaagaaaagggatcgtggggtcagcaggtatggcataagaatccgaacggcgaaggatatttctacggtacattctggtcgggcatgccggatctgaactttgacaatcccgaagtccgcaaagaaatgatcaaagtcggcaagtattggctgcagcagggtgcagacgggttccggcttgacgcggcgatgcatatttttagaggacagacgaaggatggtgcggataagaacatcgcctggtggaatgaattccgttccgagatggagaaggtaaatccaaatgtatatctggcaggagaggtatgggacaaaccggagaccatagctccttattacggaccgctccactccctgtttaattttgacctgggtggaacgattttgaactccgtgaaaaacggccgagatcagggtatcgtgacattagccgagaaaacgctgcaactgtacaaatcgtataataaggcggcactcgatgctccgttcctgagcaatcatgaccagacccgtgtcatgagcgaactgggcggggatgtgcgaaaagccaagctggccgcttccattcttttgacgcttccgggtcagcctttcctgtattacggggaagaaatcggcatgaagggagagaagcctgatgagtatcttcgtgagcctatgcgctggtacaagggagatggccctggtcaaacgacgtgggagaaacccaaatacaacacaggcgaggtatcggtggaagcgcagctgagggacgatgattccttactggaaagctatcgcacactcatccgtgtgagggatgaacatgaagctttacgcagcgacagtctgcaacctatacaagcaggttctgccagcgtgaccgcatttaaacgtacttcaggcaaagaaacaatgtatgtatatcataacctgtctggagagccggttaccttgcagataaaagatttcgataagggtaaatggaaagtggtcttttccacctcaaaggatgtaaaggtgaagaaaggaacagttacaattccggcttacagttctctaattaccgaagaagacagaaagagctga

SEQ ID NO: 1172 - DNA, 1602 bp, Paenibacillus sp.
ttgacacgtaacaaacgcttaagaagattgtccaccgccatgttaacggtgcctatgctcacgatgttcgcttcaggtgcaatggcagagcaggaaatgaacggacataagcctccggtttctactggaagcggcgtattttatgaaatttatatcaattctttttatgattcgaatggagacggacacggtgatttgaaaggaatcacacaaaaacttgattacttaaacgatggcaaaccccattcgggtaaggatttgcaggtcagcggcctctggcttatgccccttaatccatctccaagctaccataaatatgatgtaactgattactatcaggtggacccgcagtatgggagtctaaatgatttccgcaccttgatgaaagaagcggaccgaaagggcgtcaaggtgatcatggaccttgttatcaatcattcgagcagcgagcacccatggtttaaggaggccagtgccaacccacaaagcaaataccacgactattacgtatgggcggatgagaacacagatctggaagaaaagggctcgtggggtcagcaggtatggcataagaacccgaatggcgaagggtatttctacagtacattctggtcgggcatgccggatctgaactttgacaatcccgaagtccgcaaagaaatgatcaaagtcggcaagtattggctgcagcagggtgcagacgggttccggcttgacgcggcgatgcatatttttagaggacagacgaaggatggtgcggataagaacatcgcatggtggaatgaattccgttccgagatggagaaggtaaatccaaatgtatatctggcaggagaggtatgggacaaaccggagaccatagctccttattacggaccgctccattccctgtttaattttgacctgggtggaacgattttgaactccgtgaaaaacggccgagatcagggtatcgcggcattcgccgagaaaacgctgcaactgtacaaatcgtataataaggcggcactcgatgctccgttcctgagcaatcatgaccagacccgtgtcataagcgaagtgggcggagatgtgcgaaaagccaagctggctgcttccattcttttgacgcttccgggtcagccgttcctctattatggggaagaaatcggcatgaagggagagaagcctgatgagtatcttcgtgagcctatgcgctggtacaagggagatggccctggtcaaacgacgtgggagaaacccaaatacaacacaggcgaggtatcagtggaagcgcagctgagggacgatgattccctgctggaaagctatcgcacactcatccgtctgagggaagaacatgaagctttacgcagcgacagtctgcaacctatacaagcaggttctgccagcgtgaccgcatttaaacgtacttcaggcaaagaaacactatatgtatatcataacctgtctggagagccggttaccctgcagatgaaagatttcgataagggtaaatggaaagtggtcttctccacctcaaagaatgtaaaggtgaagaaaggaacagttacaattccggcttacagttctctaattaccgaagaagacagaaagagctga

SEQ ID NO: 1173 - DNA, 1602 bp, Paenibacillus sp.
ttgacacgtaacaaacgcttaagaagattgtccaccgccatgttaacggtgcctatgctcacgatgttcgcttcaggtgcaatggcagagcaggaaatgaacggacataagcctccggtttctagtggaagcggcgtattttatgaaatttatatcaattctttttatgattcgaatggagacggacacggtgatttgaaaggaatcacacaaaaacttgattacttaaacgatggaaaaccccattcgggtaaggatttgcaggtcagcggcctctggcttatgccccttaatccatctccaagctaccataaatatgatgtaactgattactatcaggtggacccgcagtatgggagtctaaatgatttccgcaccttgatgaaagaagcggaccgaaagggcgtcaaggtgatcatggaccttgttatcaatcattcgagcagcgagcacccatggtttaaggaggccagtgccaacccacaaagcaaataccacgactattacgtatgggcggatgagaacacagatttggaagaaaagggctcgtggggtcagcaggtatggcataagaatccgaatggcgaagggtatttctacggtacattttggtcgggcatgccggatttgaactttgacaatcccgaagtccgcaaagaaatgatcaaagtcggcaagtattggctgcagcagggtgcagacgggttccggctagacgcggcgatgcatatttttagaggtcagacgaaggatggtgcggataagaacatcgcttggtggaatgaattccgttccgagatggagaaggtaaatccaaatgtatatctggcaggagaggtatgggacaaaccggagaccatagctccttattacggaccgctccattccctgtttaattttgacctgggtggaacgattttgaactccgtgaaaaacggccgagatcagggtatcgcggcattcgccgagaaaacgctgcaactgtacaaatcgtataataaggcggcactggatgctccgttcctgagcaaccatgaccagacccgtgtcatgagcgaactgggcggggatgtgcgaaaagccaagctggctgcttccattcttttgacgcttccgggtcagccgttcctctattacggggaagaaatcggtatgaagggagagaagcctgatgagtatcttcgtgagcctatgcgctggtacaagggagatggccctggtcaaacgacgtgggagaaacccaaatacaacacaggcgaggtatcggtggaagcgcagctgaagaacgatgattccctgctggaaagctatcgcacactcatccgtctgagggaagaacatggagctttacgcagcgacagtctgcaacctatacaagcaggttctgccagcgtgaccgcatttaaacgaacttcaggcaaagaaacactgtatgtatatcataacctgtctggagagccggttaccctgcagatgaaagatttcgaaaagggtaaatggaaagtggtcttctccacctcaaagaatgtaaaggtgaagaaaggaacagttacaattccggcttacagttctctaattaccgaagaagacagaaagagctga

SEQ ID NO: 1174 - DNA, 1602 bp, Paenibacillus sp.
ttgacacgtaacaaacgcttaagaagattgtccaccgccatgttaacggtgcctatgctcacgatgttcgcttcaggtgcaatggcagagcaggaattgaacggacataagcctccggtttctactggaagcggcgtattttatgaaatttatatcaattctttttatgattcgaatggagacggacacggtgatttgaaaggaatcacacaaaaacttgattacttaaacgatggaaaatcccattcgggcaaggatttgcaggtcagcggcctctggcttatgcccctaaatccatctccaagctaccataaatatgatgtaactgattactatcaggtggacccgcagtatgggagtctaaatgatttccgcaccttgatgaaagaagcgcaccgaaagggcgtcaaggtgatcatggaccttattatcaatcattcgagcagcgatcacccatggtttaaggaggccagtgccaacccacaaagcaaataccacgactattacgtatgggcggatgagaacacagatctggaagaaaagggctcttggggtcagcagatatggcataagaatccgaatggcgaagggtatttctacggtacattctggtcgggcatgccggatctgaactttgacaatcccgaagtccgcaaagaaatgatcaaagtcggcaagtattggctgcagcaaggtgcagacgggttccggcttgacgcggcgatgcatatttttagaggacagacgaaggatggggcggataagaacatcgcctggtggaatgaattccgttccgagatggagaaggtaaatccaaatgtatatctggcaggagaggtatgggacaaaccggagaccatagctccttattacggaccgctccactccctgtttaattttgacctgggtggaacgatcttgaactccgtgaaaaacggccgagatcagggtatcgcgacattcgccgagaaaacgctgcaactgtacaaatcgtataataaggcggcactcgatgctccgttcctgagcaaccatgaccagacccgtgtcatgagcgaactgggcggagatgtgcgaaaagccaagctggctgcttccattcttttgacgcttccaggtcagccgttcctctattacggcgaagaaatcggcatgaagggagagaagcctgatgagtatcttcgtgagcctatgcgctggtacaagggagatggacctggtcaaacgacgtgggaaaaacccaaatacaacacaggcgaggtatcggtggaagcgcagctgagggacgatgattccttactggaaagctatcgcacactcatccgtctgagggaagaacatgatgctttacgcagcgacagtctgcaacctatacaagcaggttctgccagcgtgaccgcttttaaacgtacttcagacaaagaatcattgtatgtatatcataacctgtctggagagccggttaccttgcagatgaaagatttcgataagggtaaatggaaagtggtcttctccacctcaaaggatgtaaaggtgaagaaaggaacaattacaattccggcttacagttctctaattaccaaagaagacagaaagagctga

SEQ ID NO: 1175 - DNA, 1602 bp, Paenibacillus sp.
ttgacacgtaacaaacgcttaagaagattgtccaccgccatgttaacggtgcctatgctcacgatgttcgcttcaagcgcaatggcagagcaggaatcgaacggacataagcctccggtttctactggaagcggcgtattttatgaaatttatatcaattctttttatgattcgaatggagacggacatggtgatttgaaaggaatcacacaaaagcttgattacttaaacgatggaaaaccccattcgggtagggatttgcaggtcagcggcctctggcttatgcccctaaatccatctccaagctaccataaatatgatgcaactgattactatcaggtggacccacagtatgggagtctaaatgatttccgcaccttgatgaaagcagcggaccgaaagggcgttaaggtgatcatggaccttgttatcaatcattcaagcagcgagcatccatggttcaaggaggccagtgccaacccgcaaagcaaattccacgactattacgtatgggcggatgagaacacagatttggaagaaaagggctcgtggggtcagcaggtatggcataagaatccgaatggcgaagggtatttctacagtacgttctggtcgggcatgccggatctgaactttgacaatcccgaagtccgcaaagaaatgatcaaagtcggcaagtattggctgcagcaaggtgcagacgggttccgacttgacgcggcgatgcatatttttagaggacagacgaaagatggtgcggataagaacattgcctggtggagtgaatttcgttccgagatggagaaggtaaatccaaatgtatatctggcaggagaggtatgggacaaaccggagaccatagctccttattacggacagctccactccttgtttaattttgacctgggcggaacgattttgaagtccgtgaaaaacggccgagatcagggtatcgcggcattcgccgagaaaacgctgcaactgtacaaatcatataataaggcggcactcgatgctccgttcctgagcaaccatgaccagactcgtgtcatgagcgagctaggcggggatgtgcgaaaagccaagctggccgcttccattcttttaacgcttccgggtcagccgttcctctattatggcgaagaaattggtatgaagggagagaagcctgatgagtttcttcgtgagcctatgcgctggtacaagggagagggccctggtcaaacgacatgggagaaacccaaatacaacaaaggcgaggtatcagtggaagcgcagctgagagacgatgattccctgctggaaagctatcgcacactcatccgtctgagggaaaaacatgaagctttacgcagcgacagtctgcaacctatacaagcaggctctgccagcgtgaccgcatttaaacgtacttcaggcaaagaagcactgtatgtatatcataacctgtctggagagccggttaccttgcagatgaaagattccgataagggtaaatggaaagtggtcttctccacctcaaaggatgtgaaggtgaagaaaggaacagttaaaattccggcttacagttctctgattaccgaagaagacagaaagagctga

SEQ ID NO: 1176 - DNA, 1602 bp, Paenibacillus sp.
ttgacacgcaacaaacgcttaagaaaattgtccaccgccatgttaacggtgcctatgctcatgatgttcgcttcaggtgcaatggccgagcaggaaatgaacgggcataagcctccagtttctactggaagcggcgtgttttatgaaatttatattaattctttttatgattcgaatggagacgggcatggtgacttgaaagggattacacaaaagcttgattacctaaacgacggcaagccaagctcgggtcaggatctacagatcagcggtctctggctcatgccactcaatccgtccccaagctaccataaatacgatgtaaccgactactatcaagtggatcctcagtatggaaatctgaatgatttccgcaccttgatgaaagaagcgcaccgaaaaggcatcaaggtgatcatggatcttgttatcaatcattcgagcagcgatcatccttggttcaaggaggccagcgccaacccgcaaagcaaatatcgcgactattacgtgtgggcagataagaacactgatctagatgaaaaaggctcatggggacaacaggtatggcataagaatccgaatggtgaagggtatttctacggaacattctggtcaggaatgccggatttgaactttgacaatcccgaggttcgtgaagaaatgatcaaggtcggcaagtattggctgcagcagggtgcagacgggttccggcttgacgcagcgatgcatatttttaaaggacagacaaaggagggggccgataaaaacatcgcctggtggaatgagttccgctccgagatggagaaggtaaatccaaatgtatatctcgcaggggaggtatgggacaaaccggagacgatagctccttacttcggaccgcttcactccctctttaattttgacctgggcggaacgatgttgaattccataaaaaatggtcgggatcaggggattgcgacattcgccgagaaaacgctgaaattgtacaaatcgtacaataaggcgacactcgatgctccattcctgagcaaccatgatcagacccgtgtcatgagcgaactgggcggggatgtgcgaaaagccaagctggccgcttcgattcttttgacgttgccagggcagccgttcctttattacggggaagaaatcgggatgaagggtgaaaagcctgatgagtatttacgagagcctatgcgctggtacaagggagatggccccggtcaaacgacgtgggagaaacccaaatacaacacaggcgaggtatcggttgaagcgcagctgcggaacgatgattccctactggaaagctaccgcaagctcatccgtctgagggaagaacatgaagctctccgcagcgacagtctggaaacgatccaaacaggaactgccagcgtaaccgcatataaacgcacttcaggcaaagaaacattatatgtatttcataacctgtccggagagtcggttaccctgcagattaaagattcggataagggcaagtggaaagtggtcttttctacctcgaaggatgtgaaggtgaagaaaggaacagtcatgattccagcctacagctctctgattaccaaagaagatagaaagagctga

SEQ ID NO: 1177 - DNA, 1602 bp, Paenibacillus sp.
ttgacacgtaacaaacgcttaagaagattgtccaccgccatgttaacggtgcctatgctcatgatgttcgcttcaggtgcaatggccgagcaggaaatgaatgggcataagcctccagtttctactggaagcggcgtgttttatgaaatttatatcaattctttttatgattcgaatggagatggacacggtgatttgaaaggaattacacaaaagcttgattacttaaacgacggcaaactccgttcaggcaaggatctgcaggtcagcggcctctggctcatgcccctcaatccgtctccaagctaccataaatacgatgtaaccgactactatcaagtggattcgcagtatgggaatctgaatgatttccgtaccttgatgaaagaagcgcaccaaaagggtatcaaggtgatcatggaccttgttatcaatcattcgagcagcgagcacccttggttcaaggaggccagcgccgacccgcaaagcaaataccatgactattacgtatgggcagataagaacgcagatctggatgaaaaaggctcgtggggacaacaggtatggcataagaatccgaatggtgaagggtatttctacggtacgttctggtcgggaatgccggatttgaactttgacaatcccgaagttcgcaaagaaatgatcaaggtcggcaagtattggctgcagcagggtgcagacgggttccggcttgacgcggcgatgcatatttttaaagggcagacgaaggagggtgccgataaaaacatcgcctggtggaatgaattccgttccgagatggagagggtaaatccaaatgtatatctggcgggggaggtatgggacaaaccggagacgatagctccttactacggaccgcttcactccctgtttaattttgacctgggcggaacaattctgagctccataaaaaatggccgggatcagggtattgcgacattcgccgagaaaacgctgaaattgtacaaatcgtacaataaggcggcactcgatgctccattcctgagcaaccatgaccagacccgtgtcatgagcgagctaggcggggatgtgcgaaaagccaaactggctgcttcgattcttttgacgttgccggggcagccgtttctttattacggggaagaaatcggcatgaagggagagaagcccgatgagtatctacgggagcctatgcgctggtacaagggagatggccccggccaaacgacgtgggaggaacccaaatacaacactggcgaagtatcggtcgaagcgcagctgcaggacgatgattccttgctgcaaagctaccgcacgctcatccgtctaagggaagaacatgaagctctccgcagcgacagtctggaaccggtccaaacagattctgccagcgtaaccgcatttagacgcacttcaggcaaagaaacattgtatctatatcataacctgtccggagaaccggttaccctgcagatcaaagatttggataaaggcaagtggaaagtggtcttctccacctcaaaggatgtgaaggtgaagaaaggaacggtcatgattccggcctacagttctctgattatcaaagaagacagaaagagctga

SEQ ID NO: 1178 - DNA, 1602 bp, Paenibacillus sp.
ttgactcgtaacaaacgcttaagaaaatggtccacgatcctgttaacggtgcctatgctcacgatgttcgcctcaagtgcaatggccgagcaggatatgaacgggcataagcctccgacttctgctggaagcggcgtgttttacgaaatttatatcaattctttttatgattcgaacggggacggacatggtgatttaaaaggtattacgcaaaagcttgattacttaaacgacggcaatccccgttcgggtaaggatttgcaggtcagcggtctctggctcatgccactgaatccgtctccaagctaccataaatatgatgtaactgactactatcaagtggacccgcagtacgggaatctgaatgatttccgcaccttgacgaaagaagcaaaaagaaaaggtgtcaaggtgatcattgaccttgttatcaatcattcaagtagcgagcacccttggttcaaggaggctagtgccaacccgcaaagcaaataccatgactattacgtatgggctgatgagaatacaaacctggatgaaaagggatcatggggccagcaggtatggcataagaatccgaatggcgaagggtatttttacggtaccttctggtccgggatgccggatctgaattttgataatcccgaagtccgcaaggaaatgatcaaagtcggtaagtattggctacagcaaggtgcagacggcttccggcttgatgcggcgatgcatatttttaaagggcaaacgaaggacggtgccgataaaaacattgcgtggtggaatgaattccgttccgagatggaaaagataaatccaaacgtatatctggcaggagaggtatgggataaaccggagacaatagctccttattacgaatcgctccactctctgtttaattttgacctgggcggaacgatattgaactctgtgaaaaacggtcgagatcaaggtattgctacattctccgagaaaacgctgaagctgtacaaatcatacaataaggcggcactcgatgctccatttttaagcaatcatgaccaaacccgagttatgagcgagctgggcggggatgtacgaaaagccaagctggctgcatccattcttttgacgttgccgggtcagccgtttctctattatggggaagagatcggcatgaagggagagaagcccgatgagtatcttcgagagcctatgcgctggtacaagggagaaggcctcggtcaaacaaagtgggaggaacccaaatacaacaaaggcgaagtatcggtggaagcgcagttgcgggacaatgattctctgctggaaagctaccgcacgcttatccgtctgagggaagaacatgaggctcttcgcagcgacagtctagagccgatccaagcaggttctgccagcgtgacggcatacaaacgttcttcaggcaaagaaacattgtatgtatatcataatctgtcaggagagccggttaccatccagatgaaagatcgagataaggaaaagcggaaagtggttttctctacctcaaaggatgctaaagtaaggaaagaaacggtgacgattcccgcttacagttctttaattacccaagaagatagaaagagctga

SEQ ID NO: 1179 - DNA, 1602 bp, Paenibacillus sp.
ttgactcgtaacaaacgcttaagaaaatggtccacgatcctgttaacggtgcctatgctcacgatgttcgcctcaagtgcaatggccgagcaggatatgaacgggcataagcctccgaattctgctggaagcggcgtgttttacgaaatttatatcaattctttttatgattcgaacggggacggacatggtgatttaaaaggtattacgcaaaagcttgattacttaaacgacggcaatccccgttcgggtaaggatttgcaggtcagcggcctctggctcatgccactgaatccgtctccaagctaccataaatatgatgtaactgactactatcaagtggacccgcagtacgggaatctgaatgatttccgcaccttgacgaaagaagcaaaaagaaaaggtgtcaaggtgatcattgaccttgttatcaatcattcaagtagcgagcacccttggttcaaggaggctagtgccaacccgcaaagcaaataccatgactattacgtatgggctgatgagaatacaaacctggatgaaaagggatcatggggccagcaggtatggcataagaatccgaatggcgaagggtatttttacggtaccttctggtccgggatgccggatctgaattttgataatcccaaagtccgcaaggaaatgatcaaagtcggtaagtattggctacagcaaggtgcagacggcttccggcttgatgcggcgatgcatatttttaaagggcaaacgaaggacggtgccgataaaaacattacgtggtggaatgaattccgttccgagatggaaaagataaatccaaacgtatatctggcaggagaggtatgggataaaccggagacaatagctccttattacgaatcgctccactctctgtttaattttgacctgggcggaacgatattgaactctgtgaaaaacggtcgagatcaaggtattgctacattctccgagaaaacgctgaagctgtacaaatcatacaataaggcggcactcgatgctccatttttaagcaatcatgaccaaacccgagttatgagcgagctgggcggggatgtacgaaaagccaagctggctgcatccattcttttgacgttgccgggtcagccgtttctctattatggggaagagatcggcatgaagggagagaagcccgatgagtatcttcgagagcctatgcgctggtacaagggagaaggcctcggtcaaacaaagtgggaggaacccaaatacaacaaaggcgaagtatcggtggaagcgcagttgcgggacaatgattctctgctggaaagctaccgcacgcttatccgtctgagggaagaacatgaggctcttcgcagcgacagtctagagccgatccaagcaggttctgccagcgtgacggcatacgaacgttcttcaggcaaagaaacattgtatgtatatcataatctgtcaggagagccggttaccatccagatgaaagatcgagataaggaaaagcggaaagtggttttctctacctcaaaggatgctaaagtaaggaaagaaacggtgacgattcccgcttacagttctttaattacccaagaagatagaaagagctga

SEQ ID NO: 1180 - DNA, 1602 bp, Paenibacillus sp.
ttgactcgtaaccaacgcttaagaaaatggtccacaatcctgttaacggtgcctatgctcacgatgttcacctcaggtgcaatggccgagcaggatatgaacgggcataagcctccgaattctgctggaagcggcgtgttttacgaaatttatattaattctttttatgattcgaatggggacggacatggtgatttaaagggtattacacaaaagcttgattacttaaacgatggcaatccccgttcgggcaaggatttgcaggtcagcggtctctggctcatgccactgaatccgtctccaagctaccataaatatgatgtaactgattactatcaggtggacccgcagtacgggaatctgaatgatttccgcaccttgacgaaagaagcgaaaagaaagggtgtcaaggtgatcatcgaccttgttatcaatcattcgagcagcgagcacccttggttcaaggaggccagcgccaacccgcaaagcaaataccatgactattacgtatgggcagatgagaatacaaatctggatgagaagggatcatggggccagcaggtatggcataaaaatccgaatggcgaagggtatttctacggtaccttctggtcggggatgccggatctgaactttgacaatcccgaagtctgcaaggaaatgatcaaagtcggcaagtattggctacagcagggtgcagacggattccggcttgatgcggcgatgcatatttttaaagggcaaacgaaggatggcgcagataaaaacattgcgtggtggaatgagttccgttccgagatggaaaagataaatccaaatgtatatctggcaggagaagtatgggataaaccggagacaatagctccttattacgaatcgctccactctctgtttaattttgatctgggcggaacgattttgaactccgtgaaaaacggccaggatcagggtatcgcaacattcgcagagaaaacgctaaagctgtacaaatcatacaatagggcggcactcgatgctccgttcctaagcaatcatgaccagacccgtgttatgagcgagctgggcggggatgtgcgaaaagccaaactggctgcatccattcttttgacgctgccgggccagccatttctctattacggggaggagatcggcatgaagggagagaagcccgatgagtttcttcgggagcctatgcgctggtacaagggagaaggtctcggtcaaacgaagtgggaggagcccaaatacaacaaaggcgaagtatcggtggaagcgcagttgcgggacaatgattccctgctggcaagctaccgtacgcttatccgcctgagggaagaacatgaggctcttcgcagcgacaatctagaaccgttccaagcaggttctgccaacgtggcggcatacaaacgttcctcaggcaaagaaacattgtatatatatcataacctgtcaggagagccggttaccctccagatgaaagattgggataagcagaagaggaaagtagtcttctccagctcaaaggatttgaaagtaaagaaagatacggtgaagattcccgcctacagctctttgattaccaaagaagatagaaagagctga

SEQ ID NO: 1181 - DNA, 249 bp, Paenibacillus sp.
atgttgaaaaaaatgaagataatggttgttgttgcattaatgatttcaagctttggagcggcagtagcatttgctgaaaacagtcaaaacaatatgggcacaaacgacaatggtagaacacaaatgctgactactaataataatgatgacgataatgataatgataattggggatggcttggtcttttggggttaattggattagcaggtttaaagcgtcgcgaccatgaaaattccaagaaaagataa

SEQ ID NO: 1182 - DNA, 249 bp, Paenibacillus sp.
atgttaaaaaaaatgaagataatggttgttgttgcattaatgatttcatgttttggagcggcagtagcatttgctgaaaacggtgataccaatatgggcacaaacgataatggtagaacacaaatgctgactactaataataacgataacgataacgataatgataattggggatggcttggtctgttggggttaattgggttggcgggtttaaaacgtcgcgagcctgaaaaccacaaaaaaagataa

SEQ ID NO: 1183 - DNA, 252 bp, Paenibacillus sp.
atgttgaaaaaagcgaagataatggttgttgttgcattaatgatttcaagttttggagcggcagtagcatttgctgaaaacagtgaaaacaatatgggcacaaataacaatggtagaacacaaatgctgactactaataatgatgacgataatgataatgataatgataattggggatggcttggtctgttggggctaattggattggcaggtttaaaacgtcgcgaccatgaaaaccccaagaaaagataa

SEQ ID NO: 1184 - DNA, 249 bp, Paenibacillus sp.
atgttgaaaaaaatgaagataatggctgttgttgcattaatgatttcaagctttggagcggcagtagcatttgctgaaaacagtcaaaacaatatgggcacaaacgacaatggtagaacacaaatgctaactactactaataataatgataacgataataataataattgggggtggcttggtctgttggggttaattggattggcaggtttaaaacgtcgcgagcctgaaaaccacagtaaaagataa

SEQ ID NO: 1185 - DNA, 249 bp, Paenibacillus sp.
atgttgaaaaaaatgaagataatggctgttgttgcattaatgatttcaagctttggagcggcagtagcatttgctgaaaacagtcaaaacaatatggacacaaacgacaatggtagaacacaaatgctaactactactaataataatgataacgataataataataattgggggtggcttggcctgttgggactaattggcttggcaggtttaaaacgtcgcgagcctgaaaaccacagtaaaagataa

SEQ ID NO: 1186 - DNA, 258 bp, Paenibacillus sp.
atgttgaaaaaaatgaagataattgttgttgttgcattaatgatttcatgttttggagcggtagtagcatttgctgaaaacagtgaaaccaatatgggcacaaacgacaatggtagaacacaaatgctgactactaataataatgatgacaataatgataatgataattggggatggcttggtctgttggggttaattggattggcaggtttaaaacgtcgcgaccatgaaaaccacaaaaaagataatcgtaaataa

SEQ ID NO: 1187 - DNA, 1722 bp, Paenibacillus sp.
atgttaaaacgaagacccgtttcattgctgtcgttgacgcttgccattaccctgttgttatctacgttcgcatccgttgccgctgctgccgaatctgacggacaagcaccacaagctgcggctgcgagcagcatgcaatcgtatgtggaagccatgcagcctggatggaatttaggaaattctctggatgctgtgggggcggatgaaacagcctggggcaatccgcgcattacccaggcgttgatccagcaaattgctgcccaagggtacaaaagcatacgcatcccggtcacctgggataagcacattggagcagcaccgaactataccgttgagtctgcctacatgaaccgtgtggaagaggttgttcgctgggcactggatgctaatctgtacgtcatgattaatgtccatcatgattcatggacgtgggtaagcagtatggagcccaaacatgatgaggtgctggctcgctataacgcattatggacacaaattgccccacgctttaaagaccagcctaacaagctgatgttcgaaagtattaacgaaccccgtttctccgaaggagggactacggatgaaacgaaaatgaatcagatgctccaagaactgaatgtatccttccacaaaattgtccgcgcctctggcggtaagaatgccactcgtccccttgttctgcctggcttggatacttcacctgctcaggccaaaatcaacgagctgtataacacgataaccaagctgaatgatcccaatctgattgccaccgtccactattatggttattggcctttcagtgtaaatattgcgggccatactacttttgataaagatactaaaaacgatatcatccaaacctttgataacgtctataacacctttgtagccaaaggtattccggttattgtaggtgaattcggtctactcggcttcgataaaaatacaggcgttattgaacaaggcgaaaagctgaaattcttcgagtatttaacctattacatgaaagagaagaaaataacaggtatgctctgggataacggccagcattttaaccgcacaacgtacaaatggtctgatcccgagctctttaatgttattaaagccagtctaaaagggcgttcctccaatgcagccagtgacctcattcacttgaagaagggcactcctgctcaggatgccaaggtcaccttaaacctgaatggcaatcagctgaaaacactcagtgtcaacaacaggcaactgacacagggcaccgactatacgctgagcggagatacattaaccttaaaagccagcttgctcaccagcctgaccacttccggtaaatatggggagaatgccgtcattaccgctaagtttaacaagggggcagactggaacttcaaagtagtcgtgtatgataccccaaaattaagcgctgtcgaagggactacacaagcctttactattccaacagaattccacggtagccagctcgccacgatggaagccgtttataccaatggtggcaatgccggtccacaggattggacgccttataaagagtttggcaatacttttgcccctgcctatgatgccaatggcatcaagctgctacctgaattttttaatagtgtaaaagatggtgaagtcacgctgaagttccatttttggagcggcgatgtggtgacatacaagatcaccaagagcggaacccgtgtaacgggaacgacatcctaa

SEQ ID NO: 1188 - DNA, 1722 bp, Paenibacillus sp.
atgttaaaacgaagacccgtttcattgctgtcgttgacgcttgccattaccctgttgttatctacgttcgcatccgttgccgctgctgccgaatctgacggacaagcaccgcaaactgcggctgcgagcagcctgcaatcgtatgtggaagccatgcagcctggatggaatttaggaaattctctggacgctgtcggggcggatgagacagcctggggcaatccgcgcattacccaggcgttgatccagcaaattgctgcccaagggtacaaaagcatacgcatcccggtcacctgggataaacacattggagcagcaccgaactataccgttgagtctgcctacatgaatcgtgtggaagaggttgtccgctgggcactggatgccaatctgtatgtcatgatcaatgtccatcatgattcatggacgtgggtaagcagtatggagcccaaacatgatgaggtgctggcacgctatagcgcactatggaaacaaattgccccacgctttaaagaccagcctaacaagctgatgtttgaaagtattaacgaaccccgtttctctgaagggggaacaacggatgaagcaaaaatgaatcagatgctccaagaactgaatgtatccttccacaaaatcgtccgcgcctccggcggtaaaaatgccactcgcccccttgttctgcctggcttggatacatcacctgctcaggccaaaatcaacgagctgtataacacgataaccaagctgaacgatcccaacctgattgcaaccgtccactattatggcttctggcctttcagtgtaaatattgccggccatactacttttgatacagataccaaaaacgatattatccaaacctttgataacgtctataacacctttgtagccaaaggtattccggtcattgtcggtgaattcggtctgctcggcttcgataaaaatacaggcgttattgaacaaggcgaaaagctgaaattcttcgagtttttgacctattatatgaaagagaagaaaataacaggcatactttgggataacggccagcattttaaccgcacaacgtacaaatggtctgatcctgaactctttaatgtcattaaatccagcctaaaagggcgttcctctaatgcagccagtgacctcattcacttgaagaaaggcacctctgctcaggacgccaaggtcattttaaacctgaacggcaatcagctgaaaacactcagtgtgagcagcaagcaactgaaacagggcactgactatacgctgagcggagacacattaaccttcaaagccagcttactcaccagcctgaccacttccggtaaatatggggagaatgccgtcattaccgctaagtttaacaagggggcagactggaatttcaaagtagttgtgtatgatactccaaagttaagtgctgtcgaagggactacacaagcctttaccattccaacggacttccgtggtagccagcttgccacgatggaagccgtttatacgagtggtggcaatgccggtccacaggattggacaccgtataaagagtttggcaatacctttgcccctgcctatgatgccaacggtatcaagctgttacctgaattttttaatagtgtaaaagatggcgaagtcacgctgaagttccacttctggagtggcgatgtggtgacatacaagatcaccaagagcggaaaccgtgtgacgggaacgacatcttaa

SEQ ID NO: 1189 - DNA, 1722 bp, Paenibacillus sp.
atgttaaaacgaagacccgtttcattgctgtcgttgacgcttgccatcaccctattattatctacgttcgcatccgttgccgctgctgccgaatctgacggacaagcaccgcaagctgcggctgcgagcagcctgcaatcgtatgtggaagccatgcagcctggatggaatttgggaaattctctggatgctgtcggggcagatgagacagcctggggtaatccgcgcattactcaggcgttgattcagcaaattgctgcccaagggtacaaaagcatacgcatccccgtcacctgggataagcacattggagccgcaccaacctataccgttgagtctgcctacatgaaccgtgtggaagaggttgttcgctgggcactggacgccaatctgtacgtcatgatcaatgtccatcatgattcatggacgtgggtaagcagtatggaacccaaacatgatgaggtgctggctcgctataacgcattatggacacaaattgccccgcgctttaaagatcagcctaacaagctaatgtttgaaagcattaacgaacctcgtttctccgaaggagggactacggatgaagcgaaaatgaaccagatgctccaggaactgaatatatccttccacaaaattgtccgtgcttctggcggtaaaaatgccactcgtccccttgttctgcctggtttggacacctcacctgctcagaccaaaatcaatgagctgtacaacacgataaccaagctgaacgatcccaacctgattgccaccgtccactattatggttattggcctttcagtgtaaatattgcaggccatactacttttgataaagatactaaaaacgatatcatccaaacctttgataacgtctataacacctttgtagccaaggggattccggttattgtcggtgaatatggcctgctcggcttcgataaacatacaggcgtgattgaacagggcgaaaagctaaaattcttcgagttcctgacctactacatgaaggagaagaaaataacaggcatactctgggataacggccagcattttaatcgcacaacgtacaaatggtctgaccctgaactctttaatgttattaaggccagcctaaaagggcgttcctccaatgcagaccgtgacctcattcacttgaagaaaggcacccctactcaggataccaagattactttaaacctgaacggcaatcagctgaaaacactcagtgtgagcagcaagcaactgacacagggcaccgactatacgctgagcggagatacattaacgttcaaggccagcttgctcaccagcctgaccacttccggtaaatatggggagaatgccgccattaccgctaagtttaacaagggggcagactggaattttagagtcgtcgtgtatgataccccaaaattaagtgctgtcgaagggactactcaagcctttaccattccaacagacttccgtggtagccagcttgccacgatggaagccgtgtatacgaatggtggtaatgccggtccacaggattggacaccttataaagaatttggcaataccttttcccctgcctatgatgccaatgggatcaagctattgcctgaattttttaatagtgtaaaagatggtgaagtcacgctaaagttccacttctggagtggcgatgtggtgacatacaaaatcactaagagcggaacccgtgtaacgggaacgacatcttaa

SEQ ID NO: 1190 - DNA, 1722 bp, Paenibacillus sp.
atgttaaaacgaagacccgtttcattactgtcgttgacgcttgccatcaccctattattatctacgttcgcatccgttgccgctgctgccgaatctgacggacaagcaccgcaagctgcggctgcgagcagcctgcaatcgtatgtggaagccatgcagcctggatggaatttgggaaattctctggatgctgtcggggcagatgagacagcctggggtaatccgcgcattactcaggcgttgattcagcaaattgctgcccaagggtacaaaagcatacgcatccccgtcacctgggataagcacattggagccgcaccaacctataccgttgagtccgcctacatgaaccgtgtggaagaggttgttcgctgggcactggacgtcaatctgtacgtcatgatcaatgtccatcatgattcttggacgtgggtaagcagtatggaacccaaacatgatgaggtgctggctcgctataacgcattatggacacaaattgccccgcgctttaaagatcagcctaacaagctaatgtttgaaagcattaacgaacctcgtttctccgaaggagggactacggatgaagcgaaaatgaaccagatgctccaggaactgaatatatccttccacaaaattgtccgtgcttctggcggtaaaaatgccactcgtccccttgttctgcctggtttggacaccgcacctgctcagaccaaaatcaatgagctgtacaacacgataaccaagctgaacgatcccaacctgattgccaccgtccactattatggttattggcctttcagtgtaaatattgcaggccatactacttttgataaagatactaaaaacgatatcatccaaacctttgataacgtctataacacctttgtagccaaggggattccggtcattgtcggtgaatatggcctgctcggcttcgataaacatacaggcgtgattgaacagggcgaaaagctaaaattcttcgagttcctgacctactacatgaaggagaagaaaataacaggcatactctgggataacggccagcattttaatcgcacaacgtacaaatggtctgatcccgaactctttaatgttattaaagccagcctaaaagggcgttcctccaatgcagaccgtgacctcattcacttgaagaaaggcacctctgctcaggacaccaaagtcaccttaaacctgaacggcaatcagctgaacacactcagtgctaacagcaagcaactgaaacagggcaccgactatacgctgagcggagatacattaacgttcaaggccagcttgctcaccagcctgaccacctccggtaaatatggggagaatgccgccattaccgctaagtttaacaagggggcagactggaattttagagtcgtcgtgtatgataccccaaaattaagtgctgtcgaagggactactcaagcctttaccattccaacagacttccgtggtagccagcttgccacgatggaagccgtgtatacgaatggtggtaacgccggtccacaggattggacaccctataaagaatttggcaataccttttcccctgcctatgatgccaatgggatcaagctattgcctgaattttttaatagtgtaaaagatggtgaagtcacgctaaagttccacttctggagcggcgatgtggtgacatacaaaatcactaagagcggaacccgtgtaacgggaacgacatcttaa

SEQ ID NO: 1191 - DNA, 1722 bp, Paenibacillus sp.
atgttaaaacgaagacccgtttcattgctgtcgttgacgcttgccatcaccctattgttatctacgttcgcatctgttgccgctgctgccgaatctgacggacaagcaccgcaaactgcggctgcgagcagcatgcaatcgtatgtagaagccatgcagcctggatggaatttaggaaattctctggatgctgtcggggcggatgagacagcctggggcaatccgcgcattacccaggcgttgatccagcaaattgctgcccaaggttacaaaagtattcgtattcccgtcacctgggataagcacatgggagcagcacccaactataccgttgagtctgcctacatgaaccgtgtggaagaggttgttcgctgggcactggatgccaatctgtacgtcatgatcaatgtccatcatgattcatggacgtgggtaagcagtatggagcccaaacatgatgaggtgctggcacgctataacgcattatggacacaaattgcccaacgctttaaagatcaacccaacaagctgatgtttgaaagtattaacgaaccccgtttctctgaagggggaacaacggatgaagcaaaaatgaatcaaatgcttcatgagctgaatgtatccttccacaaaatcgttcgcgcctccggtggtaaaaatgccactcgtccccttgtcctgtctggtctggatgcttcacctactcaggccaaaatcaacgagctgtacaacacgataaccaagctgaacgatcccaatctgattgcgaccgttcactattatggcttctggcctttcagtgtgaacattgccggatatactacctttgagaaagataccaagaacgatattgttcaaacctttgataacgtctataacacctttgtagccaagggaatcccggttattgtcggtgaatacggtctgctcggtttcgataaacatacaggtgttattgaacagggcgaaaagctgaaattcttcgagtttttgacccattacatgaaagagaagaaagtaacaggcatgctctgggataacggccaacacttgaaccggacaacgtacaaatggtctgatcccgaactctttaatgttattaaagccagcctaaaagggcgttcctccaatgcagatcgtgacctcattcacttgaagaaagactctcctgttcaggataccaaggtcactttaaacctgaacggcaatcagttgaaatcactccataccggcagtaagcaactgaaacaggacaccgactacacgctgagtggagacacattaaccttcaaagccagcttgctcaccagcctgaccacttccggtaaatatggcgagaatgccgtcattacggctaagttcaacaaaggggcagactggaatttcaaagtagtcgtgtatgatacacccaaattaagtgcagtcgaagggactacacaagcctttaccattccaacagacttccgtggtagccagcttgcgacgatggaagccgtgtatacgaatggtggaaatgccggtccacaggattggacaccttataaggaatttggcaatacctttgcccctgcctatgatgccaatggcatcaagctgctgcctgaattttttaatagtgtaaaagatggcaaagtcacgttgaagttccatttctggagcggcgatgtggtgacatacaaaatcaccaagagcggaacccgtgtaacgggaacgacatcttaa

SEQ ID NO: 1192 - DNA, 1722 bp, Paenibacillus sp.
atgttaaaacgaagacccatttcattgctgtcgttgacgcttgccattaccctattattatccacgttcgcatccgtggccgctgctgctgaaacggacgaacaagcacaaccagctgctgcaacaagcaatatgcagtcatacgtggaagccatgcagcctggatggaatttaggaaattcgctggatgctgtcggggcggatgagaccgcctggggcaatccgcgcattacccaagctttgatccagcaaattgctgcccaagggtacaaaagtattcggattcccgtcacctgggataagcatattggagccgcaccccattataccgttgagtctgcctacatgaaccgtgtggaagaggttgttcgctgggcactggatgccaatttgtatgtcatgattaatgtccatcatgattcatggacgtgggtaagcagtatggagcccaagcatgatgaagtgttagcacgctataacgcattatggacacaaattgccgaccgctttaaaaatcagcccaacaagttgatgtttgaaagtattaacgagccccgcttttctgaagggggaacaacggatgaagcgaaaatgaatcagatgcttcatgagctaaatgtatccttccacaaaatcgttcgcgcctccggtggtaagaatgccactcgtccccttgttctgcctggattagatacttcacctgctcaggccaaaatcaacgaactgtataacacgataaccaagctgaacgatcccaacctgattgcaaccgttcactattatggcttctggcctttcagtgtgaacattgccgggaatacaacatttgataaagcttcccaaaacgatattgttcaaacctttgataatgtctataacacctttgtagccaagggaatcccggttattgtcggtgaatatggcctgctcggttttgataaacatacaggtgttattgaacagggtgaaaagctgaagttttttgaatttttgacttattacatgaaagagaagaaagtaacaggcatgctctgggataacggccagcatttgaatcggagcacttacaagtggtctgatcctgaactttttaatgtcattaaggccagcctgaaaggacgttcctccaatgcagctagtgatctcattcacttgaagaaaggctcttctgttcaggataccaagatcactctaaacctgaccggcaaccagttgaaatcgctcaatgtcaacagcaagcagctgaaacagggcaccgactatacgctgagtggagatacattaaccttcaaagccagcttgctcaccagccttattacttccggtaaatatggtgagaatgccgtcattaccgccaagtttaataagggggcagattggaattttagagtcgtcgtgtatgatacaccgaaattaagtgctgtcgaagggactacacaagcctttaccattccaacagacttccgtggtagccagcttgcgacgatggaagccgtgtatacgaatggtggcaatgccggtccacaggattggacaccttataaagagtttggcaatacttttgcccctgcctatgatacgaatggcatcaagctgttgcctgaatttttcaacagtgtgaaggatggtgaagtcacgttgaagttccacttctggagcggcgatgtagtgacatacaaaatcaccaagaacggaacccgcgtgacgggtacgacatcttaa

SEQ ID NO: 1193 - DNA, 1722 bp, Paenibacillus sp.
atgttaaaacgaagacccatttcattgctgtcgttgacgcttgccatcaccctattgttatccacgttcgcatccgttgccgctgctgctgaaacgaacgaacaagcacaaccagctgctgcaacaagcaatatgcagtcatacgtggaagccatgcagcctggatggaatttaggaaattcgctggatgctgtcggggcggatgagaccgcctggggcaatccgcgcattacccaagctttgatccagcaaattgctgcccaagggcacaaaagtattcggattcccgtcacctgggataagcatattggagccgcaccccattataccgttgaatctgcctacatgaaccgtgtggaagaggttgttcgctgggcactggatgccaatttgtatgtcatgattaatgtccatcatgattcatggacgtgggtaagcagtatggagcccaagcatgatgaagtgttagcacgctataacgcattatggacacaaattgccgaccgctttaaaaatcagcccaacaagttgatgtttgaaagtattaacgagccccgcttttctgaagggggaaccacggatgaagcgaaaatgaatcagatgcttcatgagctaaatgtatccttccacaaaatcgttcgcgcctccggtggtaagaatgccactcgtccccttgttctgcctggattagatacttcacctgctcaggcaaaaatcaacgaactgtataacacgataaccaagctgaacgatcccaacctgattgcaaccgttcactattatggcttctggcctttcagtgtgaacattgccgggaatacaacatttgataaagcggcccaaaacgatattgttcaaacctttgataatgtctataacacctttgtagccaagggaatcccggttattgtcggtgaatatggcctgctcggttttgataaacatacaggtgttattgaacagggtgaaaagctgaagttttttgaatttttgacttattacatgaaagagaagaaagtaacaggcatgctctgggataacggccagcatttgaatcggagcacttacaagtggtctgatcctgaactctttaatgtcattaaggccagcctgaaaggacgttcctccaatgcagctagtgatctcattcacttgaagaaaggctcttctgttcaggataccaagatcactctaaacctgaacggcaaccagttgaaatcgctcaatgccaacagcaagcagttgaaacagggcaccgactatacgctgagtggagatacattaaccttcaaagccagcttgctcaccagcctaattacttccggtaaatatggtgagaatgccgttattaacaccaagtttaataagggggcagattggaattttaaaatcgtcgtgtatgatacaccgaaattaagtgctgtcgaagggactacacaagcctttaccattccaacagacttccgtggtagccagcttgcgacgatggaagccgtgtatacgaatggtggcaatgccggtccacaggattggacaccttataaagagtttggcaatacttttgcccctgcctatgatacgaatggcatcaagctgttgcctgaatttttcaacagtgtgaaggatggtgaagtcacgttgaagttccacttctggagcggcgatgtagtgacatacaaaatcaccaagagcggaacccgcgtgacgggtacgacatcttaa

SEQ ID NO: 1194 - DNA, 1722 bp, Paenibacillus sp.
atgttaaaacgaagacccatttcattgctgtcgttgacgcttgccatcaccctattgttatccacgttcgcatccgtggccgctgctgctgaaacggacggacaagcacagccagctgctgccacaagcaatatgcagtcatacgtggaagccatgcagcctggatggaatttaggaaattcgctggatgctgtcggggcggatgaaaccgcctggggcaatccgcgcattacccaagctttgatccagcaaattgctgcccaagggtacaaaagtattcggattcccgtcacctgggataagcatattggagccgcaccccattataccgttgaatctgcttacatgaaccgtgtggaagaggttgttcgctgggcactggatgccaatctgtatgtcatgattaatgtccatcatgattcatggacgtgggtaagcagtatggagcccaagcatgatgaagtgttagctcgctataacgcattatggacacaaattgccgaccgctttaaaaatcagcccaacaagttgatgtttgaaagtattaacgagccccgcttttctgaagggggaaccacggatgaagcgaaaatgaatcagatgcttcatgagctaaatgtatccttccacaaaatcgttcgcgcctccggtggtaagaatgccactcgtccccttgtcctatccggtctggatgctgcacctgcccaagccaagatcagccaacttgccaacacgattactgggctgaacgatcctaatctgattgcgactgttcactattatggcttttggcctttcagtgtgaacattgccgggaatacaacttttgataaagctgcccaagacgatattattcaaacctttgataatgtctataacacctttgtagccaagggaatcccggttattgtcggtgaatatggcctgctcggttttgataaacatacaggtgttattgaacagggcgaaaagctgaagttttttgaatttttgacttattacatgaaagtgaagaaagtaacaggcatgctctgggataacggccagcatttgaatcggagcacttacaagtggtctgatcctgaactctttaatgtcattaaggccagcctgaaaggacgttcctccaatgcagctagtgatctcattcacttgaagaaaggctcttctgttcaggataccaagatcactctaaacctgaacggcaaccagttgaaatcgctcaatgccaacagcaagcagctgaaacagggcaccgactatacgctgagtggagatacattaaccttcaaagccagcttgctcaccagcctaattacttccggtaaatatggtgagaatgccgtcattaccgccaagtttaataagggggcagattggaattttaaagtcgtcgtgtatgatacgccgaaattaagtgctgtcgaagggactacacaagcctttaccattccaacagacttccgtggtagcctgcttgcgacgatggaagccgtgtatacgaatggaggcaatgccggtccacaggattggacaccttataaagagtttggcaatacttttgccccttcctatgatacgaatggcatcaagctgctgcctgaatttttcaacagtgtgaaggatggtgaagtcacgttgaagttccacttctggagcggcgatgtagtgacatacaaaatcaccaagaacggaacccgcgtgacgggtacgacatcttaa

SEQ ID NO: 1195 - DNA, 1722 bp, Paenibacillus sp.
atgttaaaacgaaaacccgtttcattgctgtcgttgactcttgccattactctagtattatctatgttcacgtccgttgccgccgctgcggaatctgacggacaagcacagccagctgccgccacaagaaatatgcaatcgtatgtggaagccatgcagccgggatggaatttaggaaattctctggatgctaccggagcagatgagacatcctggggcaatccgcgcattacccaggcgttgatccagcaaattgctgcccaaggatacaaaagcattcgtattcccgtcacctgggataagcatattggagcagcacccaattatactgttgaatctgcctacatgaaccgtgtggatgaggttgttcgctgggcgctggatgccaatctgtacgtcatgatcaatgttcatcatgattcatggatgtgggtaagcagtatggagcccaagcacgatgaagtgctggctcgctataacgcaatatggacacaaattgccaaacactttaaagataagccggacaagctgatgttcgaaagcattaacgagccccgtttcaccgaaggcggaacaaccgatgaagcgaaagcgaaccagatgctccaggaactgaatgtgtccttccacaaaattgtccgcgcctccggtggtaacaatgccactcgcccacttgttctgccgggcttggatacttcacctgcccaaaacaaaatcaatgagctgtacaacacgatgaccaagcttaaagatcccaacctgattgccaccgttcactattatggttattggcctttcagtgtgaatattgcgggccatactacttttgatcaagataccaaaaacgatattactcaaacctttgataacgtctataacacctttgtagccaaaggtattccagttattgtaggtgaattcggtctactcggcttcgataaaaatacaggcgttattgaacaaggtgaaaagctgaaattcttcgagtttttgacctattatttgaaagagaaaaaaataacaggcatactttgggataacggccagcattttaaccggacaacgtacaagtggtctgatcctgaactctttaacgtcatccgggccagcctgaaaggtcgttcctccaatgcagccagtgacctcattcacttgaagaaaggcgcttccgttcaggatgccaaggtcaccttaaacctgaatggcaatcagctgagcacactcagtgccaacagcaagcaactgaaacagggcacggactacacgctgagcggtaacacattaacgttcaaggccagcttgcttaccagcctgatcacttccggcaaatatggcgagaatgcagtcatcaatgccaaatttaacaagggtgcagactggaattttaaagtagtcgtgtatgatacaccaaaattaagcgctaccgaggggactacgcaagcctttaccattccaaccgacttccgtggcagccagcttgccacaatggaggctgtgtataccaatggcggcaatgccggtccgcaggattggacatcctataaggagtttggcaatacctttactcctgcctatgataccaatggcatcaagctgctgcctgaattctttaacagcgtgaaggatggtgaagtcacactgaagttccatttctggagcggcgatgtggtgacatacaagatcaccaagagcggaacccgtgtgacgggaaaggcatcttaa

SEQ ID NO: 1196 - DNA, 1722 bp, Paenibacillus sp.
atgttaaaccgaaaacccgtttcattgctgtcgttgactcttgccattactctagtattatctatgttcgcgtccattgccgccgctgcggaatctgacgaacgagcacggccagctgccgccacaagaaatatgcaatcgtatgtggaagccatgcagccgggatggaatttaggaaattctctggatgctaccggagcagatgagacatcatggggcaatccgcgcattacccaggcgttgatccagcaaattgctgcccaaggatacaaaagcattcgtattcctgtcacctgggacaagcatattggagcagcacccaattataccgttgagcccgcctacatgaaccgtgtggatgaggttgttcgctgggcactggatgccaatctgtacgtcatgatcaatgttcatcatgattcatggatgtgggtaagcagtatggagcccaagcacgatgaagtgctggctcgctataacgcaatatggacacaaattgccaaacactttaaagataaaccggacaagctgatgttcgaaagcattaacgagccccgtttcaccgaaggcggaacaagcgatgaagcgaaagcgaaccagatgctccaggaactgaatgtgtccttccacaaaattgtccgcgcctccggtggcaacaatgccactcgcccacttgttctgccgggcttggatacttcacctgcccaaaacaagatcaatgagctgtacaacacgatgactaagctgaacgatcgcaacctgattgccaccgtccattattatggatattggcctttcagtgtaaatatcgcgggtcataccacttttgataaagagaccaaagacgatattactcaaacctttgataacgtctataacacctttgtagccaaaggtattccggttattgtaggtgaattcggtctactcggcttcgataaaaatacaggcgttattgaacaaggcgaaaagctgaagttctttgagttcttaacctattacttgaaagagaaaaaaataacaggcatactctgggataacggccaacatttcaaccgtacagcatacaagtggtccgatcctgaactctttaatgtcatcaaggccggtttgaaaggacgttcctccaatgctgccagtgatctcattcacttgaagaaaggcactgccgttcaggatgccaaggtcaccttaaacctgaatggcaaccaactgagctccctcagtgtcaacaacaaacaactgaagaaaggcaccgactacacactgagcggtgacacattaactttcaaggccagcttgcttaccagcctgatcacttctggcaaatatggcgaaaatgcagtcatcaacgccaaatttaacaagggtgcagactggaattttaaagtagtcgtgtatgatacaccaaaattaagcgctaccgaggggactacgcaagcctttaccattccaacggacttccgtggcagccagcttgccacaatggaagctgtttataccaatggcggcaatgccggtccgcaggactggacatcctataaggagtttggcaatacctttactcctgcctatgatgccaatggcatcaagctgctgcctgaattctttaacagcgtgaaggatggtgaagtcacactgaaattccatttctggagcggcgatgtggtgacatacaagatcaccaagagcggaacccgtgtgacgggaaaggtatcttaa

SEQ ID NO: 1197 - DNA, 1728 bp, Paenibacillus sp.
atgatcaaacgaaagtacaaatcgctgctatctctgacgatggctgctgctctgctcctctcactgattccctctgccgcttcggcagcaagtacggaagaagcagtacagcccaaagctgccgctgcgacgaatatgcaatcttatgttgatgcgatgcagcccggctggaatctgggcaatactctggatgctacaggcgcagatgagacttcctggggcaaccctcgtatcactcagacactaatcaagcaaattgcggcacagggctacaaaagtatccgaattccggtaacctgggatacacatattggtgcagcgccgaattatacgatcgatccggcttatttaagtcgtgtggaagaagtcgtcaactgggcgctgaacgagaatctgtacgtaatgatcaatgtacatcatgattcctggctctggatcagcaaaatggagacccagcatgataccgtactggcacgctacaatgcggtatggaaacaaatcgccgaccgcttcaagaatagctcgaacaagctgatgtttgagagtgttaacgaaccacgctttacggatggtggtacaacagacgaaggcaaacagcagcagatgctggatgagcttaatgtctctttccacaaaattctaagagcatccggtggccagaatgcgacacgtcctctggtattgtccacgctggaggcaactccttcacaggaacgcatgacagcactgtacaacacgatgagcaagctgaatgactccaatctgatcgcaaccgttcactattatgggttctggccattcagtgtgaatattgcaggatataccaaatttaatgaagaagtacaaaaagatattacgactacatttgataacgtctacaatacctttacggctaaaggcattccagttattctcggtgaatacggtctccttggattcgataaaaataccggcgtgatcgaacagggcgaaaagcttaaatttttcgaattcctcgggtattacctgaagcagaaaaagatcgctaccgtgctgtgggataacggacagcatttcagccgtaccaactacacctggtccgatccggatctgtttaatgtaatcaaaaccagctggaccggacgttcctccaatgcggatagcgacctcatttatatcaaaaaaggaacgactattcaggacaagaaaattacgctaaatctgaatggcaatcaattatcttccttgagtgtcggcagtactacgctgcaatcgggtacagattatacactcagcggcaatatattgaccatcaaagccagccagctgaccaagttgactacttcgggcaaattcggcgtaaatgctacgatcactgccaaattcagcaaaggtgccaactggaaattcaatgttatcgtgtatgacacgccaaaactgagcaatgctcagggatctaccagctcgttcagtattccgactgcctttaatggtgatcaattggcgactatggaagcaacctatgcttctggcggtaacgcaggtccacaaaactggacctccttcaaagaattcgaaactactttctcaccagtatacagtgggaatactatcaaactacagcctgcgttcttcaacgaaaccaaggatggtcaggtaaacctgaaattccatttctggagcggtgcgattattaattacactattaccaagagcggcaccacagtaacaggtacagctgcccagtaa

SEQ ID NO: 1198 - DNA, 1077 bp, Paenibacillus sp.
atgagtaaaaagttatccgtcttggtactcactatggtgttgcttttgacggtagccctggtaggttgtagcaagaagttagaaccgaaggaagctgttacgaacggtacagctaatgcaatgaaattgaattcttatgaatccaaaagtcaattcacgattaaggaactgaccattacatccgcttctgttccaagtgagcaaagtgcaatggtaactagcatgctgaaaaatgctgatattacgttggatggtgtgtaccaaaaggaacctttccaatctgaaatgacgctcggcattcatttgaaaggggatctttccaccagcttcacgattccaatggtaatgactaaagataaactttacgttaaaattcctaatattccattttacccgcttccacaggatgttgtaggtaaattcctgatcattgatccacaagaactggctaaacaatcaggacaagaatttaaccctgcagccatggatcaggaaaaatcgcagaaatttgcgaatgaagttattgctgcgattatgaacgagtatgatcaagctacgtacttctttgatattgatcctaaagacgctaaattgccacaaggcgttgaagctaaacaagtagttcagtttaaaataacgaacgacaatgtgaagcaagcgaccaatacatttatcactaaggcgcttcctaaagttcttgatgtgatgtccaaagatgaatatgctagcatgcttcaagtgaagaaggaagagctggctgaagcgaagaaagaactgcaatccaacaccagcgaagttagcaaaaagctggatgagttgaaaaactatttgacggtgaaacagtttgacattaacacagctttgaacaaggatgacattcctgtgtatcaagacctgaatgcgaatgtagagatgaatgatccggctacaaaagacaatgtgaaattgtccgtaacaggctacacgcaatacagcaaaatcaatgctaaagcagcatttaaagtgggtattccaacaggtgatcaagtcctgactatggaacaactgcaacaaaaaatgcaaactgttgctccttaa

SEQ ID NO: 1199 - DNA, 1077 bp, Paenibacillus sp.
atgagtaaaaagttatccgtcttggtactcactatggtgttgcttttgacggtagccctggtaggttgtagcaagaagttagaaccgaaggaagcagttacgaccggtactgcaaatgcaatgaagttgaattcttatgaatccaaaagtcaatttaccgttaaggatctgacaatttcatctgctactttaccaagtgaacaaagtgcaatgataaccagtatgctgaaaaatgcagacattacgctggacggtgtatatcaaaaagaacctttccaatctgaaatgacgctcggcattcatttgaaaggtgatctttccaccagcttcacgattccaatggtgatgactaaagataaactgtacgttaaaattcctaatattccattttacccgctcccacaggatgttgtaggtaaattcctgatcattgatccacaagaactggctaaacaatcgggacaagaatttaaccctgcagctatggatcaagaaaaatcgcagaaatttgcgaatgaagtgatcgctgctattatgaacgagtatgatcaagctacgtacttctttgatattgatcctaaagacgctaagttgccacaaggcgttgaagctaaacaagtagttcagtttaaaataacgaacgacaacgtgaagcaagcaaccaatacatttatcactaaggcgcttcctaaagtccttgatataatgtctaaggacgaatatgctagcatgcttcaagtgaagaaggaagagctgtctgaagcgaagaaagaattgcaatctaacaccagcgaagttagcaaaaagctggatgagttgaaaaactacttgacagtgaagcagtttgacattaacacagctttgaacaaggataacattcctgtgtatcaagacctgaatgcgaatgtagagatgaatgatccggctacaaaagacaatgtaaaattgtctgtaacaggctacacgcaatacaacaaaatcaatgctaaagcagcatttaaagtaggtattccaacagctgatcaagtcctgacgatggaacaactgcaacaaaaaatgcaaactgttgctccttaa

SEQ ID NO: 1200 - DNA, 1077 bp, Paenibacillus sp.
atgagtaaaaaattatccgtcttggtcctcactatggtgttgctaatgacggtagcgctggtaggttgtagcaagaagttagaaccgaaggaagctgttacgactggtacagcaaatgcgatgaagttgaattcctatgaatccaaaagtcaatttaccgttaaggaactgacaattacctccgcttctgtgccagctgagcaaagtgcaatggtaactagcatgctgaaaaatgctgatattacactggatggcgtataccaaaaggagcctttccaatctgaaatgacgcttggcattcatttgaaaggtgatctttctactagctttacgattccaatggtaatgactaaagataaattgtacgttaaaattcctaatattccattttacccgcttccacaggatgttgtaggtaaattcctgctcattgatccacaagaactggctaaacaaacgggacaagaatttaaccctgcaaccatggatcaggaaaaatctcagaaatttgcgaacgaagtgattgctgcgatcatgggcgagtatgatcaagctacgtatttctttgatattgatcctaaagatgctaaattgccgcaaggcgttgaagctaaacaagtggttcagtttaaaatcacgaacgataacgtgaagcaagcgaccaatacatttatcactaaggcgcttcctaaggtcttggatataatgtctaaagacgaatatgctggcatgcttcaagtgaagaaggaagaactggctgaagcgaaaaaagaactgcaatccaacaccagcgaagttagcaaaaagctggatgagttgaagaactatttgacagtgaaacagtttgacattaacactgctttgaacaaggataacgttcctgtgtatcaagatctgaatgcgaacgtggaagtgaatgatccttctacgaaagataatgtgaagttgtctgtaacaggctactcgcaatacagcaaaatcaatgaaaaagcatcatttaaagtggggattccaacagctgaccaagtcctcactatcgaacaactacaacaaaaaatgcaaactgtatctccttaa

SEQ ID NO: 1201 - DNA, 1077 bp, Paenibacillus sp.
atgagtaaaaaattatccgtcttggtcctcactatggtgttgctaatgacggtagcgctggtaggttgtagcaagaagttagaaccgaaggaagctgttacgactggcacagcaaatgcgatgaagttgaattcctatgaatccaaaagtcaatttaccgttaaggaactgacaattacctccgcttctgtgccagctgagcaaagtgcaatggtaactagcatgctgaaaaatgctgatattacactggatggcgtaaaccaaaaggagcctttccaatctgaaatgacgcttggcattcatttgaagggtgatctttctactagctttacgattccaatggtaatgactaaagataaattgtacgttaaaattcctaatattccattttacccgcttccacaggatgttgtaggtaaattcctgctcattgatccacaagaactggctaaacaaacgggacaagaatttaaccctgcaaccatggatcaggaaaaatctcagaaatttgcgaacgaagtgattgctgcgatcatgggcgagtatgatcaagctacgtatttctttgatattgatcctaaagatgctaaattgccacaaggcgttgaagctaaacaagtggttcagtttaaaatcacgaacgataacgtgaagcaagcgaccaatacatttatcactaaggcgcttcctaaggtcttggatataatgtctaaagacgaatatgctggcatgcttcaagtgaagaaggaagaactggctgaagcgaaaaaagaactgcaatccaacaccagcgaagttagcaaaaagctggatgagttgaagaactatttgacagtgaaacagtttgacattaacactgctttgaacaaggataacgttcctgtgtatcaagatctgaatgcgaacgtggaagtgaatgatccttctacgaaagataatgtgaagttgtctgtaacaggctattcgcaatacagcaaaatcaatgaaaaagcatcatttaaagtggggattccaacagcggaccaagtcctcactatcgaacaactacaacaaaaaatgcaaactgtatctccttaa

SEQ ID NO: 1202 - DNA, 1077 bp, Paenibacillus sp.
atgagtaaaaagttatccgtcttggtactcactatggtgttgcttttgatggtagccctggtaggttgtagcaagaagttagagccgaaggaagctgttacgaccggtactgcaaatgcaatgaagttgaactcttatgaatccaaaagtcaatttaccgttaaggatctgacaatttcatccgctactctaccaagtcaacaaagtgcaatgataaccagtatgctgaaaaatgcagacattacgctggatggtgtgtatcaaaaagaacctttgcaatctgaaatgacgctgggcattcatttgaaaggtgatctttccaccagcttcacgatcccaatggttatgaccaaagataaattgtatgttaaaattccgaatattccattctacccgcttccacaggatgtagtgggtaaattcctgattattgatccacaagaactggctaagaaatccggacaagaatttaaccctgcaacgatggatcaggaaaaatcgcaaaaatttgcgaacgaagtgatcgcagcgattatgggcgagtatgaccaagctacgtatttctttgatattgatcctaaggatgctaaattgccacaaggcgttgaagctaaacaagtggttcaattcaaaattacgaacgacaatgtgaagcaagctgtcgatacatttgttactaaggcgcttccgaaagtcctggatatcatgtccaaagacgaatatgctggtatgcttcaagtgaagaaggaagaactggctgaagcgaagaaagaactgcaatccaacaccagtgaagttagcaaaaaactcgatgagttgaaaaactatttgacggtgaaacaattcgacattaacacggctttgaacaaggataacattcctgtgtatcaagacctgaatgcgaatgtggagatgaatgatccggctacaaaagacaatgtgaaattgtctgtaacaggctacacgcaatatagcaaaatcaatgaaaaagcaacatttaaagtgggtattccaacaagcgaccaagtgttgactatagaacaactgcaacaaaaaatgcaaactgtcgctccttaa

SEQ ID NO: 1203 - DNA, 1077 bp, Paenibacillus sp.
atgagtaaaaagttatccgtcttggtactcactatggtgttgcttttgacagtagccctggtaggttgtagcaagaagttagaaccgaaggaagctgttacgaccggtactgcaaatgcaatgaaactgaactcttatgaatccaaaagtcaattcacgatcaaggaactgaccattacatccgcttctgttccaagtgagcaaagtgcaatggtaactagcatgctgaaaaatgctgatattacgttggatggtgtgtaccaaaaggaacctttccaatctgaaatgacgctcggcattcatttgaaaggtgatctttccaccagttttacaattccaatggtaatgactaaagataaactgtacgttaaaattcctaatattccattttacccgcttccacaggatgttgtaggtaaattcctgatcattgatccacaagaactggctaaacaatcaggacaagaatttaaccctgcagccatggatcaggaaaaatcgcagaaatttgcgaatgaagtgattgctgcgattatgaacgagtatgatcaagctacgtacttctttgatattgatcctaaagacgctaaattgccacaaggcgttgaagctaaacaagtagttcagtttaaaataacgaacgacaatgtgaagcaagctgtcgatacatttgttactaaagcagttcctaaagctattgatattatgtcaaaagatgagtacattagcttgttccaattgaagaaagaagatcttactgcagcaaaacttgcagtagaaacaaacaccagcgattttaggaaaaagctggatgagttgaaaaactacttgacagtgaaacagtttgacattaacacagctttgaacaaggataacattcctgtgtatcaagacctgaatgcgaatgtagagatgaatgatccagctacaaaagacaatgtaaaattgtctgtaacaggctacacgcaatacagcaaaatcaatgctaaagcagcatttaaagtgggtattccaacaggggatcaagtcctgactatggaacaactgcaacaaaaaatgcaaactgttgctccttaa

SEQ ID NO: 1204 - DNA, 1077 bp, Paenibacillus sp.
atgagtaaaaagttatccgtcttggtactcacgatggtgttgcttttgacggtagccctggtaggttgcagcaagaagctagaaccgaaagaagcagttacgactggtactgcaaatgcaatgaagttgaactcttatgaattcaaaagtcaattcacagtgaaggatctgacaatttcactcgctactctaccaagtgaacaaagtgcaatgatgaccaatatgctgaaaaatgcagacattacgctggatggtgtgtatcaaaaagaacctttgcaatctgaaatgacgctcggcattcatttgaaaggtgatctctccaccagcttcacgattccaatggttatgactaaggataaattgtacgttaaagttccgaatattccgttctacccgcttccacaggacgttgtaggtaaattcctggttgtcgatccgcaagaactggctaagcaatccggacaagaattcaaccctgcagtgatggatcaggaaaaatcgcaaaaatttgcgaacgaagtgattgccgcaattatgggcgagtacgaccaagctacgtatttctttgatattgatcctaaagatgctaaactgccacaaggcgttgaagctaaacaagtggttcaattcaaaattacgaacgataatgtgaagcaagctactgatacatttattactaaggcgcttcctaaattatttgatatcatgtctaaagacgaatatgctggcatgcttcaagtgaagaaggaagaactggctgaagcaaagaaagaattgcaatccaataccagtgaagttagcaaaagtttggatgagttgaaaaattatttgacggtgaaacaatttgacattaacacagctttgaacaaggataacattcctgtgtatcaagacctgaatgctaatgtggaagtaaatgatccggatacaaaagacaatataaaattgtctgtaacaggctacacgcaatccagcaaaatcaatgaaaaggcaacatttaaagtaggtattccaacaggcgaccaagtcctgacaatcgaacaattgcaacaaaaaatgcaaactgttgctccttaa

SEQ ID NO: 1205 - DNA, 1077 bp, Paenibacillus sp.
atgagtaaaaagttatccgtcttggtactcacgatggtattgcttttgacggtagccctggtaggttgcagcaagaagctagaaccgaaggaagcagttacgactggtactacaaatgcaatgaagttgaactcttatgaatctaaaagtcaattcacagtgaaagatctgaccattacatccgctactctaccaagtgagcaaagtgcaatgataactagtatgctgaaaaatgcagacattacgctggacggcgtatatcaaaaagaacctttgcaatctgaaatgacgctgggtattcatttgaagggtgatctttccaccagcttcacgattccaatggttatgactaaagataaattgtacgttaaaattccgaatattccattctacccacttcctcaagacgttgtaggtaaattcctggttgtcgatccgcaagaactggctaagcaatccggacaagaattcaaccctgcaacgatggatcaggcaaaatcgcaaaaatttgcgaatgaagtgattgccgcgattatgggcgagtacgatcaagctacgtatttctttgacattgatcctaaagatgctaaactgccacaaggcgttgaagctaaacaagtggttcaattcaaaattacgaacgacaatgtgaagcaagctgccgatacatttgttactaaagcgattcctaaagctattgatattatgtcaaaagacgagtacattagcttgttccaattgaagaaagaagatcttaccacagtaaaacttgcagtagaaacaaacaccagcgatttcaagaaaaagctggatgagctgaaaaattatttgacggtgaaacaatttgacattaacacagctttgaacaaggataacattcctgtgtatcaagacctgaatgctaatgtggaaatgaatgatccggaaacaaaagacaatgtgaaattgtctgtaacaggctattcgcaattcagcaaaatcaatgaaaaagcaacatttaaagtaggtattccaacaggcgaccaagtcctgacaatcgaacaattgcaacaaaaaatgcaaactgttgctccttaa

SEQ ID NO: 1206 - DNA, 1062 bp, Paenibacillus sp.
atgagtaaaaagttatctgtcttgatgctcactatggtgttgcttttgacagtagccttggtcggttgcagtaagaaggacgaattaaaggaagccattacaaaaggtactgctaatgtaacgaagttgagttcttatgagttgaaaagccaattcaaaattaaagatctgtctatttcatcgaattcacttccagctattcaaaatgcgtttataaccgatacattaaaagatgcggatattacactggatggtgtgtaccaaaaagagccattacaatctgagatgacgctgggtatccatttaaagggtaattattctactccatatacgattcctatggttgtgacaaaagacaaactgtatgtgaagcttcctgatcttccttcataccgaattccgaaaaaagctataggtaagttcctggagattgatccgaagcagctcgcagagcagtctggaagcaaatttaatcctgagatcatggatcctacacaggttcaaaagttagtatctgaagttgtaagcgccttgctctctgagtatgatcaagctacgtatttctttgatattaatcctaaagatgctaaattgccacaaggcgttgaagctaaacaagtggttcaatttaaagtaacgaacgataatttgaagcaagcagcaggtgtatttattactaaggcgcttcctaaggctattgatgttatttctaaagacgaatatgcaaacatgtttcaagtgaataaagaaaaactggctgaagcgaagaaaaaactgcaatccaataccagtgaagtcagtaagaagttcaataatctgactgtgaaacagtttgacattaacacagcattggacaagaatgatattcctatgtatcaagatttaaatgcgaatgtggaatggaatgacccaacatcaaaggacaatgtgaaattgtttgtaacaggatatatgcaatacagcaaaatcaatgaaaaaacaacatttaaattgagtgttccaacaggggaccaagttcttacaatcgaacaactgcaaaaaatgaaaactgttgctccttaa

SEQ ID NO: 1207 - DNA, 1194 bp, Paenibacillus sp.
atgaagaaaaaaggaatgaaaaaaacatttttcgtcattgcctccctcgtaatgggcttcacactgtatagctatactcccgcttcagcagatgcagccagtgtgaaaggatattatcacacccaaggaaacaagattgtagacgaatccgggaaagaggcggcatttaacggtctgaactggttcggtttggaaacccctaattataccttgcatggactgtggagccgttcaatggacgacatgctagatcaagtgaagaaagaaggctacaatctgattcgtctgccttacagcaatcagttgttcgattccagttctcgtccagacagtattgattatcacaaaaaccctgatctggtcggattaactccgattcaaattatggacaagctgatcgaaaaagctggacaacgcggtattcagattatccttgaccgtcaccgtccaagctcaggtgggcaatcagagctgtggtacacatcccagtaccctgagtctcgctggattagcgactggaaaatgttggctgatcgttataaaaacaaccctaccgtcattggtgcggatttacacaatgagccacacggtcaagcaagctggggcacaggcaatgcctccacagactggcgtctggcggcacaacgtgcagggaatgcgattctgtccgtgaatccgaattggctgattctcgtagaaggtgtagaccacaatgtacaaggcaacaatagccaatactggtggggtggcaacctgacaggtgtagccaactatcctgtcgttctggacgtaccgaaccgtgtcgtatattctccacatgattacggccctggtgtgtcttcgcagccatggttcaacgatccggccttcccgtccaacttgccagcgatctgggatcaaacctggggctacatcagcaagcaaaacattgctccggtactggtcggtgaattcggcggccgtaatgttgatttgtcctcccctgaggggaaatggcaaaatgcactcgtagactatattggtgccaacaacctgtactttacgtactggtccctgaatccgaatagcggcgacacaggcggtctgctgctggatgactggactacctggaatcgtccgaagcaagatatgctgagtcgaattatgaagcctgttgttttcgtagcggaacaagcgaaagcgaccgccgaatag

SEQ ID NO: 1208 - DNA, 1194 bp, Paenibacillus sp.
atgaagaaaaaaggaatgaaaaaaacatttttcgtcattgcctccctcgtaatgggcttcacactgtatggctatactcccgcttcagcagatgcagccagtgtgaaaggatattatcatacccaaggaaacaagattgtagacgaatccgggaaagaggcggcatttaacggtctgaactggttcggtttggaaacccctaattacaccttgcatggactgtggagccgctcaatggacgacatgctagatcaagtgaagaaagaaggctacaatctgattcgtctgccttacagcaatcagttattcgattccagttcccgtccagacagtattgattatcacaaaaaccctgatttggtcggattaactccgattcaaattatggacaagctgatcgaaaaagctggacaacgcggtattcagattatccttgaccgtcaccgtccaagctcaggtgggcaatccgagctgtggtacacatcccagtaccctgagtctcgctggattagcgactggaaaatgttggctgatcgttataaaaacaactctaccgtcattggtgcggatttacacaatgagccacacggtcaagcaagctggggcacaggcaatgcctccacagactggcgtctggcggcacaacgtgcagggaatgcgattctgtccgtgaatccgaattggctgattctcgtagaaggtgtagaccacaatgtacaaggcaacaatagccaatactggtggggtggcaacctgacaggtgtagccaactatcctgtcgttctggacgtaccgaaccgtgtcgtctattctccacatgattacggccctggtgtgtcttcgcagccatggttcaacgatccggccttcccgtccaacttgccagcgatctgggatcaaacctggggctacatcagcaagcaaaacatagctccggtactggtcggtgaattcggcggtcgtaatgttgatttgtcttcttctgaggggaaatggcaaaatgcactcgtagactatattggtgccaacaacctgtactttacgtactggtccctgaatccgaatagcggtgacacaggcggtctgctgctggatgactggactacctggaatcgtccgaagcaagatatgctgagtcgaattatgaagcctgttgttttcgtagcggaacaagcgaaagcatccgcagaatag

SEQ ID NO: 1209 - DNA, 1194 bp, Paenibacillus sp.
atgaagaaaaaaggactgaaaaaaacatttttcgtcattacctccctcgtaatgggcttcacactgtatggctatactcccgcttcagtagatgcagccagtgtgaaaggatattatcacacccaaggaaacaagattgtagacgaatccgggaaagaagcggcatttaacggcctgaactggttcggtctggaaacccctaattacaccttgcatggactgtggagccgctcaatggacgacatgctagatcaggtgaagaaagaaggctacaatctgattcgtctgccttacagcaatcagttattcgattccagttcccgtccagacagtattgattaccacaaaaaccctgatcttgtcggattaactccgattcaaattatggacaagctgatcgaaaaagctggacaacgcggtattcagattatccttgaccgtcaccgtccaggctcaggtgggcaatccgagctgtggtacacatcccagtatcctgagtctcgctggattagtgactggaaaatgttagctgaccgttataaaaacaaccccaccgtcattggtgcggatttgcacaacgagccacacgggcaagcgagctggggtacaggcaatgcctccacagactggcgtctggcggcacaacgtgcagggaatgcgattctgtccgtgaatccgaattggctgattctcgtagaaggtgtagaccacaatgtacaaggcaacaatagccaatactggtggggtggcaacctcacaggtgtagccaactatcctgtcgttctggacgtaccgaatcgtgtcgtatattctccacatgattacggccctggtgtgtcttcgcagccatggttcagcgacccggccttcccgtccaacctgccagcgatctgggatcaaacctggggctacatcagcaagcaaaacatagctccggtgctggtcggtgaattcggcggtcgtaatgttgatttgtctaatactgaggggaaatggcaaaatgcactcgtagactatattggtgccaacaacctgtactttacgtactggtccctgaatccgaatagcggcgacacaggcggtctgctactggatgactgggttacctggaatcgtccgaagcaggatatgctgagccggattatgaaacctgttatttttgtagcggaacaagcgaaagcaaccgccgaatag

SEQ ID NO: 1210 - DNA, 1194 bp, Paenibacillus sp.
atgaagaaaaaaggattaaaaaaaacatttttcgtcattgcctccctcgtaatgggcttcacactgtatggctatacaccagcttctgcagatgcagccagtgtgaaaggatattatcacacccaaggaaacaagattgtagacgaatccgggaaagaagcggcatttaacggcctgaactggttcggtctggaaactcctaattacaccttgcatggactgtggagccgctcaatggacgacatgctggatcaggtgaagaaagaaggctacaatctgattcgtctgccttacagcaatcagttgttcgattccagttcccgtccagacagtattgattatcacaaaaaccctgatctagtcgggttaaacccgattcaaattatggacaagctgatcgaaaaagctggacaacgcggtattcagattatccttgaccgtcaccgtccaggctcaggcgggcaatccgagctgtggtacacatcccagtaccctgagtctcgctggattagtgactggaaaatgttggctgaccgttataaaaacaaccccaccgtcattggtgcggatttgcacaacgagccacacggtcaagcaagctggggtacaggcaatgcctccacagactggcgtctggcggcacaacgtgcagggaatgcgattctgtccgtgaatccgaattggctgattctcgtagaaggtgtagaccacaatgtacaaggcaacaatagccaatactggtggggtggcaacctgacaggtgtagccaactatcctgtcgttctggacgtaccgaaccgtgtcgtatattctccacacgattacggccccggtgtgtcttcgcagccatggttcaacgacccggccttcccgtccaacctgcctgcgatctgggatcaaacctggggctacatcagcaagcaaaacatagctccggtactggtcggtgaattcggcggtcgtaatgttgatttgtctactcctgaggggaaatggcaaaatgcactcgtagactatattggtgccaacaacctgtactttacgtactggtccctgaatccgaatagcggcgacacaggcggtctgctgctggatgactggactacctggaatcgtccgaagcaagatatgctgggtcgaattatgaagcctgttgtttccgtagcccagcaagcggaagcagcagccgaatag

SEQ ID NO: 1211 - DNA, 1194 bp, Paenibacillus sp.
atgaagaaaaaagggttcaaaaaaacatttttcgtcattgcctccctcgttatgggccttacactgtatgggtacactccaccttcggcagatgcagccagcgtgaaaggatattatcacacccaaggaaacaagattgtagatgaatccgggaaagaggccgcatttaacggtctgaactggttcggcctggaaacccctaattacaccttgcatggactgtggagccgctcaatggacgacatgctggatcaggtgaaaaaggaaggctataatctcatccgtctgccttacagcaatcagttatttgattccagctcccgtgctgacagtattgattactacaaaaatcctgatctggtcggattgactccgattcaaattatggacaagctgatcgaaaaagctggacaacgcggtattcagattatccttgaccgtcaccgcccaggctcaggtggacaatccgagctatggtatacctctcagtatcctgagtcccgctggatcagcgactggaagatgttagctgaacgttataaaaacaatcctaccgtcatcggtgcagatttacacaacgagccacacggtcaggcaagctggggaacaggcgatgtctccacagactggcgtctcgcggcgcagcgtgcagggaatgccattctgtccgtgaatccaaattggctgattctcgtagaaggtgtggaccataatgtacaaggcaacaacagccaatattggtggggcggcaacctgacaggtgtggctaattatcctgtcgtactggacgtgccgaaccgtgtcgtatattcaccacatgactatggtcctggtgtgtcttcgcagccatggttcaacgactcgaccttcccgtccaacctgccagcaatttgggatcaaacctggggctacatcagtaagcaaaacatagctccagtgctggttggtgaattcggcggtcgcaatgtcgattcgtcttcccctgagggtaaatggcaaaatgcactcgtagactatattggtgccaacaacctgtactttacgtattggtccctgaatccgaatagcggcgacacaggcggtctgctgctagatgactgggttacctggaatcgtccgaagcaggacatgctgagccggattatgaagcctgtaaatttcatagcagagcaagcgaaagcaagcgccgaatag

SEQ ID NO: 1212 - DNA, 1194 bp, Paenibacillus sp.
atgaagaaaaaagggttgaaaaaaacatttttcgtcattgcctccctcgtcatgggcttcacactgtatgggtacactccaccttcggcagatgcagccagcatgaaaggatattatcatacccaaggaaacaagattgtagatgaatccgggaaagaggccgcatttaacggtctgaactggtttggtctagaaacccctaattacactttgcatggactgtggagccgctcaatggacgacatgctggatcaggtgaagaaggaaggttataatctcatccgtctgccttacagcaatcagttattggattccagctctcgtccggacagtattgattactacaaaaatcctgatctggtcggattgactccgattcaaattatggacaagctgatcgaaaaagctggacaccgcggtattcagattatccttgaccgtcaccgcccaggctcaggtggacaatccgagctatggtatacctctcagtaccctgagtcccgctggatcagcgactggaagatgttagctgaacgttataaaaacaatcctaccgtcattggtgcagatttacacaacgaaccacacggtcaggcaagctggggaacaggcgatgtttccactgactggcgtctcgcggcgcaacgtgcagggaatgccattctgtccgtgaatccgaattggctgattctggtagaaggtgtggaccataatgtacaaggcaacaacagccaatattggtggggcggcaacctgacaggtgtagccaactatcctgtcgttctggacgtaccgaaccgtgtcgtctattcaccacatgactacggtcctggtgtgtcttcgcagccatggttcaacgattcaaccttcccgtccaacctgccagcaatctgggatcaaacctggggctacatcagtaagcaaaacatagctccggtgctggtcggtgaattcggcggtcgcaatgttgattcgtcttccgctgagggtaaatggcaaaatgcactcgtagactatattggtgccaacaacttgtactttacgtattggtccctgaatccgaatagcggcgatacaggtggtctgctgctggatgactgggttacctggaatcgtccgaagcaggacatgctgagccggattatgaagcctgcaaatttcatagcagagcaagtgaaagcaagcgccgaatag

SEQ ID NO: 1213 - DNA, 1233 bp, Paenibacillus sp.
atgaacttgtttgatggaagttgcagaacgtgccggagtgtcgaagagtacagactgaaaaaaacatttttcgtcattgcctccctcgtaatgggcttcacactgtatggctatactcccgcttcagcagatgcagccagtgtgaaaggatattatcacacccaaggaaacaagattgtagacgaatccgggaaagaagcggcatttaacggtctgaactggttcggtctggaaacccctaattacaccttgcacggactgtggagccgctcaatggacgacatgctggatcaggtgaagaaagaaggctacaatctgattcgtctgccttacagcaatcagttattcgattccagttcccgtccagacagtattgattaccacaaaaaccctgatctggtcggattaactccgattcaaattatggacaagctgatcgaaaaagctggacaacgcggtattcagattatccttgaccgtcaccgtccaagctcaggtgggcaatccgagctgtggtacacatcccagtaccctgagtctcgctggattagtgactggaaaatgttagctgaccgttataaaaacaacccaaccgtcattggtgcggatttgcacaacgagccacacggtcaagcaagctggggtacaggcaatgcctccacagactggcgtctggcggcacaacgtgcagggaatgcgattctgtccgtgaatccgaattggctgattctcgtagaaggtgtagaccacaatgtacaaggcaacaatagccaatactggtggggtggcaacctcacaggtgtagccaactatcctgtcgttctggacgtaccgaatcgtgtcgtatattctccacatgattacggccctggtgtgtcttcgcagccatggttcaacgacccggccttcccgtccaacctgccagcgatctgggatcaaacctggggctacatcagcaagcaaaacatagctccggtgctggtcggtgaattcggcggtcgtaatgttgatttgtctactactgaggggaaatggcaaaatgcactcgtagactatattggtgccaacaacctgtactttacgtactggtccctgaatccgaatagcggcgacacaggcggtctgctactggatgattgggttacctggaatcgtccgaagcaagatatgctgagtcgaattatgaagcctgttattttcgtagcggaacaagcgaaagcagcagccgaataa

SEQ ID NO: 1214 - DNA, 1194 bp, Paenibacillus sp.
atgaaaagaaagagcatgaagaagtcatttttcgtcattgcctccctcgtcatgagcttttcgctctatggctacactcccggtacagcagatgcagccagtgcaaaaggatactatcacacctcaggcagcaagattgtagacgaatccgggaaagaggcggcatttaacggcctgaactggtttggtctggaaacccctaattacaccttgcatggactgtggagccgctcaatggacgacatgctggatcaggtgaagaaagaaggttacaatctgatccgtctgccttacagcaatcagttattcgattccagttcccgtccggacagtattgattattccaaaaaccctgatctggtcggattgactccgattcaaattatggacaagctgatcgaaaaagctggacaacgcggtattcagattatccttgaccgtcaccgtccgggctcaggtggacaatccgagctgtggtacacgtcccagtaccctgagtctcgctggattagtgactggaaaatgttggctgaacgctacaaaaacaactctaccgtcatcggtgctgatttgcacaacgaaccacacggtcaggcaagctggggtacaggcaatctctccacagattggcgtctggcggcgcagcgcgcagggaatgcgattctgtccgtgaatccgaattggctgattctcgtagaaggtgtggatcacaatgtacaaggcaacaacagccaatactggtggggcggtaacctgatcggtgtcgccaactaccctgtcgtgctggacgtaccgaaccgcgtcgtgtattctccgcatgattacggtcctggtgtgtcttcgcagccatggttcaacgatcctgccttcccggccaacctgccagccatctgggatcaaacctggggctacatcagcaagcaaaacatagctccggtgctggtcggtgaattcggcggtcgtaatgtcgatatgtcctcaactgagggtaaatggcaaaatgcactcgtagactatattcgtgccaacaacctctactttacgtactggtccctcaatcctaatagtggcgacacaggtggactactgctagacgactgggttacctggaatcgtccgaagcaagatatgctgagccggattatgaagcctgtcatcttcgcagcggagcaaacgacaccagccaccgaataa

SEQ ID NO: 1215 - DNA, 1194 bp, Paenibacillus sp.
atgaaaagaaaaagcatgaagaagccatttctcgttatggcctctctcgtaatgggcttcaccttgtatggctacactcctgcttcggcagatgcagccagtgtgaaaggatattatcacacccaaggaaacaaaattgtggacgagtccgggaaggaggcagtatttaatggtttgaactggtttggtctggaaactccgaattacactctgcatggattgtggagccgttcgatggacgacgtgctggaccaggtgaaaaaagaaggctacaatctgatccgtctgccatacagtaatcagttgttcgattccacttcccgtccagacagtattgattattacaaaaatcctgatctggttggattgactccgattcaaattatggacaagctgatcgaaaaagccggacaacgcggtattcaggttatccttgaccgccaccgtgccgactccggcgggcagtccgagctgtggtacacatccaagtaccctgaatcccgttggatcagcgactggaaaatgctggccgaacgttataaagacaaccctaccgtcatcggtgcggatttgcacaacgaaccacacggtcaggcaagctggggcacaggcaacctctccacagactggcgtcttgcggcgcagcgcgcagggaatgcggttctgtccgtaaatccaaattggttgattctcgtagaaggtgtggaccacaatgtccaaggcaacaatagccaatactggtggggcggcaacctgactggtgtagccaagtaccctgtcgtgctggacgtaccgaaccgtgtcgtatattctccgcatgattacggccctggcgtgtcttggcagccatggttcaacgagtcgagcttcccgtccaacctgccagccgtctgggatcaaaactggggctacatcagcaagcaaaacatagctccggtgctggttggtgaattcggcggccgtaatgttgatttgtcttctcctgagggtaaatggcaaaatgcactcgtagactatattggtgccaacaacttgtactttacgtactgggacctgaatccaaatagcggtgacacgggtggactgctgctggacgactgggttacctggaatcgtccgaagcaggatatgctgagccgcattatgaagcccgtaacgttcgtgacgggacaagcgaaagcaacagctgaatag

SEQ ID NO: 1216 - DNA, 1656 bp, Paenibacillus sp.
atgacctttggtttcaggacactggggacaatgcttttggctttaacactgcttgcaggtacaaccgctattgccggacagccggtgaaggctgagggggcagcgaagcttttttatcacacctcgggcagccggattgtagattcgcaggggaacccggccgtgttcaacggactcaactggtttggcttcgagacgccgaactattccccgcacggattatggtcgcgttccatggatgatgtgctcgatcaggtccgcgcagaagggtacaacttgattcgcctgccgttcagcagtcaaatgttcgatccggcttcccaggccaacagcattgattatgccaaaaacccggacctggccggtctgactcccatcgaaattatggataccttaatcgaaaaagccggccagcgcggcattcaaatcttcctggaccggcatcgtcccgattccggcgggcagtcgacgctctggtataccgctgcatatcctgaatcccgctggatcagtgactgggtgatgctggctgcacggtatgcgaataatcctacggtgatcggtgccgacctgcataatgagcctcatggcccggcaagctgggggaccggtgatctcagcacagactggcggctcgcggcccagcgggctgggaatgccatccttgcggtgaatccgcactggctgatcatcgtcgaagggatcgagcagaatgtgcagggtaacaccagtaagtactggtggggcggcaacctcaccggggtgcgaaattatccggtaacgcttaccgtgccgaatcaagtggtgtattctccgcatgattacggtcccggggtggcggagcagccgtggttcagcgatccggcttttccggcgaacctgcctgctatatgggatcagacctggggttatatcagcaaagagaacattgcccctctaatcatgggtgaattcggaggccgcagcgtggacaccctctcggttgaagggaaatggcagaataaattagtcgattacatcggcacgaatgatctctactggacctactggacactgaatcccaacagcggggataccggcggtctgctgcaggatgactgggcaacctggaaccggccgaagcagctcatgctgaaccggattatgaagacggtcaccttccctcctattgaacaacctggaggccccgggacaggacctgtaaccgctactccgctctaccgcagtgatgagaccggcaacaacgtgggctccatccgggcaagtctccagctgaagagcacttccaccgtccctgtcccgctcagccaattcacgatccgttactggttcacccaggacggcagctccgcacacaccatggagattgactacgccgtcgtcggcaaaaacaatattcagaccaccatcgtcccgctcgcggttccggtcccgaacgctgatgcctacgccgaaatctccttcaagggcggggctggcagcctggcagcttccggctcgaccggagagatccagttccgtattcacaaggataactatgcgaattatagccaggccaacgattactccttccggccgctgctgaccagcttcacggccaatgaccggatcactgtataccataatggaacgctgatctatggcgtagagccgtaa

SEQ ID NO: 1217 - DNA, 1656 bp, Paenibacillus sp.
atgtcgtttgggttcaggaaactgggagtattgttcgttgcttttgtattgctggcaggtgcttattcgtatccgggttatgaagtgaaggctcaagatgcagcaggctattatcatacctcaggcagcagaatcgtggattcgtcaggcagtcctgccgtattcaacggacttaattggtttggcttcgaaaccgcgaattactctccacacgggttgtggacccgttcaatggatgatgtgctcgatcaaatcaaagcggaaggctataacctgatccggctgccttactgcaaccaaatgttcgattcaggctctgctgccaatagtattgattatgccaaaaatcccgatcttgccggtctgaagcccgttcagatcatggataaactgattgaaaaagccggaaagcgcggcatacggatcttcctcgaccggcaccggccggattctggcggacaatccacgctgtggtacactgcggcctatcccgaaacccgctggatcagtgactgggtgatgcttgctcagcgttacgcagataatcctacggtcattggagccgatctgcataatgaaccgcacggtacggcaagctgggggtcaggtaatcttgccacagactggcggctggccagcgaacgggcaggaaatgcgattctcgccgtgaatccgaactggctgattatagtcgaaggcgtcgaaaccaacgtccagggcaactccagcagctattggtggggcggtaatctgacaggtgtgcgcaataatccggtcacgcttacagtaccggatcgggtggtctattccccgcatgattacggtcctggcgtcgcttcacagccttggttcagcgctgccgatttcccgaacaatctgcccaagctgtgggatgatacctggggatacattagcaaggaacaaattgccccaatccttgcaggggaattcggcggccgcagcgtggataccctttcggtggaaggaaaatggcaacatgcgctcgtaagctacatcggccagaataacctctactggacgtactggagtcttaatccgaatagcggggataccggagggctattgctggatgactggacctcgtggaatgagccgaagcaggccatgctggaccttattatgaagccggtaacctttatccctgttggcgatcccggggaaggaccaggtacgggtgaccctcaagcggcaatactttatcgcgcaggtgaaacagggactgctgtcaattcaatccgggccagcttgcagctcaagaacgagtccggggcttctattccgctgcatgaactcaagatacgttattggtatacaagggatggaaatacggaacagaccgtggagtttgactatgcggtaataggaaaagaaaaactgctgacggaaatcgtccccttgactacgccgtcggcaggtgccgatacctatgcggagatcggttttacggcaggtgcaggctcgctcgcagctttgggcacaaccggagacatccagttccgcattcacaacaaggattggtcgaattacaatcaggctgatgattactcttttcaacccgccatcaccagttatgctgcgaatgatcatatcacggtctatcataaagggaagctgatttatgggattgaaccttaa

SEQ ID NO: 1218 - DNA, 843 bp, Paenibacillus sp.
atggaagtaaaattggtagtggattttgaagcttatgagaatggccaaacgatggctaaattgcttgaggaactggcagccaagccggagagcgcggaagttacggatctgatcattggagattggggtggagcctatgagagctcaccagatgatttcatcccagtgttagtgaagcttaaagatcatttccctaagttacgcaagctgtttattggtgatatggaatatgatgagtgtgaggtttcatggattaaccagacgaatctatccccgttattagaagcgtttccagcattggagtcctttcatatcaaaggaagccaggacctgagtctggaaccacttcgtcataaccaccttcaggaattggttattatttgtggcggcctgcctgtgagcgttcttcagcaaatacacaatgcagaactgcctgaactgcgcaagctggaactgtatttaggtgtcgataactatggttttgacggtaacctgaaagatgttttgccgtttttgaatagcaatcctttccccaaacttacatacttgggactgaaagatagtgaaatacaggatgaaattgcaattgcagcagctaatgcccctgtgattggacaactggaagtgctggatctctcacaaggtacgttgtctgataaaggtgcagaagcgctactggctagtgaaagtataaaagggctgaagtatctggatttgagctatcattatatgtctagtgaaatgatgcaacgttggaaaagctcgggtctatctgtgaacgtggaagatcaacaagaagcggatgaggaagatgattggcgttatccatcactgactgagtaa

SEQ ID NO: 1219 - DNA, 843 bp, Paenibacillus sp.
atggaagtaaaattggtagtggattttgaagcttatgagaatggccaaacgatggctaaattgcttgaggaactggcagccaagccggagagcgcggaagttacggatctgatcattggagattggggtggagcctatgagaactcaccagatgatttcatcccagtgttagtgaagcttaaagatcatttccctaagttacgcaagctgtttattggtgatatggaatatgatgagtgtgaggtttcatggattaaccagacgaatctatccccgttattagaagcgtttccagcgttggagtcctttcatatcaaaggaagccaggacctgagtctggaaccacttcgtcataaccaccttcaggaattggttattatttgtggcggcctgcctgtgagcgttcttcagcaaatacacaatgcagaactgcctgaactgcgcaagctggaactgtatttgggtgtcgataactatggttttgacggtaacctgaaagatgttttgccgtttttgaatagcaatcctttccccaaacttacatacttgggactgaaagatagtgaaatacaggatgaaattgcaattgcagcagctgatgcccctgtgattggacaactggaagtgctggatctctcacaaggtacgttgtctgataaaggtgcagaagcgctgctggctagtgaaagtataaaagggctgaagcatctggatttgagctatcattatatgtctagtgaaatgatgcaacgttggaaaagctcgggtctatctgtgaacgtggaagatcaacaagaagcggatgaggaagatgattggcgttatccatcactgactgagtaa

SEQ ID NO: 1220 - DNA, 843 bp, Paenibacillus sp.
atggaagtgaaattggtagtggattatgaagcttacgagaatggccaaacgatggctaaatctattgaggaactggcagccaagccggagagcgcgcaagttacagatctcatcattggtgattggggcggcgcctatgaaagttcaccagaggattttatcccagtgttagtgaagctcaaagatcatttccctaagatacgcaaactgtttattggtgatatggaatacgatgagtgtgaggtttcatggattaaccagacgaatctgtccccattgttagaagcgtttccagcattggagtcctttcatatcaaaggaagccaggacctgagcttggagccgcttcgtcataaccatcttcaagaattggttattatctgtggtggcctgcctgtgagcgttcttcagcaaatatgtaatgccgaactgcctgaactgcgcaagttggaactgtatttgggtgtcgagaactatggctttgacggtaaccttaaagatattttgccgtttttagacagcaatccttttcccaaacttacatacttgggactcaaagatagtgaaatacaggatgaaattgctattgcagcagctaatgcccctgtgattggacaattggaagtgctggatctctcacaaggtacgttgtctgataaaggtgcagaagcgctactggctagtgaaagtataaaagggctgaagcatctggatttgagctatcattatatgtctagtgaaatgatgcaacgttggaaaagctcgggtctatctgtgaacgtggaagatcaacaagaagcggatgaggaagatgattggcgctatccatcactgactgagtaa

SEQ ID NO: 1221 - DNA, 843 bp, Paenibacillus sp.
atggaagtgaaattggtagtggattatgaagcttacgagaatggccaaacgatggctaaatctattgaggaactggcagccaagccggagagcgcgcaaattacagacctcatcattggagattggggcggtgcctatgaaagttcaccagaggattttatcccagtgttagtgaagctcaaagatcaattccccaagatacgaaaactgtttattggtgatatggagtatgatgagtgtgaggtttcatggattaaccagacgaatctgtccccgttgttagaagcgtttccagcattggagtcatttcatattaaaggaagccaggacctgagcttggagccgcttcgtcataaccatcttcaagaattggttattatctgtggtggcctgcctgtgagcgttcttcagcaaatacgtaatgccgaactgcctgaactgcgcaagttggaactatatttgggtgtcgagaactatggctttgacggtagcctgaaagatgttttgccgtttttagacagcaatccttttcccaaacttacatacttgggactcaaagatagtgaaatacaggatgaaattgcaattgcggcagctaatgcccctgtgattggacaattggaagtgctggatctctcacaaggtacgttgtctgataaaggtgcagaagcactactggctagtgaaagtataaaagggctgaagcatctggatttgagctatcattatatgtctagtgaaatgatgcaacgttggaaaagctcaggtctatctgtgaacgtggaagatcaacaagaagcggatgaggaagatgattggcgctatccatcactgactgagtaa

SEQ ID NO: 1222 - DNA, 843 bp, Paenibacillus sp.
atggaagtgaaattggtagtggattatgaagcttatgagaatggccaaacgatggctaaatctattgaggaactggcagccaagccggagagcgcgcaaattactgatctcatcattggagattggggcggcgcctatgaaagttcaccagaggattttatcccagtgttagtgaagctcaaagatcaattccctaagatacgcaaactgtttattggtgatatggaatatgatgagtgtgaggtttcatggattaaccagacgaatctgtccccgttgttagaagcgtttccagcattggagtcctttcatatcaaaggaagccaggacctgagcttggagccgcttcgtcatagccatcttcaggaattggttattatctgtggtggcctgcctgcgagggttcttcagcaaatacgtaatgccgaactgcctgaactgcgcaagctggaactgtatttgggtgtcgaggactatggttttgacggtaacctcaatgatattttgccgttcttggacagcaatccttttcccaaacttacatacttgggactcaaagatagtgaaatacaggatgaaattgcaattgcagcagctaatgcccctgtgattggacagctggaagtgctggatctctcacaaggtacgttgtctgataaaggtgcagaagcgctgctggctagtgaaagtataaaagggctgaagcatctggatttgagctatcattatatgtctagtgaaatgatgcaacgttggaaaagctcgggtctatctgtgaacgtggaagatcaacaagaagcggatgaggaagatgattggcgctatccatcactgactgagtaa

SEQ ID NO: 1223 - DNA, 843 bp, Paenibacillus sp.
atggaagtgaaattggttgtagattatgaagcttatgagaatggccaaacgatggctaaatctattgaggaactggcagccaagccggagagtgcccaagttacggatctgatcattggagattggggcggagcctatgaaaattcaccagatgattttatacccgtgttagtgaagctaaaagatcaatttcctaaggtgcgcaagctgtttattggtgatatggaatatgatgagtgtgaggtatcatggattaaccaaacgaatctgtccccgctgttagaagcgtttccaaagcttgaatccttacatattaaaggaagccaggatctgagcttggaaccccttcgccataatcatcttcaagaattggttattatttgtggcggtctacctgtgagcgtccttcgacaaatccgtaatgccgaactgcctgaactgcgcaagctggagctgtatttgggtgtcgaggattatggttttgacggtaaactggaagatattttaccgtttttggacagcaatccttttcccaaacttacatacttgggactcaaagatagtgagatacaggatgaaattgccgttgctgctgctaatgcccctgtgattggacaactggaagtactggatctctcacaaggtactttgtctgatcaaggtgcagaagcgttgctggctagtgaaagtataaaaggactgaaacatctggatttgagctatcattatatgtctagtgaaatgatggggcgctggaagaactctggtttatctgtgaacgtagaagatcaacaagaagcagatgaagaagatgattggcgctatccatcactgacagagtaa

SEQ ID NO: 1224 - DNA, 843 bp, Paenibacillus sp.
atggaagtaaagctggttgtggattatgaagcttatgagaatggtcaaacgatggctaagtctattgaagaacaggcaggtaagccagagagcgcggaaattacagatttgattattggagactggggcggagcctatgaacaatcgccggaggattttattccggtactggtaaagcacaaagatcaatttccgaagctgcgtaagctgtttatcggggatatggaatatgatgagtgtgaggtttcgtggattaaccagacgaatctgtctccgctgttggaggcgtttccagcattggaatccttttatgtcaaaggaagtcaggacctgagcctggaaccgttgcggcatagccatcttcaggaattggttattatttgcggaggtttgcctgcgagtgtccttcaggaaattcgtaatgccgagctgcctgagctgcgcaagctggagttgtatttgggcgtggatcaatacggctttgatggtggcctgaaggatgtattaccgttcctgaacgacaatctttttccaaagcttacctatttggggctgaaggatagtgaaatacaagatgaaattgcgattgctgcggcaaacgcacctgtgattggacaactggaggtactggatctgtctcaaggcacgttgtctgataaaggggctgaggcactactggctagtgaaagtatcaaagggctgaagcatctggatttgagctatcattatatgtcggatgaaatgatgaaacgttggaaaagctccggactgtctgtgaatgtggaggatcagcagcaagcggacgaggaagatgattggcgttatccatcgttgaccgagtaa

SEQ ID NO: 1225 - DNA, 843 bp, Paenibacillus sp.
atggaagtaaaattggtagtggattttgatgcttatgagagtggacaaacgatggctaaattgattgaagagctggcagccaagccggatagcgcggaaattacagatctgattattggggattggggcggagcctatgaaaattcgcctgaggattttatcccggtgctggtgcagcataaagatcaatttccgaagctgcgcaagctgtttatcggcgatatggaatatgatgagtgtgaggtttcatggattaatcaaacaaatctgtccccgctgctagaagcgtttccagcattggagtctttttatgtcaaaggaagccaggacctgagcttggagccgcttcgtcatagccaccttcaggaattggtaattatttgcggtggtctgcctgctagcgtccttcagcaaatatatcatgccgagctgcctgagctgcgcaagctggagctgtatttgggggtggatgaatacggttttgacggtggtttgaaagatgttttaccgtttttggacaacaatccttttcccaagcttacatatttggggctaaaagatagcgaaatacaggatgaaattgcgattgcagcagcgaatgccccagtgatcggacaactggaagtgctggatctgtctcagggtacgttgtcagatcaaggagcagaggctctgctggcaagtgaaagcatcaaggggctaaagcatctggatttgagctatcattatatgtccagtgaaatggtagagcgttggaaaaactctggattatctgtgaacgtggatgatcagcaggaagcagatgaggaagatgattggcgttatccttcattgaccgagtaa

SEQ ID NO: 1226 - DNA, 840 bp, Paenibacillus sp.
atggaaatcaagttatccttggattatgaagcctatgaaggtggagcagtaatggtggacctggttcgtgagctggcggggaagccggagagcacagaggtgacctcattgatcattggtgactggggcggagcctatgagcagggcccagaggattttgtggaagagctgattgcacaaaaggaacagttcccgcaattaaagaagctgtttattggagacatgggctacgaggaatgtgaggtatcctggatcaatcaagcgaatctggggccgctgctgcaggcttttccccagctggagtcgttcacggtcaagggaagtacagatctggagcttgacccgctgaatcatgaccatttacaggagctcgtcattatttgtggtggacttccaaaaagagtccttcatcaaatccatgcagcctctctaccggagctacggaagctggagctgtatcttggggttgaggactatggctttgatggacaaatggaggatatcttaccatttctgaaccagaatccttttccgaagctgacttatcttgggctcaaggatagtgagctacaggacgagattgcaatcgctgctgcacagtccccggtgctgagtcaattggagttgcttgacctctccatgggcacgctatcggatcaaggagctgaggctctgctggcaagcgagagtgtgcgtaagctcaagcatctgaatctaagctaccattacatgtcggatgagatgctgctgaaatggaaacaaagtggactgtctgtagatgtaagtgaacagcaagagtctgatgaggatgattggcgttatccggcattgaccgaatag

SEQ ID NO: 1227 - DNA, 378 bp, Paenibacillus sp.
gtgaaaacatcttcatttttcctgggaatcgtcttgggcgctgtagcaagctccttgatctcccgcaaccgcgacatgttgggcttatccatggacatgggtggaaaaaaaagcggcaatttagtgcagaaagcccgtactaaaatgatggacgcggcattccctggaatgggcgagataacgctaaataaagaagacacccataaggatcaagaccatcattcaccaacagataaaaccgctcataacgcccataccgccaagaacaaagaagagaatatgaagttgattaaagacttcatcagcacaagtcccgatgttaaacgtgaggtcgagcaaattttgaaagaaactcatacagccgtaccgggattgtaa

SEQ ID NO: 1228 - DNA, 378 bp, Paenibacillus sp.
gtgaaaacatcttcatttttcctgggaatcgtcttgggcgctgtcgcaagctctttgatctcccgcaaccgcaacatgttgggcttatctatggacatgggtggaaaaaaaggcggcaatttagtgcagaaagcccgtactaaaatgatggacgcggcattccccggaatgggcgagattacgctcaataaagaagacacccataaggatcaagaccatcattcacaaacagataaaaccgctcataacgcccatactgccaagaataaagaagagaatatgaagttgattaaagacttcatcagcacaagtcccgatgttaaacgtgaggtcgagcaaattttgaaagaaactcatacagccgtaccgggattgtaa

SEQ ID NO: 1229 - DNA, 378 bp, Paenibacillus sp.
gtgaaaacatcttcatttttcctgggaatcgtcttgggcgctgtcgcaagctctttgatctcccgcaaccgcaacatgttgggcttatctatggacatgggtggaaaaaaaggcggcaatttagtgcagaaagcccgtactaaaatgatggacgcggcattccccggaatgggcgagataacgctcaataaagaagacacccataaggatcaagaccatcatttacaaacagataaaaccgctcataacgcccatactgccaagaacaaagaagagaatatgaagttgattaaagacttcatcagcacaagtcccgatgttaaacgtgaggtcgagcaaattttgaaagaaactcatacagccgtaccgggattgtaa

SEQ ID NO: 1230 - DNA, 378 bp, Paenibacillus sp.
gtgaaaacatcttcatttttcctgggaatcgtcttgggcgctgtcgcaagctctttgatctcccgcaaccgcaacatgttgggcttatctatggacatgggtggaaaaaaaggcggcaatttagtgcagaaagctcgtactaaaatgatggacgcggcattccccggaatgggcgagataacgctcaataaagaagacacccgtaaggatcaagaccatcattcacaaacagataaaaccgctcataacgcccatactgccaagagcaaagaagaaaatatgaagttgattaaagacttcatcagcacaagtcccgatgttaaacgtgaggtcgagcaaattttgaaagaaactcatacagccgtaccgggattgtaa

SEQ ID NO: 1231 - DNA, 378 bp, Paenibacillus sp.
gtgaaaacatcttcatttttcctgggaatcgttttgggcgctgtcgcaagctctatgatctcccgtaaccgcaacatgttgggcttatctatggacataggtggaaaaaaaggcggcaatttagtgcagcaagcccgcactaaaatgatggacgcggcattccccgggatgggcgagattacgctcaataaagaagacacccataaggatcaagaccatcattcacaaacagataaaaccgcttataacgcccatactgccaagaacaaagaagagaatatgaagttgattaaagacttcatcagcacaagtcccgatgttaaacgtgaggtcgagcaaattttgaaagaaactcatacagccgtaccgggattgtaa

SEQ ID NO: 1232 - DNA, 378 bp, Paenibacillus sp.
gtgaaaacatcttcatttttcctgggaatcgttttgggcgcagtggcgagcactatgatctcccgtaaccgcagcatgttaggcttatctatggacatggatggaaaaaaaggcggtaatctggttcaaaaagcccgtaccaaaatgatggacgcggcgttccccggaatgggtgatattacgcttaacaagcaagacacccataaggatcacgatcaccgttccacaacagataagacagctcatagcacccacactgcccaaaataaagaagaaaatatgaagctgattaaagattttatcagcaccagtcccgatgttaagcgtgaggtcgagcaaatcctgaaagaaactcatacagccgtaccgggtttgtaa

SEQ ID NO: 1233 - DNA, 378 bp, Paenibacillus sp.
gtgaaaacatcttcatttttcctgggaatcgtcttgggggctgtcgcaagctctctgatctctcgtaaccgcaatgcgttgggcttatccatggacatgggcggaaaaaaaggcgggaatttggtacagaaagctcgtacaaaaatgatggacgccgcatttccaggcatgggtgatattgcgctgaatacacaagacacccacaaggatcatgatcatcgttcacaagcagataaaaccgttcataacgcccaaactgccaagagcaaagaagagaatatgaagttgattaaagagtttattagcacaagtcccgatgttaaacgtgaggtcgagcaaatactgaaagaaactcatacagccgtaccgggattgtaa

SEQ ID NO: 1234 - DNA, 378 bp, Paenibacillus sp.
gtgaaaacatcttcatttttcctgggaatcgtcttgggggctgtcgcaagctctctgatctctcgtaaccgcaatgcgttgggcttatccatggacatgggcggaaaaaaaggcggaaatttggtacagaaagctcgtacaaaaatgatggacgccgcatttccaggcatgggtgatattgcgctgaatacacaagacacccacaaggatcatgatcatcgttcacaagcagataaaaccgttcataacgaccaaactgccaagagcaaagaagagaatatgaagttgattaaagagtttattagcacaagtcccgatgttaaacgtgaggtcgagcaaatactgaaagaaactcatacagccgtaccgggattgtaa

SEQ ID NO: 1235 - DNA, 369 bp, Paenibacillus sp.
gtgaaaacatcttcatttttcctgggaatcgttttgggcgctgtcgcaagcactctgatctcccgtaaccgcaacatgttgggcttatccatggacatggatgggaaaaaaggtggcaatttggtgcagaaagcccgcaccaaaatgatggacgctgcgtttcctggtatgggcgatattaagttgaataaacaagacacccataaggatcatgatcatcgttccaaaacagataataacgttcatacgctccaaaacaaagaagaaaatatgaagttgattaaagactttattagcagcagtcctgatgttaaacgtgaggttgagcaaatactcaaggaaactcatacagccgtaccgggattataa

SEQ ID NO: 1236 - DNA, 369 bp, Paenibacillus sp.
gtgaagacatcttcatttttcctgggaatcgttttgggcgctgtcgcaggctctatgatctcccgtaaccgcaacatgctgggcttttctatgaacatggatggaaaaaaaggcgaaaatttggtgcagaaagcccgcaccaaaatgatggacgctgcgtttcccggaatgggcgatattacgctaaacaaacatgatacccatgaggatcatgatcatcgttccaaaacagataaaaccgttcatactgtccaaagcaaagaagagaatatgaagctgattaaagactttatcagcagtagtcccgatgttaaacgtgaggtcgagcagatattgaaggaaactcatacagccgtaccgggattatag

SEQ ID NO: 1237 - DNA, 366 bp, Paenibacillus sp.
gtgaagacatcttcatttttcctgggaatcgttttgggcgctgtcgcaggctctatgatctcccgtaaccgtaacatgttgggtttttctatgaacatggatggaaaaaaaggcgaaaatctggtgcagaaagcccgcaccaaaatgatggacgctgcgtttcccggaatgggcgatattacgctaaataaacatgatacccataaggatcaggatcatcgttccaaaacagaaaccgctcatgcagtccaaagcaaagaagaaaatatgaagctgattaaagactttatcagcagcagtcccgatgttaaacgtgaggtcgagcaaatactgaaggaaactcatacagccgtaccgggattataa

SEQ ID NO: 1238 - DNA, 1161 bp, Paenibacillus sp.
ttgaatttttactccaggatcaaattgctcggtcttttgcttgtttttcttatgtgttctatcggtaacgctcagcatgtgcaagcagcgctgcctccacaagcttctttggatttgttcggttctaaaagcgtgaggacaacccaagaaagtgtaattcccgatttaaaagtatacccgggagggcagacgattggggttaaagtaaaatcttcaggagtgcttgtcgtcggtcaccatatcattcaggaaagtaatgatcgtaaggtatcacctggtgaaacagcggggattcgcctaggggatcggattacacacatgaacggcaaaccactcaatagcctggcaagggttgctgaagtagtagacgaagcaggtaagaataaaaagccgctcgacattacgctttgtcgaggtgagcagaccatttccaccaagttaacaccagcatatgatcaggatgataaagcatggcggcttgggttgtatattagggactcggctgcaggtgtaggtacattaacgttttacgcaccagaccaaggtgtatacggggccttgggccacgtaattaccgatatgaatacccaaacccctattgtcgtgggaagcggagagattgtgcagtccaatgtgacatcaattgcgaaaagccaaagtggggaaccaggagaaaaacgcgctcattttctcaaagatcatcgggtattaggaaatattgaacgaaatacgaatttcggaatctttgggaaaatgtcagatgagccgcaatatggattgtattcgactcctattccggtggctcttgcgaatgaagtaaaggaaggacctgcagaaattttgactgtactggaaggtcaacaaattcagcggtttcaggcggaaattgtacacatttctcagcaggacaaaccggcaaccaaaggacttgtgattcgtattgtagatccaaagctgttggataagaccgggggaatcgtgcaaggaatgagcggtagtccgatcatccaaaatggtaagcttatcggggctgtaacacatgtatttgtgaatgatcctaaatcaggttacggttgttttatcgaatggatgctgcgcgatgcaggaatcatgcagaataacgtaagcttaaaatcatcttctaatcttaaggcgagctag

SEQ ID NO: 1239 - DNA, 1137 bp, Paenibacillus sp.
ttgctcggtcttttgcttgtttttcttatgtgttctatcggtaacgctcagcatgtgcaagctgcgctgcctccacaagcttctttggacttgttcggctctaaaagcatgaggacaacccaagaaagtgtagttcccgatttaaaagtatacccgggggggcagacgattggggtcaaagtaaaatcttcaggagtgcttgtcgtcggtcaccatatcattcaagaaagtaatgatcgtaaggtgtcacctggtgaaacagcggggattcgcctaggggatcggattacacacatgaacggcaaaccactcaatagcctggcaagggttgctgaggcagtagacgaagcaggtaagaataaaaagccgctcgacattacactttgtcgaggagagcagacgatttccacaaagttaacaccagcatatgatcaagatgataaagcgtggcggcttgggttgtacattagagactcggctgcaggtgtaggtacattaacgttttacgcaccggaccaaggtgtatacggggcattgggccacgtaattaccgatatgaatacccaaacccctattgtcgtggggagcggagagattgtgcagtccaatgtgacgtcaattgcgaaaagccaaagtggggaaccaggagaaaaacgcgctcattttctcaaagatcatcgggtattaggaaatattgaacgaaatacgaatttcggaatttttgggaaaatgtcagatgagccgcaatatggattgtattcaactcctattccggtggctcttgcgaatgaagtaaaggaaggaccggcagaaattttgactgtactggaaggtcaacaaattcagcggtttcaggcggaaattgtacacatttctcagcaggacaaaccagcaaccaaaggacttgtgattcgcattgtagatccaaagctgttggataagaccgggggaatcgtgcaaggaatgagcggtagtccgattattcaaaatggtaagcttatcggggctgtgacacatgtatttgtgaatgatcctaaatcaggttacggttgttttatcgaatggatgctgcgcgatgcaggaatcatgcagaataacgtaagcttgaaatcatcttctaatcttaaggcgagctag

SEQ ID NO: 1240 - DNA, 1161 bp, Paenibacillus sp.
ttgaatttttactccaggatcaaattgctcggtcttttgcttgtttttcttatgtgttctctcggtaacgctcagcatgtgcaagcagcgctgcctctacaagcttctttggatttgttcggctctaaaagcatgaaaacaacccaggaaagcgtggttcccgatttgaaagtatacccagggggtcagacgatcggggtcaaagtaaaatcttcaggagtgcttgtcgttggtcaccatatcattcaggaaagcaatgatcgtaaggtgtcacctggtgagacagctggtattcgcctaggggaccgtattacacacatgaacggcaaacccctcaatagtctcgccagggtagcggaagccgtggacgaggcaggtaaaaacaaaaagccgcttgacatcacgctttgtcgaggcgaacagacgatctccactaagttaaccccagcatatgatcaagaggataaagcgtggcggctcgggttatatattagagactcggctgcaggcgtaggtacattaacattttatgcaccggatcagggggtttacggggccttgggccatgtaattaccgatatgaatacacaaactcccattgtcgtgggcagcggagagattgttcaatccaatgtgacgtcaattgcgaaaagccagagtggggaacccggagagaaacgtgctcattttctcaaggatcatcggatcttaggaaatattgaacgaaatacgaactttggaatatttgggaaaatgtcagatgagccgcaaaatggattgtattcgacgcccattccggtgggacttgcgaatgaagtaaaagaaggaccagcagaaattttgactgtactggaaggtcaacaaattcagcgttttcaggcagaaattgtacacatttctcagcaggataaaccagcaaccaaagggcttgtgattcgggttgtagatccaaagctattagataagaccggcggaatcgtgcaaggaatgagtgggagtccgattatccaaaatggtaagctgatcggagctgtaacgcatgtatttgttaatgatcctaaatcaggttacggatgttttatcgaatggatgttgcgtgacgcaggaatcatgcataataaactgagcttgaagtcatcctctaatcttaaggcgagctag

SEQ ID NO: 1241 - DNA, 1161 bp, Paenibacillus sp.
ttgaattttttctccaggatcaaattgctcggtcttttgcttgtttttcttatgtgttctctcggtaacgctcagcatgtgcaagcagcgctgcctctacaagcttctttggatttgttcggctctaaaagcatgaaaacaacccaggaaagcgtggttcccgatttgaaagtatacccagggggccagacgatcggggtcaaagtaaaatcttcaggagtgcttgtcgttggtcaccatatcattcaggaaagcaatgatcgtaaggtgtcacctggtgagacagctggtattcgtctaggggaccgtattacacacatgaacggcaaacccctcaatagtctcgccagggtagcggaagccgtggacgaggcaggtaaaaacaaaaagccgcttgacatcacgctttgtcgaggcgaacagacgatctccactaagttaaccccagcatatgatcaagaggataaagcgtggcggctcgggttatatattagagactcggctgcaggcgtaggtacattaacgttttatgcaccggatcagggggtttacggggccttgggtcatgtaattactgatatgaatactcaaactcccattgtcgtgggcagcggagagattgtgcaatccaatgtgacgtcaattgcgaaaagccagagtggggaacccggagagaaacgtgctcattttctcaaggatcatcggatcttaggaaatattgaacgaaatacgagctttggaatatttgggaaaatgtcagatgagccgcaaaatggattgtattcgacgcccattccggtgggacttgcgaatgaagtaaaagaaggaccagcagaaattttgactgtactggaaggtcaacaaattcagcgttttcaggcagaaattgtacacatttctcagcaggataaaccagcaaccaaagggcttgtgattcgggttgtagatccaaagctattagataagaccggcggaatcgtgcaaggaatgagtggtagtccgattatccaaaatggtaagctgatcggagctgtaacgcatgtatttgttaatgatcctaaatcaggttacggatgttttatcgaatggatgttgcgtgacgcaggaatcatgcataataaattgagcttgaagtcatcctctaatcttaaggcgagctag

SEQ ID NO: 1242 - DNA, 1161 bp, Paenibacillus sp.
ttgaattttttctccaggatcaaattgctcggtcttttgcttgttttttttatgtgttctctcggtaacgctcagcatgtgcaagcagcgctgcctctacaagcttctttggatttgttcggctctaaaagcatgaaaacaacccaggaaagtgtggttcccgatttgaaagtatatccagggggccagacgatcggggtcaaagtaaaatcttcaggagtgcttgtcgttggtcaccatatcattcaggaaagcaatgatcgtaaggtgtcacctggtgagacagctggtattcgcctaggggaccgtattacacacatgaacggcaaacccctcaatagtctcgccagggtagcggaagccgtggacgaggcaggtaaaaacaaaaagccgcttgacatcacgctttgtcgaggcgaacagacgatctccaccaagttaaccccagcatatgatcaagaggataaagcgtggcggctcgggttatatattagagactcggctgcaggcgtaggtacattaacgttttatgcaccggatcagggggtttacggggccttgggtcatgtaattactgatatgaatactcaaactcccattgtcgtgggcagcggagagattgtgcaatccaatgtgacgtcaattgcgaaaagccagagtggggaacccggagagaaacgtgctcattttctcaaggatcatcggatcttaggaaatattgaacgaaatacgagctttggaatatttgggaaaatgtcagatgagccgcaaaatggattgtattcgacgcccattccggtgggacttgcgaatgaagtaaaagaaggaccagcagaaattttgactgtactggaaggtcaacaaattcagcgttttcaggcagaaattgtacacatttctcagcaggataaaccagcaaccaaagggcttgtgattcgggttatagatccaaagctattagataagaccggcggaatcgtgcaaggaatgagtggtagtccgattatccaaaatggtaagctgatcggagctgtaacgcatgtatttgttaatgatcctaaatcaggttacggatgttttatcgaatggatgttgcgtgacgcaggaatcatgcataataaactgagcttgaagtcatcctctaatcttaaggcgagctag

SEQ ID NO: 1243 - DNA, 1155 bp, Paenibacillus sp.
ttgaatttttactccaggatcaaattgctcggtcttttgcttgtttttcttatgtgttctatcggtaacgctaagtatgtgcatgcagcgctgcctccacatgcttctttggattggtttggtcctaaaagcacgaggacggcccaagaaagcgtgattccggatttaaaggtatacccgggaggacagacgattggggtcaaggtaaaatcatcaggagtgcttgtcgtcggccatcatgtcatccaggaaagtaatgatcgcaaggtgtcacctggagagacagcaggaattcgtctaggggatcgcattacgcatatgaacggcaagcctttggatagtctggcaaaggttgcggaggctgtagatgaagcaggcaagaacaagaagccgctcgacatcacgctttgtcgtggggagcagacgatttccaccaagctaacaccagcttatgattcagatgataaagcttggcgattgggattgtacattagagattcggctgcgggcgtaggtacattaactttttacgcaccagatcagggtgtatacggcgctttagggcacgtcattaccgatatgaatactcaaactcctattgtcgtgggaagcggagagattgtacaatccaatgtgacgtcaattgcaaaaagccaaagcggggagcctggtgaaaaacgcgctcattttctcaaagatcatcggatattaggtaatattgaacgtaatacgaacttcggaatttttgggaaaatgtccgatgagccgcaatatggcttgtattccaaacccattcctgtggctcttgccaatgaagtaaaggaaggacccgcagaaatattgaccgttttggagggacagcagattcaacggtttcaggctgaaattgtacacatttctcagcaggataagccagcaaccaaaggacttgtgatccgtattatagatccaaagctgctggagaagactggaggaatcgtgcaaggaatgagcggtagtccaattattcaaaatggcaagcttatcggggctgtgacacatgtattcgtaaacgatccgaaatcaggctacggttgttttatagaatggatgcttcgtgatgcaggaatcatgcaaaataacgtgagcatgacaactaatcttaaggcgagctag

SEQ ID NO: 1244 - DNA, 1161 bp, Paenibacillus sp.
ttgaatttttactccaggatcaaattgctcggtcttttgcttgtttttcttatttgttgtatcggtaacgccaagcctgtgcatgcagcgctgcctccacaagcttctctggaattattcggttcccatgtagcgaagacgactcaagatagcgtgattcccgacttgaaggtgtatccagggggtcagacgattggggtcaaagtaaaatcttcaggggtgcttgttgttggtcatcatgtcattcaggaaagtatggaccgcaaggtgtcacctggagagacggccgggattcgtctcggtgaccggatcacccatatgaatggaaaaccgctggatagcctgacaagggtagcggaggctgtagaggaagcaggcaagaacaaaaagccgctcgacatcacgctttgccgaggggagcagacgatttccaccaagctgacaccagcttatgatcgcgatgacaaagcttggcggcttggactgtatatcagggactcggctgcgggtgtaggcaccttgaccttttacgcaccggatcagggggtatacggggccttagggcacgttatcaccgacatgaatacccagacccccattgttgtggggagcggggaaatagtacaatccaatgtgacgtcaattgcgaaaagtcaaagtggtgaacctggggaaaaacgcgcacattttctcaaggatcatcgggtgttaggtaatattgaacgaaacacgaacttcgggatttttgggaagatgtcagatgagccgcaatatggtttatattccaagccgattcctgtggcacttgcaaatgaagtaagggaaggacccgcagaaattttgactgtattggaaggtcagcagattcagcggtttcaggcagaggtcgtacacatttctcaacaggataaaccggcaaccaaaggacttgttatccgtatcgtagatccaaagctactggacaagaccgggggaattgtacaagggatgagcggaagcccaattattcaaaacggcaagctcatcggggctgtgacgcatgtatttgttaatgatccgaaatcaggctacggctgctttatcgaatggatgctacgcgatgcaggaatcatgcagaataacataagcttcaaatcatcctcgaatcttaaggcgagctag

SEQ ID NO: 1245 - DNA, 1161 bp, Paenibacillus sp.
ttgaatttttactccaggatcaaattgctcggtcttttgcttgtttttcttatttgttgtatcggtaacgccaagcaagtgcatgcagcgctgccttcacaagcttctctggaattattcggttcccatgcagtgaagacgtctcaagagaacgtgatccccgatttgaaggtgtatccagggggtcagacgatcggggtcaaagtaaaatcttcaggagtgcttgttgttggtcatcatgttattcaggaaagtgtggaccgcaaggtgtcacctggagagactgccgggattcgtctcggtgatcggatcacccatatgaatggcaaaccgctggatagcctgacaaaggtagcggaggctgtagaggaagcaggaaagaacaaaaaaccgctcgacatcacgctttgccgaggggagcagacgatttccaccaagctaacaccagcttatgatcgtgatgacaaagcatggcggcttggactgtatattagggactcggctgcgggtgtaggcaccttgaccttttacgcaccggatcagggggtatacggggccttggggcacgtgatcaccgacatgaatacccagactcccattgttgtgggcagcggagaaatagtgcaatccaatgtgacgtcaattgcgaaaagtcaaagtggtgaacctggggaaaaacgcgcacattttctcaaggatcatcgggtgttaggcaatattgaacgaaacacgaacttcgggatttttgggaagatgtcagatgagccgcaatatggtttgtattccaagccaatacctgtggcatttgcgaatgaaataaaggaaggtcccgcagaaattttgactgtattggaaggtcagcagattcagcggtttcaggcagaggtcgtacacatttctcaacaggataaaccggcaaccaaaggacttgttattcgtatcgtagatccaaagctgctggataagaccgggggaattgtacaagggatgagcggaagcccaattattcagaacggcaagctcatcggggctgtgacgcatgtatttgttaacgatccgaaatcaggctacggctgctttatcgaatggatgctgcgcgatgcaggaatcatgcagaataacgtaagcttgaaatcatcctctaatcttaaggcgagctag

SEQ ID NO: 1246 - DNA, 1110 bp, Paenibacillus sp.
atgtgttctctcggtaacgctcatcatgtgcaagcagcgctgcctctacaagcttctttggatttgttcggcactaaaagcatgcaaacaacccaagaaagcgtggtccccgatttgaaagtatacccaggggggcagacgatcggggtcaaagtaaaatcttcaggagtgcttgtcgtaggtcaccatatcattcaggaaagcaatgatcgtaaggtgtcacctggtgagacagctggtattcgcctaggggaccggattacacacatgaacggcaaacccctcaatagtctcgccagggtagcggaagccgtggacgaggcaggtaaaaacaaaaagccgctggacatcacgctttgtcgaggtgagcagacgatttccaccaagttaaccccagcatatgatcaagatgataaagcgtggcggcttgggttgtatattagagactcggctgcaggcgtaggtacattaacgttttatgcaccggaccagggggtttacggggccttgggtcatgtaattaccgatatgaatactcaaactcccattgttgtgggtagtggagagattgtgcaatccaatgtgacgtcaattgcgaagagccagagtggggaacccggagaaaaacgtgctcattttctcaaagatcatcggatcttaggaaatattgaacgaaatacgagcttcggaatatttgggaaaatgtcagatgagccgcagaatggattgtattcggcgcccattccggtgggacttgcgaatgaagtaaaagaaggaccagcagaaatattgactgtattggaaggtcaacaaattcagcgttttcaggcagaaattgtacacatttctcagcaggataaaccggcaaccaaagggcttgtgattcgggttgtagatcctaagctattagataagaccggcggaatcgtgcaaggaatgagtgggagtccgattatccaaaacggtaagctgatcggagctgtaacacatgtattcgttaatgatcctaaatcaggttacggatgttttatcgaatggatgttgcgtgatgcaggaatcatgcataataaattgagcttgaagtcatcctctaatcttaaggcgagctag

SEQ ID NO: 1247 - DNA, 1053 bp, Paenibacillus sp.
atgaaaacaggtaaccgcactatcgtgtttgcgatgttgatcttgctatccagcttattgtatccgttcggctctgtagggttgggtgcggcttcggccgcccctgctttcgccaaaggagcagatataagctgggtagcaggaatggaagcgcaaggtatgacttggaaggataaaaagggtgttcgtcgagatatactgcaaattttgcgagatgactatcagatcaactcggtacgtatccgtgtgtgggtaaaccctgacatgaaagattatgcaagcggatacatgaatgccgaaaaggcagcagaactggcgcagcgagctaaaaaattgggtatgagcgtgatgctgactctacattatagtgattcctgggcagatccagggcaacagaacaaaccttatgcgtggcgcaatttcacatttacacaactcatggatgcagtctggtctcatacggtctatgttatgaacacgatgaaaagcaagggggtaacaccggactgggtgcagatcggtaatgagacgaacaatggaatgctctgggaagacggcaaagcttcagtgaacatgaaaaactatgcctggctcgtcaatacaggtaataatgctgtaaaatcggtaagcagcagtaccaaaacaatcgtacatttagccaacggggataacggttccgtgttgaactggaatatcggcgggctgattgataatggagctcagtttgatctcatcggtctgtctctgtatccgtctccttctgactggcagggcaaggtggatcagacgattaccaatgccaataacctcattgccaaatacggtaaaggcattgtcatcagtgaaatcgggatggaatataacgaacctgcagcttccaaggcatttatttctgcaatcaaaacgaaggttcggaacatcggaggcggcaaaggtacaggggtattttattgggaaccggctgcaactccaggttacaatcaaggttataacaaaggtgcttggcaggctgacggtaaaccaacctcagctttggaaggatttttaaactaa

SEQ ID NO: 1248 - DNA, 1053 bp, Paenibacillus sp.
atgaaaacaggtaaccgcacgatggtatttgcgatgttgatcttgttatccagcttattgtatccgttgggctctgtggggttaggtgcggcttcggccgcccctgctttcgccaaaggagcagatataagctgggtagcaggaatggaagcgcaaggtatgacttggaaggataaaaagggtgttcgtcgggatatactgcaaattttgcgggatgactatcagatcaactcggtacgtatccgtgtgtgggtaaaccctgacatgaaagataatgcaagcggatacatgaatgccgaaaaggcagcagaactggcacagcgagctaaaaaattgggcgtgagcgttatgctgactctacattatagtgattcctgggcagatccagggcaacagaacaaaccttatgcgtggcgcaatttcacatttacacaacttatggatgcagtctggtcgcatacggtctatgttatgaacacgatgaaaagcaagggggtaacaccggactgggtgcagatcggtaatgagacgaacaatggaatgctctgggaagacggcaaagcttcggtgaacataaaaaactatgcctggctcgtcaatacaggtaataatgctgtaaaatcggttagcagcagtactaaaacgatcgtacatttagccaacggggataacggttccgtgttgaactggaatatcggtgggctgattgataatggagctcagtttgatctcatcgggctgtctctgtatccgtctccttctgactggcaggggaaggtggaccagacgattgccaatgccaataacctcattgccaaatacggcaaaggcattgtcatcagtgaaatcggaatggaatataacgaacctgctgcttccaaggcatttatttctgcaatcaaaacaaaggttcggaacattggaggcggcaagggtataggggtattttattgggagccggctgcaactccaggttataatcaaggttataacaaaggtgcttggcaggctgacggtaaaccaacctcagctttggaagggtttataaattaa

SEQ ID NO: 1249 - DNA, 1053 bp, Paenibacillus sp.
atgaaaacaggtaaccgcacgatggtatttgcgatgttgatcttgttatccagcttattgtatccgttcggttctgtagggttgggtgcggcttcggccgcccctgctttcgccaaaggagcagatataagctgggtagcaggaatggaagcgcaaggtatgagttggaaggataagaagggtgttcgtcgagatatactgcaaattttgcgagatgactatcagatcaactcggtgcgtatccgtgtgtgggtaaaccctgacatgaaagattatgcaagcggatacatgaatgccgaaaaggcagcagaactggcgcaacgagctaaaaagttaggtatgagcgttatgctgactctacattatagtgattcttgggcagatccagggcaacagaacaaaccttatgcgtggcgcaatttcacatttacacaacttatggatgcagtctggtcccatacggtctatgttatggacacgatgaaaagcaagggggtaacaccggactgggtgcagatcggtaatgagacgaacaatggaatgctctgggaagatggcaaagcttcggtgaacatgaaaaactatgcctggctcgtcaatacaggtaataatgctgtaaaatcggtaagcagtagtactaaaacgatcgtacatttagccaatggagataatgattccgtgttgaactggaatatcggcgggctgattgataatggagctcagtttgatctcatcgggctgtctctgtatccgtctccttcggactggcagggcaaggtggatcagacgattaccaatgccaataacctcattgcaaaatacggcaaaggtattgtcatcagtgaaatcgggatggaatatagtgaacctgcggcttccaagtcatttatatttgcaatcaaaacgaaggttcggaacatcggaggcggtaaaggtacaggggtattttattgggagcctgctgcaactccaggttacaatcagggttataacaaaggtgcttggcaggctgacggtaagccaacttcagctttggaaggatttataaattaa

SEQ ID NO: 1250 - DNA, 1053 bp, Paenibacillus sp.
atgaaaacaggtaaacgtactatggtatttgcgatgttgatcttgttatccagctttttgtacccattgggctctgtgggagtgggtgcggcttcggccgcccctgctttcgccaaaggagcagatataagctgggtcgcagggatggaagcccaaggtatgacctggaaggataaaaaaggggttcgccgggatgtgctgcaaattttacgggacgattatcagatcaattcggttcgtattcgagtgtgggtaaatcctgacatgaaggattatgcaagcggatacatgaatgccgagaaggcagcagaacttgcgcagcgagctcaaaagttaggcatgagcgttatgctgaccctgcattatagcgattcatgggctgacccaggacagcagaataagccttacgcatggcgcaattttacatttacacaacttatggatgcggtctggtcccataccgtctatgttatgaacacgatgaagagcaagggtgtgacaccggattgggtgcaaatcggcaatgaaacgaacaatggcatgctctgggatgacggcaaagcctcagtgaatatgaaaaactatgcgtggctcgtcaatgcagggaataacgctgttaaatccgtaagcagcagcaccaagacgatcgtacatttagctaacggggataacagttccgttttgaactggaacattggtggactgattgataatggagctcagtttgaccttattggactgtctttatatccgtcttcctctgattggcagggtaaggtggatcagacgattaccaatgccaatagcctcattgcgaaatatggtaaaggcattgttatcagtgaaatcgggatggaatataatgaacctgctgcttccaaggcatttatttccgcaatcaaaacgaaggtgcggagtatcggaggcggtaaaggcgtgggcgtattttattgggagccagctgcaaccccaggttataatcaaggctataacaaaggtgcttggcaggctgacggtaagccaacctcagcgttggaaggctttttaaactaa

SEQ ID NO: 1251 - DNA, 1053 bp, Paenibacillus sp.
atgaaaacaggtaaacgtactatggtatttgcgatgttgatcttgttatccagctttttgtacccattgggctctgtgggagtgggtgcggcttcggccgcccctgctttcgccaaaggagcagatataagctgggtcgcagggatggaagcccaaggtatgacctggaaggataaaaaaggggttcgccgggatgtgctgcaaattttacgggacgattatcagatcaattcggttcgtattcgagtgtgggtaaatcctgacatgaaggattatgcaagcggatacatgaatgccgagaaggcagcagaacttgcgcagcgagctcaaaagttaggcatgagcgttatgctgaccctgcattatagcgattcatgggctgacccaggacagcagaataagccttacgcatggcgcaattttacatttacacaacttatggatgcggtctggtcccataccgtctatgttatgaacacgatgaagagcaagggtgtgacaccggattgggtgcaaatcggcaatgaaacgaacaatggcatgctctgggatgacggcaaagcctcagtgaatatgaaaaactatgcgtggctcgtcaatacagggaataacgctgttaaatccgtaagcaacagcaccaagacgatcgtacatttagctaatggggataacagttccgttttgaactggaacattggtggactgattgaaaatggagctcagtttgaccttattggactgtctttatatccgtcttcctctgactggcagggtaaggtggatcagacgattaccaatgccaatagcctcattgcgaaatatggtaaaggcattgttatcagtgagatcgggatggaatataatgaatctgctgcttccaaggcatttatttctgcaatcaaaacgaaggttcggagtatcgggggcggtaaaggcgtgggcgtattttattgggagccagctgcaaccccaggttataatcaaggctataacaaaggtgcttggcaggctgacggtaagccaacctcagcgttggaaggctttttaaactaa

SEQ ID NO: 1252 - DNA, 1053 bp, Paenibacillus sp.
atgaaaacaggtaaacgtactatggtatttgcgatgttgatcttgttatccagctttttgtacccattgggctctgtgggagtgggtgcggcttcggccgcccctgctttcgccaaaggagcagatataagctgggtcgcagggatggaagcccaaggtatgacctggaaggataaaaaaggggttcgccgggacgtgctgcaaattttacgggacgattatcagatcaattcggttcgtattcgcgtctgggtaaatcctgacatggaggattatgcaagcggatacatgaatgctgagaaggcggcagaacttgcgcagcgagcccaaaagttaggcatgagcgttatgctgaccctacattatagcgattcctgggctgatccaggccagcagaataagccttacgcatggcgcaattttacatttacacaacttatggatgcggtctggtcccatactgtttatgttatgaacacgatgaagagcaagggtgtgacaccggcttgggtgcaaatcggtaatgagacgaacaatggaatgctctgggatgatggcaaagcctcggtgaatatgaaaaactatgcgtggctcgtcaatacagggaataacgctgttaaatccgtaagcagcagtaccaagacaatcgtgcatttagctaatggggataacagttccgttttaaactggaacattggtggactgattgaaaacggagctcagttcgactttattggcctgtctctatatccgtcttcctctgactggcagggtaaggtggatcagacgattaccaatgccaatagcctcattaaaaaatatggtaaaggcattgtcatcagtgaaatcggaatggagtataatgaacctgctgcctccaaggcatttatttctgcaatcaaaacgaaggttcggagtatcggaggcggtaaaggcgtcggcgtattttattgggagccggctgcaaccccaggttataatcaaggttataacaaaggtgcttggcaggctgacggcaaaccaacctcagcgttggaaggctttttaaactaa

SEQ ID NO: 1253 - DNA, 1053 bp, Paenibacillus sp.
atgaaaacaagcaaccgatttatactatttgcggtgttgattttgttatccagtgttttgtacccgttcggctctgcagggttggggacggcttcagccgcccctgcttttgccaaaggagccgatataagctgggtagcaggaatggaagcacaaggtatgacctggaaggataaaaaaggggtccgtcgggatgtactgcaaattttgcgagacgattaccagattaactcggtacgtattcgtgtatgggtgaaccctaacatgaacgattatgcaagcggttacatgaatgctgagaaggcggcagagctggcgcagcgagccaaaaaattgggtatgagcgttatgctgaccctgcattatagcgattcctgggctgatccaggccagcagaacaagccttacgcatggcgcaattttaactttacacaactgatggatgcagtctggtcccacacggtttatgttatgaacacgatgaaaagcaagggcgtaacaccagactgggtacaaatcggcaatgagacgaacaatggaatgctctgggatgacggtaaagcctcggtgaatatgaaaaactatgcatggctcgtcaatacaggcaataacgcagtaaaatcggtaagcagcagcaccaagacgatcgtacatttggctaacggggataacggttccacgttaaactggaatattggcgggctgattgacaatggagctcagtttgacctcgtcgggctgtctctgtatccgtcttcttctgactggcagggcaaggtggaccagacgattgccaatgccaatagcctcattgcaaaatacggtaaaggcattgtcatcagtgaaatcgggatggattataatgaacccgcagcttccaaggcatttattgctgctatcaaaacaaaggtgcggaacatcgggggtggcaaaggcgcaggggtattttattgggagccggctgcaaccccaggttacaacaagggctacaacaaaggtgcttggcaggctgacggaaagccaacctccgctttggaaggatttctaaactaa

SEQ ID NO: 1254 - DNA, 1053 bp, Paenibacillus sp.
atgaaaaagcaccgaaacagatttggattgatattcttgagtctctcgatgttactcatgctgctcggcccgtctggtgaagatcgtaaggcggaggcagcccctgcttttgccaaaggagcggatatcagctgggtagcagggatggaagcagcaggatacaagtggaaggacaagaacggggtgcagcgtgatatcctgcaaattttaaaaaatgactatcagatgaactcggttcgcttgcgtgtatgggtgaatcccaacatgagtgattatgtaaacggatatatgaatgcagagaaagcagctgatctcgcgcttagagcgaagaatctgggaatgagtgtaatgctgaccttgcactacagtgactcgtgggctgacccgggacagcagaacaagccttatgcctggcgaaattacacttttcagcagcttatggacgccgtatggtcccacaccatttatgtgatgaatactatgaagaacaaaggggttacaccggattgggttcaaattggtaacgaaacaaatgacgggatgttatggaatgacggtaaagcttccgtaaacatgaaaaattatgcttggctcgtgaacaccgggcataatgccgtgaagtcgatcagtccgaatacgaaaaccatcgtgcacctggcaaacggacatgatcaggccgttctcgactggaatatcggaggtcttgttcaaaatggagccaattttgatgtcatcggactgtctctatatccatcggcctctgattggacgaccaaggtgaatcagaccataacgaatgcgaatcagttgatatcgaagtatggaaaagagattgtcatatccgagatcggtatggattacaatcaggcttcggcagccaagagcttcattacaaagatcaaaaatgatgtgcgtaatatttctggaggcaaagggctcggtgtattctattgggaacctcaagcgacccccgggtataatggtggatacaacaagggtgcctggaacgcagatggcaaaccgactattgcactggaaggatttattaattaa

SEQ ID NO: 1255 - DNA, 1047 bp, Paenibacillus sp.
atgagaggcatgaagtcggtattattgcttgtattaagcttgtccttgctgctagtcccatggagtaccggagtatccacgactgtggaggcggcgccggcctttgccaagggtgctgacatcagttgggtggccggaatggaggcgcagggctacacctggaggaataagcagggagtacagaaggatgtcctgcaaattttgcgcgatgattatcagattaattcggtacggattcgtgtatgggtaaatcctaatatgaacgattatggtaacggctatatgaatgctgacaaggctgccgagctggctgctcgtgccaagaagctggggatgagcgtcatgctgacgttgcattacagcgattcctgggctgatccgggcaagcaaaataagccttatgcatggcgtaatcataatttccagcagctgatggatgcagtgtggagtcatacggtctatgtcatgaacacgatgaagaacaagggagttacaccggattgggtgcagattggcaatgagaccagtgacggaatgctgtggccggacggcagagcatcgcaaaatatgaagaattatgcgtggctcgtgaacacggggcataatgccgtcaagtcggttagcagcagcaccaagaccatcgtacatcttgctaccggtgaggatcgcgcgctgtttgaatggaatattggcggactgattgacaatggcgctaattttgatatggtgggtatgtccctgtatccttccaagtccgactggcagagcaaagtgaatcagacgattcagaatgctaataatgtgattagcaaatacaaaaaagatgttgtgatttcggaaatcggtttggagtataatgaagctgcggctgctaaaagctttatttcggatatcaagcagaaggtaaggaatctatcgggtggaagaggcaagggcgtattctattgggagcctgccgcgactccgggctacaacgatggctataataaaggagcctggggaacagacggccgacctacgcaggcccttgagggcttcctgaactaa

SEQ ID NO: 1256 - DNA, 1053 bp, Paenibacillus sp.
atgactggagtcgcgaaaggagtttggttcagaatgtttctttgcatgtcgatgcttgcgttaacgtttggcttttcgggtaacgacgccgccgaggcggcgcctgcctttgcaaaaggtgcggacatcagctgggttcccggtatggaagctcaagggtataagtggaaggacaagacaggggttcagcgcgatattctggacattctgaagaacgattaccagatcaattcggcaaggatccgtgtctgggtcaatcccaacatgaatgattacatgaacggttatctgaatgcggaaaaagccgccgagctggcccagcgtgccaagaataaaggcatgagcattatgcttacgctgcattacagcgattcctgggcggatccgggacagcagaacaagccctatgcttggcgtaattttacttttcagcagctgatggatgcggtctattcccataccgtctatgtgatgaacaccatgaagaacaaaggcgtgactccggattgggtacaggtcggcaacgaaaccaacaacggaatgctgtgggaggacggcaaggcctcagcgaacatgaagaattacgcatggctcgtcaatacggggcataacgcggtgaagtccgtcagcggccaggccaagacgatcgttcatttatcgaatggctacgacaatgaattgttcaagtggaatattggcggcttgatcagcaacggcgcgaacttcgatattatcggcatgtcgctgtacccggaagcgggcgattggtcatcgaaggtcgatcagacgatagccaatgccaaagacatgaccgccagatatggaaaaagcatcatgatcagcgaaattggcatggattacaatcagccggcggcagccaagagctttgtccagagcatcaagaccaaggtgagaggcttagcgggaggtaccgggctgggcgtgttctactgggagcctgaagctacgccgggatacaatgcgggatacaacaagggagcctggcaggcggacgggaagccgaccattgccttggaaggctttaaagactga

SEQ ID NO: 1257 - DNA, 1035 bp, Paenibacillus sp.
atcctgatggcggcgctgctcctgctgctcgctccggcatgggagggcgccggcgctggggtcggcggcaaggcggaggcagcgccggccttcgccaaaggagccgacatcagctgggtggcggccatggaggcgcagggctacaagtggaaggataaaaacggcgtcacgcgggacatcttcaacattctcaaaaacgactacggactgaactccgcccgcatccgcgtgtgggtcaatccgaatatgagcgactacggcaacggctacctgaacgccgacaaggcggccgagctggcggcgcgggcaaaggcgcagggcatgagcgtcatgctgtcgcttcattacagcgactcgtgggccgatcccggcaagcagacgaagccctatgcgtggaccggcttcaccttcaatcagctgatggacgccgtctggtcgcataccgtatacgtcatgaacacgatgaaggcgaagggcgtcacgccggactgggtgcagattggcaacgagacgaacgacggcatgctgtggcaggacggccgcgcgtccgtcaatatgaagaactacgcctggctcgtcaatacgggcaacaacgcggtcaagagcatctttccgtcgaccaagacgatcgtgcatctggccaacggctacgacaacgcgctgttcgtctggaacatcggcgggctgatcgcgaacggcgcgacgttcgactacatcggcatgtcgctctatccgtccgtctccgactggcagacgaaggtgacgcagaccgtcgccaatgccaatgacatgatcgcccgctacggcaaaagcgtcatgatctgcgagatcggcctcgactacaatcagccggccgcgtcgaagagcttcatcgccgatatcaagacgaagatccggaacatctccggcggcaaaggcctcggcgtgttctactgggagccgcagtcgacgccgggctacaacggcggctacaacaagggcgcctggcaggccgacggcaagccgacgatcgcgctcgacggcttcttgaactag

SEQ ID NO: 1258 - DNA, 1866 bp, Paenibacillus sp.
atgaacaaaaggtttcggtatactgcgttgctctgtctcggtgtaatgttgagtggagtggtcaccccgatggatagccaggtctctgctgcttctacgaggcaaatggaaaagctaagccggggagctgtcgctgttaaggtgcctgagggtgtactggtgagctggcgcttgctgggcacggaagcggattcggtcggctttaatttgtacagagggacaagcaaggtgaacgatgcgccgattacatcgagaaccaactttttggacaaggcaggtacgacctcatcttcgtataccgttcgtgccgtggtcaatggagcagagcagggcgcttctcctgcggtgaaggtatggaacaacaactacctggatgttccgatccagcagcccgcgggaggcacaactccggataatgtgaactacacataccatgccaatgatgccagcgtaggggatctggatggggatggcgagtatgagattgtgttaaaatgggacccttccaatgccaaggataattcgcaatccggttatacgggaaatgtatttttggatggctacgagctggatggaacacgcaaatggcggatcgacctgggacggaacatacgggctggagctcactacacgcaatttctcgtctacgattttgatggagatggtaaagcagagatcgtatgtaaaacagcagacggcacagtggatggtgcaggtgtaaagattggggacgcttcggctgattatcgaaacacgagcggatatattttgaaaggtcctgagtttctaactgtgttctcaggtgatacaggcaaggctcttagtacgattgactacgtgccaccgcgcggaacggtatcgagctggggagataattatggtaaccgtgtggatcgttttctcgccggggttgcttatctggatggtgtgagacccagcattgtgatggcacgtggttattacacccgcaccgttctggtcgcatatgattggcggaacggtaacctgagccgacgctggacctttgacagcaacagctccaccaatgccgggacggctggacaggggaaccacagtttgagcgtggcggatgtggatggagatgataaggatgagatcgtgtatggctcgctggttgtagacgataacggagcgaagctggctaacacggggatgggacatggagatgcacttcatgttggcgatctggaccccgaccgttcaggttatgaagtgttcaaggtgaacgaggacaaaaatgccacctacggagctgccatgtacgacccgcgtaatggaaatattttatggggcgtaaatacaggcaaggataccggaagaggcatgtcggcagacattgacccgcggaccaaagggaacgagcagtgggcaccgggtattggtttgcgttcagccaaggggcagctcatcaccaacacgctaccgtcttccattaattttggcatctggtgggatggggatctcctccgtgaactgctggatcatacctcatcaagcgctggaaagatagacaagtggaactatacgaactcgactacttccaacttgcttacggcaacaggaacgagttccaataacggaaccaaaggaacaccgtccttgcaggccgatctcttcggtgactggcgtgaggaagtcatttggcgcaaaagtgataattcggcgctgcggatctacacaacaccatacgagtcagaacatcgattctatacgcttatgcatgatccagtgtatcgcctgagtgttgcctggcagaacgtagcttataatcagccgccgcacaccgggttttatctcggagaagggatgtccaagccccagcagccgaatatatatactccttga

SEQ ID NO: 1259 - DNA, 1866 bp, Paenibacillus sp.
atgaacaaaaggtttcggtatactgcgttgctctgtctcggtgtcatgttgtgtggagtggttaccccgatggatagccaggtctctgctgcctctacgagacaaatggaaaagctgaaccggggagccgtcgctgttaaggtgcctgagggtgtactggtgagctggcgcttgctgggcacggaagcggattcggtcggctttaatttgtacagagggacaagcaaggtgaatgatgcgccgataccatcgagaaccaactttttggacaaggcaggttcgacctcatcttcgtataccgttcgtgccgtggtcaatggagcagagcaggccgcttctcctgcggtgaaggtatggaacaacaactatctggatgttccgatccagcagcccgcgggaggcacaactccggataatgtgagctacacgtaccatgccaatgatgccagcgtaggggatctcgatggggatggcgagtatgagattgtgttaaaatgggacccttccaatgccaaggataattcgcaatccggttatacgggaaatgtatttttggatggctacgaactggatggaacgcgcaaatggcggatcgacctgggacggaacatacgggctggagcccactatacgcaatttctcgtctatgattttgacggagacggcaaagcagagatcgtatgtaaaacagcagacggcacggtagatggtacaggtgtaaagattggggacgcttcggctgatcatcgaaacacgagtggatatattttgaacggacccgagtttctgaccgtgttctcaggaaatacaggcaaggctcttagtaccattgactatgtgccaccacgcggaacggtatcgagctggggagataattatggtaaccgtgtagatcgttttctcgccggggttgcttatctggatggcgtgagacccagcatagtgatggcacgtgggtattacactcgcaccgttctggtcgcatatgattggcggaatggtaacctgagccgacgctggacctttgacagcaacagctccaccaatgctggaactgctggacaggggaaccacagtttgagcgtggcagatgtggatggagatgataaggatgagatcgtgtatggctcgctggttgtagacgataatggagcgaagctggctaacacggggatgggacatggagatgcacttcatgttggcgatctggaccccgaccgttcgggctatgaagtgttcaaggtgaacgaggacaaaaatgccacctacggagctgccatgtacgatccgcgtaatggaaatattttatggggcgtaaatacaggcaaggataccggaagaggcatgtcagcagacattgacccgcggaccaaagggaacgagcagtgggcaccgggtattgggttgcgttcagccaagggacagctcatcaccaacacgctaccgtcttccattaattttggcatctggtgggatggggatctcctccgtgaactgctggatcatacctcatcaagcgctggaaagatagacaagtggaactacacgaactcgactacttccaacttgcttacggcaacaggaacgagttccaataacggaaccaaaggaacgccgtccttgcaggccgatctgttcggtgactggcgtgaggaagtcatttggcgtaaaagtgataattcagcgctgcgtatctacacaacaccatacgagtcagaacatcgattttacacgcttatgcatgatccagtgtatcgcttgagtgttgcctggcagaacgtagcttataatcagccgccgcacaccgggttttatctgggagaagggatgcccaagctccagcagccgaatatatatactccttga

SEQ ID NO: 1260 - DNA, 1866 bp, Paenibacillus sp.
atgaacaaaagatttcggcatactgtgttgctctgtctcggtgtcatgttgtgtggagtggtcgctccaatggatagcccaatctcagctgcgtctacgaggcaaatggagaagctgaacaggggaactgtcgcagtgaaggtaccagaggggatactggtgagctggcgtttatcgggtacggaagcggattcggttggcttcaatctgtacagagggtcaagcaaggtgaatgatgcgccgattacatcgagaaccaactttctggacaaggcaggtacgacatcatcttcgtataccgttcgtgccgtggtcaatggagcagagcaggccgcttctccagcggtaaaggtatggaacaacaactatctggacgttcccatccagcagcctgcagtaggtacaaccccggatcatgtgaactacacgtacaatgccaatgatgccagtgtgggggatctcgatggggatggcgaatatgagattgtgttgaaatgggacccttccaattctaaggataattcgcaatccggttatacgggaaatgtatttttggacggatatgagctggatggaacacgcaaatggcgaattgatctgggacggaatattcgggctggtgcacactatacgcaatttctcgtctatgattttgatggagatggtaaagcagaggttgtatgcaagacagcagacggcacggtagatggtacaggagtaaagattggcgacgcttcggctgatcatcgcaacacgagtggatatattttgaaaggtcccgagtttctaactgtgttctcaggtgatacaggcaaggctcttagcacgattgactatgtacctccgcgcggaacggtgtccagctggggagataactatggtaaccgtgtggatcgttttctcgccggggttgcttatctggatggcgtaagacccagcatagtgatggcacgtggttactacacgcgcaccgttctagtcgcatatgattggcggaacggcaatctaagccgccgctggacctttgacagcaatagctccaccaacgccgggacggctggacaggggaatcacagtttgagcgtggcagatgtggatggagatgataaggatgagatcgtgtatggctcgctggttgtagacgataacggggcgaagctggctaacacggggatggggcacggcgatgcacttcatgtaggcgatttggacccggaccgttcaggttatgaagtgttcaaggtgaacgaggacaaaaatgccacttacggagccgccatgtatgatccgcgtaatggcaacattttatggggcgtaaaaacaggcaaggatacgggacgaggcatgtcggcagacattgatccgcgtaccaaaggaaacgaacagtgggcaccgagcatcgggttacgttcagccaagggagagctcattaccaacacgatgccgtcctccattaacttcggaatttggtgggatggggatctcctccgtgaactgctggatcatacctcctcaagcgctggtaaaatcgacaagtggaactatacgaactcgacgacttccaacttgcttacggccacagggacgagttccaataacgggaccaaaggaacgccgtcgctgcaggctgatctgttcggtgactggcgggaggaagtcatttggcgcaaaagtgataattcggcgcttcgtatctatacaacaccttatgagtcagaacaccgattttacacgcttatgcatgatccggtgtaccgcctgagtgtggcctggcagaacgtagcctataatcagccaccgcacaccggattttatttgggagaagggatgtccaagccccagcagccgaacatatacactccttga

SEQ ID NO: 1261 - DNA, 1866 bp, Paenibacillus sp.
atgaacaaaaggtttcggtatactgcgttgctctgtctcggtgtcattttgagtggagtggtcaccccgatggatagccatgtctctgctgcctctacgaggcaaatggaaaagctgaaccggggagccgtcgcggtcaaggtgccggagggcgtgctggtgagctggcggctgctgggcacggaagcggattcggccggcttcaatctgtacagagggacaagtaaggtcaatgctgcgccgattacgtcgaaaaccaactttctggacaaggcaggtacgacctcatcatcttacactgttcgtgccatagtgaatggagcagaacaggctgcttctctggcggtaaaagtctggagcaacaactatctggatgttcccatccagcagcctgcaggtggtacaaccccggataatgtcagctacacgtaccatgccaatgacgccagtgtaggtgacctggatggggatggcgagtatgagcttgtgttaaaatgggacccttccaatgccaaggacaattcacaatccggctacacgggaaatatatttttggatggctacgagctggacggaacacgcaaatggcggatcgatctgggcaggaatattcgggcaggagcgcactatacgcaatttctcgtctatgattttgacggagacggcaaagcggaaatcgtatgcaaaacagcagacggcactaaagatggcacaggggtgatcatcggcaacgcctcggcggattatcgcaatgccagtggttatattttggacgggtctgaatttttgaccgtgttctcgggcgatacgggcaaagcacttagcacgattgactatgtgccgccacggggaacggtatccagctggggagataattatggcaaccgggtggatcgttttctcgccggggttgcttatctggatggcgtacggcccagcattgtgatggcacggggttattatacccggacggttctggtcgcgtacgattggcgtaatggtaacttgaatcgacgctggacctttgatagcaacagctacgccaatgccgggaccgccggacagggcaaccatagcttgagcgtggcggatgtggatggagacgataaggatgagatcgtgtacggctcgctggtggtggacgataacgggaccaagctagcaaatacgggcatgggacacggcgatgcgcttcatgttggggatctggacccggatcgttcaggctatgaagtgttcaaggtaaacgaggacaaaaacgccacctacggcgctgccatgtacgacccgcgtaatggtaacattttatggggcgtaaatacaggcaaggatactggaagaggcatgtcggcagatattgacccgcgtaccaagggcaacgagcaatgggcaccgggcatcggcgtgcgttcggctaaaggagagcttattacgaatacgctaccgtcctccattaattttggcatctggtgggatggcgacttgctgcgtgagctgcttgaccatacctcttcaagcgctggaaaaatagataagtggaactatacgaactcaaccacttccaatttgcttacggcgacaggcaccagctccaataacggaacgaaaggaacaccgtccttgcaggccgatctgttcggagactggcgcgaggaagtgatttggcgcaaaagcgataattcggcgctgcgtatctacacaacaccatatgagtcagagtatcgtttttatacacttatgcatgatccggtgtaccgcctgagcgtggcttggcagaacgtggcctataaccagccgccgcacactggattttatctgggagaagggatgtccaagcccgcgcagccgaatatatacatcccttga

SEQ ID NO: 1262 - DNA, 1866 bp, Paenibacillus sp.
atgaaaaaaagatttcggtataccgcgttgctctgtctcggtgtcattttgtgtggaacagtcaccccgatggatagccaggtctttgctgcttctgcgaggcaaatggaaaagctgaaccgtggagccgttgcggtcaaggtgccggagggcgtgctggtgagctggcgtttgctgggcacggaagcggatttggtcagcttcaatctgtatagagggacaagcaaggtcaatgatgcgccgattacgtcgaaaaccaactttttggacaaggcaggtacgacttcctcctcgtacacggttcgtgccgttgtgaatggagcagaacaggctgcttctcaggcagtgaaggtttggagcaacaactatctggatgttcccatccagcagcctgcgggcggtacaaccccggataatgtgagctacacgtacaatgccaatgacgccagtgtaggtgatctggatggggatggcgagtatgagattgtgttaaaatgggacccttccaatgccaaggacaattcgcaatccggctacacgggaaatgtatttctggacggctacaagctggatggaacacgcaaatggcgaatcgacttgggccggaacatccgggctggagcgcactacacgcaatttctcgtttatgattttgacggagacggcaaagcagaaatcgtatgcaaaacagcagacggcactaaagatggcacaggggtgaccatcggcaacgcctcggcggattatcgcaatgccagtggttatattttggatgggcctgaatttctgaccgtgttctcgggcgatacgggcaaagcacttagcacgattgactatgtgccgccacggggaacggtatctagctggggagataattatggcaaccgggtggaccgttttctcgccggggttgcttatctggatggcgtgcggcccagcattgtgatggcacggggttattacacccggacggttctggtcgcgtacgattggcgtaatggtagcttgaatcgacgttggacctttgatagcaacggttcgaccaatgctggaaccgctggacagggcaaccatagcttgagtgtggcggatgtggatggagacgataaggatgagatcgtgtacggctcgctggtggtggacgataacgggaccaagctggctaacacgggcatgggacacggggatgcgcttcatgttggaaatttggacccggaccgttcaggctatgaagtgtttaaggtaaacgaggacaaaaatgcgacttatggcgctgctatgtatgatccgcgtaatggaagcattttatggggcgtaaatacaggcaaggataccgggagaggcatgtcggcagacattgatccccgtacaaaaggaaacgagcaatgggcgccggggatcggtgtgcgttcggctaaaggagagcttattacgaatacgctaccgtcctccattaactttggaatttggtgggatggcgacctgctgcgtgaactgctggatcatacctcgtcaagcgctggtaaaatcgacaagtggaactataccaactcgaccacttccaatttgcttacggctacaggcaccagctccaataacggaacgaaaggaacaccgtccttgcaggccgatctgttcggcgactggcgcgaggaggtgatttggcgcaaaagcgacaattcggcgttgcgtatctacacaacaccgtatgagtcagagtatcgtttttatacacttatgcatgatccgttgtatcgtctgagtatagcgtggcagaacgtggcctataaccagccgccacacactgggttttatctgggagaagggatgtccaagcccgcgcagccgaatatatacattccttga

SEQ ID NO: 1263 - DNA, 1866 bp, Paenibacillus sp.
atgaacaaaggatttcggtataccgcgttgctctgtctcggtgcaatgctatgtggaatggtcactccgatggatagtcatgtctctgctgcctccacgaggcaaatggaaaagctgaaccggggagcggttgcggtcaaggtgccagagggtgtacttgtgagctggcgtttgttgggtacggaagcggactcggtcagcttcaatctgtacagagggacaagtaaggtgaatactacgccgattacctcaagaaccaactttttggataaggcaggtacgacctcatcctcgtacacggttcgtgccgtggtaaatggaacagaacaggccgcttcacctgcggtaaaggtatggagcaacaattatctggacgttcccatccagcagcctgcgggtggtaaaaccccggataatgtcagctacacgtataatgccaatgatgccagtgtaggggatctggatggggatggcgagtatgagcttgtattaaaatgggacccttccaattccaaggataattcgcaatccggctatacgggaaatgtatttttggacggctacgagctggatggaacacgcaaatggcgaatcgatctgggacggaacatccgcgctggagcgcactacacgcaatttctcgtctatgattttgatggtgatggcaaagcggaaattgtatgcaaaacagcagatggcacggtggatgggacaggtgtaaagattggcaatgcttctgctgaccatcgcaactccaacgggtatattttgaacggccccgagtttttgaccgtgtttgctggcaatacaggcaaggccctcagcaccattgattatgtgccgtcacgcgggtcggtgtcgagttggggagataattatggcaaccgagtggatcgttttctggccggggttgcttatctggatggggtgcggcccagcattgtgatggcacggggctattacacccggacggttctggtcgcatatgactggcgtaacggaaatctgagtcgtcgctggacctttgacagcaacagctccaccaatccggggacagctgggcaggggaaccatagcctgagtgtggcggatgtggacggagatgataaggacgagatcgtgtacggctcgctggtggtggacgataacggggcgaagctggttaacacgaagatgggacacggcgatgcacttcatgtcggggatttggacccggaccgttcaggatatgaagtgttcaaggtaaatgaggacaagaacgcctcctacggcgctgccatgtacgatccgcgcaacggaaacattttatggggcgtaaaaacaggcaaggataccggacgaggcatgtcagcagacattgatccacgtacgaaggggaatgagcaatgggcaccagggatcggtgtccgttcggctaaaggagagctgattacagataagctgccgtcctccactaactttggaatttggtgggatggcgacctgctgcgcgaattgctagatcatacctcctcgagcgccggtaaaatcgacaaatggaactataccaactcgaccagctccaatttgcttacagcgacaggaaccagctctaataacggaacgaaagccacaccgtccttgcaggctgatctgttcggtgactggcgcgaggaagccatttggcgcaaaagtgacaattcggcgctgcgaatctacacgacaccttacgaatcggaacaccgattctatacacttatgcacgatccagtgtaccgcttgagcgtggcctggcagaacgtagcgtataatcagccgccacacaccagtttttatctgggggaaggaatgtctaagccccggcagccgagtatatacactccttga

SEQ ID NO: 1264 - DNA, 1887 bp, Paenibacillus sp.
atgaactcatggtaccgcaagccgctgaaatgggctgtaatcgccctgtccagcgctatcttgggcacggccttgctgacgagcgctcccgctcaggccgccgcggccaggcagatggagaagctcgaccgcggcctgacggcggtcaagatcaatggaggcgtgctggtgagctggaggctgctcggcacagacgccggctcggtcagcttcaatctgtaccgcggaagcacgaaggtgaacgccagtccgatcacctccaagacgaactacctcgatgcggccggcacgacctcttcgagctacacggttcgcgccatcgtcggaggcgtagagcaggcggcatcgccgccggcgtcggtgtgggcgaacaactacctggacgtgccgctccagatccctgccgggggaacgactccggacggcgtcagctacacgtatcagccgaatgacgcgagcgtcggcgatctggacggagatggaagctacgagatcgtcgtgaaatgggacccgaccaatgcgaaggacaattcgcaaggcggctataccggcaacgtgtatctggacgcctacgagctgaacggcacccgcctctggcggatcaatctcggcaggaacatccgcgctggcgcgcattatacgcagttcctcgtctatgacttcaatggagacggcaaggcggaggtcgtctgcaagacagccgacggcacggtggacggcacaaatgtaacgatcggaagcgccacagccgatcatcgcaacagcggcggctacattttggccgggccggaatatttgaccgtattcgcaggcaatacgggagctgcgctatccacggtcagctatgacccgccgcgcggcaacgtgagcgattggggcgacggctacggcaaccgggtggaccgcttcctcgccggcgtcgcctacctggacggagtccggccgagcatcgtcatggccagaggctattacacccgcgccgtgctggtcgcctacgactggcgcaacggcgccctcactaagcgctggacgttcgacagcaacagctcggccaatgcgggaacggccggacagggcaatcatcagctggccgtcgccgacgtcgacggcgacagcaaggatgagatcgtatacggcgcgttcgtcgtcgatgacaacggaacgaagctggtcaacacgagcagagggcatggcgatgcgctgcatgtcggcgatctcgatccgtcccgtcccggcctcgaggtgttcaaggtcaacgaaagctcgccttacggcgcctattcctacgatccgaaaacgggctcgatcctatggagcgtcacggccagcgcggataccggacgcggcatgacggcggacatcgatccgcgctacttgggcgaggagatgtgggccacgaacggggtcggcttgcggacggccaaaggggtcctgattacgaattcgtccccagcctcggtcaacttcggcatctggtgggacggcgatctgcagcgcgagctgctggatcatacgtggagcggcagcacgagcacgggcgtcggcaagatcgagaagtggaactacgcgacctcgagcgtgaccaatctgctgaccgcctccggcacgctgtcgaacaaccatacgaagggcacgccgagcctgcaggccgatctattcggcgactggcgggaagaagtcatctggcgcaagagcgacaactcggcgctgcgcatctacacgacgccgtacgagacgagccatcgcttctatacgctgatgcacgatccggtctatcggctgtcgatcgcctggcagaacgtcgcctacaaccagcctccccatacgggcttctacttgggagaagggatggcggctcagcccgttcccgacctgtatacgccataa

SEQ ID NO: 1265 - DNA, 1896 bp, Paenibacillus sp.
atgggaacatggagacgaacatgtcgtaacgtagccctcgctgctattggcagtatggtgcttgctgggatgtattctggtggagaatcaagtatggctgctgcggcacctagacagatggagcagcttgaccgaggtgccatcgctgtaccagtagagggtggaatgctggtaagctggcgaatgctgggcacggagcctgcccatgtcagttatgatgtctaccgggatagcctcaagatcaatgaggcaccgattacggcatcgaccaactttttggacacatcgggtacgacctcttctgagtacaccatcaaggcaattcttaacggcgagccacaagcagaatcatccccagcgatggtatggaacgatacctacatggatgtgcccatccagcagccagcaggaggaacgacgcccgatggtgtagtctatacctataatgccaatgacgcgagtgtgggggatctggatggagacgggaaatatgagattgtgctgaagtgggacccttccaactcgaaggataattcgcaatcaggccacaccggacctgtctatctggatgcctatcaattggatggaaccttgaaatggagaattaatctgggacgcaatattcgtgccggtgcgcattacactcaatttctggtctacgattttgatggggatggacgggcagagattgtcagcaagaccggagatggcacgattgatggagtcggtcaggtcattgggaatgccacggcggattatcgcaattctgcaggttatgtgttaagtggaccagagtatttgaccgtgttcgacggggatacaggacaagccttgactacaatagactacgagccgccaagaggcagtgtatcctcatggggagataactatggtaaccgcgtggaccggttcttggcaggtgtagcttatctggatggaactcgccccagtatcgtcatggcacgaggatattatacgcgttctgtcctagtcgcctacgattggcgtgatggagagctcacacgaagatggatatttgacagcaatgctccggcgaatgcggggaccgcaggacagggcaatcacagtctgagcgtagccgatgtggataacgacggcagggatgagatcatctatggctccatggtcgtggacgacgatggtaccctcctggtgaataccaaaatgggacacggggacgcccttcatgttggcgatctgaacccggatcgtccaggcctagaggtcttcaaggtgaatgaggatcgaaacggcaaatatggagcagccatgtacgatccgcagacgggtgagattctgtggggagtgcacaccggggtggataccggacgcggcatgtccgcagacatcgaccctcgctataagggagcggagcagtgggcatcgggaaatgtaggcttgcgcaccgctacaggagagctgattagcagcacatccccttcgtccaggaactttggcatttggtgggatggagatctgctgcgtgagctgctggaccatacccgatctagcaacaacgagacaggcgtcggcaagattgagaaatgggactatatcaatgagtcgccagtgctgctgctgaacgcggatggaacgttatctaataatggcaccaagggtacaccagctctgcaggcggatctctttggcgactggcgagaggaagttatctggcgaacagcggataattcggccctgcgaatctactctacaccgtatgagacggagcatcgtttttacacgcttatgcatgatcccgtctatcgactaagtatagcctggcaaaatgtagcctataatcagcctccacatacaggcttttatctgggtgagggcatggagtcgcctccacagccagccatttatacaccttag

SEQ ID NO: 1266 - DNA, 1878 bp, Paenibacillus sp.
atggataaaagaaagcgttttctgctgcgttctacggcagcgctcctctttgcagccacactggccgtgtcgccggctcttccccagccggaggcgcatgcggccgcccgccaggcggagaagctgaaccgcggcgtcgtcgccgtccccatgtcgagcggtgtgttcgtttcatggcgcctgctgggaacggaggacagcaccgtgtccttcaatctctaccggaacggaaccaaggtgaattcgacgccgatcacgaacagcaccaattaccaggatcccgggggcaccacatcctccacctatacggtgaaggcggtcgtgaacggcacggagcagacggcctccccggcggcgggcgtgtggggttccggttatctcgatgtgccgatccagaagccggccggcgggacgacaccggacggggtggcttacacttacagcgcaaatgacgcgagcgtaggggacctggacggcgacggagattacgagatcgtgctgaagtgggacccgtcgaattccaaggacaattcgcagagcggatataccggcaatgtgtacctcgatgcctatgagctggatggtacgcggaaatggcggatcgatctcggaaaaaatatccgggcgggcgcgcactacacccagttccttgtgtacgattttgacggagacgggaaggccgaggttgtctgcaaaaccgccgacggcacgaaggacggcgccggggtgacgatcggcagctccacggcggattaccgcaactccagcggatatatcctggacgggcccgaatacctcacggtcttctcgggaacgaacggagcggcgctctccaccattgactatgtgccgccgcggggcaccgtatcaagctggggcgacagctacggcaaccgcgtcgaccgcttcctcgccggcgtggcttatctggacggcgtaaggccgagcattatcatggcccggggctattatacccgcacggtggtcgtcgccttcgactggcgcagcggcagtctgacccgcaagtggaccttcgacagcaacagctcgacaaacggatcggcgacagccggccagggcaaccataacctgagcatcgcggatgtcgatggcgacggcaaagatgaaatcgcttacggatcgctgggcattgatgacaacggagcgaagctgtatgtcacgggactcggacacggcgatgcgatgcacctcagcgacctgaacccggaccgcgccggcctggaggtattccaggtgcatgaaagcacaagcgcagcctacggggcggagattcacgacgcgaagaccggagcggtcctgtggggcaagaacaccggagcggataccggccgcggcatggcggccgatattgatccccgctacaagggagcggagctctgggcttcgggtgtaggccttcatacggtcacgggcacgcagatcagcagctcggcgccgggttcgatcaactttgcaatctggtgggacggcgatctctcccgcgagctgctcgaccacaccggaggaaccggcaagatcgacaagtgggattacaacgcaggctccctgacgcgactgctgacggcgaccggcaccagctccaacaattcaaccaagggcaatccttccctgcaggcggacctgatcggcgactggagggaggaggtcatctggcgcacgtcggacagcaccgccctgcggatctatacgacgaacgcggtgaccacgacgaagctgcataccctgatgcatgatccggtctaccgcctcggcgtagcctggcagaatgtagggtataaccagccgccgcacaccagctactaccttggcacgggcatgagcacgccggccaagccgagcatctacacgacaccgtag

SEQ ID NO: 1267 - DNA, 462 bp, Paenibacillus sp.
atgaccattgcttttatcgtagtagctgcggttgcctttatttttttgctggtatttaatacaaagatgacgcgcaaatcctctcccaaaactcgccccacggaagaggagtcacggcaaagaagcaaacgtccttatcctgtacaggtggaacccgaggtgcgtgaaaggatagattctacgcgagagatgccgcataaggatatcgacgtcgaagaacgtcatgcggaggaacaacacaaggtgcctgatatccagacggataagaaggtagaaaaggatcgcgagaatatcaaagatgcttacggagatcaggattatcgtgcggctttacgtggttttgccaggaaggaagaagaaaaggatggacgttcccaaatatccaatggagagaaggagactcacaaaagtgaggacgagcagtatcgtgaagcactgcgctccatgaaccaaaaaaaatga

SEQ ID NO: 1268 - DNA, 462 bp, Paenibacillus sp.
atgaccattgcttttatcgtagtagctgcggttgcctttatttttttgctggtatttaatacaaagatgacgcgcaaatcctctcccaaaactcgccccacggaagaggagtcacggcaaagaagcaaacgcccttatcctgtacaggtggaacccgaggcacgtgaaaggatagattctacgcgagagatgccgcataaggatatcggcgtcgaagaacattatgcggaggaacaacacaaggtgcctgatatccagacggataagaaggtagaaaaggatcgagagaatatcaaagatgcttacggagatcaggattatcgtgcggctttacgtggttttgccaggaaggacgaagaaaaggatggacgttcccaaatatccaatggagagaaggagactcacaaaagtggggacgagcagtaccgtgaagcactgcgctccatgaaccaaaaaaaatga

SEQ ID NO: 1269 - DNA, 462 bp, Paenibacillus sp.
atgaccattgcttttatcgtagtagctgcggttgcctttatttttttgctggtatttaatacgaagatgacgcgcaagtcctctcccaagactcaccccaccgaagaggatacacggcaaagaagcaaacgtccttatcctgtgcaggtggaacctgaggtgcgtgaattgacagatcatacgcgagagatgcagcataaaaatctcgacgtcgaagaacatcatgcgcaggaacaacataaggtgcctgatatccagacggataagaaggtagaaaaggatcgcgagaacctcaaagatgcttacggagatcaggattatcgtgcggctttacgtggttttgctggaaaagacgaagaaaaggatggacgttcccaaatatccaatggagagaaggagactcacaaaagtgaggacgagcagtaccgtgaagcactgcgctccatgaaccaaaaaaaatga

SEQ ID NO: 1270 - DNA, 462 bp, Paenibacillus sp.
atgaccattgcctttatcgtagtagctgcagttgcctttatttttttgctggtatttaatacgaagatgacgcgcaagtcctctcccaagactcgctctaccgaagaggattcacggcaaagaagcaaacgtccttatcctgtgcaggtggaacccgaggcgcgtgaatggaaagatcctacgcaagatatgcctcctaaggatatcgacgttgaagaacatcatgtggaggaacaacataaggcgcctgatatccagacggataagaaggtgggaaaagatcgcgagaatatcaaagatgcttatggagatcaggattatcgtgcggctttacgtggttttgccaaaaaggacgaagaaaaggatagacgttccccaatatccaacggtgagaaggagactcacaaaagtgaggacgaacagtatcgtgaagcattgcgctccatgaaccaaaaaaaatga

SEQ ID NO: 1271 - DNA, 462 bp, Paenibacillus sp.
atgaccattgcttttatcgtagtagctgcggttgcctttatttttttgctggtatttaatacgaagatgacgcgcaagtcctcttccaagactcgctctaccgaagaggactcacggcaaagaagcaaacgtccttatcctgaacaggtggaacccgaggcgcgtgaatggatagatcctgcgcaagagacgcctcctaaggatatcgatgtcgaagagcatcatgcggaggaacaacacaaggtgcctgatatccagacggataagaaggtggaaaaagatcgcgagaatattaaagatgcttacggagatcaggattatcgtgcggctttacgtggttttgccaaaaaggacgaagaaaaggaaagacattccccaatatccaatggagagaaggagactcacaaaagtgaggacgagcagtatcgtgaagcattgcgctccatgaaccaaaaaaaatga

SEQ ID NO: 1272 - DNA, 462 bp, Paenibacillus sp.
atgaccattgcttttatcgtagtagctgcggttgcctttatttttttgctggtatttaatacgaagatgacgcgcaagtcctctcgcaagactcaccccaccgaagaggatacacggcaaagaagcaaacgcccttatcctgtgcatgtggaacccgaggcgcgtgaatggacagatcctacgcaagacatgcctcctaaggatatcgacgtcgaagaacatcatgcggaggaacaacataaggcgcctgatatccagacggataagaaggtggaaaaggatcacgagaatatcaaagatgcttatggagatcaggattatcgtgcggctttacgtggttttgccaaaaaggacgaagaaatggatagacgttccccaatatccaatggagagaaggagactcacaaaagtgaggacgagcagtaccgtgaagcactgcgctccatgaaccaaaaaaaatga

SEQ ID NO: 1273 - DNA, 462 bp, Paenibacillus sp.
atgaccattgcttttattgtagtagctgtggttgcctttatctttttgctggtatttaatacgaagatgacgcgcaagtcctcggccaagaatcgccccaaccaagaggaatcccggcaaagaagcaaacgtccatatcctgtgcaggtggaacccaaggcgcatgaattgacggagcatacgggagagatccagcctaagaattcgagcgttgaagaacatcgtgcagaggagcagcacaaattgcctgatatccaaacggatataaaggtggagaaagatcgcgagaatacagaaggtgcctacggggaccaggattatcgtgcggctttgcgtggttttgctggaaaggacgaagaaaaggatggacattcccgactctctaatggagagaaggagaattccaaaagtgaggacgagcagtatcgtgaagcactgcgttccatgaaccgaaaaaaatga

SEQ ID NO: 1274 - DNA, 462 bp, Paenibacillus sp.
atgaccattgcttttattgtagtagctgtggttgcctttatctttttgctggtatttaatacgaagatgacgcgcaagtcctcggccaagaatcgccccaaccaagaggaatcccgtcaaagaagcaaacgtccatatcctgtgcaggtggaacccaaggcgcatgaattgacggagcatacgggagagatccagcctaagaattcgagcgttgaagaacatcgtgcagaggggcagcacaaattgcctgatatccaaacggatataaaggtggagaaagatcgcgagaatacagaaggtgcctacggggaccaggattatcgtgcggctttgcgtggttttgctgaaaaggacgaagaaaaggatggacattcccgactctctaatggagagaaggagaattccaaaagtgaggacgagcagtatcgtgaagcactgcgttccatgaaccgaaaaaaatga

SEQ ID NO: 1275 - DNA, 462 bp, Paenibacillus sp.
atgaccattgcttttatcgcagtagctgtggttgccttgatctttttgctggtatttaacacaaagatgacgcgcaagtcctcgaccaagaatcgccccagccaagaggaatcccggcaaagaagtaaacgtccttatcctgtgcaagtggaacccaaggcgcatgaattaacggaacataacggagagatgccgcctaaggattccgaagttgaagaacatcgtgccaaggagcatcagaagttgcctgatatccaaacggatatgaaggtggaaaaagatcgcaagaacatagaaggtgcttacggggatcaggattatcgtgcagctttgcgtggttttgctggaaaggacggagaaaaggatggaggttccccaagatccaatgggaagaaagggacttccaaaagtaaggatgaacagtaccgtgaagcactgcgttccatgaaccaaaaaaaatga

SEQ ID NO: 1276 - DNA, 648 bp, Pantoea sp.
atgagaaacctgtttctgtgcccggtgcttgctgcactggtcctgagcggttgctctgtgggccatactgagtacagtcgcacggcgatgcagcacgtagatatgagcgtgacgggcattccgacgatcctcggtctcggcacactgggcaccagcatacctctgacgcctgaatatagcctcaccgctgcgcacgttgctaaaactgccgtacagcgcgtgaagtcatatcacccttattgcgaccttgcgattatttatcacaagaatgatgctaacacgctggctaaattccgcagcggtgacatcggcgatcccgttaaaatgtatggctacagctttatttccgcgatgcccgttgaatcgacaggggttaatttagcccgcacggctatcaggaataactggaataaaagcccctgtatcgccatggcgtctaacgcaggcgtggttcagggaatgtcgggcggcggcgtttacaaccgtgatgatacgctaagcggcgttattgttggctattctgattcgattaagaatggtcgtaataacaaagtgatcctgaaagatgtgtcactttatattccttacggccagtttaagagctggctagagtcgaatctggctcagacaccgacccgcggtgtctga

SEQ ID NO: 1277 - DNA, 648 bp, unknown
  environmental sample
atgagaaacctgtttctgagcccggtgcttgctgcactggtgctgagcgggtgttccgtgggccacaccgagtacagtcgtacggcgatgcagcacgtagatatgagcgtgacaggcattccgacgatcctcggtctgggcacactgggcaccagcattcctctgacgcctgaatatagccttacggctgcgcacgtggctaaaaccgccgtgcagcgcgttaagtcttatcacccttattgcgaccttgcgattatttatcacaagaatgatgccagcacgctgactaagttccgcagcagtgacatcggtgatccagttaaaatgtatggctacagctttatttcagcgatgccggttgaatcgtccggggttaatttagcccgcacggctattcggaataaatggaataaaagtccctgcttagcgatggcctcgaatgcgggcgtcgttcagggaatgtctggcggtggcgtgtataaccgggatgatacgctgggcggcgttattgttggctattctgactcgatcaggaatgggcgtaataacaaagtgatcctcaaagatgtatcactttatattccttacggtcagtttaagaactggttagagtcgaatctggctcagacaccgacgcgcggtgtctga

SEQ ID NO: 1278 - DNA, 648 bp, Pantoea sp.
atgagaaacctgtttctgtgcccggtgctggctgcactggtgctgagcgggtgttccgtgggccacactgagtacagtcgtacggcgatgcagcacgtagatatgagcgtgaccggcatcccgacgatcctcggtttcggcacactgggcaccagcatcccactgacgcctgaatatagccttaccgcagcgcacgttgccaaaaccgccgtgcagcgcgtgaagtcttatcatccctattgcgaccttgcgattatttatcacaagaatgatgccaccaccctggcaaaattccgcagtggtgatattggcgatcccgttaaaatgtacggatacagctttatttccgcgatgccggtagagtcgacgggggtgaatttagcccgcacggctattcggaataaatggaataaaagtccctgcattgcgatggcctctaatgcaggcgtggttcagggaatgtcgggcggcggtgtttataaccgcgatgaaacgctgagcggcgtgattgtcggttattccgatgccattaaaaatggccgtaacgggaaagtgatcctgaaagacgtttcactttatattccctacggccagtttaaaagctggttgcagtcaaatctggccccgacaccgacgcgcggtgtctga

SEQ ID NO: 1279 - DNA, 702 bp, unknown
  environmental sample
atgtcaaaaatcttcaccagggatttcccgacatgcctgaataaagaaaccatcatgaaaaacctgttgctgtgcccggtgcttgctgcactcgtgctgagcgggtgttctgtgggccatactgagtacagtcgtacggcgatgcagcacgtagatatgagcgtgactggcattccgacgatcctcggtctcggcacactgggcaccagcattcctctgacgcctgaatatagcctgacagctgcgcacgtcgccaaaactgccgtgcagcgcgtcaagtcttatcacccttattgcgaccttgcgattatttatcacaagaatgacgccagcacgctgactaagttccgcagcagcgacatcggcgatccggttaaaatgtatggctacagttttatttcagcgctgccggttgaatcgaccggagttaatttagcccgcacggctattcgaaataactggaataaaagtccctgtatagccatggcctccaatgcaggcgttgttcagggaatgtcgggcggcggcgtttataaccgtgatgatacgctgggcggcgtgattgttggctattctgactcgattaaaaatgggcgtaataacaaagtgatcctgaaagatgtgtcactttatattccttacggccagttcaaaagctggttagagtcgaatctggcccagacaccgacacgcggtgcctga

SEQ ID NO: 1280 - DNA, 648 bp, unknown
  environmental sample
atgagaaacctctttctgtgcccagcgtttgccgcgctggcgttgaccgggtgttccgtgggccatactgagtacagtcgtacggcgatgcagcacgtagatatgagcgtgaccggcattccgacgatcctcggtctgggtacacttggcaccagcattccgcttaccccagaatatagcctgaccgccgcccacgtcgcgaaaaccgccgtgcagcgcgttaagtcttaccatccttattgcgacctggcgattatttatcataagaatgatcccggcaccttaacccgcttccgcagtagcgatattggcgatccgataaaaatgtacggatacagttttatttccgcactgccggttgaatctaaaggggttaatttagcccgcaccactattcgcaatggctggaataaaagtccctgtatggcaatggcctctaatgctggcgtcgtgcagggaatgtcaggcggcggtgtttataacagtgatgagacactgggcggcgtgattgtcggttattctgatgccattaagaatggccgtaacgggaaagtgatcctcaaagacgtttcactttatattccgtacggccagtttaaagcctggctgcagagtaatctggcccagacaccgactcgcggtgcctga

SEQ ID NO: 1281 - DNA, 642 bp, Pantoea sp.
atgcaaaaacagtttttatgcctggcgcttatgacgctggcgctaagcggttgttctgtgggtcacactgagtacagccgtacggcaatgcaacacgtggatatgagtgtgacaggcatccctaccattctcggtttagggacgctgggcaccagcattcctctgacgcctgactacagcctgactgccgcgcacgtggctaaatttgccgtgcagcgcgtgaagtcctaccacccttattgcgaccttgcgattatttatcacaagaatccccctaatacgctgacccagttccgcagcaccgatattggtgatgcggtgaaaatgtacggatacagctatatctccgccatgccggtggagtcgaaaggggtaaacctggcgcgcacagccattcgtaatacctggaataaaagcccttgtatcgcgatggcgtctaacgccggtgtggttcagggcatgtccggcggcggtgtttacaacagtgatgatacgctgggcggggttatcgtaggttattcagatgccattaaaaatggccgcagcggaaaagtgattttaaaagacgtgtcactgtatatcccttacggccagtttaaaaactggttacaggcgacccttccggccacccgtaaaacctga

SEQ ID NO: 1282 - DNA, 642 bp, unknown
  environmental sample
atgcaaaaacagtttttatgcctggcgcttatgacgctggcgctaagcggttgttctgtgggtcacactgagtacagccgtacggcaatgcaacacgtggatatgagtgtgacaggcatccctaccattttcggtttagggacgctgggcaccagcattcctctgacgcctgactacagcctgactgccgcgcacgtggctaaatttgccgtgcagcgcgtgaagtcctaccacccttattgcgaccttgcgattatttatcacaagaatcccccgaatacgctgacccagttccgcagcaccgatattggtgatgcggtgaaaatgtacggatacagctatatctccgccatgccggtggagtcgaaaggggtaaacctggcgcgcacagccattcgtaatacctggaataaaagcccttgtatcgcgatggcgtctaacgccggtgtggttcagggcatgtccggcggcggtgtttacaacagtgatgatacgctgggcggggttatcgtaggttattcagatgccattaaaaatggccgcagcggaaaagtgattttaaaagacgtgtcactgtatatcccttacggccagtttaaaaactggttacaggcgacccttccggccacccgtaaaacctga

SEQ ID NO: 1283 - DNA, 642 bp, Pantoea sp.
atgaaaaaacgttttgtaagttcagcgttgattgcgttggcgctgagcggttgttccgtgggccataccgagtacagccgaacggcaatgcagcacgtggatatgagcgtgacaggcattccgacgattctgggtttaggcacgctgggcaccactattccgttgacgcctgaatacagcctgactgccgcgcatgtggcaaaatttgccgtgcagcgcgtgaagtcttatcacccttactgcgaccttgcgattatttatcacaagaatccgcctgatacgctggctcacttccgcagcaccgatattggcgatcacgtaaagatgtacggttacagctatatttcggcgctacctgttgaatcaaaaggtgtgaatctcgcacgcaccgccattcgtaacctctggaataaaagtccgtgcatcgcgatggcttccaatgctggcgtggttcaggggatgtctggcggtggggtcttcaatagtgacgataccatcggcggcgtgatcgtcgggtattccgattcaattaaaaatggccgtagcgggaaagtgatactgaaagatgtgtcactctatatcccttacggccagtttaaaaactggttacaggcgacgattcctgacacccgtaaaacctga

SEQ ID NO: 1284 - DNA, 657 bp, unknown
  environmental sample
atgaaaacctctctgctttggcctgcgctcgctgcgctggctctgagcggttgttccgtgggccacactgagtacagtcgtactgcgatgcaacacgttgatatgagcgtgacaggcattccgaccgtgctgggtttgggcattctcggtacaaccattcctttgacgccagaatacagcctgacggcggcgcacgtggcaaaaacggccgtgcagcgtgtcaaggcctatcatccttattgcgacgtcgcgattatttatcataaaaacagtccagaaacgctggcgaaattccgcaacggtgctattggcgaaccgattaaaatgtacggttacagctttatttccgctatgccggtggaatcgagcggcgttaatttagcgcgtaccgccattaccaataaatggaataaaaagccctgcatggcaatggcatcaaatgctggcgtggtgcaagggatgtccggtggcgcggtatataatgcggaccaaaccattggcggggtgattgtcggttacagccatgaaatatctaacgttcgcagcaagaaagtcatcttaaaagatgtctcgctgtatattccgtacggggatttcaaaacctggctggaatccaatattggtcagacgcagaaagccacgcctgaccatgcatga

SEQ ID NO: 1285 - DNA, 648 bp, Pantoea sp.
atgagaaaacgactgctcgtgcctgcgcttgctgcgctgggcttgtgcggctgttcggtgggtcataccgaatacagccgtactgcactgtcacatgttgatatgagctttaccggcgcgcccaccattctggggctgggtacgctgggcaccaccattccccttacgcctgaatacagcctgactgccgcccacgtggcaaaatttgccttacagcgggttaaggcctatcacccgtattgtgacgttgcgattatttatcataaaaactcaccctacacgctgacaaaattccgcagcagtgaaatgggcgaaccgattaaaatgtacggctacagttttgttagcgcattgccagttgagtcggagggggttaatttagcccggaccactatccgtaacctctggaataaaaaaccctgcatggcggtggcttctaatgccggtgtggttcagggcatgtccggcggcggtgtttataatcgtgatgatacgttggcgggtgtcatcgttggttataccagcgggattaaaaataaccgcagtggcaaagttttcctgaaagatgtgtcactctacattccctatggggaattcaaaacctggctgcaaagtaatattaatcaggcaccgggtaacagtgcctga

SEQ ID NO: 1286 - DNA, 657 bp, Pantoea sp.
atgagaacttccctgctttggcctgcgctcgccgcgctggcactgagcggttgttccgtgggccatactgagtacagccgtgcggcgctgcaacacgtggatatgagcgtgaccggcatcccgactgtactgggtttaggtgtcctcggcacaaccattcctttaacaccagagtacagcctgacagctgctcacgttgcgaccactgccgtccagcgtgtgaaggcttatcacccgtattgtgatgtggcaattatttatcacaagaacgatcccagcaccttggttaaattccgcaaaagtaacattggcgaaccaattaagatgtatggctacagttttatttctgcgatgccagtggaatccagtggcgtgaatttagcgcgtaccgccattaataatcactggaataaaaaaccatgtgtggccatggctaccaatgctggcgttgtgcagggaatgtcaggaggggcggtgtataattccgatcagacgatggccggtgtgattgtcggctatagccatcggattgataatatccgtagcggtcaggcggtattgaaggatgtctcgctgtatattccctacggtgaattcagaaactggctggagagtaatattggccagacgccggacagcgcgcctgaccatacctaa

SEQ ID NO: 1287 - DNA, 672 bp, unknown
  environmental sample
atgaagaccgccatcatgagaacctccctgctttggccggcgcttgcagcgctggcactgagcggctgttccgtgggccatactgagtacagtcgtacggcgctgcagcacgtggatatgagcgtgaccggcatcccgacggtactgggtttgggcatcctcggtacaaccattccgttaacgccggaatacagtctgactgccgcgcacgtggccaaaaccgccgtgcagcgcgtgaaggcttatcacccctattgcgacgtcgcaattatttatcataaaaacaatccggatacgctggcgaaattccgcagcagcgcggtgggcgagccaattaaaatgtatggctatagttttatttccgcgatgccggtggagtcgagcggcgttaatctggcgcgcaccgccattaataatcgctggaataaaaagccctgtatggcaatggcttccgatgccggtgtcgttcaggggatgtcaggcggcgctgtctataatgccgaccagacaatcagcggggtgattgtgggttacagccatgaaattgctaacgtacgcagcaaaaaagtcatcttaaaagatgtctcgctgtacattccgtacggcgatttcaaacgctggctggaagccaatatcggccagacgccacaaacagcgcccggcccggcgtaa

SEQ ID NO: 1288 - DNA, 642 bp, Pantoea sp.
atgaaaataaccgtactttgcccggcgctgttcgcgctggcgctgaccggttgttccgttggacagactgaatacagcaaagcggcgcttgaacatgttgatatgagcgtaacaggcgtgccgacagtgctgggtttgggtgttctcggtacaactattccccttacgccggagtacagcctgacagcggcgcacgttgctaaaacgtctgtgcagcgcgttaaggcctatcatccttattgcgacgttgcgattatttatcataaaaatagtcctgatacgctggccaggtttcgtaccagcgcgcccggagaagcgattaaaatgtatggctacagttttatttctgccatgccggttgaatcgagcggcgttaatttggcgcgcacggctattactaatcgctggaataaaaaaccctgtatggcaatggcatctaatgcgggtgtgactcagggaatgtcaggcggcgcggtctataacagtgatgaaaccattgccggagtgattgtaggatacagtcatgaaattgcgaacagacgtagcagaaaagtgatccttaaagatgtgtcactctatattccctatggcgattttaagcgctggcttgagcgcaatctcagccaggcgcctgtcacgtag

SEQ ID NO: 1289 - DNA, 630 bp, unknown
  environmental sample
atgaaaacactgccattattgtcagtagtagctgcgctattactcagtggctgctcagtgggaaaatatgagtacagccgggaagcgatggaacgcgttgatatgagcgtaacgggtataccgaccattctgggcctcggcacaatgggtaccagcataccgctcacgcctgaatacagcctgaccgctgcgcacgtggcgaagttcgccgtgcagcgcgtaaaggcctaccatccctattgcgatctggcgatcatttatcataaaaacgatttgaaaacgctgcccgcttttcgtgccggtaagccgggtgacgcggtcaaaatgtttggctacagcttttattctgccatgccggtcgaatccagcggcgttaatttagcgcgcaccggcattcgcaatgagtggaataaaagtccctgcattgctatggcgtcaaacgctggcgtggtgcagggtatgtccggcggcgcggtatataacagcgataacaccgttgcgggcgtgattattggttattcacgtgaaattaaaagtcgtcgccgcgatcagccagtgctgaaagatgtctcgctctatattccttatagcgacttctcgaaatggctggcgcgcgaaaccacttcctga

SEQ ID NO: 1290 - DNA, 627 bp, Erwinia sp.
atgaaaatactgactattatgccagcattagccgcgctattgctgacaggatgctctgtagggaaatatgagtacagcagtgaagctttaaaacgcgttgatatgagttttaccggcgtccctactgttcttggtcttggcacgctcggcaccagtatccccatcactcctgagtacagcctcacagcggcacacgtggcgaagtttgccgtgcagcgggttaaggcttatcacccttactgtgaccttgcgattatttatcataaaaatgatatgaaagagttgcctaaattccgcagcagcggtgtgggcgatccggtaaaaatgtacggcttcagttttatttccgccatgccagttgaatcgaagggaattaacctcgcccgcaccggaatccgcaatgaatggaataaacgtccctgcgtagcaatggcgtcaaatgccggagtcgttaaagggatgtcaggcggagccgtttacaacagcgatgacagtatcggcggggtaattgtcggctttacgtcttcgattaaaaataaacgcagtggcaaagaaattctcaaggatgtgtcgctgtatatcccttataccgattttaaggactggctggctaaatcaacgtcgtaa

SEQ ID NO: 1291 - DNA, 630 bp, unknown
  environmental sample
atgaaaatactgacttttttaccagtgttgctgacactattgctgtcaggttgctccgtgggaaaatatgagtacagcagtgaagccatgaagcatgtggatatgaattttaccggtattcccaccgtgctgggcgtcggaatgctgggcagcagtattccgattacgccggaatatagcctgacggccgctcatgtcgctaaatattccgtgcaacgcgttaaggcttatcatccttattgcgacattgccgttatctatcataaaaatgatatcaaggatttacctaagtttcgcaacagcgaaattggcgacccaatcaaaatgtatggctacagttttatttctgcaatgccagtggaatcaacaggcgttaacttaacccgaaccggtattcgtaatagctggaataaacgcccgtgcgtggcaatggcgtccaatgctggcgtggtaaaagggatgtcaggtggagcggtgtttaacaatgatgacaccatcggcggagtgatcgtgggttacacttcgaaagtgaaaaatcgcgccaacagtcaatcggtactgaaggatgtttcgctgtatatcccgtatgctaactttaagcagtggctggaagaaaccacctcgtcgtga

SEQ ID NO: 1292 - DNA, 267 bp, unknown
  environmental sample
atgaaaatgaaattagctatcgctgcactgagtctggcatccctgttctcagtgggtgctaacgccgccagcctggtgtccaatgaacaggcacagggtctgcagccaatgaatcagaccatcagcattggtggacgaaatggcgaccagacgcatatccgtcaggtgctgtcagagaaagcggatgcccagggcgcaagccactatcgcatcatcgaaaacaaccaggataacacctggcatgtcaccgctgagctttataaataa

SEQ ID NO: 1293 - DNA, 267 bp, Pantoea sp.
atgaaaatgaaattagcgattgctgctcttagtctggcgtccctgttctcagtgggtgccagcgccgccagcctggtatcaaatgaacaggcgcagggtttgcagcccatgaatcagaccatcagcattggtggacgtaacggcgaccagacgcatatccgtcaggtgctgtcagagaaagcggatgcacagggcgcaagccattatcgcatcatcgaaaacaaccaggacaacacctggcatgtcaccgctgagctttataaataa

SEQ ID NO: 1294 - DNA, 267 bp, unknown
  environmental sample
atgaaaactaaattagcaattgctgctcttagtctggcgtccctgttctcagtgggtgccagcgccgccagcctggtatcgaatgaacaggcgcagggtttgcagcccatgaatcagaccatcagcatcggtggacgtaacggcgaccagacgcatatccgtcaggtgctgtcagagaaagcagatgcacagggcgcaagccactatcgcatcattgaaaacaaccaggacaacacctggcatgtcaccgctgagctttataaataa

SEQ ID NO: 1295 - DNA, 267 bp, Pantoea sp.
atgaaaacgaaattagcgattgccgtactgagtctggcttcactgttctcagtaggtgccagtgctgcaagcctggtgtccaatgagcaggcacagggcctgcaatcaatgaatcagaccatcagtattggtggacgcaacggtgaccagacgcatgtccgtcaggtcctgtctgagaaagcggacgcacagggtgcaagccactatcgcatcatcgaaaacaaccaggataacacctggcatgtcaccgctgagctttataaataa

SEQ ID NO: 1296 - DNA, 264 bp, Pantoea sp.
atgaaaaccaaacttgccatcgctgcactgagcatcgccctgttttcagcaggtgccagtgccgccagcctggtttctaatgaacaggcgcagggtttgcagtcaatgaaccagaccatcagcattgcgggccgtaacggcgaccagacgcatatccgtcaggttctgtcggagaaagcggatgcgcagggcgcaagccactatcgcatcatcgaaaacaaccaggacaacacctggcatgtgaccgctgagctgtataaataa

SEQ ID NO: 1297 - DNA, 273 bp, Pantoea sp.
atgaaaactacatttgctattgccgtactcagtctggcctccgtgttctcagtcggtgccagcgcagccagcctggtctcaaaccagcaggcacagagccagaatctgcaaccgatgaaccagaccatcagcgtcagcggtcgtgacggcgatcagaccaatatccgtcaggtcctgtctgagaaagccgatgcgcagggtgccagccactatcgcatcatcgaaaacaaccaggatgacacctatcacgtcaccgctgagctgtataaataa

SEQ ID NO: 1298 - DNA, 273 bp, unknown
  environmental sample
atgaaaaagacattcgctattgccgtactgagtctggcttccgtgttctcaatgggtgccagcgcagccagcctggtatcgaatcagcaggcacagagccagaatctgcaaccgatgaaccagactatcagcgtcagcggccgtgacggcgatcagaccaatatccgtcaggttctgtctgagaaagccgatgcgcagggtgccagccactatcgcatcatcgaaaacaaccaggatgacacctaccacgtcaccgctgagctgtataaataa

SEQ ID NO: 1299 - DNA, 267 bp, Pantoea sp.
atgaaaaccaaattaaccatcgcaatcatcggtctggcatcactgctttctgtcggtgcccacgctgcatcactggttagcaacgatcaggcggctggcctgcaatcaatgaatcagactgttagcgttagcggtattgatggcgaccagaccaacattcgtcaggcactgtcagagaaagccgatgctcagggtgctagccactaccgcatcatcgaagctaaccgtgacaacacttaccactacaccgctgaactgtataaataa

SEQ ID NO: 1300 - DNA, 273 bp, unknown
  environmental sample
atgaaaatccaattaacgattgccgcgctgggcgtggcctcactgctctcttttggtgccaatgccgctagcatggtcacaaatcagcaggcgcaagacatgaatctgcagccgctaaaccaaacaattagcgtaagcggtatcaatggcgaccagaccaacatccgccaggtactgtctgagaaagcggatgcacaaggtgcaggccattaccgcgtgattgagaacaaccgtgacgataccttccacgtcaccgccgaactgtataaataa

SEQ ID NO: 1301 - DNA, 273 bp, Pantoea sp.
atgaaaactaaattatctatcgcagtgctgagcctggcttccgttctttctttcggtgccagcgcagcaagcctgattaccaatgagcaggcagacaccatgaatctgcaaccgctgaaccaaaccatcagcgtgagtggccgtgatggcgaccagaacaacatccgtcaggaactgtccgccaaagccgatgctcagggtgccagccactatcgcatcattgaaaacaatcagaatgacacctaccacgtcactgctgaactgtacaaataa

SEQ ID NO: 1302 - DNA, 267 bp, Pantoea sp.
atgaaaaccaaatcacttatcgctttagccgccctgaccgccgcgctgtcgtttggcgccagcgcagccagtctggtatcgaatcaacaggccgaaacgctgcagccgctgaaccagaccattagcatcagcggtcatgacggcgatcagaccaacatccgtcaggcgctttctcagaaagccgacgcgcagggcgcaagccattaccgcattatcgagaacaaccaggacgacacctaccacgtcacggctgagctctacaaataa

SEQ ID NO: 1303 - DNA, 267 bp, Pantoea sp.
atgaaaaccaaattagctatcgcagtactgggcctggcttctgttctttcttttggcgcaagcgccgcaagcctggtttccaatcaacaagctgaacagctgcaatctctgaaccaaactatcagcgtaagcggtgttgatggcgaccagaccaatgttcgccaggaactgtcgcagaaggccgatgctcaaggtgccagccattaccgcatcattgagagcaaccgtggcgataccttccacgtgactgctgaactgtataaataa

SEQ ID NO: 1304 - DNA, 264 bp, unknown
  environmental sample
atgaatatcaaaacaaccatcgctacagtcagtctgctttccgttatggcgttcggcgcatcagccgcacagctggtcaccggcgatcagacgcagaacctgcagcctgcgggcaccgtgaccatcagtggaaccgcgggatcgccaatggattaccgcgctgagctttctcagaaagcggataaacagggtgccagcgcctataaagttattgaggcgcgcaccggcgataactatcacatcaccgcacagctttataagtaa

SEQ ID NO: 1305 - DNA, 264 bp, unknown
  environmental sample
atgaatatcaaaacaaccattgctacagtcagtctgctttccgttattgcgttcggcgcttctgccgcacagctggtaaccggcgatcaggcgcagaatctgcagcctgcgggtaccgtgaccatcagtggaaccgcgggatcaccgatggattaccgcgcagagctttcacagaaagcggatgagcagggtgccagcgcctataaagtgatcgaggcgcgtaccggtgataactatcacatcaccgcacagctttataagtaa

SEQ ID NO: 1306 - DNA, 264 bp, Pantoea sp.
atgaatatcaaaacaaccatcgctacagtcagtctgctttccgttatggcgttcggcgcatctgctgcgcagctggtaaccggcgatcagacgcagaacctgcagcctgcgggcaccgtaagcatcagtggaaccgcgggtgcaccaatggattatcgtgcagcgctttcacagaaagcggatgaacaaggtgccagcgcctacaaagtcattgaagcgcgcacgggtgataactaccacatcaccgcacagctttataagtaa

SEQ ID NO: 1307 - DNA, 264 bp, unknown
  environmental sample
atgaaaatcaaaacaaccatcgctacagtcagcctgctttccgttatggcgttcggcgcttctgccgcacagctggtaaccggtgaacagacacaaaacctgcagcctgcgggaactgtcaccatcagtggtacagcgggggcaccgatggattatcgtgcggagctttctcagaaagccgatgagcagggtgccagcgcctataaagtgattgaggcccgtaccggcgataactatcacttcaccgctcagctttataagtaa

SEQ ID NO: 1308 - DNA, 264 bp, Pantoea sp.
atgaaaatcaaaacaaccatcgctacagtcagcctgctttccgttatggcgttcggcgcatctgccgcacagctggtaaccggcgagcaagcgcagaatctgcagcctgcgggcaccgtaaccatcagcggtacagcgggtgcccccatggattatcgcgctgagctgtctcagaaagccgatgaacagggtgccagcgcctataaagtgattgaagcgcgcaccggtgataactatcacttcaccgctcagctgtataagtaa

SEQ ID NO: 1309 - DNA, 264 bp, Pantoea sp.
atgaaaatcaaaacaaccatcgcaaccgttagcctgctttccgtaatcgcattcggcgctcaggcagcgcagctgattaccggtgaccaggcgcagaacatgcagcctgcggggacagtgacaatcagtggtacagcgggctcgccgatggactaccgcgcgcagctttcgcagaaagccgatgaacaaggcgccagcgcctataaagtgatcgaagcgcgcactggcgacagctaccacttcactgctgaactctataagtaa

SEQ ID NO: 1310 - DNA, 264 bp, unknown
  environmental sample
atgaacatcaaatcaaccatcgcaacgatgagtctgctctccgtgatcgcttttggcgcttcagcagcgcagcttgtcacggccgatcaaacgcagaatctgcaacctgcaggaaccgtaagcatcagtggcgttgcgggttcacctatcgactatcgcgcccagctgtcccagaaagcggatgaacaaggcgcaagtgcctataaaattattgaggctaataccggcgacagctaccacatcaccgcgcagctgtataaatag

SEQ ID NO: 1311 - DNA, 264 bp, Pantoea sp.
atgaaaatcaaagcaaccatcgcaaccgctagcctgctctcactgttgaccttcggtgcctctgcggcacaactggtcacggcggaacaggctcagaatatgcagcctgcggggacagtgaccatcagtggtactgccggtgcaccaatggattatcgtgctcagctgtcgcagaaagccgatgaacagggtgccagcgcctataaagtgattgaagcccgcaccggcgacaactatcacatcactgctgaactgtataagtaa

SEQ ID NO: 1312 - DNA, 264 bp, Pantoea sp.
atgaacatcaaagcaaccatcgcaacagtaagtcttctttctgctatgacattcggcgcttccgctgcacagctggtgaccgccgaacaagcacagaacttacaacctgccggaaccgtaagcatcagcggtgtagcaggctctccgattgattatcgtgctcagctgtctcaaaaagctgatgagcaaggcgcaagcgcgtacaaaatcattgaagcaaataccggtgacagttatcacctcaccgcacagctttataaatag

SEQ ID NO: 1313 - DNA, 267 bp, Pantoea sp.
atgaaaatcaaaacaaccatcgcaactgctagcctgctttccctgttagcctttggtgcttccgcagcacaactggttaccgaacaacaggcgcagaatctgcaacctaccggcagcactatttcaattagcggaaccggcggttcaccgatggattaccgtgccgagctttcacagaaagcggatgagcaaggtgccagcgcctacaaagttattgaagctaaaaccggcgacagctatcacgtcaccgctgagctgtataagtaa

SEQ ID NO: 1314 - DNA, 267 bp, Pantoea sp.
atgaaaatcaaaacaaccatcgcaactgctactctgctttccctgttcgcctttggtgcttctgcagcacagctggtgactgaacaacaggcgcagaatctgcaacctaccggcagcactatttcaatcagcggaaccggcggttcgccaatggattatcgtgccgagctttctcagaaagcggatgagcaaggtgccagcgcttacaaagtgattgaagcgaaaaccggcgacagctatcacgtgacagctgagctgtataagtaa

SEQ ID NO: 1315 - DNA, 267 bp, Pantoea sp.
atgaaaatcaaaacaaccatcgcaaccgctacgctgctttctctgttcgcttttggcgcttcagctgcccaactggtaacggatgaatccgcgcagaatctgcaatctaccggccagactattaccgttagcggaacaggcggctcacctatggattaccgcgctcagctttctcagaaagccgatgagcagggtgccagcgcgtataaagtgattgaagcgcgcaccggtgacagctatcacctgactgcagagctgtacaaataa

SEQ ID NO: 1316 - DNA, 267 bp, Pantoea sp.
atgaaaatcaaaacaactcttgcaacggctggcctgctctctctgtttgcctttggcgcctctgcggctcaactggttaccagtgaatcagcacaaaatctgcagcctgctggcagcaccatctcaatcagcggtaccggcggttcaccaatggattatcgcgaacagctttctcagaaagctgatgcgcagggcgccagtgcttaccgcgtcatcgaagcgcgtaccggcgacagctatcatgtgaccgccgaactctataagtaa

SEQ ID NO: 1317 - DNA, 273 bp, Pantoea sp.
atgaaaatcaaagccagcatcgccaccctcggcctgctctctgtgatgacttttggcgcttctgcagcgcaactggttacacaacagcaggttgatgaacagaatctgcaatctgtcggtagcactatcactatcagcggcactgccggatcgcctatggactaccgcgcccagctttctgaaaaagcaaatgcgcagggagccagtgcgtacagggttatcgaagcacgcaccggtgacagctatcacgtcaccgctgagctctataagtaa

SEQ ID NO: 1318 - DNA, 282 bp, Plautia sp.
atgaggagacgaattataaaaatcaaaacaaccatcgcaaccgctacgctgctttctctgttcgcttttggcgcttcggcagcccaactggtaacggatgaatccgcgcagaatctgcaatctaccggccagaccattaccgttagcgtaacaggcggctcacccatggattatcgcgctcagctttctcagaaagccgataagcagggtgccagcgcgtataaagtgattgaagcgcgcaccggtgacagctatcacctgactgcagagctgtacaaataa

SEQ ID NO: 1319 - DNA, 264 bp, Erwinia sp.
atgaaaatcaaaacaaccatcgcaacattgagtctgctgtcactgatcaccttcggcgcttcggcagctgaactggtcaccacacaacaggcaaacaatctgcagtctgcgggaaccattagcgtcagcggcaccggcggcgcaccgattgatatacgtcaggcgctgtcacagaaagcggatgcgcaaggcgccagcgcttatcgggtgattgaagcgcgtactggcgacagctggcacgccaccgccgagctgtataaataa

SEQ ID NO: 1320 - DNA, 756 bp, unknown
  environmental sample
atgaaaatccaacaaactgtgttagctcttgggctggcaacgctgctgagcggctgtcaggggttagacaataatgcattgatgcagtcgggcgcgcaggcctatcaggcctataccctgagcgatgatcaggtgaagcagctcagcgatcaatcctgtgagcagatggataaagagaaccagattgcacctgccagcagcgaataccagcagcgtctgaacaagatcgccgccgcgctgggcgacaacatcaacggcgtaccggccaattacaaggtgtaccagaccaaagatgtcaacgcctgggcgatggctaacggctgtatccgtgtctacagcggcctgatggatatgatgacggacaatgaagtggaaggcgtgctgggccatgagatgggccacgtcgcgttaggtcatacgcgcaaggcgatgcagctggcttatgccaccaccgccgcccggaccgcagcggcgtcagtgggcggcgtgattggatcgctgtcgcagtcgcagctgggtgaaatgggcgaaaaactggtcaacgcccagttctcgcaaacccaggagacgcaggcggatgattactcctacgatctgatgaagaagcgcaacatcgacccaatggggctggcgaccagttttgagaagctggcaaaattagaacagggacgtcagagttcgatgttcgattcgcatccggcttctgaggcgcgcgcccagcatatccgtgagcgtattgcggcagacggcaagtaa

SEQ ID NO: 1321 - DNA, 756 bp, Pantoea sp.
atgaaaatccagaaaacggtattagcgcttggactggcgacgctgctgagcggctgtcaggggctggacaataacgcgctgatgcagtcaggcgcacaggcctatcaggcttacacgctgagcgacgatcaggttaagcagctgagcgataagtcctgtgatcagatggacaaagagaatcagatcgcgccggctgacagccaatatcagcagcgtctgaacaagattgctgccgcgctgggcgacaacatcaatggcgttccggctaactacaaggtttaccagacgaaagatgtcaacgcctgggcgatggcaaacggctgtatccgtgtctacagcggactgatggatatgatgaccgacaatgaagtcgaaggggtactgggccatgagatgggtcacgttgcgctgggccacacccgtaaagcgatgcagctggcgtatgccaccactgcggcccgcacggctgccgcgtcggttggcggggtgatcggttcgctgtcgcagtcgcagctgggcgaactgggtgagaaactggtcaacgcgcagttctcccagtcgcaggagtcacaggcggatgactactcctatgacctgatgaagaagcgcaacattaaccccatggggctggtcaccagctttgagaaactggcgaagctggaacagggccgtcagagttcaatgtttgactcccacccggcttcagaagcgcgcgctcagcatatccgcgatcgcattgctgccgacgcgaaataa

SEQ ID NO: 1322 - DNA, 756 bp, Pantoea sp.
atgaaaattcagaaaacggtactggctttggggatgatcgcgctgttaagcggctgcgaggggatgaataacaacggcctgctgcagtcaggtgcacaggctttccaggcgtacacattaagcgatgcccaggtgaagcagttgagcgatcaatcctgtgcccagatggacaaagacaatcaggtcgcgccggcgaacagcgaataccagcaacgtctgaataaaatcgcggccgcactgggcgacaacattaacggtacgccggctaactataaggtctaccagaccaaagatgtgaatgcctgggcgatggccaacggctgtatacgcgtttacagcggcctgatggacatgatgaacgacaatgaagtggaggcggtgctggggcacgaaatgggtcacgtcgcgctgggccatacacgtaaagcgatgcaggttgcctttaccacgaccgccgcgcgcaccgctgccgcgtccgtaggaggcatcattggctcgctgtcgcagtcacaactgggcgatatgggcgaaaaactggtgaatgcgcagttctcccagactcaggaaacgcaggcggatgactactcttacgatctgcttaaaaaacggggaattgaccctgtcggattagcgaccagctttgaaaaactggcgaaactggaacagggtcgccagagctctatgttcgattcgcaccctgattctgaagcccgcgcacaacacattcgcgatcgtatcgcggcagacagcaagtaa

SEQ ID NO: 1323 - DNA, 756 bp, unknown
  environmental sample
atgaaaattcgcgccatggttgtcgcgctgggaatggtttcgctgctgagcggctgcgaaggaatggataataacgcactgttgcagtctggcgcgcaggcgtttcaggcttactcactgaatgacgcccaggttaaagagctgagcgatcagtcatgtgcccagatggataaagagaaccagctggcgccggccaacagcagctatcagcaacggctgaacaaaatcgccgccgcgctgggcgataacatcaacggcgtaccggccaactacaaggtgtatctgaccaaagacgtcaacgcctgggcgatggcgaatggctgtatccgcgtttatagcggtctgatggatatgatgagcgacaacgaagtggaaggcgtgctcggccatgaaatgggccacgtcgcgctcggccacacgcgcaaagcgatgcaggtggctttcgcgaccacggcggcacgcaatgctgcggcgtcggtgggtggcgtgattggttcgctgtcgcagtcacaactgggcgaaatgggcgagaagctggttaacgcgcagttctcacagacccaggagtcgcaggcggatgactattcgtacgatctgctgaagaagcgcggcattaatccgcttggtctggcgaccagcttcgagaagctggcgaagctggatcagggccgccagagttcgatgtttgactcgcatccggattctgagtcgcgcgcacagcatattcgcgaccgcatcgcggcggatgggaagtag

SEQ ID NO: 1324 - DNA, 756 bp, unknown
  environmental sample
atgaaaattcataaaacggcactggctctgggcctggttgcgctgcttagcggctgtgagggtgtaaatagtaatggtctgctgcaatccggcgcacaggcatttcaggcttacacgttgagcgatgctcaggtcaagcagcttagcgatcagtcctgcgcccaaatggacaaagaaaatcaggtcgcgccagctgacagcgagtaccagcaacggctgaataaaatcgctgcggcactgggcgacaacatcaatggtatcccggctaactacaaggtttaccagaccaaagacgttaacgcctgggcaatggccaatggctgcatccgcgtttacagcggactgatggatatgatgaccgacaatgaagtcgaggcggtactgggccatgaaatgggccacgttgcgctgggtcatacgcgcaaagcgatgcaggtcgccttcaccacaacggcagcacgcaccgcggcggcatcggctggcggtattattggttcgctgtcacagtcgcagttgggtgatatgggtgaaaaattagtaaatgcccagttctcgcagacgcaggagactcaggctgatgactactcatacaacctgctgaaaaagcgcggtattgatccggtcgggctggcaaccagctttgaaaaactggcaaaactggaacagggccgtcaaagctcaatgtttgactcgcatcctgactccgaagcgcgtgcgcagcatattcgcgatcgcatcgccgcagacggcaagtaa

SEQ ID NO: 1325 - DNA, 759 bp, Pantoea sp.
atgacgatcaagacaggcatcatggcaattagcctcgcggcgctgctcagcggctgccagggcatggacaataacgcgctgctgcagtcgggcgcgcaggcttttcaggcctacacccttaacgacgcgcaggtgaagcagctcagcgatcaatcctgcgcgcagatggataaagagaaccagcttgcgcccgccgacagcacctaccagcagcgcctgaacaaaatcgccgccgcgctgggcgacaacatcaacggcacgccggccaactaccgcgtctacgtcaccaaagacgttaacgcctgggcgatggctaacggctgcatccgcgtctacagcggcctgatggatatgatggacgacaacgaggtcgaaggggtgctggggcatgagatgggccacgtcgcgctgggtcacacgcgcaaggcgatgcaggtcgccttcggcaccacggcggcgcgcaccgcggccgcatccgtaggcggcgtgatcggctcgctgtcgcagtcgcagctgggcgatctgggcgaaaagctggttaacgcgcagttctcgcaaacccaggagtcgcaggcggatgactactcctacgatctactgaagaaacgcggtatcgatccgatggggctggcgaccagctttgagaagctggcgaaaatgcagcagggccagcagagcagcctgtttgattcgcatcccgattccgcggcgcgcgcgcagcatattcgcgaacgcatcgcggcggacgccgggaaataa

SEQ ID NO: 1326 - DNA, 753 bp, Erwinia sp.
atgaaattaaaaactgccgctttagcatttagtgttgctaccctgcttgctggttgccaaaaccttgataccagcgctctgatgcagtccggcgcccaggcttatcaggccgccacgctgagcgatgcacaggttaaagagttaagcgataaatcctgtcagcagatggacagcgaagcacaaattgcccctgccagcagcacctacgctaaacgactggcaaaaatctccgccgcgctgggtgacaatatcaacggcacaccggccaactataaggtctacgtgaccaaagacgtcaacgcctgggcgatggctaacggctgtatccgcgtctatagcggcctgatggatatgatgaccgacaatgaagttgaaggcgtgctgggtcatgaaatgggccacgtggcgctgggccacacgcgtaaagcgatgcaggttgcttatgccaccaccgctgcccgttcggcggctggcgctgccggtggcattgccgcctcactgtcacaatcgcagctcggcgacctcggcgagaaactggtcaatgcgcagttctcccagactcaggagtcacaggcggatgactactcatttgatctgctgaaaaaacgtggcattaacccgaacggcttggtcaccagctttgaaaaactggcgaagctggaaggcggccatcagagcagcatgtttgactcgcaccctgcttctgcagcgcgcgcagagcatattaaagagcgtattgctgccggaaaataa

SEQ ID NO: 1327 - DNA, 753 bp, Serratia sp.
atgaagattcgtacctctttgattgcactaagtattaccactctgctgggcggttgccaaaacctcaacaccgacacgctgatgcagtccggcgcacaggcattccaggcggctacgctgagcgacgccgacgtcaaagcgctgagtgataaatcctgcgccgagatggacagccaagctcaaatcgcgccggccgacagcacctataccaagcgactgaacaagattgccgcagctttgggggataatatcaacggtacacctgccaactacaaggtttacctgaccaaagacgtgaatgcctgggcgatggccaacggctgcattcgcgtttacagcggcctgatggacatgatgaacgacaacgaggtagaaggcgtgctgggccatgaaatgggtcacgtcgcgctgggccacacccgtaaggcgatgcaggtcgcttatgggaccgtggcgctgcgcaccgcggctgcttcaaccggcggtatcgcggcttcactctctcagtcacagttagccgatctgggcgaaaaactggtgaatgcccagttctcgcagaaacaagaaagcgaagcggacgattactcgttcgatctgctgaagaaacgcggtatcgatccaaacggcctggtaaccagttttgaaaaactggcgaaaatggaaggggatcgcaagagcagcatgtttgacagccacccagcctccgaagcccgcgcgcagcacattcgcgagcgtatcgcggcaggtaaataa

SEQ ID NO: 1328 - DNA, 753 bp, Erwinia sp.
atgaataaacgtatctcttgcatcgcgctggcgctggctggcctgctttccggctgtcagaattttgacagtaatgccctgatgcagtctggcacccaggcctggcaggccgcgaccctgagtgatgtgcaggttaaggagctgagcgacaagtcttgccagcagatggatggcgaagcacaaattgcgcctgacagcagcccctatgctcaacgcctgaaaaaaatcgccgctgcgctgggagataatatcaacggcaccccggccaactacaaagtttatctgaccaaagacgtcaacgcctgggcgatggcgaacggctgcattcgcgtatatagcggcctgatggatttgatgagcgataacgaagtcgaaggcgtgctcggccacgaaatgggccacgttgcgctgggtcactcgcgtaaagccatgcagctggcctgggctaccaccgccgcgcgtagcgctgccgcttccgtcggtggggttaccgcttcgctatcgcagtccgagctgggcgatctgggcgaaaaactggtcaacgcacagttctcgcagagccaggaatctcaggctgatgactactctttcgatctgctgaaaaaacgcaacatcaatcagcaggggctggtgaccagctttgaaaaactggcgaaaatggaaggtagccatgccagcagcctgtttgattcgcacccggcctcacaggcgcgtgctgaccatatcaggcagcgcatcgccgcagaaaaataa

SEQ ID NO: 1329 - DNA, 753 bp, unknown
  environmental sample
atgaaaattcgtacctccgtgatggcactgagcgttgccaccttactgtccggctgtcagaattttgacactaactcattaatgcagtctggtgctcaggcttatcaggcggcgacattaagtgatgcgcaggtcaaagaactgagcgtgcaatcttgtcagcagatggatagcgaagcgcagattgcgccagccagcagtgaatacactaaacgcctggacaaaattgccacctcgctgggtgacaatatcaacgggacgccagccaactataaagtctatctgaacaaagatgtgaacgcctgggcgatggccaacggctgtatccgcgtctatagcggtctgatggatatgatgaccgacaacgaagtcgaaggtgtgctggggcacgaaatgggccacgtcgcactgggccacacgcgtaaagccatgcaggttgcctacgccaccaccgctgcacgcaccgcagccagcgccgctggcggtatcgccgcgtcactgtcgcagtcgcagctgggcgatcttggcgcgcagctggtcaacgctcagttctcacaaactcaggagtcacaggccgatgactactctttcgacctgatgaagcagcgcaaaattgatccgaacggcttagtcaccagttttgagaaactggcaaagctggaaggcagccatcagagcagcatgtttgacacccatccttcttcagcttcgcgtgcagaacatattaaagcgcgtatcgccgcagagaaataa

SEQ ID NO: 1330 - DNA, 759 bp, Klebsiella sp.
atgaaaattcgcccagccctccttgccctgggaatgacaactctgcttgccggttgtcagaacatggattcaaacggttttctcagctccggcgcagaagcctttcaggcttacaccctgagcgatgcgcaggttattgccctgagtgacgacgcctgtaagcagatggacagtaaagccaccatcgcaccggcaagcagcgaatacagccaacgcgtgaacaaaattgccgccgcccttggcgacaacatcaacggtcagccggtgaactacaaggtgtatgtcactaaagacgttaacgcttttgcgatggcgaatggctgtatccgcgtctacagcggcctgatggatatgatgaccgacaatgaagtcgaagcggtagttggccacgaaatgggccacgttgcgctcggtcacgtgaagaaagggatgcaggtggcgctcggtaccaatgcggtgcgcgcggcggcagcctcggcgggcggcgtggtgggtagcttgtcccagtcgcagcttggtgcactcggggaaaaactggtcaactcacagttctcccagcgtcaggagtcggaagcggatgactactcttacgacctgctgcgcaagcgcggcattaacccggtcggtttagccaccagcttcgaaaaactggcgaagatggaccagggccgtcaaagctcaatgtttgacgatcacccggcttcagaagcccgtgcccagcacattcgcgaccgtatggccgcagacggcatcaagtaa

SEQ ID NO: 1331 - DNA, 753 bp, Yersinia sp.
atgaacattcgtacttcgttgatggctttgagtatcaccgcgctgctaagtgggtgtcagaatatgaacaccgaaggcctgatgcaatctggcgcacaggcgtttcaggctgcaacgctaagtgataccgatgtcagaacgctcagcgataaatcctgtgcagaaatggatcaaaaggcgcaaatcgcgccagctgacagcgaatacagcaagcgtctggcaaaaatttccgcagccctcggcgacaatatcaatggaacaccagccaactataaggtttatgtgaccaaagacgtcaatgcctgggcgatggcgaacggttgtattcgcgtatacagcggcctgatggatatgatgactgacaacgaagtggaaggggttttgggccacgaaatgggccacgtcgctttagggcatacccgtaaagccatgcaggttgcttatggcaccatcgccctgcgtaccgcagcgtcttccgctggcggtattgccacttccctgtctcagtcccaacttgcggatattggagaaaaactggtgaacgcccagttctcgcagaaacaagaaagtgaagccgatgattattcctttgaactgctgaaaaaacgcggtatcgatccgaacggtttggtcaccagtttcgaaaaactggcaaaaatggaaggtgggcgaggcagcagcctgtttgacgatcacccggcttctcaggcacgcgccgatcatattcgtgagcgtattaccagcggccagtaa

SEQ ID NO: 1332 - DNA, 759 bp, unknown
  environmental sample
atgaaaatgcgtgcaatcgggctggctgtgggaacaacgctcctgctaagcggctgtcagaatatggattctaacggcctgatgacctcaggcgcagaagcttttcaggcctactcattgagcgatgcgcaggtgaaagcgttgagcgacgaggcctgtaaggatatggatggaaaagctacgcttgccccggcaaacagcacctacacgcagcgtctgaacaagattgcttccgcgctgggcgacaacattaacggtcagccggtgaactacaaggtgtatatggcgaaagacgtcaacgcctttgcgatggcgaacggctgtatccgcgtttacagcggcctgatggacatgatgaccgacaacgaagtggaagcggtgatcggccatgaaatgggtcacgttgcactgggtcacgtgaagaaagggatgcaggttgcgctgggcaccaatgccgtgcgcgcagcggcggcctctgcgggcggcatcgtcggcagcctgtcccagtcgcagctgggcgacgtgggcgaaaaactggtgaactcgcagttctcccagcgtcaggagtcggaagcggatgactactcttacgatctgttgcgcaaacgcggcatcaatccatcgggtttagctaccagcttcgaaaaactggcgaaactggaggagggccgtcaaagctccatgtttgacgatcacccggcttcggaagagcgtgcgcagcatattcgcgaccgtatggcggcagacggaattaaataa

SEQ ID NO: 1333 - DNA, 753 bp, Rahnella sp.
atgaaatttcaccctcttctgttaagcctttttaccgcgtcactggtcagcggttgtgcgaccgtcaataccgacactttaatgcagtccggcgcgcaggcttatcaggcgtataccctgagcgatgccgacgtcaaaacgctgagcgtgcagtcttgtgaagaaatggataaaaaggcgcagatagcacccgacagcagcgaatacgcacagcgcctgaaaaaaatctccgcagcactgggcgatagcattaacggcacgcccgccaactataaggtttacctgaccaaagacgtcaatgcctgggcaatggccaacggctgtatccgcgtttacagcggcctgatggacataatgaacgacaatgaagtggaaggcgtgctcggccatgaaatgggccacgtcgcactcggccacacccgtaaagccatgcaggtcgcctacagcgccacggcggcacgttccgcgatttcgtcactcggcggcgtcagcgcaacattgtcacaatcgcagctggcggatctgggcgagaaatacgtcaatgcgcagttctcgcagaaacaggaatccgaagcggatgattactcgtttgatttgctgaaaaaacgcggtatcgacccgacaggtctggcaaccagttttgagaaactggcaaaactggatcagggcagcagcatcggctggtttgatgatcacccgtcttcagaagcacgtgctaaacatattcgcgagcgaattgctgccgggaaataa

SEQ ID NO: 1334 - DNA, 759 bp, Enterobacter sp.
atgaaaattcgctcaacccttcttgccttcgggatcgcagcaacgttaaccggatgtcagaacatggactccaacgccctgctgagctcgggcgcggaagcattccaggcctactctcttagcgacgaacaggtaaaaaccttaagcgaccaggcgtgtaaagagatggacgccaaagccactatttctccggccagcagcgagtacagcaaacgcctgagcaagattgccgcggcgctgggcgataacatcaacggtcagccggtcaactataaggtttatgaaacaaaagacgtcaacgccttcgcgatggccaacggctgcatccgcgtttatagcggcctgatggacctgatgaacgataatgaagtggaagcggttatcggccacgaaatgggccacgttgcgttgggccacgtgaagaaaggcatgcaggtcgcgctgggcactaacgccgtgcgcgcggcggcggcctccgctggcggcatcgtcggcagcctgtcgcagtcgcagctgggcgatctcggcgaaaaactggtgaactcgcagttctcccagcgccaggagtcggaagcggacgactactcttacgacctgctgcgtaaacgcggcatcaatccatcgggactggccaccagcttcgaaaaactggccaagctggaagccggccgtcagagctccatgtttgacgatcacccggcatcggaagcccgcgcgcagcatattcgcgatcgcatgaaggccgacggtattaaataa

SEQ ID NO: 1335 - DNA, 753 bp, Xenorhabdus sp.
atgaaaattaaagctcttgttgcagtagcggtttctgctgtaattctgacaggttgtaagaatattgatcagggaatgctggctcaatccggaatgcaattattccaagcggcaacactaagtgattctgatgtcaaacagttatctgaccaatcatgtaaggatatggatgcacaaaataaagttgcaccggcatccagccaatacactaaacgtctgaacaaaatcgccaaagcattaggtaacgaagttaatggtacacaggttaactataaagtttatctgactaaagatgtgaacgcatgggccatggctaacggttgtgtgcgtgtatacagcggcctgatggacatgatgaacgacaatgaagttgaaggcgttctgggccatgaaatgggtcacgttgcactgggccacacccgtaaagcaatgcaggttgcttatgcggcagttgctgcacgtaccgcagcggcatcagctggtggtgtagccgcacagttgagcgattctcagcttgcagagttgggtgaaaaattgatcaactcgcagttctcgcagcatcaggaaagtcaggctgatgactcctcttatgatctgctgaaaaaacgcaatatcaaaactgaaggtttagcaaccagcttcgagaaactggctaaactgggcagcggtgaaaccagcatgtttgattcacacccaccttcacaggcgcgtgctcaacacgttcgtgatcgtatcgcagcagataagaaataa

SEQ ID NO: 1336 - DNA, 207 bp, unknown
  environmental sample
atgaaaacgttcgtcatcgccactttactgggtctcttcctgtctccacccgctcttgccagcaatgctgactgtgcgcagcagataagaagtcacagcagcgaagcggcatcgggttatatctacgttaatcggctggatgcgccacaaaagaacccggtcaacgcgcctgccagagcagccgaaaaatcgtctgcgcactggtaa

SEQ ID NO: 1337 - DNA, 207 bp, unknown
  environmental sample
atgaaaacgttcgtcatcgccactttactgggtctcttcctgtctccacccgctcttgccagcaatgctgactgtgcgcagcagataagaagtcacagcagcgaagcggcatcgggttatatctacattaatcggctggatgcgccacaaaagaacccggtcaacgcgcctgccagagcagcagaaaaatcgtctgcgcactggtaa

SEQ ID NO: 1338 - DNA, 207 bp, Pantoea sp.
atgaaaacgttcgtcatcgccactttactgggtctcttcctgtctccacccgctcttgccagctatgctgactgtgcgcagcagatgagaagtcacagcagcgaagcggcatcgggttatgtctacgttaaccggctggatacgccggaaagaaacccggttaatgcacctgccagaacagcagaaaaatcgtctgcacactggtaa

SEQ ID NO: 1339 - DNA, 207 bp, unknown
  environmental sample
atgaaaacgttcgtcatcgccactttactgggtctcttcctgtctccaaccgctcttgccagctatgctgactgtgcgcagcagatgagaagtcacagcagcgaagcggcatcgggttatgtctacgttaaccgtctggatacgccggaaagaaacccggtcaatgcgcctgccagaacagcagaaaaatcgtcagcacactggtaa

SEQ ID NO: 1340 - DNA, 207 bp, Pantoea sp.
atgaaaacgttcgtcatcgccactttactgggtctcttcctgtctccacccgctcttgccagccatgctgactgtgcgcagcagatgagaagtcacagcagcgaagcggcatcgggttatgtttacgttaaccggctggatacgccggaaagaaacccggttaatgcgcctgccagcgcagcagaaaaagcgtctgcgttctggtaa

SEQ ID NO: 1341 - DNA, 207 bp, Pantoea sp.
atgaaaacgttcgtcatcgccactttcctgggtctcttcctgtctccacccgcccttgccagccatgctgactgtgcgcagcagataagaagtcacagcagcgaagcggcatccggttatgtctacgttaaccggctggacaggccggaacgaaacccggtcagcgcgcctgtcagtcctgctgagaaatcggctgcgcgctggtaa

SEQ ID NO: 1342 - DNA, 204 bp, unknown
  environmental sample
atgaaaaggtacgtcatcgccactttactgggtctcttcctgtctctccccgctcttgccagcaatgctgactgtgcgcagcagatgagaagtcacagcagcaaagcggcatcgggttatgtctatgtgaatcgactggatgcaccggagagaagcccggtcagcacgccggcccgaccggcagaacggttcgctgccccctga

SEQ ID NO: 1343 - DNA, 204 bp, Pantoea sp.
atgaaaaggtacgtcatcgccactttactgggtctcttcctgtctctacccgctcttgccagcaatgctgactgtgcgcagcagatgagaagtcacagcagcaaagcggctgagggttatgtctacgttaatcgactggatgcaccggagagtaatccgatcagtgcgccagcccgactgtcagaacggttcactgcccgctaa

SEQ ID NO: 1344 - DNA, 918 bp, Pantoea sp.
atgcgtatatctctgttcagtggcactcccacggtcattggtcatgacaaccgcggcctgaccgtacgcgatatcctgtataatcggcatcccggcttaccggaagcaactgacgagcgcatcacccgtcataggtatgacgcccgtggcttcctgacgcagagtgccgatccgcgtctgcatgaaagagggctggcaaacttcagttccgtgacggacgcggctggccgcgtcctgcgcgccagaggcgcagacaacggaactattgtgatgcttaacgacgccgcaggccgggcttttatgactgtcagtaatatccgcactactgaggacgacacggaagacctgagtcaggcggtgacccgcaactggcagtatgagggcgcaatactgccgggccgtccggttagcatgatggagcaggtaaccggcaaaaccgcccgaatcacggcacgcttcgtgtatgccggcaatgcaggtgaggagaaagcccttaacctggcgggatcctgcgtcagccattacgacacggccggtctggtgcagaccgacagcattgctctcaccggcgtaccgctctccgttatctgccgtctgccgaaggacgcggacaatcctgatgttatgactgactggcagggtgatgatgcctctctctggaacgacctgctggatagtgaatctcaagccactctgaccaccgccgacgccaccggggcggtgctgaccaccaccgatgcacggggcaacctgcagcgcgtggcgtacgacgtggcgggcctgctgtcgggcagctggctgaccgtgaagggcggcagggagcaggttatcgtcgcctccctgacgtactcggccgccgggcagaagctgcgcgaggcgcacggcaacggcgtggtgacctcgtacgcgtatgacgcg

SEQ ID NO: 1345 - DNA, 969 bp, unknown
  environmental sample
atgcgtatatctctgttcagtggcactcccacggtcattggtcatgacaaccgcggcctgaccgtacgcgatatcctgtataatcggcatcccggcttaccggaagcaactgacgagcgcatcacccgtcataggtatgacgcccgtggcttcctgacgcagagtgccgatccgcgtctgcatgaaagagggctggcaaacttcagttccgtgacggacgcggctggccgcgtcctgcgcgccagaggcgcagacaacggaactattgtgatgcttaacgacgccgcaggccgggcttttatgactgtcagtaatatccgcactactgaggacgacacggaagacctgagtcaggcggtgacccgcaactggcagtatgagggcgcaatactgccgggccgtccggttagcatgatggagcaggtaaccggcaaaaccgcccgaatcacggcacgcttcgtgtatgccggcaatgcaggtgaggagaaagcccttaacctggcgggatcctgcgtcagccattacgacacggccggtctggtgcagaccgacagcattgctctcaccggcgtaccgctctccgttatctgccgtctgccgaaggacgcggacaatcctgatgttatgactgactggcagggtgatgatgcctctctctggaacgacctgctggatagtgaatctcaagccactctgaccaccgccgacgccaccggggcggtgctgaccaccaccgatgcacggggcaacctgcagcgcgtggcgtacgacgtggcgggcctgctgtcgggcagctggctgaccgtgaagggcggcagggagcaggttatcgtcgcctccctgacgtactcggccgccgggcagaagctgcgcgatgcgaacggcaagggcgtggtgacctcgtacgcgtatgacgcgcggacgcagcgcctgaccggcattaaaacggcacgccccgccgggcacgca

SEQ ID NO: 1346 - DNA, 747 bp, Pantoea sp.
atgcgtatatctctgttcagtggcactcccacggtcattggtcatgacaaccgcggcctgaccgtacgcgatatcctgtataatcggcatcccggcttaccggaagcaactgacgagcgcatcacccgtcataggtatgacgcccgtggcttcctgacgcagagtgccgatccgcgtctgcatgaaagagggctggcaaacttcagttccgtgacggacgcggctggccgcgtcctgcgcgccagaggcgcagacaacggaactattgtgatgcttaacgacgccgcaggccgggcttttatgactgtcagtaatatccgcactactgaggacgacacggaagacctgagtcaggcggtgacccgcaactggcagtatgagggcgcaatactgccgggccgtccggttagcatgatggagcaggtaaccggcaaaaccgcccgaatcacggcacgcttcgtgtatgccggcaatgcaggtgaggagaaagcccttaacctggcgggatcctgcgtcagccattacgacacggccggtctggtgcagaccgacagcattgctctcaccggcgtaccgctctccgttatctgccgtctgccgaaggacgcggacaatcctgatgttatgactgactggcagggtgatgatgcctctctctggaacgacctgctggatagtgaatctcaagccactctgaccaccgccgacgccaccggggcggtgctgaccaccaccgatgcacggggc

SEQ ID NO: 1347 - DNA, 2004 bp, Photorhabdus sp.
atgagtacatcactgttcagcaggaccccgcaggtcgcggtcctcgataaccgcggcctgccggtacgggagctgcagtaccaccgccacccggacaccccggacgtgacccgtgaacgcatcacccgtatccggtacgacgcccgcggcttcctgcagcagaccgctgacccgcgcctgcacgaggccggactggcgaacttcacgtacctgaccggcctggacggcagcgtcctgcgcacgcagggcgccgataacggtaccctcgtcagcctgaacgatgcggccggccggccgtttatcgcggtcagcaacgtccgcaccgcgggcgacggcacggaggacagaagccaggccgtgacccgcacctggcagtatgaggacgcagcactccccggccgtccgctgagcgtcacggagcaggtgaccggtgaagccgcccgcgtcacggaccgctttgtgtacgccggcaatactgacgcggagaaagccctgaatctggcaggaacatgcgtcagccagtacgacacggccggtctggtgcagacggacagcgttgccctgaccggtgtgccgctctccgtgacccgcagactgctgaagggtgcagacaacccggataccgtggccgactggcagggggctgacgtgtcggcctggaacgacctgctggacggtgacgcccggacaaccctgagcacggcggacgccaccggtgcggtgctgaccaccaccgatgccagaggcaacctgcagcgggtggcgtacgacgtggcgggcctgctgtcgggcagctggttgacggtgaaaggcggcacggagcaggttatcgtcgcctccctgacatactccgctgccgggcagaagctgcgtgaggagcacggcaacggcgtggtgaccacttacgaatacgagccggaaacgcagcgcctgaccggtatcagaacagagcggccggccggacatgtgtcgggtgcgaaagttctgcaggacctgcgctacgggtatgaccccgtgggaaatgtgctgaccgtcagtaacgacgcggaagagacgcgcttctggcgcaaccagaaagtggtgccggagaacacgtacgcttatgacagcctgtaccagctggtgagcgccaccgggcgcgaaatggcagatgccgctcagcagggcagcagcttaccgtcccccgccgttccccttcccaccgacagtacggcatatacccgttacacccgcacttatacctacgacagcgccggcaacctgacgcaaatcaggcacagcgcgccggccacaaataacagctataccacgaacatcacggtaagcgaccgcagcaaccgggctgtgccgggcgcgctgacggagaccccttccggcgtggaggcgctgttcacggcgggcgggcagcagacgcagctgcagccggggcagggtctggtctggacggcgcgcaacgagctgctgaaggtgacgccggtggtgcgtgacggcggtacggacgacagggaaagctaccgctatgatgcggagagccagcgcatactgaaggtgagcacacagaaaaccggcagcagcacacagacgcagcgggtgcagtacctgccgggactggagctgcggagcacaaaggcaggcgacgcggaaacggagagcctggaggtgattaccgtgggtgaggcgggccgtgcgcaggtgcggatgctgcactggacgggcgggaaaccggacgccatcagcaacgaccaggtacgttacagctacgacaatctcaccggcagcagcagcctggagctggacggtgacgggaatatcatcagcatggaggagtactacccgtacggcggcacggcagtctggacggtccgcagcgcgatggaagcggattataagaccgtccgctactcgggcaaggagcgtgacgcaacggggctgtactactacggataccgttactaccagccgtgggcgggccggtggctctctgcagatccggcgggggtggtg

SEQ ID NO: 1348 - DNA, 2985 bp, Yersinia sp.
atgagaacatcattgttcagtaaaaccccttcggtcacggttcttgataaccgcggcctgaccgtgcgcgacatcgcataccaccgccatcccgactcgccggatgttaccagtgagcgtatcacccaccatcagtacgacgcccgcggctttctgacccagagcgccgacccgcgcctgcatggtgccgggctgatgaacttcagctacctgacggacctgaccggccgcatcctgcgcacgcagggggcggataacggtaccaccgtcagcctgaatgatgctgccggacgaccatttatctcggccagtaatatcagcaccagcgacgacggtactgaagacagaggccaggcgatgacccgcacctggcagtatgaggaggcttcactgccgggacgtctggtgagcgtaaccgaacaggtgaccggcaaagccacccgcatcacggagcgcttcgtgtacgctgccaatactgacgcggaaaaaagcctgaacctggccggcgcgtgcgtcagccattacgacactgcgggactggtgcagccggacagcattgccctgaccggtgtaccgctctctgtcacccgccgcctgatgaaaagtgcggataacccggacgccgtggccgactggcagggggcggacgcctccgcctggaacgaccaactggacggcgaaacgcataccaccctgaccaccgcggacgccaccggggcggtgctgaccaccaccgatgcgaaaggtaacctgcagcgcatggcgtacgacgtggcgggcctgctgtcgggcagttggctgaccctgaaggatggcacagagcaggtcatcgtgaagtccctgacatactcagccgccgggcagaagctgcgcgaggagcacggcaacggcgtggtgaccacgtacgaatacgagccggaaacgcagcgcctggtcgggattaaaacggaacgtcccgccgggcacgcctccggggcgaaggtgctgcaggacctgcgttacgagtacgacccggtgggcaacgtgctgaaggtcactaacgatgcggaagagacgcgcttctggcgcaatcagaaagtggtgcctgagaacacgtacacctacgacagcctgtaccagttggtcagcgccaccgggcgcgagatggcaaacgccggccagcagagctgcagcttaccgtccaccaccgtcccccttcctgccgacagctccgcgtatacccgctactcccgaacctatacctacgacgaagccggcaacctgacgcaaattaggcacaatgccccggccaccaacaacagctacaccacaaaaatcaccgtcagtgaccgcagcaaccggggtgtactaagcacactgaccgaaaatgccgcagacgtggacgcgctgttcacggcaggcgggcagcaggctcagttgcagccgggacagcatcttatctggacggcacgtaatgagctgctgaaggtgacgccagtggtccgcgacggcagcacgaacgacagcgaaagctaccgctatgatgcagccagccagcgaatcctgaaggtcagcaggcagaaaacgaacaccagcatgcagacacagcgggtgctgtacctgccagggctggagctgaggagtacaaaatccggcgatacggaaacggaaggcctgcagattatcacagtgggtgaggcgggccgtgcgcaggtgcgggtgctgcactgggagagcggcaggccggatgaaatcactgacgaccagatacgttacagttacgacaatctggccggtagctgcagcctggaactgggcggtgacggcaatatcatcagcgcggaggagtattatccgtacggcggcacggcggtctgggcggtgcggcgcgcggtggaagcggattacaaaaccgtccgctactctggtaaggaacgggatgcgacggggttgtactactacgggtaccggtactatcagccgtgggcgggcagatggctctccgcagacccggctggcatggtggacgggctgaatctgttcaggatggcgcgcaataatcctgttgcgtttattgatcgtaatggtcttaattcagaattgttatattctcaggcattcaagcggacggcaaataaatataacgtaattattggtgtaagggcacctaatccattaggtgaaactttattaaaagaaggctttccatcaaaaaatttccatatgaaggcaaaatccagtccaacaggaccaactgcaggttttattgcagaagacccgatttactctaaggtgtcaccttctgcatataaaaaacagagagcatcaattgataaggcaaaagctttgggctcagaatctatagatttattcattagcaaatcacgaattaatgagttaatagagactgggaatttaaattttctaggcgaaaatcgttactcagcgaagtatccgtatggtactcaagagtttgagattggaaataatggaagagttttaaattcagagggaaaacctgttaaagtaatgactaatccaccggagattggagagagaaaaagcaatagttcccccataacagccgattacgatttgtttgcaattataccaagtgttaatcagtcagttaatgaaagacccctgacagtgcctcataagttattacgtggtaatttttctctccccttcaccagtccaaaagggaaaaatggcatgagtgaagatgtaaatatgggaaatcttcatcattttgggaaaacgatcgtcaacagtttaaataaagagattaacgcagagggatatgctggcggtaaattggtctggcataacgatgaagctggaaatccatttagccctggatttgatgagaatgacaaaccaattttcttcctcccatcaggaggtatgttccaggcaaaaaataaaagtgaattgcttggtttttattccagattgcggaggagtggatacactccagagcatagtccaatttttggtttttaa

SEQ ID NO: 1349 - DNA, 2904 bp, Serratia sp.
atgagcacatcgctgttcagcaaaaccccgacggtcacggtcctcgataaccgcgggctgaccgtgcgcgacatcgcgtaccaccgacatcccggctccccggacattaccagtgagcgcatcacccgccatcagtatgacgcccgcggctttctgacgcagagcgccgacccgcgcctgcacgacgccgggctggcgaacttcagctacctcacagacctgaccggcggcgttctgcgttcagagggcgtggataatggcaccactctggcgctgaacgatgccgccggccggccgtttctggcggtcagcaacatcagcactgccggtgatggcacggaggacagaagccaggcggtaacccgcacctggcagtatgtggactcagaactgccgggccgcacactgagcattacggagcaggccaccggcgaagccgccctcatcacggagcgtttcgtctgggccggtaattctgctgaggagaaggcgctgaatctcgccggcgcgtgcgtcagccactacgacacggccggcctgacgcagaccggcagcatcgcgctgaccggcgtgccgctttccgtcacccgccgcctgctcagggacgtggactatcctgacgtcgtggccgactggcagggcggggatgcctccgcctggaacgacctgctggatggtgaggcataccccaccctgaccaccgcggatgccaccggggcgatgctgaccaccaccgacgcgaagggtaacatgcagcgtgtggcgtacgacgtggcgggcctgctgtcgggcaactggctaaccctgaagggcggcacggaacaggttatcgtcaggtccctgacgtactcagccgccggacagaagctgcgtgaggtgtacggtaacggcgtgatgaccacgtatacgtatgaggcagagacgcagcgccttatcggcattaaaacggaacgtccggcaggacacgcctcgggtgcgaaagtgctgcaggacctgcgctatgagtatgacccggtgggcaacgtcctgaaaatcagcaacgacgccgaggagacccgcttctggcgcaaccagaaagtggtgccggagaacgcttacgtctacgacagcctgtaccagctggtcagcgccaccgggcgcgaaatggcaaacgccggtcagcagggcagcagcctgccttcagtcgccgtcccccttccggcagacaactccgcatacacgaattacacccgcacttacacatacgacagcgccggcaatctgacacaaatccgtcacaacgcccccgcgacaaacaacagttacaccacaaacatcaccgtctccgataaaagcaaccggggcgtgctgagcacgctgacggaaaacccggcggacgtggacgcgctgttcacagcggacggacagcagagacagctcctgcaggggcaggtactggtctggacgccgcgtaacgagctgctgaaggtgacgccggtggtgcgcgacggtagtacggacgacagtgaaagctaccgctatgacggcggccgccagcgcatcctgaaggtcagcgggcagaaaaccggcaacagcatgcagacgcagcgtgcgctgtacctgccgggactggagttgcgcacgaccacatccggcagtacggaaacggaaagcctgcaggtgattaccgcgggcgaggcgggacgggcgcgggtgcgagcgctgcactgggagagcgatacgccggagggtgtcagcaatgaccagctacgctacagctatgacaacctgacgggcagctgcagcctggagctggacggggatagaaacgtcatcagcatggaagagtactacccgtacggcggcacggcgctctggactgcccgcagcgcggtggaggcggagtacaaaaccgtgcgttactcaggcaaggagcgtgacgcgacggggctgtattattacgggtaccggtactaccagccgtgggtgggccggtggctctcctcagatccggcgggcacggtggacgggctgaatttgttcaggatggtaaggaataatcctgtttccatgcaggataatgatggcaggcttccctctctttcatgttttggaccttcggcgaaacaacggtttaatgcaaagatgaaggatgaactttctagattgaatgatgtgagtataccaaaaacaatacatatgatatggattgggacaggcaagatatccgacaaaaacgttgcgttatcacttgaaacagcaagtaagaaccctgactatgataccagggttatttatgatggtggcattgtcgggcatgagactgcaagagattatttagtgagtaagttttccggaagtagcgtgaaaattatggatttgagggggttgccttatttttcagatataagctctcatccagcctttaaatattacgaagaaacggtaaggcaaaaaaaatatgctcaggcaagtgatttgttacgccttcacttgttggaaaacgaggggggcatttataaagacatagatgatacacaggtggaatcatttggatcactttcattcccaaaaggtataggtttcaagggcgaatatgctgctgcacctgacggttctaaagctagtgcagttcctaatacaccaattgcagctgcagaaaagcatcctgtcatcagcaagacacttgggttagcaattgagaactataaaaatggggagggaaatgttttgaaacttgcagggcctgatgtattcactgaggcactatatgatgtagtgccattttcttctcgtactgtactggatgattgggaaagaactaagcaagatgtattcaatgataaaaagcagaaattaagtatggatgagataagattactacatgaaccaaaagtaaaatgctcaagctggaaaggtttgtaa

SEQ ID NO: 1350 - DNA, 2901 bp, Salmonella sp.
atgagcacttcgttgttcagtaacaccccgacggtcacggtcctcgacaaccgcggactgaccgtgcgcgacaacgcgtattaccgccaccccgactccccggatgtgaccagtgagcgcatcacccgccatcagtacgacgcccgcggctttctgacgcagagcgccgacccgcgcctgaatgaggccgggctggtaaacttcagtttcctcacggacctggccggcaacgtcctgcgcacgcacggggtggataacggtatcactgtggcgctgaacgacgccgcaggccggccgtttatgaccgtcagtaatatcggcactgctgacgacggcacggaagacgccagtcaggcaatgacccgcacctggcagtatgaaggtgtgtctctgccgggccgcccggtgggcattacggagcaggtctccggcgaagccgcgcgtatcacggagcgcttcgtctgggccggcaactctcctgaggagaaggcgctgaatctggcgggccagtgtgtcagccattacgataccgcaggcctgatgcagactgacagcgtggccctgaccggcgtaccgctctccgtcacccgccgtctgctgaaggatgcggacaaccccgatatcgtggccgactggcagggtacggatgcctccgtccggaacacgctgcccggtgacgggggggtcaccaccctgaccaccactgacgccaccggggcggtgctgaccacgacggatgcacagggtaacaggcagcgggtggcatacgatgtggcaggcctgctctcgggcagatggctgacgctgaaggatggtacggaacaggttatcgtgaagtccctgacgtattccgccgccgggcagaagctgcgcggggagcacggcaacggcgtggtgaccacgtacgaatacgagccacagacgcagcgcctggtcgggattaaaacggaacgtccggccggccacgccgcaggcgcaaaggtactgcaggacctgcgctacgagtacgacccggtgggcaacgtgctgaaaatcagcaacgacgcggaagagacccgcttctggcgcaaccagaaagtggtgccggagaacaggtatacctgtgacagcctgtaccggctggtcagcgccaccgggcgcgaaatggcaaacgccggtcggcagggctgtaatctcccctcagccaccattccccttcccgcagacagttccgcatacacaaactacacccgtacctatacctacgacagcgccggaaatctgacgcagataagccacagcgccccggccacgggcaacaattacaccacggacatcacggtgagcgaccgcagcaaccggggcgtgctgagcacgctgacggaaaatccgtcaggggtggacgcgctgttcactgcggggggacaacagaagcagctccagccggggcagaacctggtctggacgccgcgcaacgagctgctgaaggtgacgccggtggtgcgtgacggcagtacggatgaccgggagagctaccggtatgacggtggcagccagcgatgcctgaaggtgagtgtgcagaacaccggcagcagcacgcagacgcagcgtacgctgtacctgcccgggctggagctgcggaccacagtcagcggcggtaaggaaacggagagtctggaggtaatcacggtgggcgaggcaggatgtgcgcaggtgcgggtactgcactggacagcaggcaggccggcggaactcaccggcgaccagaccagatacagctatgacaacctgaccgggagcagcggtctggagctgggcggcgacgggaatatcatcagcatggaagagtattatccgtacggcggtccggccgttctgacggcgcgcagccagaccggggcggattacaaaaccgtgcgttactcgggcaaggagcgtgacgcgacggggctgtattactacggataccgttattaccagccgtgggcgggacgctggctgggcgcagacccggcggggacggcggacgggctgaacctgttcaggatggtacggaataatcctgtatccatgaaggataacgatgggcgtgttacagaatggcttgacctggcatatccacacaagtcatttaacgttgtagcgcttatgtataaaaataatcctatgctaaagttatatcatcgaatctttacgcaagaaacaaagaaaatacttgacgaagctgaaataaatgaatccagccttaaaaaactaaaacctaataaaagacaaaaaacatcgagagacatgaaatatactaaaacaaaattaaagaactatgcagcacatgccggatttttaaatgtacccagcggcagcggtgaaactccgagatttaaatctggatttgtaaatttacccggaagcctgagcaataaaaacacattcccgggagtccgtctgatagatgaaaaaatcaaaagaaggtttaaggattactctccagaaaagctaaaagaatcaacaaaatggagacctgaaacgagccttggttattatcgtgtggaaaatgttgacattttcatttctgaaatcaagaaattatatgcagcgtcaggttcggagcttcatgaggttgttgaacgtaggatcagaaatcatctggcgagcaataataatatattaccaagaatggctgggattgcagggcttcacgctgaggtacaggcgctgaaccatatcatatccatgactgatactgaggctagtgtagctagtaaactcagttccagttacatatatacccaacgtctggttggagccagaaatgaggatttccctgcatgccataactgctcaggaattattaatgggcttgaaaacatcatgacagggagagttgaaggtcacacaagattaataagaaggaaatccatctga

SEQ ID NO: 1351 - DNA, 2958 bp, Salmonella sp.
atgagcacttcgttgttcagtaacaccccgacggtcacggtcctcgacaaccgcggactgaccgtgcgcgacaacgcgtattaccgccaccccgactccccggatgtgaccagtgagcgcatcccccgccatcagtacgacgcccgcggctttctgacgcagagcgccgacccgcgcctgaatgaggccgggctggtaaacttcagtttcctcacggacctggccggcaacgtcctgcgcacgcacggggtggataacggtatcactgtggcgctgaacgacgccgcaggccggccgtttatgaccgtcagtaatatcggcactgctgacgacggcacggaagacgccagtcaggcaatgacccgcacctggcagtatgaaggtgtgtctctgccgggccgcccggtgggcattacggagcaggtctccggcgaagccgcgcgtatcacggagcgcttcgtctgggccggcaactctcctgaggagaaggcgctgaatctggcgggccagtgtgtcagccattacgataccgcaggcctgatgcagactgacagcgtggccctgaccggcgtaccgctctccgtcacccgccgtctgctgaaggatgcggacaaccccgatatcgtggccgactggcagggtacggatgcctccgtccggaacacgctgcccggtgacgggggggtcaccaccctgaccaccactgacgccaccggggcggtgctgaccacgacggatgcacagggtaacaggcagcgggtggcatacgatgtggcaggcctgctctcgggcagatggctgacgctgaaggatggtacggaacaggttatcgtgaagtccctgacgtattccgccgccgggcagaagctgcgcggggagcacggcaacggcgtggtgaccacgtacgaatacgagccacagacgcagcgcctggtcgggattaaaacggaacgtccggccggccacgccgcaggcgcaaaggtactgcaggacctgcgctacgagtacgacccggtgggcaacgtgctgaaaatcagcaacgacgcggaagagacccgcttctggcgcaaccagaaagtggtgccggagaacaggtatacctgtgacagcctgtaccggctggtcagcgccaccgggcgcgaaatggcaaacgccggtcggcagggctgtaatctcccctcagccaccattccccttcccgcagacagttccgcatacacaaactacacccgtacctatacctacgacagcgccggaaatctgacgcagataagccacagcgccccggccacgggcaacaattacaccacggacatcacggtgagcgaccgcagcaaccggggcgtgctgagcacgctgacggaaaatccgtcaggggtggacgcgctgttcactgcggggggacaacagaagcagctccagccggggcagaacctggtctggacgccgcgcaacgagctgctgaaggtgacgccggtggtgcgtgacggcagtacggatgaccgggagagctaccggtatgacggtggcagccagcgatgcctgaaggtgagtgtgcagaacaccggcagcagcacgcagacgcagcgtacgctgtacctgcccgggctggagctgcggaccacagtcagcggcggtaaggaaacggagagtctggaggtaatcacggtgggcgaggcaggatgtgcgcaggtgcgggtactgcactggacagcaggcaggccggcggaactcaccggcgaccagaccagatacagctatgacaacctgaccgggagcagcggtctggagctgggcggcgacgggaatatcatcagcatggaagagtattatccgtacggcggtccggccgttctgacggcgcgcagccagaccggggcggattacaaaaccgtgcgttactcgggcaaggagcgtgacgcgacggggctgtattactacggataccgttattaccagccgtgggcgggacgctggctgggcgcagacccggcggggacggcggacgggctgaacctgttcaggatggtacggaataatcccgtcacgttgattgacagcaatgggttgatcagtactggtcgggaagcccgaaaattagtgggcgaagcatttgttcaccctttgcatatgcctgtctttgaacgaatttctttagaggaaaatctttcaatgagcgtaagggaggcgggcatttatactatttcagcactcggtgaaggtgcggcagcaaaaggccataatattcttgagaagactattaaacctggttcactaaaggctatctatagtgataacgctgaatctattcttggtcaggcaaaacgtagcggtttcgttggccgagtaggtcagtgggatgcatctggcgtacggggaatttatgcacacaacagactgggtggtgaggatttggcttatccagtcagcctggaaaatacttttgctaatgaacttgttaatgcatggataaaatttaaaatcatcacgccctataccggtgattatgacatgcacgatattattaaattctctcatgggaaagggcatgtccccatggcggaaagtaatgaggaaagaggagtaaaggatttaattaataaaggtattgcgaaagtcgatccttccagaccctttgagtatacagcgatgaacgttattcgccatggtcctcaggtaaactttgttccctatatgtgggaacatgagcacgataaagttgtaaaggataatggttatctgggagtggtagctcgtccggggccattccctgtggcaatggtacatcagggcgaatggactgtttttgacaatagtaaggaactgtttaatttttataaatctacaaacacccctcttcctgaacactggtcccaggattttgttgatagagggaaaggaatggttgcaactccccgacacgctgaacttcttgataaacggcgaaacatgcattaa

SEQ ID NO: 1352 - DNA, 2559 bp, Serratia sp.
atgaacacatcaccgttcatcagcaccccgaccgtcacggtcctcgacaaccgtggcctgaccgtgcgcgacatcgcgtaccaccgccacccggataccccggacgtcaccaccgggtgcatcacccgccaccgatacgatgcccgcggctttctaacgcagagcgctgacccgcgcctgcatgaaacggggctggcaaacttcagctacctcacggacctggccggcagcgtcctgcgtaccgtcagcattgatgccgggatcaccctgacgctgaacgacgccgcaggacgcccctttatggcggtcagcaacatcggcaccgcagacgacggtacggaagacctgagtcgggcggtaacccgcacatggcagtatgaggacgccaccctgccgggccgtccggtcagcatcacggagcagcccacaggcgaagccgcccacatcacggagcgctttgtctatgccggcaatacggacaaagagaaagccctgaacctcgccggcgcctgcgtcagccattacgacacggctggcctgacgcagaccgacagcgtggccctgaccggcgtcccgctcgccgtgacccgccggctgcttaaggatgcggacaaccctgacatggtggccgactggcagggcgatgacgtatccgcctggaacgccctgctcgcaggggagagcgggggttataccaccctgaccaccgccgacgccaccggggcggtgctgaccaccacggatgcaaaaggcaaccagcagcgcgtgacgtatgacgtggcgggactgctgtcgggctgctggctgaccctgaggggcggcacggagcaggttatcgtgtcctccctgacgtactcggccgccggacagaagctgcgcgaggtgcacggcaacggcgtggtgaccacctatacgtatgaagtagagacgcagcgcctgaccgggattaaaacggcgcgaccggccggccacgctgcaggcgcaaaagtgctgcaggacctgcgctatgagtacgacccggtgggcaacgtattaaaaatcactaacgatgcggaagagacccgcttctggcgcaaccagaaagtggtgccggagaacacgtacgtctatgacagcctgtaccagctggtcagcgccaccggccgcgagatggcgaacgccgggcagcagggcagcaatcccctctcagccaccgttccccttcccgacgatggcgccgcgtatacgaactacacccggacttatacctacgacgaagcaggcaacttgacgcagattcgtcacagcgccccttcgacaaacaacacgtacaccacgaaaatcaccataagcgaccgcagcaaccggggggtgctgagcacgctgacggaaaacccggcggaggtggaggccctgttcacggcggggggccagcagacgcgcctgcagccggggcaggcgctggtctggacgccgcgcaatgagctgcagacggtgacgccggtggtgcgtgacggcagtacggacgacagggaaagctaccgctatgacgcgggcagtcagcgcgtgctgaagatgagcgtgcaggaaacgaaagccagcacacaaaagcagcgggtgctgtacctgccggggctggagctgcacagcacacagagcggtaacacggagacggagagcctggaggtgattacagtgggcgaggcgggccgggcacaggtgcgggtgttgcactggacatccggcaggccggcagaaatcaccggcgaccagataaggtacagttacgataacctgacgggcagcagcgggctggagctggacggtgacggcagcattatcagcgcggaggagtactacccgtacggaggcacggcggtgtggacggcgcgcagcgcggtggaggcggactacaaaaccctcagctactcgggcaaggagcgtgatgcgacggggctgtactactacggttaccggtactaccagccttgggcgggccggtggctgagcgctgacccggcggggacggtggacggcctgaacctgttcaggatggtgcggaataatccggtgactctcaaggataatgacgggctgatttcatttgaagatcactattctcatactgaagggggaatggtttacgggctctcagaatcaaggagtcagtacataaggaaaataagtccgaagttttcaatcgctgataatactgacactctcgttattgacaaatataacaacgccttggctatgacaataatgtttggtcaacatagtgaaacgcaaaatcaacagattaatctggatttttactcagccacagaagacaaaacccaaaagaaacttggagcaaaaataaaggttcctggggaaatttttgatgtggttaaaaggaagtttaaccatccggaatttaagtgggatgattattcctcccctggcaaggataatcccaaattcaacatacctaaaatatatcaacaggtggcaaaaaaaatacgggcaggattacttccatggttaccagatggccggaaaggggtatcttgtgcccagactattatggaagcgaggtag

SEQ ID NO: 1353 - DNA, 885 bp, Yersinia sp.
atgaaaacatcattgttcagtaaaacccctccggtcacggttcttgataaccgcggcctgaccgtgcgcgacatcgcgtaccaccgccatcccgactcgccggatgttatcagtgagcgtatcacccaccatcagtacgacgcccgcggctttctgacacagagcgccgacccgcgcctgcatggtgccgggctgatgaacttcagctacctgacggacctgaccggccgcatcctgcgcacgcagggggcggataacggtaccaccgtcagcctgaatgatgctgccggacgaccatttatctcggccagtaatatcagcaccagcgacgacggtactgaagacagaggccaggcgatgacccgcacctggcagtatgaggaggcttcactgccgggacgtctggtgagcgtaaccgaacaggtgaccggcaaagccacccgcatcacggagcgcttcgtgtacgctgccaatactgacgcggaaaaaagcctgaacctggccggcgcgtgcgtcagccattacgacactgcgggactggtgcagccggacagcattgccctgaccggtgtaccgctctctgtcactcgccgcctgatgaaaagtgcggataacccggacgccgtggccgactggcagggggcggacgcctccgcctggaacgaccaactggacggcgaaacgcataccaccttgaccaccgcggacgccaccggggcggtgctgaccaccaccgatgcgaaaggtaacctgcagcgcatggcgtacgacgtggcgggcctgctgtcgggcagttggctgaccctgaaggatggcacagagcaggtcatcgtgaagtccctgacatactcagccgccgggcagaagctgcgcgaggagcacggc

SEQ ID NO: 1354 - DNA, 2898 bp, Yersinia sp.
atgagcacatcgttgttcagcagaaccccgaaggtcacggtctttgataaccgcggcctgaccgcgcgcgacatcgcgtaccatcgccaccctgatgcccctgaggtgacaaatgaacgcatcacaccccaccagtacgacgcacgcggctttctgacgcagagcgccgacccgcggctgcacgacgccggtcgcgtaaatttcagctacctgacggacctggccggaggcgttctgcgtacacagggggcggataacggtactagcgtcagtctgaacgacgtcgccggacgaccgtttatcgtggtcagtcatatcagcgccaccgatgagggcactgaggacagaagcctggcggtgacccgcacctggcagtatgaggatgcggcgcttccgggtcgaccactgaacgtgacggagcagatcagcactgaagtcgcccgcatcacggagcgcttcgtgtatgccggcaatactggcgcagagaagactctgaacctggcgggattatgcgtccgtcattacgatacggcaggactggtgcagacagacagcatagcgctgacaggcgtctcgctctccgtcacccgccgtctgctgaaggacgcggataacccggacaccgtggctgactggcaaggagaaggtgcctctgcatggaatgatctgctcagtggcgaggagtatgtcaccctgaccactgctgacgccaccgggacggtgctgaccaccaccgatgcgaaaggtaatattcagcgcgtgaggtacgacgtggcgggactgttgtcaggcagttggctgacggtgagggaccgtacggaacaggttatcgtgaagtccctgacgtactcggccgccgggcagaagcaacgcgaggatcacggcaacggcgtggtgatcacgtacacgtacgaggcagagacgcagcgcctgaccggcatccggacggagcgacctgccggccacgcttcgggtgccaaggtgctgcaggacctgcgctatgagtatgacccggtgggcaacgtgctgaaaatcaccaatgatgctgaagcaacccgcttctggagtaatcagaaagtggtgccggaaaatacctacacctacgacagcctgtaccaactggtcagtgccaccgggcgcgagatggcaaacgtcggacagcagggcagccgtttaccgtcagctaccgtcccctttcctacagacagctccgcatataccagttacacccgcacctacacctacgacgaagccagcaacctgacgcagatacgccattccccggcaacacgcagtggttacacaaccaacatcaccgtaagcaaccgcagcaaccgggctgtgcttagcaacttgaccgaaaacgccgcagacgtggacgcactgttcactgcgggcggccagcagacgcagctacagccggggctgggcctggtctggacggcacgtaatgagctgttgaaggtaacgccggtgatgcgagatggcagtgcggatgacagcgagaattaccgctatgacggcggtagtcagcgcattctgaaggtcagtgtacagaaaaccggtaacagcgcgcagacgcagcgggcgctgtaccttccgggcttggaactgcgcagcgcgaaaaatggcgatacggaaacggaaagcctgcaggttatcactgtgggtgaggcgagccgtgcgcaggtgcggatgctgcactgggagagcggcaggccggatggaatcactgacgacaaggtacgttacagttacgataacctgaccggcagtagcgtgctggagctggacagcgacggcaaacttatcagcatggaggaatactatccgtacggcgggacagcggtatggacggttcgcagcgcggtggaggcaaactacaagaccgtgaggtattcaggcaaggagcgggacgcaacggggctgtactactacggttaccggtactaccaaccgtgggcgggcagatggctaagtgcagacccggcgggctcggtggacgggctgaatctgtacaggatggtgcggaataatccggtggcgtggaaggacaatgatggaagaatccctatcaatactatgattccaccgccgccaccgatgatggggggaaatccaccgccaccaccaccgatgatgggaggaaaccctccgccgccgccaccggtggcgggaggaaaccctccgccgccaccatcgatgcccgggcagcaaaatggagcaaagaaaaactgggttattaaggaagaccccgctttatataaacagcaagggggggaatatccatactattcttcattcacaatagccttacagaagcttaatatcagtcattatgattcaattatcgatatggacaactttataagcaagtgggctgaaattggtagaaacatgaagccggcagcaagagatattagtcacgacaagtttatagaggttcagaaaactctgggcaaaattgatgctgaatggtctgggtatcattcagcagatgtgaacgaaaccttccgtggagacacgccagtaatatctaatagttattcttggcttgctgagtttataaatgaatctgaaggtaagagcgatactgtacaaaaatcaatggatttagaaataaaatctcccctcataatgtctacagctaaggatcctaaaatgggttatgtgtcaggtaaaacaattatgtggcactttgatcttgagccaggacacgccggtgtttctgaaggattgtatgcctccgagggtgaagtgacgtttccattatacaacaggatgaagataacatctttacaataccttcctgaaggaaggtcttatatggacaacccagaacaatatggaacatctcaccgatatatcatcaaagccagaatgttaccccggtcataa

SEQ ID NO: 1355 - DNA, 2832 bp, Serratia sp.
atgagcacatcgttgttcagcaacaccccggcggtcacggtccttgataaccgcggccttaccgtgcgcgatatcgcgtaccaccgccaccccggctccccggacgtcaccagtgagcgcatcacccgccatcagtacaatgaccgcggctttctgacgcagagtgctgacccgtgtctgcacgacaccgcgctggagaacttcacgtatcttacggacctggccggcaacgtgctgcgctcgcagggcgtggataacggcaccaccgtcagtctgaacgacgccgcgggacggccgtttatcgcagtcagtaatatcagctctgccggtgatggcactgaagacagaagccaggccatgacccgcacctggcagtatgaagatgcagaactgccgggacgtccggtgagcattactgaacagatcagcggcgaagccgcccgcattgcggagcgcttcgtttatgccggcaataccgatgcggagaaaaccctgaacctggcaggaatatgcgtcagccactacgatacggcgggcctgacgcagacggacagcgtggcgctgaccggcgtgccgctctcggtcacccgccgcctgctgaaggaggcgaacaaccctgacgtcgtgggcgactggctgggtgcggaagcctctgcctggaacgacctgctggccgcagaagcccacaccacccagaccacggcagatgccaccggcgtagtgctgaccaccacggacgcaaaaggcaacctccagcgggtggcgtacgacgtggcgggcctgctgtcgggctgctggctgaccatgaagggcggaaaagagcagactatcgtcgcctccctgatgtactccgccgccgggcaaaaactgtgcgaggagcatggcaacggcgtggtgaccacgtatgaatacgagccggagacgcagcggctgaccgggattaaaacggagcgtcctgccgggcataagtcagggcagaagatactgcaggacctgcgctatgaatatgacccggtgggcaacgtcctgaaaatcagcaacgacgcggaagagacccgcttctggcgaaaccagaaagtagtaccggaaaacacgtacgtctacgacagcctgtaccagctggtcagcgccaccgggcgcgagatggcaaatgccggccagcagggcagtaatctccccgccaccaccgctcccctcctcaccgacagttccgcatataccagttacacccgcacatatagctacgacagtgctggcaacctgacacaaatcaggcacagcgcaccggcgacaaacaacagttacaccacaaatatcaccgtctccgataaaagcaatcggggcgtgctgagcacgctgacggaaaatccctcagatgtggacgcgctgtttacggcgtgcggacagcaaacgcagctgcagccgggccagagcctcgcatggacgccgcgcaacgagttactgaaggtgacgccggtggtgcgcgacggcagcgcggacgacagggagagctaccggtatgacggcggcagccagcgtgtgctgaaggtcagcgagcggaaaaccggaaccagcatgcagacgcagcgggtgctgtacctgccgggtctggagctgcgaaccacagccagcggcgatatggaaacggaaagcctgcaggttattacggtgggtgaagcggggcgggcgcaggtgcggatgctgcactgggagagccaccggcctgcagaaatccccggcgaccaggtgcgttacagctacgataacttgacgggcagcagcagcctggagctggacggcgacgggaatatcatcagcacggaggagtactacccgttcggcggcaccgccatcctgacggcgcgaagcgcggtggaagcggactacaaaacggtgcggtactcaggtaaggagcgtgatgcgacagggctgtactactacgggtaccgctattatcagccgtgggcggggagatggctgagcgctgatccggcgggaatgatggatggattaaatttgttcaggatggtcaggaataatccggtctcactgcatgatcctgatggaagaatgccgaaaaaaaatcaaaatgctgacgccagtgtaccaccggaagcaagttcttcagtacgagcatcagttgaagcagtaaataaaacttcaggagcaatactcaaacaagtaccggctccatcccatcaacaaagtattgctgattcaggcagtctggcaacagcggcagaaaatttatcagaagcgacgtccggacaagcaacgtcagaagggttaaagaagaaaggaaaaatatctatattccaaaaaatattttcaccaaagaaaaaagatgctgataacgcgtttagtgttaatcccgatgacgacttcgaaccggtcaatattaagcaatctgatgttgacaaagttgcagctccagtcaacggcccggtaagtctcagaaagccttttgattacaagcgttgggtgaccaattcagaggaaattgtcgtttaccgtcaggatcagcgttcactaaatgaaattattgatgcaggcggattttatcccagaacgcttgaaattggtactctggaggatcatgcacaaggttcgacaaaagagtattcatttgtatcaacttccgacaaaaggctaaaaggtggctcttatggtaaatatgaatataaaataaggcttaatcctcgtcaggctgtacatctccctgcaacgctggacagaattcatggtagcccccccaagaaatataaaataaatgaacattcggttccgggtttcattacaccctcgcaaatcattggttggaggaaatggtag

SEQ ID NO: 1356 - DNA, 1614 bp, Pantoea sp.
atgaatacatcgtcgttcagtaagaccccttctgtcacggtcctcgacaaccgccagctgaccgtgcgcgacatcgcctaccactgccacccggatacacccgacgtcatcagtgagctcatcacccgtaatcagtacgatgcccgccgctttctgacgcagagcgccgacccgcgcctgcaagaagccgggctggcgaacttcacgtacctgactgacctgaccggaagcctcctgcgttcgcagggagtcgataacgggaccaccgtggcactgaatgatgccgccggacggccgtttgtcgcggtcagcaatatcagcacccccgacagtggcaaagacgaccggtgtcaggcggtcgcactcacccggcagtatgaggacgcagacctgcccggtcgtccggtcagcgtgacgcagcaggtgacaggcggcgctgcccgcatcacggagcgcttcgtgtatgccggcaatacggacgcagagaaggcactgaacctggcgggagcctgcgtcagccactacgacacggcgggcatggcccagaccggcagcactgccctgaccggcatgccgctctccgtcacccgccgcctgctgaaggatgcggataacccggacgccacggccggctggcatggaatggacgcgccggcctggaacgacctgctggctggcgaggcatacaccacccggaccaccgccgacgccaccggggcggtgctgaccaccaccgacgcacggggcaacctgcagcgcgtggcgtacgacgtggcgggcctgctgtcgggcagctggctgaccgtgaagggcggcagggagcaggttatcgtcgcctccctgacgtactcggccgccgggcagaagctgcgcgaggcgcacggcaacggcgtggtgacctcgtacgcgtatgacgcgcggacgcagcgcctgaccggcattaaaacggcacgccccgccgggcacgcatccggtgcgaaggtgctgcaggacctgcgctatgagtacgacccggtgggcagcgtgctcagcgtccgcaacgacgccgaagagacccgcttctggcgcaaccagaaggcggtgccggagagcacctacgcctacgacagcctgtaccagctggtccgcgccaccgggcgcgagatggccggtgccggacagcagggcagcagcctgccgtccgctaccgcaccctttcccgccgacggctccgcatatacacaatatacccgcacttatgcttacgatgaggccggcaacctgacgcagatatgccattccccggccgcgggcagcggctacacaacccgaatcaccgtaagcaaccgcagcaaccggggcgtgctgagcacgctgacggaaaacccgtcagaggtggacgcgctgttcacggcgggcgggcagcagacccggctgcagccgggtcagagcctggtctggacgccgcgtaacgagctgctgaaggtcacgccggtggtgcgcgccggatatgcggatgaccgggagagctaccgctacgacggtagcagccagcggcttctgaaggtgagcgtgcagagaacaggcagcagcacgcagacgcagcgggtactgtacctgccggggctggagctg

SEQ ID NO: 1357 - DNA, 360 bp, Pantoea sp.
atgaactatttccgcatcggctctctggctggcgtgctgctgctctgcggctgccaggcacccacgcctgatcaggctcgtcagcagcagcctgtttttcagggtcaaagcacccgcaccgtccctcagctcagcgactgtatttatcgcggctggtccactaccagcgtcattgccagagataacaccactcacacccagcctgacggcagcgagattagcgttttcacctgggaagattcgatttttgcggatgtgtcgccccgccgaaaagggtctgatgtgaaatatttcacgactttccggatggcgcctcaggtgatggcggacagacaggcgattgttgagcgctgcctgtaa

SEQ ID NO: 1358 - DNA, 360 bp, Pantoea sp.
atgaactatttccgcatcggctctctggctggcgtgctgctgctctgcggctgccaggcacccacgcctgatcaggctcgtcagcagcagcctgtttttcagggtcaaagcacccgcaccgtccctcagctcagcgactgtatttatcgcggctggtccaccaccagcgtcattgccagagataacaccacccacacccagcctgagggcagcgagatcagcgttttcacctgggaagattcgatttttgcggatgtgtctccccgccgaaaagggtctgatgtgaaatatttcacgactttccggatggcgcctcaggtgatggcggacagacaggcgattgttgagcgctgcctgtaa

SEQ ID NO: 1359 - DNA, 360 bp, unknown
  environmental sample
atgaactgtttccgcatcggctctctggctggcgtgctgctgctctgcggctgccaggcacccacgcctgatcaggctcgtctgcagcagcctgtttttcagggtcaaagcacccgcaccgtccctcagctcagcgactgtatttatcgcggctggtccaccaccagcgtcattgccagagataacaccacccacacccagcccaacggcagcgagatcagcgtttttacctgggaagattcgatttttgcggatgtgtcgccccgccgaaaaggggctgaggtgaaatatttcacgactttccggatggcgcctcaggtgatggcggacagacaggcgattgttgagcgctgcctgtaa

SEQ ID NO: 1360 - DNA, 360 bp, Pantoea sp.
atgaactgtttccgcatcggctctctggctggcgtgctgctgctctgcggctgccaggcacccacgcctgatcaggctcgtctgcagcagcctgtttttcagagtcaaagcacccgcaccgtccctcagctcagcgactgtatttatcgcggctggtccaccaccagcgtcattgccagagataacaccacccacacccagcccaacggcagcgagatcagcgtttttacctgggaagattcgatttttgcggatgtgtcgccccgccgaaaaggggctgaggtgaaatatttcacgactttccggatggcgcctcaggtgatggcggacagacaggcgattgttgagcgctgcctgtaa

SEQ ID NO: 1361 - DNA, 360 bp, Pantoea sp.
atgaattatgtccgcatcggatctctggctggcgtactgctgctctgcggctgccaggcacctacccctgatcaggctcgtctgcagcaacccgttttccagggccaaagcgcccgcaccgtccctcagctcagcgactgtatttatcgcggctggtccaccaccagcgtcattgcacgggataacaccacccacacccagccgaacggcagtgagatcagcgtctttacctgggaagattctatttttgcggatgtttcgccccgccgaaaaggtgctgatgtgaaatatttcaccaccttccggatgtccccggaagtgatggcagacagacaggcgattgttgagcgctgcctgtaa

SEQ ID NO: 1362 - DNA, 360 bp, Pantoea sp.
atgaactattaccgcatcggctctctggctggcgtgctgctgctttgtggctgccaggctcccacgcctgatcaggctcgtctgcagccacccgtttttcagggtcaaagcacccgtaccgtccctcagctcagcgactgtatttatcgtggatggtccaccacccgcgttattgcccgagataacaccactcacacccagcccgccggcagcgagatcagcgtcttcacctgggaagattctatttttgcggatgtctcaccccacagaaaaggggcggaggtgaaatatttcacgaccttccggatgtccccggatgtgatggcagacagacaggcgattgttgagcgctgcctgtaa

SEQ ID NO: 1363 - DNA, 360 bp, unknown
  environmental sample
atgaactattaccgcatcggctctctggctggcgtgctgctgctttgcggctgccaggctcccacttctgatcaggctcgtctgcagccacccgtttttcagggtcaaagcacccgtaccgtccctcagctcagcgactgtatttatcgtggctggtcaaccaccagcgttattgccagagataacaccacccacacccagccgaacggcaacgagatcagcgtctttacctgggaagattcgatttttgcggatatctctccccacagaaaaggggcagaggtaaaatatttcacgaccttccggatggctcctcaggtaatagcggacagacaggcgattgtgcaacgctgcctgtaa

SEQ ID NO: 1364 - DNA, 360 bp, Pantoea sp.
atgaatactttccgcatcggctctctgactggcgtgctgctgctctgcagctgtcaggcccccacccccgatcaggcgcgtctgcaggaacccctctttcagggccagagcacccgcaccgttcctcaactcagcgactgcatttatcgcggctggtccacgaccagcgtggttgcccgcgatgacacgacccatacccggcccggcggcagtgcgatcagcgtctttacctgggaggattctatctttgcggatgtctcgcctcacggacgaggggcagaggtcaaatattttaccaccttccggatggcacctcaggtgatggcagacaggcaggcgattgttaagcgctgcctgtga

SEQ ID NO: 1365 - DNA, 360 bp, Pantoea sp.
atgactcatttccgcatcggttctcttttcggcgtcctgctgatttgtggttgtcaggcgccgacaccggaacaagcccggctgaatcaaccgctattccagggacaaagcgcccgcacggtgccacagctcagcgactgtatttatcgcggctggtccaccaccgaggtcatcgccagagataacaccacccatactcagccgcagggtgaacagatcaccatcctgacctgggaagattcgatctttgccgatgtgacgccacagccacagggtgcggaggtgaaatttttcaccaccttcaatatggcgcctcaggtaatggctgaccggcaggctatcgtcaggcgctgcctgtga

SEQ ID NO: 1366 - DNA, 360 bp, unknown
  environmental sample
atgactcatttcagcatcggttctcttttcggcgtcctgctgatttgtggttgtcaggcgccgacaccggaacaagcccggctgaatcagccgctattccagggacaaagcgcccgcacggtgccacagctcagcgactgtatttatcgcggctggtccaccaccgaggtcatcgccagagataacaccacccatactcagccgcagggtgaacagatcaccatcctgacctgggaagattcgatctttgccgatgtgacgccacagccacagggtgcggaggtgaaatttttcaccaccttcaatatggcgcctcaggtaatggctgaccggcaggctatcgtcaggcgctgcctgtga

SEQ ID NO: 1367 - DNA, 264 bp, Pantoea sp.
atgaactatttccgcatcgactctctggctggcgtgctgctgctctgcggctgccaggcacccacgcctgatcaggctcgtcagcagcagcctgtttttcagggtcaaagcacccgcaccgtccctcagctcagcgactgtatttatcgcggctggtccactaccagcgtcattgccagagataacaccactcacacccagcctgacggcagcgagattagcgttttcacctgggaagattcgatttttgcggatgtgtcgccc

SEQ ID NO: 1368 - DNA, 399 bp, Pantoea sp.
atgaagttagtacatggattggctttagcggttttctctcttggcatcagcgcttcagcgctcgctgaagatacctgtgcaaaacagccttcagacggtgcgctatttcagtgtactgttcagcaaaagaagctggcggaagatgacctcaacaaagaataccagacggctaaaaaacgcattgttcagatgtacggcacgcagaaaaaactggctgatgactatgtcgccacgctggtagatacccagcgtaactggctgaaatatcgtgacggtcagtgcaaactggaagcctttgccgctgaagatggcagcaatgcgaatgcggttgccaccaacctctgtgttatccgcatcgacaaagaacgcactgctattctgaagcaactgccttactga

SEQ ID NO: 1369 - DNA, 399 bp, unknown
  environmental sample
atgaagagactacataaattggctttgatcgctgtgtctctttgcatcagcgcttcagcgctcgctgaagatacctgtgcaaaaaagccttcagacggtgcgctatttcagtgtactgttcagcaaaagaagctggcggaagatgacctcgacaaagagtaccagacggctaaaaaacgcattgttcagatgtacggcacgcagaaaaaactggctgatgactatgtcgctacgctggtggatactcagcgcagctggctcagttatcgtgacggtcagtgcaaactggaagcctttgccgctgaagaaggcagcaatgcgaatgcggttgccaccaacctctgtgtcatccgcatcgacaaagaacgtactgctattctgaagcaactgccttactga

SEQ ID NO: 1370 - DNA, 399 bp, unknown
  environmental sample
atgaaaagactacatgaagtggctttgatcgctgtctctctttgcataagcgcttcagcattcgctgaagatacctgtgcaaaacagccatcagacggtgcattgtttcaatgtactgttcagcagaagaagctggcggaagatgacctgaacaaagcgtaccagacagctaaaaaacgcattgtacagatgtacggcacgcagaaaaaactggctgatgactatgtcgccacgctggtggatacgcagcgcagctggctcaggtatcgtgacggtcagtgcaaactggaagcctttgccgctgaagaaggcagcaatgcgaatgcggttgccaccagcctctgtgttatccgcatcgacaaagagcgtactgctattctgaagcaactgccttactga

SEQ ID NO: 1371 - DNA, 423 bp, unknown
  environmental sample
atggtacagactgctgagaaaaatatgaagagactacataagttggctttaatcgctgtgtctcttggcatcagcgcttcagcgctcgctgaggaaccttgtgcaaaacagccttcagacggtgcgctatttcagtgtactgttcagcagaagaagctggcggaagatgagctgaacaaagagtaccagacggctaaaaaacggattgttcagatgtatggcacgcagaaaaaactggctgatgactatgtcgccacgctggtggatactcagcgcagctggctcaggtatcgtgatggtcagtgcaagctggaagcctttgccgctgaagaaggcagcaatgcgaatgcggttgccaccaacctctgtgttatccgcatcgacaaagaacgtactgctattctgaagcaactgccttactga

SEQ ID NO: 1372 - DNA, 423 bp, unknown
  environmental sample
atggtacagactgctgagaaaaatatgaagagactgcataaattggctttaatcactgtgtctctttgcatcagcgcttcagcgctcgctgaagatacctgtgcaaaacagccttcagacggtgcgctatttcagtgtactgttcagcagaagaagttggcggaagatgacctcaacaaagaataccagacggctaaaaaacgcattgtaaagatgtacggcacgcagaaaaaactggctgatgactatgtcgccacgctggtggatacccagcgtaactggctgaagtatcgtgatggtcagtgcaagctggaagcctttgccgctgaagaaggcagcaatgcgaatgcggttgccaccaacctctgtgttatccgcatcgacaaagaacgcactgctattctgaagcaactgccttactga

SEQ ID NO: 1373 - DNA, 423 bp, unknown
  environmental sample
atggtgcagactgctgagaaaaatatgaagagactgcataaattggctttaatcactgtgtctctttgcatcagcgcttcagcgctcgctgaagatacctgtgcaaaacagccttcagacggtgcgctatttcagtgtactgttcagcagaagaagctggcggaagatgacctcaacaaagaataccagacggctaaaaaacgcattgtacagatgtacggcacgcagaaaaaactggctgatgactatgtcggcacgctggtggatacccagcgtaactggctgaagtatcgtgatggtcagtgcaagctggaagcctttgccgctgaagatggcagcaatgcgaatgcggttgccaccaacctctgtgttatccgcatcgacaaagaacgcactgctattctgaagcaactgccttactga

SEQ ID NO: 1374 - DNA, 423 bp, unknown
  environmental sample
atggtgcagactgctgagaaaaatatgaagagactatataaattggctttaatcactgtgtctcttggcatcagcgcttcagcgctcgctgaagatacctgtgcaaaacagccttcagacggtgcgctatttcagtgtactgttcagcagaagaagctggcggaagatgacctcaacaaagaataccagacggctaaaaaacgcattgtacagatgtacggaacgcagaaaaaactggctgatgactatgtcaccacgctggtggatacccagcgtaactggctgaagtatcgtgatggtcagtgcaagctggaagcttttgccgctgaagaaggcagcaatgcgaatgcggttgccaccaacctctgtgttatccgcatcgacaaagaacgtactgctattctgaagcaactgccttactga

SEQ ID NO: 1375 - DNA, 399 bp, unknown
  environmental sample
atgaagaaaatctatgaagtggctttgatcgctttttctatttccatgagtgcttcagcgctcgctgaaagtccctgtacaaaacagccttcagacggtgcgctgttccagtgtactgttcagcagaagaagctagcggaagatgacctgaacaaagagtatcagacggctaaaaaacgtattgtgcagatgtacggcacgcagaaaaaactggctgacgactatgtcgctactctggtggatacccaacgcaactggctgaagtatcgtgatggtcagtgcaggctggaagccttcgccgccgaagaagtcagcaatgcgaatgctgtggcaaccaagctctgtgttatccgcatcaataaagagcgtactgctattcttaagcaactgccttactga

SEQ ID NO: 1376 - DNA, 399 bp, unknown
  environmental sample
atgaagaaaatctatgaagtggctttgatcgctttttctatttccatgagtgcttcagcgctcgctgaaagtccctgtacaaaacagccttcagacggtgcgctgttccagtgtactgttcagcagaagaagctagcggaagatgacctgaacaaagagtatcagacggctaaaaaacgtattgtgcagatgtacggcacgcagaaaaaactggctgacgactatgtcgctactctggtggatacccaacgcaactggctgaagtatcgtgatggtcagtgcaggctggaagccttcgccgccgaagaagtcagcaatgcgaatgctgtggcaaccaagctctgtgatatccgcatcaataaagagcgtactgctattcttaagcaactgccttactga

SEQ ID NO: 1377 - DNA, 399 bp, Pantoea sp.
atgaaaagaataagtaaactggttttgatcggtgtgtccctttccgtaagtgcttcagcgatcgctgatgagacctgtgcaaaacagccttcagacggcacgctgtttcagtgtactgttcagcagaagacgctggcggaagatgacctgaacaaagcgtaccagacggctaaaaagcggattgtacagatgtacggcacacagaaaaaactggctgatgactatgtcgcaacgctggtagatacccagcgcaactggctgaagtatcgtgatggacagtgcaggctggaggcctttgcggctgaagaaggcagcaatgcgagtgcggtggcgactaatctctgtgttatccgcatcgataaagagcgtattgctcttctgaaacaactgccttactga

SEQ ID NO: 1378 - DNA, 315 bp, Pantoea sp.
atgaagttagtacatggattggctttagcggttttctctctttgcatcagcgcttcagcgctcgctgaagatacctgtgcaaaacagccttcagacggtgcgctatttcagtgtactgttcagcagaagaagctggcggaagatgagctgaacaaagagtaccagacggctaaaaaacgcattgtacagatgtacggcacgcagaaaaaactggctgatgactatgtcgccacgctggtggatactcagcgcagctggctcaggtatcgtgacggtcagtgcaagctggaagcctttgccgctgaagaaggcagc

SEQ ID NO: 1379 - DNA, 399 bp, Erwinia sp.
atgaagttgggttatggatgcatagtgaccgtattagcacttagcgtaagtgcttcggcttttgccgaagatatttgctctaatgagccttccgatggtgcgctttatcaatgtacagtgcagcagaaaaaactggcggaaaatgatctcaataaagaatacgcggttgccaaaaaacgtattgtgcagatgtatggggcgcagaagcagttggccgatgaatacgtcgccaccgttgtcgatactcagcgcagctggcttaaatatcgtgacggtcagtgtaagctggaagcatttgccgcagaagaaggcagtaatgctaatgcggttgctgtgaatctgtgtatcattcgtatcgataaagagcgtaccgaaatgatcaggcagatgccgtactga

SEQ ID NO: 1380 - DNA, 399 bp, Ewingella sp.
atgaagttgggttatggattgttggtaacaatattggcactaggcggcatgacctcggcttttgctgacgataattgctccaaacagccttcagacggtgcgctttatcagtgtacggtgcagcagaaaaaatcggcggaagacgatctcaataaagagtacgcggctgccaaaaaacggattgtgcagatgtatggatcgcagaagcagttaggcgatcagtatgttgcgattgtcgttgatacgcagcgcagctggcttaaatatcgagatgggcagtgcaagcttgaagcttttgctgctgaggaaggcagtaacgctaatgcggtcgccgtgaacctgtgtattacacgtatcgacaaagagcgtaccgacatgctcaagcaaatgccgtactaa

SEQ ID NO: 1381 - DNA, 306 bp, unknown
  environmental sample
atgtctaaagacacatcatcggaacatttgcgtgctgaactgaaaaaccttgctgacacgctggaagaggtgctgagcagcagcactgagaaatccaaaggcgagctggataagctgcgtaacaaagcgcgtgtggcgctggacagctcccgcgagcgtttaggggaatccagcgagcgtatcgctgccaccacccgcgaagccgcgcagaaagccgaaggctatgtgcgtgaaaatccatggcatggtgtcggtatcggtgcagcgattggcgtcgcactgggcatcctcatttcgcgtcgataa

SEQ ID NO: 1382 - DNA, 306 bp, Pantoea sp.
atgtctaaagacacatcatcggaacatctgcgtgctgaactgaaaaatctggctgataccctggaagaggtgctgagcagcagcactgaaaaatcgaaaggggagctggataagcttcgtaataaagcgcgtgtggcgctggacagctcacgtgagcgcctgggtgaatcaggcgaacgcctcgcggcgacaacccgtgaagcagcgcagaaggcggaaggctacgtgcgtgaaaatccctggcatggtgtgggtatcggtgcagcgattggcgtcgcactgggcatgctcatttcgcgtcgctga

SEQ ID NO: 1383 - DNA, 306 bp, Pantoea sp.
atgtctaaagacacatcatcggaacatttgcgtgctgaactgaaaaacctcgccgataccctggaagaagtactgagcagcagtactgaaaaatccaaaggtgagctggataaacttcgcagcaaagcgcgtgatgcgctggacagctcacgtgaacgtctgggcgaatcaagcgagcgcattgctgcgactacgcgtgaagcggcacagagagctgaaggctatgtgcgtgaaaatccatggcatggtgtgggcatcggtgcagcgattggcgtcgcactgggcatgctcatttcgcgtcgttaa

SEQ ID NO: 1384 - DNA, 324 bp, Pantoea sp.
atgttaaaggagtattttatgtctaaagacacatcatcggaacatttgcgtgctgaactgaaaaacctggccgataccctggaagaggtgctgagcagcagcactgaaaaatccaaaggcgagctggataaacttcgcaataaagcgcgtgtggcgctggatagctcacgtgaacgtctgggcgaatcaagcgagcgcattgctgcgaccacccgcgaagcggcgcaaaaagccgaaggctacgtgcgtgaaaatccatggcatggtgtgggtatcggtgcagcgattggcgtcgcactgggcatgctcatttcgcgtcgataa

SEQ ID NO: 1385 - DNA, 306 bp, unknown
  environmental sample
atgtctaaagacacatcatcggaatatttgcgtgctgaattgaaaaacctggcggatacgctggaagaagtcctgagcagcgggactgaaaagtccaaaggtgaactggataagctccgtcacaaagcgcgcgttgcgctggacagctctcgtgagcgtttaggtgaatcgggtgagcgcctggcggcgaccacgcgcgaagcggcgcagaaagcagatggttatgtgcgtgataatccatggcatggcgtgggtatcggtgccgccatcggcgttgccatcggtatgctgatctcgcgtcgttaa

SEQ ID NO: 1386 - DNA, 306 bp, Pantoea sp.
atgtcaaaagacacttcatcagaacatttgcgtgctgagttaaagaatctggcggacactctggaagaggtgctgagcagcacaacggataagtccaaaggcgaactggataagctgcgtcagaaagcgcgcgtcgcgctcgatagctcgcgcgagaagctgggcgattctggcgaatatctggcacagaccacgcgtgaagccgcgcagaaagcggacggctacgtgcgtgataatccctggcatggcgttggcatcggtgcggcaatcggcgtggcgatcggcatgctgatttcacggcgttaa

SEQ ID NO: 1387 - DNA, 324 bp, Pantoea sp.
atgttaaaggagtattttatgtctaaagacacatcatcggaatatttgcgtgctgaattgaaaaacctggcggatacgctggaagaagtcctgagcagcgggactgaaaagtccaaaggtgaactggataagctccgtcacaaagcgcgcgttgcgctggacagctctcgtgagcgtttaggtgaatcgggtgagcgcctggcggcgactacgcgcgaagcggcgcagaaagcagatggttatgtgcgtgataatccatggcatggcgtgggtatcggtgccgccatcggcgttgccatcggtatgctgatctcgcgtcgttaa

SEQ ID NO: 1388 - DNA, 306 bp, Pantoea sp.
atgtctaaagaatcatcttctgaacacctgcgcgccgaactgaaaaatctcgccgatacgctggaagaagtgctgagcagctccagtgagaagtctaaaaccgagctggataaactgcgccacaaagcgcaagccgcactgaatagctcacgcgagcgtcttggcgactctggtgagcgtctggcgcaaaccacgcgagaagcggccgcaaaagccgatgactacgtgcgcgaaaatccatggcatggcgtgggtattggtgcagcgattggcgttgcgctgggtattctgctctcccgtcgttaa

SEQ ID NO: 1389 - DNA, 306 bp, Pantoea sp.
atggctaaagacaccacatctgaacatctgcgtgcggaactgaaaaaccttgccgacaccctggaagaagtgctgagcagctcggctgataagtcgaaaagcgagctggataaactgcgtcacaaagcacgcggtgccattgagagttcacgcgagcggctgggcgaatccggcgaacgcatcgcgcagaccacgcgtgaagcggcggagaaagcggacgtctacgtgcgtgaaaatccgtggcacggcgtgggtatcggcgcagcagtcggcgtgctgatcggcatcctgatttcacgtcgttga

SEQ ID NO: 1390 - DNA, 306 bp, Pantoea sp.
atggctaaagacacaacatcagaacatttgcgtgccgaactgaaaaacctggccgacaccctggaagaagtactgagcagcaccggcgagaagtcaaaaactgagctggataaattgcgtcagaaagcccgcgaagccctcgacacttcgcgtgaacgcctgggcgagtctggcgaacgcctggcgcaatccacccgcgaagccgcacataaggcagatgattacgtgcgtgaaaatccctggcacggcgtcggtattggtgctgcggtgggtgtggtcatcggcattctgctttcacggcgttaa

SEQ ID NO: 1391 - DNA, 306 bp, unknown
  environmental sample
atgtcaaaagataccaactcagaacacctgcgcgcggaattaaaaaatctggccgacaccctggaagaagtactgagcaccaccggtgaaaaatcaaaaaccgagctggacaagctgcgtgccaaggcacgcgccgcgctggatgagtcacgccaccgcctgggcgaatctggcgagcgtatcgcacagggtacccgcgaagcagcaggacgcgccgatgagtatgtgcgtgaaaatccatggcatggcgtcggcattggtgccgctgtaggcgtggtgctgggcgtattgctgacgcgtcgttaa

SEQ ID NO: 1392 - DNA, 306 bp, Pantoea sp.
atggctaaagactcaacatcagaacatttgcgtgcggaactgaaaaaccttgcagacaccctggaagaggtactgagcagcaccggtgataaatcgaaaaccgagctggataaactgcgtcagaaagctcgcgaagcgctcgacacctcgcgtgaacgtctgggcgaatccggcgaacgcctggcgcaatccacccgcgaagccgcgcacaaggcggatgactacgtgcgagagaatccatggcacggtgtgggtatcggggccgcagtgggtgtggtcatcggcattctgctttcccggcgttaa

SEQ ID NO: 1393 - DNA, 318 bp, Plautia sp.
atggagaacaccatggctaaagacaccacatctgaacatctgcgtgcggaactgaaaaaccttgccgacaccctggaagaagtgctgagcagctcggctgataagtcgaaaagcgagctggataaactgcgtcacaaagcacgcggtgccattgagagttcacgcgagcggctgggcgaatccggcgaacgcatcgcgcagaccacgcgtgaagcggcggaaaaagtggacgtctatgtgcgtgaaaatccgtggcacggcgtgggcatcggcgcagcagtcggcgtgctgatcggcattctgatttcacgtcgttga

SEQ ID NO: 1394 - DNA, 306 bp, Pantoea sp.
atgtctaaagatactacttcagaacatttgcgcgctgagttgaaaaacctggccgacacgctggaagaagtgctgagcagctcaacggataaatcaaaaactgaactggataagctgcgcaccaaagcacgtgcagcgctggaagattcacgtcagcgtctgggcgattccggtgagaaactggtgcagactacgcgtgaagcagccggtcgtgcagacgaatatgtacaagataacccgtggcacggtgtcggcattggtgccgcgctgggtgtcgcactgggtatcctgatcgcgcgtcgctga

SEQ ID NO: 1395 - DNA, 306 bp, Cedecea sp.
atgtcaaaagatactacgtcagaacatttgcgcgctgagttgaaatccctggcagatacgcttgaagaagtcctgagtgcttccacggacaagtcgaaaaccgaactggataagctgcgcaccaaagctgaaaaagcgctgaaagagagccgctctcgtctcggcgaaaccagcgaagccatcgcccagcaaacccgtgaagccgcggcaaaagctgacgattatgttcgcgagaacccgtggacaggcgttgggattggtgcggcggtaggcgtcgtactgggtgtgctgctggctcgccgctaa

SEQ ID NO: 1396 - DNA, 306 bp, Enterobacter sp.
atgtcaaaagatactacgtcagaacatttacgcgctgagttgaaatccctggcagatacgcttgaagaagtcctgagtgcgtccacggacaagtcaaaaactgaactggacaaactgcgtgccaaagcggaaaaaacgctaaaagagagccgggatcgcctgggtgaaaccagcgaagccatcgccaaacagacccgtgaagcggctgccaaagcggatgattatgttcgcgagaacccttggaccggtgtaggcattggtgcggcggtaggcgtcgtgctgggtgtgctgctggcacgtcgctaa

SEQ ID NO: 1397 - DNA, 306 bp, unknown
  environmental sample
atgtctaaagatactacctcagaacatctgcgcgccgagctgaaaaacctggctgacacgctggaagaagtgcttagctcctcaaccgaaaaatccaaaaccgagctggataagctgcgcagtaaagcacaaagcgcgctgaaagatacccgtgcccgcctgggtgactctggcgaccgcatcgcgcagaccacgcgtgaagcagcagagcgcaccgatgtctacgtgcgcgataacccatggaccagcgtgggtatcggtgctgctgtcggtgtggttctgggcgtgctgctgacccgtcgttaa

SEQ ID NO: 1398 - DNA, 306 bp, unknown
  environmental sample
atgtcaaaagatactacatcagaacatttgcgcgctgagttgaaatccctggcagatacgctcgaagaggtgcttagcgcatcgtcggacaaatccaaatcggaactggaaaagcttcgcggtaaggcagagaaagcgcttaaagagagccgttcccgcctgggcgacaccagcgatgtgattgcaaaacaaacgcgtgaagcggcggcgaaagctgacgactacgtgcgtgaaaatccatggactggcgtaggtattggtgcggcgattggcgtcgtgctgggcgttctgatgacgcgacgctaa

SEQ ID NO: 1399 - DNA, 306 bp, unknown
  environmental sample
atgtcaaaagatactacatcagaacatttgcgcgctgagttgaaatccctggcagatacgctcgaagaggtgctgagcacatcgacggacaggtcgaaatcagagatggaaaagctgcgcggcaaggctgagaaagccctgaaagagagccgtcatcgcctgggtgaaaccagcgacgtgctggctaaacaaacgcgtgaagcggcggcaaaggccgacgattacgtacgtgaaaatccatggactggcgtaggtattggtgcggcgattggcgtcgtactgggtgttctgctgacccggcgttaa

SEQ ID NO: 1400 - DNA, 306 bp, Citrobacter sp.
atgtcaaaagataatgctacggaacacctgcgcgctgagctgaaatcccttgcggatacgcttgaagaggtactgagctcctctggcgataagtcgaaagaagagttgagtaaaattcgcagcaaggctgaacgagcactgaaagagagccgtaatcgtctgggagaaaccagcgacgtgattgccaagcaaacccgtgaagccgctgcccgtgccgataactatgtgcgcgaaaacccatggacaggcgtcggtattggcgctgcggtcggtgtggtacttggcgtactgctgtcgcgccgttaa

SEQ ID NO: 1401 - DNA, 306 bp, Enterobacter sp.
atgtctaaagatactacttcagaacacctgcgcgctgagttgaaatccctggccgataccctggaagaggtgctgaactcttcgaccgataaatcgaaagaagagctgagcaaactgcgcagcaaagcggaaagtgcgctgaaagacagccgctatcgcctgggtgaaaccggtgatgcgctggcaaaacagactcgcgaagcagcggctcgtgcggacgaatatgtgcgcgataatccgtggacaggcgtaggcatcggtgctgccgtgggtgtagtcctgggcgttctgctgacgcgtcgctga

SEQ ID NO: 1402 - DNA, 570 bp, unknown
  environmental sample
atgaaactcaagctttttctgtttgccgctgcaggattaacagttgctgttccatcattaacccaggcggcgacgacctcgggaaccatcaatgccacgttaacgctaactaccggttgcctggtaaatggtcagtcagccacggcgggcgttaacttcggtaccctgaactttggtagcagtgctgccacctttgataccctgaacgccaccctggtcggtgcagccggtaacggtatttttgtccgctgcaccaccggtcaggactacaacgtggtggtcaccagcagcaatgctgcgccagccactatctatggcaccgcctcaacgtcgccgcgttatctgatactgggatcgaataatgcgcagggcatcgcctataccctttacagtgacgcctcctttaccacggcgatcgccaacaatacgcctatcgccgccagcggtaccaccgatccgacgctggggaccaactacgccatctatggccgggtggtcggcggcggttttaaccccctgatccctgccggaacctataccgacacgattaacgttgccgtgaactattaa

SEQ ID NO: 1403 - DNA, 570 bp, Pantoea sp.
atgaaactcaagctttttctgtgtgccgctgcaggattaactgtcgcaatgacacccttaacccaggcggcaacgacctccggaaccatcaatgccacgttaacgctgaccacgggttgcctggtaaacggtcagtcagctacggcgggcgttaacttcggtaccctgaattttggtagcagtgcagcgaccttcgacaccctgaacgccacgctggtcggtgcggcgggtaacggtatttttgtccgctgtaccacgggtcaggactataacgtggtggtgaccagcagcaatactgcgccagcgaccatttatggcaccgcctctgcatcaccacgttatctggttctgggatcggataatgcacagggcatcgcctataccctctacagtgacgcctcttttaccacggctatcgccaacaatacgccaatcgccgccagtggaaccacggacccaacactgggcaccaactacgccatttatggccgggttgttggcggcggttttaatcccctgattcctgccggaacttataccgatacgattaacgttgccgtgaactattaa

SEQ ID NO: 1404 - DNA, 570 bp, Pantoea sp.
atgaaactcaagctttttctgtttgccgctgcaggattaactgttgctgttccatcattaacccaggcggctacgacctcgggaaccatcaatgccacgttaacactgaccaccggttgtctggtaaacggacagtcagccacggcgggcgttaactttggtaccctgaactttggtagcagcgccgccacctttgataccctgaacgccaccctggtcggtgcagccggtaacggtatttttgtgcgctgcactaccggtcaggattacaacgtggtggtgaccagcagcaatgctgcgccagccactatctatggcaccgcctctacgtcgccgcgttatctgattctgggatcgaataatgcgcagggtatcgcctataccctctacagtgacgcctcctttaccacggcgatcgccaacaatacgccgatcgcctccagtggtacgaccgatccgacgcggggaaccaactacgccatttatggccgggtggtcggcggcggctttaaccccctgatccctgccggaacctataccgatacgatcaacgttgccgtgaactattaa

SEQ ID NO: 1405 - DNA, 570 bp, unknown
  environmental sample
atgaaactcaagctttttcttttggctgctgctggcattaccaccgcgcttccgtcattaacgctggcggcaaccacctcgggcaccatcaatgcgacgctgacgctgaccaccggttgtctggtaaacggtcagtccgccaccgccggggttaatttcggtaccctgaacttcggcagcagtgccgccacctttgataccctgaacgccacgctggtcggtgcggcaggcaacggtatttttgtccgttgcaccaccggccaggattacaatgtggtggtcaccagcagcaataccgcgcctgctaccgtctatggcacggcgtccacttcgccgcgctatctggtgctgggctcagataatgcgcagggcatcgcctacaccctgtatagcgacgcgtctttcaccacggcgattgccaataacacccccatcgcggccagcggcactaccgatcctaccctgggcactaactatgccatttacggtcgggtggttggcggaggctttaacccgctgatccctgccggaacctataccgacaccattaacgtcgccgtgaactattaa

SEQ ID NO: 1406 - DNA, 570 bp, Pantoea sp.
atgaaattcaagctttttcttttggccgctgcgggcatctccacagcacttccgtcattaacgctggcggcgaccacctcgggaaccatcaacgcgacgctgacgctgaccaccggttgtctggtcaacggtcagtcagccaccgccggggttaatttcggtaccttaaacttcggtagcagtgcggcaaccttcgataccctgaacgccacgctggtcggcgcggcgggtaacggtatttttgtccgttgtaccaccggtcaggactataacgtggtggtcaccagcagtaatactgcgcccgccaccgtctatggtacggcctccacttcaccgcgctatctggttctgggctcagataacgctcagggaatcgcctatacgctgtatagcgatgcctcatttaccacggcgattgccaataacacgccgattgcggccagcggcactaccgatccgaccttaggcactaactatgccatttacggtcgggtcatcggcggcggtttcaatccgctgatcccggctggcacctacaccgataccatcaacgtcgccgtgaactattaa

SEQ ID NO: 1407 - DNA, 570 bp, Pantoea sp.
atgaaattcaagctttttttgtttgccgctgcgggcctgacctcggcactccctgctgtgacatttgccgccaccaccacagggacgatcaacgccaccctgacgctgactaccggctgtctggtgaacggccagtccgccacgaccggcgttaacttcggtaccttgaacttcggcagcagcgcggcgaccttcgatacccttaacgccacgctggtcggcgcgtccggcaacggcatctacgtgcgctgcaccaccggccagactttcaacgtgcaggtgaccagcagcaacgcggcgcccgccaccatctacggcaccgtttccggccagccgcgctacctgatcctcggctccaacaatactcaggggatcgcctacaccctttatagcgacgcggcctttaccaccgctatcgccaataacaccaatatcgcgcccagcggcaccaccgatccgacgctgggcaccaactacgccatctacggtcgcgtcgtaggcggcggcttcaacccgctgattccggcaggcacctataccgacaccattaacgtcgccgtgaattactga

SEQ ID NO: 1408 - DNA, 570 bp, unknown
  environmental sample
atgaaactcaagctttttcttgtggcgtctagcctaagcgccgcactggcacctcatgctgtttttgccgccaccacaacgggaaccatcaatgcgacgttgacgctgaccaccggttgtttggtgaacggtcaatcggccacggcgggagtgaacttcggtaccctgaactttggtagcagcgcagccacttttgatacactcaatgccaccctggttggcgcagcaggtaacggcatctttgttcgctgcaccaccggacaaactttcaacgtgcaggtcaccagcagcaacgctgcaccggcgaccgtttacggcacggtgagtggccagccacgctacctgatcctcggctccaacaacacgcaaggcattgcctatacgctgtatagcgacgccgcattcactaccgccatcgccaacaacaccaatatcgctgccagtggtaccaccgatcctacactcgggaccaactacgccatttacggtcaggttgtgggcggcgggtttaaccccttgattccggcagggacctacaccgacaccatcaacgtggcggtgaattactga

SEQ ID NO: 1409 - DNA, 570 bp, unknown
  environmental sample
atgaaactcaagctttttcttttggctaccagcctgagcgccgcgctcgcccctgcaacggtttttgctgccaccacaacgggaaccatcaatgccacattgacgctcaccaccggctgtctggtgaacggtcagtccgccaccagcggggttaacttcggtaccctgaacttcggtagcagcgctgcaacctttgataccttaaacgccactctggtaggcgcatccgggaacggcatttttgtccgctgcaccacaggccaaacctttaatgtgcaggtcaccagcagtaatccggcaccggccaccatttacggtacggtgagcggccagccgcgttacctgatcctcggctccaacaatacgcagggcattgcttacacgctgtacagcgacgccgcgtttaccaccgccatcgccaacaacaccaatattgccgccagcggcaccaccgatccgacgctcggcaccaactatgccatttatggtcgggtggtcggcggcggctttaacccactgattccggccggtacctacaccgatactattaacgtggcggtgaactactga

SEQ ID NO: 1410 - DNA, 567 bp, unknown
  environmental sample
atgaaattcaagctttttctgttcgttgtcgggttgactacggcgctgccttccgcgacgtttgctgccaccaccacgggtgcgattaacgcgacgctaacattaaccacgggttgtctggtgaacgggcagtccgccaccactggcgtaaatttcggttcgttaaactttggcagcagtgccgcgaccttcgataccctgaatgccaccttagtgggcgcggcgggtaacggtatctacgtgcgctgcacaaccggtcaaacctttaacgtccaggtgaccagcagcaatgcggcaccgggaaccgtctacggcaccgtgtcatccgctccacgctacctggtgctgggggcggataatacccagggcatcgcttataccctctatagtgacgcctcctttagcaccgccatcgcaaataacaccaatattgcgcccagcggcaccaccgatccgacgcttggtaccaattacgccatctacgggcgcgtcgtgggcggcggctttaaccctgtgataccggccgggacttacaccgatacgattaacgtcgccgtgaactattga

SEQ ID NO: 1411 - DNA, 570 bp, unknown
  environmental sample
atgaaactcaagctttttcttttggctaccagcctgagcgccgcgctcgcccctgcaacggtttttgctgccaccacaacgggaaccatcaatgccacattgacgctcaccaccggctgtctggtgaacggtcagttcgccaccagcggggttaacttcggtacactgaactttggtagcagcgctgcaacctttgataccttaaacgccaccctggtgggtgcatccgggaacggcatttttgtccgctgcaccaccggtcaaaccttcaatgtgcaggtcaccagcagtaatccggcaccggccaccatttacggtacggtgagcggccagccgcgttacctgatcctcggctccaacaatacgcagggcattgcttacacgctgtacagcgacgccgcgtttaccaccgccatcgccaacaacaccaacattgccgccagcggcaccaccgatccgacgctcggcaccaactatgccatttacggtcgggtagtcggcggcggctttaacccactgattccggccggtacctacaccgataccattaacgtggcggtgaactactga

SEQ ID NO: 1412 - DNA, 573 bp, Pantoea sp.
atggttatgaaattcaagctttttctgttcgttgtcgggttgactacggcgctgccttccgcgacgtttgctgccaccaccacgggtgcgattaacgcgacgctaacattaaccacgggttgtctggtcaacgggcagtccgccaccactggcgtaaatttcggttcgttaaactttggcagcagtgccgcgaccttcgataccctgaatgccaccttagtgggcgcggcgggtaacggtatctacgtgcgctgcacaaccggtcaaacctttaacgtccaggtgaccagcagcaatgcggcaccgggaaccgtctacggcaccgtgtcatccgctccacgctacctggtgctgggggcggataatacccagggcatcgcttataccctctatagcgacgcctcctttagcaccgccatcgcaaataacaccaatattgcgcccagcggcaccaccgatccgacgcttggtaccaattacgccatctacgggcgcgtcgtgggcggcggctttaaccctgtgataccggccgggacttacaccgatacgattaacgtcgccgtgaactattga

SEQ ID NO: 1413 - DNA, 570 bp, Pantoea sp.
atgaaactcaagctttttcttatgaccgcaggcctgtacacaggattgacgtccgtaacggccctggcagccaccactaccggggcgatcaacgccacgctcacgctgacgaccggttgcctggtcaacggtcagtcagccaccaccggcgtcaatttcggtaccctgaactttggcagcagcgcagctacctttgatacgctgaatgccacgctggtgggcgcggccggcagcggtatctatgtgcgctgcacaaccggacagacctttaatgtacaggtcaccagcagcaacggcgcgccgggcacgatttacggcaccgtcagcggccagccgcgctacctcattctgggctcggataatacgcggggcatcgcctataccctctacagcgacgccgcctttaccaccgcgatagcgaacaacaccaacattgccgccagcggcaccaccgatccgacgctgggcaccaactatgccatctatggtcgggtcgtcggcggcggcttcaacccgcttatcccggcgggtacctataccgacaccataaacgtggcggtgaattactga

SEQ ID NO: 1414 - DNA, 567 bp, Pantoea sp.
atgaaacttaagctttttctgctggcaaccagcctgagtatcgctgtacctgttgtcactcaagccgcctccaccaccgggaccattgctgccaccctgacgctgaccactggctgtctggttaatggccagtctgctaccactggggttaacttcggtgcccttaacttcggtactagcgctgctacttttgacactctgggagcaacactggtgggttcatcgggtaacggtatttatgttcgctgtaccaccggccaaacgttcaacgtgcaggtgaccggcagtaacaccgcaccagcaaccgtctatggcacggcaagtacacagccgcgttacctgcgcctgtcctcggataatacccaaggtatcgcgtataccctgtatagcgactccgcttacaccaccgctatcgccaacaataccaatattgcagccagtggtgtcactgatgcgacattggggaccaactacgccatttatgggcgtatcgtgggtggcggttacaacccggttatcccggcgggcacctataacgacacgatcaacgtctcagtaaactattga

SEQ ID NO: 1415 - DNA, 567 bp, Erwinia sp.
atgaaaatgaagctttttttgctgggctgcggcttgggtctcggcgtggcctcttccggctttgccgccaccacgacgggaactatcaacgccacgctggtcctgaccacgggttgcctggtcaatggccagaccgccaccaccggtgttaacttcggtaccttagactttggtagcagcgccgcgacctttgataccctgaacgccaccttagttggcgcgctgggcaacggcatctttgtgcgctgcaccactggtcaaacctataacgtgcagctcaccagcagcaacgccgcgcccgctaccgtgtttggcgaagtaaccgcgcagcctcgctatctggtgctgggcagcaacgccacgcagggcattgcctatacgctctataactccacttcctataccacgcccatcgctaacaacactaacctgaccagcacgggcaccacggatccgaccaatggcgacaactacccgatttacggtcgtattaccggcggcggttttaacgcagcgatcccggcaggtacctataccgatacgattaacgttgccgtgaactactga

SEQ ID NO: 1416 - DNA, 567 bp, Erwinia sp.
atgaaaatgaagctttttctgctgggctgtggccttagccttggcgtggcctcttctggctttgccgccaccacaacgggaaccattaacgcaaggctggtcctgaccaccggctgcctggttaacggtcagtccgccaccaccggcgttaacttcggtaccttagactttggtagcagcgctgccaccttcgatactctgaacgccaccttagtcggctcgctgggtaacggcatctttgtccgttgcaccaccggtcaaacctacaacgttcagctcaccagcagtaatgcggcccccgctaccgtgttcggtgcggtgacggcacagccacgctatctggtactcggcagtgacgccacacagggaattgcttacaccctgtatggcaccacctcttacaccacgccaattgctaacagcacaaacctgactaataccggcaccaccgatccggtcaacggcgacaactacccgatttacggtcgtatcaccggcggtggattcaatgcggccattccggcaggcacctacaccgataccatcaacgtagccgtcaattactga

SEQ ID NO: 1417 - DNA, 573 bp, Erwinia sp.
atgaaaataaagctttttctggtgggctgtggcctgagcctcggtgttgcctcttcaggctttgccgccaccacaacgggaacaatgaacgccaccctgacgctgacaacgggttgtctggtcaatggcgggactgcaacgaccggggttaacttcggtactttagacttcggtagcagcgccgccacctttgacaccctcaatgctaccctggtggcgccgggttcagcaggcaatggcatcaatgtgcgctgtaccaccggtcagactttcaatgtgcgtatcaccagcagtaatccggcgccaggtacggtgtatggcaccgtaaccagcgcaccgcgttacctggtgctcggcagtgatgctactcagggcatcgcctataccctctatagtgatgctgggttcgccacctcaattgccaacaacgccgatctggtctccagtggcacgcctgacccggtactgggcactaacttcccggtttatggtcgtgtcaccggtggtggtcagaatgccgccattcccgcagggacttacactgataccattaatgtcgctgtgaactactga

SEQ ID NO: 1418 - DNA, 567 bp, Pantoea sp.
atgaaaatgaagctttttttgctgggttgtggcctgggcctcggcgtggcctcttgcggctttgccgccaccacgacgggaaccatcaacgcccagctggtgctgaccaccggctgtcttgttaacggacaatcggccacgactggcgttgacttcggtactctggactttggtagcagcgctgccaccttcgataccctcaacgccaccctggtcggttcgctgggcaacggcattttcgtgcgttgtaccactggccagacctataacgtccagctcaccagcagcaatacggcgccgaccaccgtgtttggtgccgtcaccgcgcagccccgctaccttgttcttggcagcgatgccactcagggaattgcttacaccctctatagcaccacttcttacaccacgccgatcgccaataacactgaccttaccaataccggcacgaccgatcctgttaacggcgaaaactatccgatttatggccgcatcaccggaggcggattcgatgccacaatcccggcaggcacctacacggatacgatcagcgttgccgtgaactactga

SEQ ID NO: 1419 - DNA, 567 bp, unknown
  environmental sample
atgaaaatgaagctttttctgctgggctgcggcctgagctttggcgtcgtcagttcgggattcgccgccaccacgacagggactatcgcggccagactggtattaaccaccggctgcctggtgaacggtcaatccgccacctccgccgtcaactttggtaccctcgactttggtagcagcgcggcgacgtttgatacgctgaatgccaccctggtcggttcactgggtaacggcatcttcgttcgctgcaccaccgggcaaacctacaacgtccagctcaccagcagcaacgccgcccccgccaccgtttacgggacggtcacggcgcagccgcgctatctggtcagcgccaccaatgccacccagggtgtcgcttacacgctgtatggcaccacctcttacaccacgccgattgctaacaacaccaacctgacaaataccggcactgccgacccggtcaacggggacaactatccgatttatggtcggattgctggcggtggctataacgccgctattccggcaggtacctacacggacacgattaacgtcgcagtgaattactga

SEQ ID NO: 1420 - DNA, 354 bp, Pantoea sp.
atgtgggatgtggatacaaccaaaagatttgatgagtggttcaaggctcagagtgaggaactgaaggaggatatgctcgccgcgatagttatcctgtctgagtatgggccgcatttagcgaggccgtttgctgataccgtagacggctctgattttccgaatatgaaagaattaagagtgcagcatcaaggcaaaccgatacgggccttctttgcttttgatccttctcgccgcggcattgtgttgtgtgcaggcgataaaaccggggttaaggaaaagaaattctataaagacatgatcaaattggcagatgctgaattccgcaaatatttgaatggaggggataatggctaa

SEQ ID NO: 1421 - DNA, 354 bp, unknown
  environmental sample
atgtgggatgtggatacaaccaaaagatttgatgaatggtttaaggctcagactgaggaactgaaggaggatatgctcgccgcgatagttatcctgtctgagtatgggccgcagttagcgaggccgtttgctgataccgtagacggctctgatttttcgaatatgaaagaattaagagtgcagcatcaaggcaaaccgatacgggccttctttgcttttgatccttctcgccgtggcattgtgttgtgtgcaggcgataaaaccggggttaaggaaaagaaattctataaagacatgatcaaattggcagatgctgaattccgcaaatatttgaatggaggggataatggctaa

SEQ ID NO: 1422 - DNA, 342 bp, Klebsiella sp.
atgtgggatgttgaaacaacggaggttttcgacaagtggtttgaggcgcagatcgaagcgcttaaagaggatatgctcgccgctatggtgatcttatccgagtatggcccccaactcggaaggccgtttgcggatacagtaaacgattctgctttttcgaatatgaaagagctgcgcgttcagcatcgaggtagcccgatcagagctttctttgtatttgacccttctcgtcgcggcatcgtgttatgcgccggagataaaacagggttaaatgaaaagagattctataaagatatgatcaagcttgcagatgctgagtaccgtaagcaccttaatcagtaa

SEQ ID NO: 1423 - DNA, 342 bp, Citrobacter sp.
atgtgggatgtagaaacaacggatgctttcgacaagtggtttgatgtacaaaccgaagcactcaaggaggatatgctcgcagcgatgatgattttgtccgagtatgggccccagttaggcaggccgtttgcagatacggtgaatgattctgttttttcaaatatgaaagagttacgggtacaacatcagggcaatcccattcgggcattctttgcgtttgatccttctcgtcatggcatcgtgttatgcgctggggataagacagggataaacgagaagaaattctataaagatatgatcaagtttgcagatgttgagtaccgaaagcaccttaataagtaa

SEQ ID NO: 1424 - DNA, 297 bp, unknown
  environmental sample
atgtgggatgtggatacaaccaaaagatttgatgagtggtttaaggctcagagtgaggaactgaaggaggatatgctcgccgcgatagttatcctgtctgagtatgggccgcatttagcgaggccgtttgctgataccgtagacggctctgattttccgaatatgaaagaattaagagtgcagcatcaaggcaaaccgatacggcccttctttgcttttgatccttctcgccgcggcattgtgttgtgtgcaggcgataaaaccgggttaaggaaaagaaattctataaagacatga

SEQ ID NO: 1425 - DNA, 342 bp, unknown
  environmental sample
atgtgggatgttgaaacaacggatgttttcgacatgtggtttgaggtgcaaaccgcagcacttaaggaagacatgctcgccgcgatgctcattttatcggaatatggcccccaactgggaaggccgtttgccgatacggtgaatggctctactttttcgaatatgaaagagctacgcattcagcatcagggccatcctatacgcgctttctttgtatttgatcctgctcgccatggcatcgtgctatgtgccggggataaaacaggctttaatgaaaagagattctataaagacatgatcaaactcgccgatgccgagtaccgtaagcaccttaatcagtaa

SEQ ID NO: 1426 - DNA, 342 bp, Salmonella sp.
atgtgggacgtagaaacaacggatgttttcgatgagtggtttgcagcgcaagccgacgttctaaaagaagatctgcttgcggcgatgatcattttatccgagcaaggcccgcagttggggaggccgtatgcagacacagtgaatggctccagcttttcgaacatgaaagaattacgtatacaacatcaaggtaatccaatccgcgccttctttgcgtttgacccttctcgccatggcatcgtgttatgtgccggagataaaacagggttgaacgaaaagagattttatagagatatgatcaagctcgcggatgccgaataccgcaagcatctgaacaagtaa

SEQ ID NO: 1427 - DNA, 345 bp, Escherichia sp.
atgatgtgggacgtcgagacaacggagactttcgacaactggtttgatgcccagactgttgcgctgaaagaagatttgcttgctgcaatgctgattcttgcagagtatggcccacagttgggcagaccctttgcggacacggttaatgattcacagttttcaaatatgaaagaattacgtgtccaacatcagggaaacccggtacgtgctttttttgctttcgatcctgcgcgccgtggcattgtattatgtgcaggtgataaaacggggttaaatgagaaaaagttttatcgcgatatgatcaagctcgctgattctgaataccgtaagcatctgaaaaagtaa

SEQ ID NO: 1428 - DNA, 342 bp, Kluyvera sp.
atgtggtcggtggaaacaacggatgttttcgacagttggtttgaggaacaggccgaagccttgagggaagatgtgcttgcagcgatggtgattttatccgagtacggaccgcagttgtcgcgcccgtttgcggatacggttaatggctccgctttttcaaatatgaaagagcttcgtatacagcatcagggaaatcccattcgggccttttttgcgtttgatccttctcgctgcgccatcgtgctatgtgcaggagataaaacaggattaaacgaaagacggttttataaagagatgatcaaacttgctgacgccgagtaccgtaagcacctgaataagtga

SEQ ID NO: 1429 - DNA, 2313 bp, Pantoea sp.
tcgggcggctacggcatcagcgtttcagccagcgtcaacgcgggcaaaggccgcgagaacggcaacgggctgacccataccgagactacactcacggcgggcaacgggctgagcctgaacgccgggcgcgacaccatgctgacgggcgcacaggtgcgcggggacagcgtgaaggtggataccggccgcaacctgacgctgacctctgaacaggacagcgaccgctacgacagcaagcagcagaacgccagcgcgggcggcagcttcaccttcggctcgatgaccggctccgcgagcgtcaacctcagccaggacaaaatgcacagcaactggcagagcgtggccgagcagaccggtatctttgctggaaagggcggctttgacgtgacggcaggcgggcacacccagctgaacggcgcggtcatcagttccaccgccaccgccgataaaaaccgtctcgacaccggcacgctgggcttcagcaacatagagaaccacgcggactataaaaccgagcaccagagcgtgggcatgagcaccggcggcagcatcggcagccagttcgaaggcaacatggcgaacggcctgctggcggggctgaacggcagcggcagcgcctcgtcggtgacgaaggcggcggtgagcgacggcaccctcattatccgggataaggcgaagcagacgcaggacgtgtcggcgctgagccgcgacgcggcgggtgcgaatccggggctggataaaatcttcgataaggagaaagagcagcggcggatggagacggcgcagctgctggcggaaatcggcagtctggcgggcgacatcgcgcggacgcagggcgatattgcggcgacgaaagcggccacggagaagatgaagaacatctcgccggaccagaagaaggatgccgaagcgcagtggcggaaagcgaacccgggtcaggagccgaccgcggccgacatcaccggacaggtctatcagacgctgtacaaccgggagatgctggccggcggaatgggaaccggcggttcggtgcagcagggcatcagcgcggcgacggcggcgatacagggactggcgggcggcaacattgcccaggcgatgagcggggcggccgcaccttatctggcggagcagatacacaagctgacgaccacgaaaggcccggacggcaaagaggtggtgaacgttcaggcaaacctgattgcgcacgcggtagtgggcgcggtgacgtcatacgcgtcgggtaatcctgcacttgcgggtgcttctggcgcggcgatgggcgaatatattgcgcagcagatgtatccgggagttaagcgcgaagacctgagtgaggagcagcggcagaccatcagtgcactggggacgctggcggcgggacttgcgggcggcgtggccggagacagcacgggcggtgcggtggcaggtgcgcaggcgggtaaaaatgcggttgagaataatgcgctgcatgcaccagatgaaaagaagcgtcaggatgcgaagtggtcgttaccgtatctggaaggagaaaagaaacagcaggcagaacagttaatcagtgacctggatgcgaaagataaggcattcgatgtagcgttagactcagcctgtaaaggactgtcttcagcagcctgccagggtatgaggcaggaactggcggcaatgggtaaaagttatagcgaacagcttgatggtcagtacatcggcaatatgggaagtgtctataaggaaggtaaaggccaggtcgatgcactgatatggcagtatgctacggcggatgcgaaagcagagcgtgatgctaacgtcaaccgcattgctgaaaactggggtgtgagtaaagaaaccgcggacggcctttataccacaatggctggtgttcatactgctgcagcgattggtggtgctctgtggggattgaaaggtccaggcaccgtaactgtttatcgtgtagagggaacaccaaatacacgtgttgtgataggagacaacggacaggttagtattactggcaatacaacgctatatttgaattttggtgacaaagccagggcactagagtttttcgaaaaacgtggctctcagaatatggatggtgcagcgataaaaacgtttgaggtaccccactctgttctggatgatttaagaaacactgttgtgaaagaaagcgtggctcgattgccagaaaataaagggaagcctgttattgcagatccaactaaagctaaggatcaatatggtataaggccagaaaagctggaagaattaaaagacaagattatccaggggacaggaagaaatgcaagtaagtga

SEQ ID NO: 1430 - DNA, 1962 bp, Pantoea sp.
accggcatctttgccgggaagggcggctttgacgtgacggcaggcgggcacacccggctgaacggcgcggtcatcagttccaccgccaccgccgataagaaccgtctcgacaccggcacgctgggcttcagcaacatagagaaccacgcggactataaaaccgagcaccagagcgtgggcatgagcaccggcggcagcatcggcagccagttcgaaggcaacatggcgaacggcctgctggcggggctgaacggcagcggcagcgcctcgtcggtgacgaaggcggcggtgagcgacggcaccctcattatccgggataaggcgaagcagacgcaggacgtgtcggcgctgagccgcgacgcggcgggtgcgaatccggggctggataaaatcttcgataaggagaaagagcagcggcggatggagacggcgcagctgctggcggaaatcggcagtcaggcaggcgacattgcgcggacctatggtcagattgaggcgacgaaagcggccactgagaagatgaagacggtgacgccggaccagaagaaggatgccgaagcgcagtggcgcaaagcgaacccgggtcaggagccgaccgcggccgacatcaccggacaggtctatcagacgctgtacaaccgggagatgctggccggcggaatgggaaccggcggttcggtgcagcagggcatcagcgcggcgacggcggcgatacagggactggcgggcggcaacattgcccaggcgatgagcggggcggccgcaccttatctggcggagcagatacacaagctgacgaccacgaaaggcccggacggcaaagaggtggtgaacgttcaggcaaacctgattgcgcacgcggtagtgggcgcggtgacgtcatacgcgtcgggtaatcctgcacttgcgggtgcttctggcgcggcgatgggcgaatatattgcgcagcagatgtatccgggagttaagcgcgaagacctgagtgaggagcagcggcagaccatcagtgcactggggacgctggcggcgggacttgcgggcggcgtggccggagacagcacgggcggtgcggtggcaggtgcgcaggcgggtaaaaatgcggttgagaataatgcgctgcatgcaccagatgaaaagaagcgtcaggatgcgaagtggtcgttaccgtatctggaaggagaaaagaaacagcaggcagaacagttaatcagtgacctggatgcgaaagataaggcattcgatgtagcgttagactcagcctgtaaaggactgtcttcagcagcctgccagggtatgaggcaggaactggcggcaatgggtaaaagttatagcgaacagcttgatggtcagtacatcggcaatatgggaagtgtctataaggaaggtaaaggccaggtcgatgcactgatatggcagtatgctacggcggatgcgaaagcagagcgtgatgctaacgtcaaccgcattgctgaaaactggggtgtgagtaaagaaaccgcggacggcctttataccacaatggctggtgttcatactgctgcagcgattggtggtgctctgtggggattgaaaggtccaggcaccgtaactgtttatcgtgtagagggaacaccaaatacacgtgttgtgataggagacaacggacaggttagtattactggcaatacaacgctatatttgaattttggtgacaaagccagggcactagagtttttcgaaaaacgtggctctcagaatatggatggtgcagcgataaaaacgtttgaggtaccccactctgttctggatgatttaagaaacactgttgtgaaagaaagcgtggctcgattgccagaaaataaagggaagcctgttattgcagatccaactaaagctaaggatcaatatggtataaggccagaaaagctggaagaattaaaagacaagattatccaggggacaggaagaaatgcaagtaagtga

SEQ ID NO: 1431 - DNA, 1236 bp, unknown
  environmental sample
atgctccttaaacttaaaaccatgaacaagataaatttaacatcaatacttttaagtgcctttatattcctgtctggctgcaataaggaagttttagtggatctggatattcctgaagccggcagctttgcgcgcttgtacatgccgcaggcggcaagcaatccggtcaatatggggatcagcattacggatcaggactatgcagtgccatatgctgcccaccttggtggttcattgcgggcccaagctgatattccggtaagctttaaagtttcaccggaaatggttgccgcttataaccagaaaaataatacagcttaccggatgatgccccagggcagctataccctgcaaactgagacggcaacgatccctaaaggtgcgcagggaactggtattctgaaactgatcattaaaactaagggttttttgaatgcatttgagtcctatctgcttccggtaagtatttctgcaccggcaggcgtaaacttaaataatgagctcagcactacttatttcgtatttacaggcgcttatgctccgggggaagttccgcgcgagaaggtgctgtcgatgggtgcggacgcgggtacatttttaatcgattttaacagtgactttatacgtaaggacccggcatcgggggagctgattttgtaccgggctgatgcagtgacagggcaatttacagcgccgcctaaaacgataggctggggctggaatgtgatggataaaatcttttcttatggcggcaaccgcctgattgcaaggtttggcagcggcgggggtaacatcaatcagtatttccttagtcaggacggcgtatttggcgcgcagcgtcaggtgggccagggctggggcgggctcgctgcgattgttccttttaaaggcctgttactggggatcgccccgaatggcgacatgacgaaatttcctttaaacggggacggcgactttgattatggaaatatcaggcagatcggttctggctggacgggctttacccaaatcttttcttatcaaaactcactgatcactgttgacaatagcggaaatatgtggcaatacccgctatctgacgatggtgtttttggtacccgcagaaagattggtacaggctgggatatgtatgtcaaggtcatcacttcaggtactgacctgctggctttggatgccaatggagatttgtggcggtataaattcaatccggaaggcttatggcctttgaaaaaataa

SEQ ID NO: 1432 - DNA, 600 bp, Chromobacterium sp.
atgctctacttgcgcttgatgttgagaggcttcctgctggcggtgctgctggtggtgctcggcttcgcctgtgtcgcgtggagcatcgtcgactacggcagcggcgacgaggtgccgggcgccgacgccgcgctggtgctgggcgccgccgcctggggcaacaagccctctccggtgttccgcgagcgcatcaaccacgcggtcaaactgtatcagagcggcaaggtgcgctggatcgtattcaccggcggcacgccggagcccggctatccggccgaggcggatgtcggccgggaattcgccgcgcgccagggcgtgccgatgacggcgatgctggtggagaaccagtcgcgcaccacctggcaaaacctgtccaacgcccgggacctgggcaaccagttcggcatccgttcctatcttttggtcagcgatccgctgcacatgcgccgcgcggtgctgatggccggagatcttggcctgcgcgcctacccggcccccacccagtccagccgcttccgcacgctggccagctggtcgcgctttctcgcgcgcgagacctggctctatgtcggttaccgggtattccggcagctatcctga

SEQ ID NO: 1433 - DNA, 600 bp, Chromobacterium sp.
atgctctatttgcgtttgatgatgaaaggctttttgctggcggtgctgctggtggtgctcggtttcgcctacatcgcctggaccatcgtcgactacggcgacggggacgagcagaacggcgccgacgcggcgctggtgctgggcgccgcggcctggggcaacaagccgtcgccggtgttccgcgagcgcatcaaccacgcggtgaagctttaccagggcggcaaggtgcgctggatcgtgttcaccggcggcacgccgcagccgggctatccgtccgaggccgatgtcggccgcgagttcgccgcgcgccagggcgtgccgatgacggcgatgctggtggagaccgagtcgcgcaccacctggcagaatctgtccaacgcccgcgatctgggccgccagtttggcatccgctcctatctgctggtcagcgatccgctgcatatgcgccgggcggtgctgatggccgctgatctgggcctgcgcgcctacccggcgcccacccagtccagccgtttccgcacgctgtccagctggtcgcgcttcctggcgcgcgagacctggctatacgtcggttatcgggcgtttcgccagttgtcgtga

SEQ ID NO: 1434 - DNA, 600 bp, Chromobacterium sp.
atgctctacttgcgtttgatgttgaaaggcttcctgctggcaatcctgctggtggtgctgggcttcagttatgtggcctggagcattgtcgatttcggcagcaacgcaagcgaaccgcaagccgacgccgcgctggtgttgggcgcggcggcctggggcaagcgcccgtccccggtgttccgcgagcgcatcaatcacgcggtcaaactgtacaagtccggcaaggtgcgctggatcgtgttcaccggcggcacgccggaaccgggctatccgtccgaagccgacgtcggccgtgatttcgccgccaagcaaggcgtgccgatgacggcgatgctggcggaaaaccagtcgcgcaccacctggcagaacctggagaacgcgcgcgaattgagcagccagttcggcatccgctccttcctcttggtcagcgacccgctgcacatgcgtcgttcagtgctgatggccaccgatatcggcctggtggcttatccggcgccaacccaatccagccgctaccgcaccctgtccagctggtcccgtttcctggctagggaaacctggctttacctgggctaccgcgtgttccgcaagctatcttga

SEQ ID NO: 1435 - DNA, 600 bp, Chromobacterium sp.
atgctctacttgcgtttgatgttgaaaggctttgtgctggcgattttgctggtggtgctgggctttagctacgtagcctggagcattgtcgatttcggcggcagcgcaaatgaaccgcaagccgacgcggcgctggtgttgggggcggcggcctggggcaagcgcccatcaccggtgttccgcgagcgcatcaaccacgcggtcaaactgtataaatccggcaaggtgcgctggatcgtgttcaccggcgggacgccggagccgggatatccatcggaagccgatgtgggccgcgactttgccgccaagcagggcgtgccgatgacggcgatgctggcggaaaaccagtcgcgcaccacttggcaaaacctggagaacgcgcgcgagttgagcagccagttcggcatccgttccttcctcttggtcagcgatccgctgcatatgcgccgctcggtgctgatggccaccgacattggcctgaccgcctatcccgcgcccactcaatccagccgctaccgcaccctgtccagctggtcccgcttcctggccagggaaacatggctttatattggctaccgggtgttccgtaagctgtcctga

SEQ ID NO: 1436 - DNA, 600 bp, Paludibacterium sp.
atgcagtacctgcgtttgatgctgagaggctttatgcttgccgtgctgttgctgctggtttttacggcactgacggcatggcgcatcgtcgactatggcgcgcgcacgtctgatgattctgccgatgcggcgctggtactgggagccgccgcttggggggaccggccgtcgccggtttttcgcgagcgtatccggcatgcggtcgatctgtatcagcgtggcaaggtgcgctggatcgtatttaccggcgggacgccggtgcccggctatccatccgaagccgaagtcggacgcgcattcgccctgcgcgccggggtgccgatgacggcgatgctggccgagaccgaatcgcgcaccacctgggaaaatatctccaatgccagacggctggccgagcctttcggcattcactcctacctgctggtcagcgatccctggcatatgcgacgtgcggtgctgatggcggaagacctcggcattgatgtcgcgccatcgcccaccgtctcgacccgttttcggacgctgaccgtgcggtgcggctttctgatgcgcgaaacctggctctatatcggctaccgcatcttccgtaccttgtcctga

SEQ ID NO: 1437 - DNA, 738 bp, Pseudomonas sp.
atgagcaagtcaatcgctgtcagccaacagagccagcagcttcacaatgatgtgcaagaagccgtcaagtcgatcatgggtgcaacgcaactgaaggcgtcggattacggccgggtactgaggtcggccctggcagcttcgcaaaaaaccgtcaccatcgaaatcgccgccggcgacctgacgcagctgaagaagtccggctacaagctgtgctttgccaagaaggtgggtgacgccgactacaacgtggtctggcagtcctatgacgcttacctgagcaacaatgagttcagctggacgcctcaatatcagctgtttgcgtccaacctgttcaaggcaaatgtgcaggtcaaagtctcgaccaacatcgtcaatatcggcctggggcaaacatcgacactcgatgagcacggtctgctgagttcggcggttaccggggggccgagcatctccatgacctttgtaaacgactacgcccccatccatccgggtatcaaccagctctctaccggcattgatggcaatcaggtcagcacgcccatttacgttgcggtggatcaggtggtcaccggtgaaaccgtgctgacgccggtggaaaccatcctcgtgtggttcgaacagaacgtacagaccagcaccatgttcagtacctcacgctccaaggcgatcgaaatcgacctgacgttcgataacaccgcaggtcgcctttacgaaggcggtcagtggaaaaccgtgtaa

SEQ ID NO: 1438 - DNA, 744 bp, Pseudomonas sp.
atgagcaaatcaatcgctgtcagccaacagagccagcagcttcacaatgatgtgcaagaagccgtcaagtcgatcatgggtgcaacgccaacgcaactgaaagcggcagattacggccgggtactgaggtcagccctggcggcttcgcaaaaaaccgtcaccatcgaaatcgccgccggcgacctgacgctgctgaagaaatccggctacaagctgtgctttgccaagaaggtgggtgacgccgactacaacgtggtctggcagtcctatgacgcttacctgagcaacaacgagttcagctggacgcctcaatatcagctgtttgcgtccaacctgttcaaggcaaatgtgcaggtcaaagtctcgaccaacaccgtcaatatcggcctggggcaaacatcgacactcgatgagcacggtctgctgagttcggcggttaccgggggaccggacatttccatgacctttgtaaacgactacggccccatccatccgggtatcaaccagctatctaccggcattgatggcaatcaggtcagcacccccatttacgttgcggtggatcaggtggtcaccggcaataccgtgctgacgccggtggaaaccatcctcgtgtggttcgaacagaacgtacagaccagcaccatgttcagtacctcacgctccaaggcgatcgaaatcgacttgacgttcgataacaccgcaggtcgcctttacgaaggcggtcagtggaaaaccgtgtaa

SEQ ID NO: 1439 - DNA, 738 bp, Pseudomonas sp.
atgagcaagtcaatcgctgtcagccaacagagccagcagcttcacaatgatgtgcaagaagccgtcaagtcgatcatgggtgctacgcaactgaaggcgtcggattacggccgggtactgaggtcggccctggcggcttcgcaaaaaaccgtcaccatcgaaatcgccgccggcgacctgacgcagctgaagaagtccggctacaagctgtgctttgccaagaaggtgggtgacgccgactacaacgtggtctggcagtcctatgacgcttacctgagcaacaacgagttcagctggacgccgcagtatcagctgttcgcctccaacgtgttcagggaaaacgtgcaggtcaaagtctcgaccaacatcatcaacattggcctggggcaaacctcgacacttgatcaacacggcctgctgagcccggcggtaaccggtggcccgaatatttccctgactttcgtgaacgactacgcgccgattcatccgggggtcaaccaattgtccaccggcattgatggcaatcaggtcagtacgcccatctacgtggccgtaaaccaggtcgtcaccggcagtaccgcgctgacgccggtggagaccatcctcgtgtggttcgaacagaacgtacagaccagcaccatgttcagtacctcacgctccaaggcgatcgaaatcgacctgacgttcgataacaccgcaggtcgcctttacgaaggcggtcagtggaaaaccgtgtaa

SEQ ID NO: 1440 - DNA, 702 bp, Pseudomonas sp.
atgagcaaatcaatcgctgtcagccaacagagccagcagcttcacaatgatgtgcaagaagccgtcaagtcgatcatgggtgcaacgcagctgaaggcgtcggattacggccgggtactgaggtcggccctggcggcttcgcaaaaaaccgtcaccatcgaaatcgccgccggcgacctgacgctgctgaaaaagtccaactacaagctgtgctttgccaagaaggtgggtgacgccgactacaacgtggtctggcaatcctacgacgcctacctgagcaacaacgagttcagctggacgcctcaatatcagctgtttgcgtccaacctgttcaaggcaaatgtgcaggtcaaagtctcgaccaacatcgtcaatatcggcctggggcaaacatcgacgctcgatgagcacggtctgctgagttcggcggttaccggagggccgaacatttccatgacctttgtgaacgactatgcccccatccatccgggtatcaaccagctaacgacgggcattgatggcaatctggtcaccggtgaaaccgtgctgacaccggtggaaaccatcctcgtgtggttcgaacagaacgtacagaccagcaccatgttcagtacctcacgctccaaggcgatcgaaatcgacttgacgttcgataacaccgcaggtcgcctttacgaaggcggtcaatggaaaaccgtgtaa

SEQ ID NO: 1441 - DNA, 744 bp, Pseudomonas sp.
atgagcaaatcaatcgctgtcagccaacagagccagcagcttcacaatgatgtgcaagaagccgtcaagtcgatcatgggtgcaacgccaacacaactgaaggcggctgattacggccgggtactgaggtcagccctggcggcttcgcaaaaaaccgtcaccatcgaaatcgccgctggcgacctgacgctgctgaagaagtccggctacaagctgtgctttgccaagaaggtgggtgacgccgactacaacgtggtctggcagtcctatgacgcttacctgagcaacaacgagttcagctggacaccgcagtatcagctgttcgcctccaacgtgttcaaggaaaacgtgcaagtcaaagtctcgaccaacatcgtcaacattggcctggggcaaacctcaacactcgatccaagcggcctgctgagctcagcagtaaccggtggcccggaaacttccctgagtttcgtgaacaactacgcgccgattcatccgggggtcaaccagctgtccaccggcatcgatggcaaccaggtcagtacgccgatctacgtggccgtaaacccggtcgtcaccggcaataccgtgctgacgccggtggaaaccatcctcgtgtggttcgaacagaacgtacagaccagcaccatgttcagtacctcacgctccaaggcgatcgaaatcgacctgacgttcgataacaccgcaggtcgcctttacgaaggcggtcagtggaaaaccgtgtaa

SEQ ID NO: 1442 - DNA, 735 bp, Pseudomonas sp.
atgagcaaatcaatcgctgtcagccaacagagccagcagcttcacgatgtgcaagaagccgtcaagtcgatcatgggtgcaacgcaacttaaggcagcggactacaacaaggtgtttaggtccaccctggcggccatacaaaaagtcgtcaccatcgaaatcgcccctggcgacctgtccctgctgaaaaagtccggctacaagctgtgctttgccaagaaagtgggcaccgaagactacaacgtagtctggcaatcctataacgcttacctgagcaacaacgagttcagctggacgccgcagtatcagctgttcgcctccaacgtgttcaaggaaaacgtacaagtcaaagtctcgaccaacatcgtcaacattggcctggggcaaacatcgacactcgatgaacacggtctgctgagttcggcggttaccggggggccgaacacttccatgacctttgtaaacgactacgcccccatccatccgggtatcaaccagctatctaccggcattgatggcactcaggtcagcacccccatttacgttgcggtggatcaggtggtcaccggcaataccgtgctgacgccggtggaaaccatcctcgtgtggttcgaacagaacgtacagaccagcaccatgttcagtacctcacgctccaaggcgatcgaaatcgacttgacgttcgataacaccgcaggtcgcctttacgaagacggtcagtggaaaaccgtgtaa

SEQ ID NO: 1443 - DNA, 738 bp, Pseudomonas sp.
atgagcaaatcaattgctgtcagccaacaaagccagcagcttcacaacgatgtgcaagaagccgtcaaatcgatcatgggtgcaacacaactgaaggcgtcggattacggtagggtattgagctccgctctggcggcctcacaaaaagtcgtcaccatcgagatcgcccccggtgacctgacgcagctcaagaaatcgggctataagctgtgcttcgccaagaaggtcggcaccgaagactacaatgtggtctggcagtcctacgacgcttacctgagcaacaacgaattcagctggacgccgcaatatcagctgtttgccaccaacgtgttccgggaaaacgtacaagtaaaagtctcgaccaatattgtcaatattggtctgggacaaacttcgacgctcgatcaacacggtttactgagtccggcagtaacgggtgggccgactatttccatgacctttgtgaatgactacgcgccgattcatccgggcgtcaatcagttgtcgaccgggatcgatggcacgcaagtcagcacgcctatctatgtagcggtcaatcaagtagtgaccggcaacaccgtactgaccccggttgaaaccatcctcgtgtggttcgaacaaaacgtgcagacgagtaccatgttcagtacatcacgttccaaggcgatcgaaatcgacctgacattcggtaacaccgcaggtcgcctttatgaaggcggtgtctggaaaaccatataa

SEQ ID NO: 1444 - DNA, 741 bp, Pseudomonas sp.
atgagcaaatcaatcgctgtcagccaacaaagccagcagcttcagaacgatgtgcaagaagccgtcaagtcgatcatgggtgctaccaccgcgctgaagtccaccgattacggtcgggtcttcaggtccgtcctggcggcttcgcaaaaaaccgtcaccatcgaaattgcccccggcgacctgaccctgctgaagaagtccggctacaagctgtgctttgccaagaaagtcggtacggccgactacaacgtggtctggcagtcctacagtgcctacttgagcaacaacgagttcagctggacgccgctgtatcagctgtttgcctccaacgtgttcaaggaaaacgtgcaagtcaaagtctcgaccaatatcgtcaatatcggtctggggcaaacctcgacactcgatgagcacggcctgctgagcccggcagtcacgggcggccctgaggtgtccgtgacgttcgtcaacaacttcgcgccgatccatccggggatcaaccagttgtccaccggcatcgatggcaaccaggtcagcacgccgatctacgtggccgtcaatcaggtggtcaccggcaacaccgtactgacccccgtggaaaccatcctcgtgtggttcgaacaggatgtgcagaccagtaccatgttcagttcctcacgctccaaggcgatcgaaatcgacctgacgttcgataacaccgcaggtcgcctttacgaaggcggtcaatggaaaaccgtttga

SEQ ID NO: 1445 - DNA, 741 bp, Pseudomonas sp.
atgagcaaatcaatcgctgtcagccaacaaagccagcagcttcacaatgatgtgcaagaagccgtcaagtcgatcatgggtgctgccactgcgctgaaatccaccgattacggtcgggtcttgaggtccgccctggcggcttcgcaaaaaaccgtaaccattgaaattgccccagacgacctgacccagctgaagaagtccggctacaagctgtgcttcgccaagaaagtcggtactgccgactacaacgtggtctggcagtcctactccgcctacctgagcaataacgaattcagctggacgccgctgtatcagctgttcgccaccaacgtgttccaggaaaacgtacaagtcaaagtctcgaccaatgtcgtcaatatcggtttggggcaaacctcgacactcgatgaacacggcttgctgagcccggcagtcacgggcgggcccgaagtttccgtgacgttcgtgaacaacttcgcgccgatccatccggggatcaatcagttgtccaccggcatcgatggcaatcaggtcagtacacccatctacgtggccgtcaatcgggtggtcaccggcaatactgtactgactcccgtggaaactatcctcgtgtggttcgaacaggatgtgcagaccagtaccatgttcagtacctcacgctcaaaggcgatcgaaatcgacctgaccttcgataacaccgcaggtcgcctttacgaaggcggtcaatggaaaaccgtttga

SEQ ID NO: 1446 - DNA, 738 bp, Pseudomonas sp.
atgagcaaatcaatcgctgtcagccaacagagccagcagcttcacaatgatgtgcaagaagccgtcaagtcgatcatgggtgcaacgcaactgaagacagcggactacaacaaggtgttgaggtccaccctggcggccgtacaaaaagtcgtcaccatagaaatcgcccccggcgacctgtccacgctgaaaaattccggctacaagctgtgctttgccaagaaagtgggcaccgaagactacaacgtagtctggcagtcctacgatgcgtatttgagcaacaacgaattcagctggaccccgcaatatcagctattcgcctccaacgtgttcaaggaaaacgtacaagtcaaagtctcgaccaacatcgtcaacattggcttggggcaaacctcgacactcgataaaaacggcctgctgagcccggcgatcacgggaggtcctgatgtttccttcaccttcgtgaacaactacgcgccgatccacccgggggtcaaccagttgtccaccggcattgatggcaatcaggtcagtacgccaatctacgtggccgtaaaccaggtcgtcaccggcaataccgtgctgacgccggtggaaaccatcctcgtgtggttcgaacagaacgtacagaccagcaccatgttcagtacctcacgctccaaggcgatcgaaatcgacctgacgttcgataacaccgcaggtcgcctttacgaaggcggtcagtggaaaaccgtataa

SEQ ID NO: 1447 - DNA, 741 bp, Pseudomonas sp.
atgagtaaatccactgcggtaagtgcccatcaaaaacagctgcatgatgacgtgcaggcggccgtcaaatcgatcatggccgcaccaacggccttgaaaacctccgactacagcaaggtcctgacctcaaccctggcggccacgcaaaagtcggtgaagatccagatcgcgtccggcgacctgaccacgctgaaacagtccggctacaaactgtgctttgccaagaaagtcggcaccgaagcgtacaacgtggtctggcagtcctatgtcgcctacttgagtaacagcaccttcagctggaccccgcaatatcagctgttcggttccaactcgttccaggccaacgtgcaagtggatgtctcgaccaacatcgtcaacatcggcctgggtcaacagtcagtgcttgatacttccggcctgcttggctcggcgacgaccggcggccctgacacatcgattaccctgatcaataactacggcgcgatccacccaggcatcagccaattgtccaccggcatcgatggcaagcaggtcagcacgccaatctacgtggcgtccaatcagatcgtcaccggctccacggtgttgaccccggtcgaaaccatattggtctggttcgaacagaacgtgcagaccagcaccatgttcagtacctcgcgctctcaatccgtcgaaatagacctgaccttcgacaacagtgccacccgcctctactccggcggcagctggaccgtcgtgtaa

SEQ ID NO: 1448 - DNA, 744 bp, Pseudomonas sp.
atgagtcagtcaagcgcagtcagtaaacaaagccagcaactgcacaaagacgtgcaagaggctttcaagtcgttccagagcgtcgccccaacggccctgaaaaccaccgactacagcaaggtgctgacgtcgaccctggcggccacccaaaagtcggtcaagatccagatcgccgccgctgatctgaccctgctcaaacaatcaggctacaagctgtgctttgccaaaaaggtcggcaatgaagcctacaacgtggtctggcagtcctacgtccagtacctgagcaacagcactttcagctggacgccccagtatcagttgttcggcgccaactctttccaggccaacgtgcaggtagatgtatcgaccaacctcgtcaatatcgggctgggccaacagtcgatactcgacaatgccggcctgctgggttcggcgacaagtggtggccccgacacctccatcaccctggtgaacaactacggtgcgatccaccccggcctcagtcaactgtccacgggcatcgatggcaggcagatcagcacgcccatctacgtggcctcggcacaagtagtcaccggccagaccgtgctaacccccgtcgagaccattctggtgtggttcgaacagaacgtgcagaccagcaccatgttcagcacctcgcgctcgcaatccatcgaaatcgacctgaccttcgataacagtgcgacccgcctctactctggcggcagctggactgtcgtgtaa

SEQ ID NO: 1449 - DNA, 744 bp, Pseudomonas sp.
atgagtcagtcaagcgcagcaagtaaacaaagccagcaactgcacaaagacgtgcaagaggctttcaagtcgttccagagcgtcgccccaacagccctgaaaaccaccgactacagcaaggtgctgacgtcgaccctggcggccacccaaaaatcggtcaagattcagatcgcctccgcagatctgaccctgctcaaacaatcaggctacaaactgtgttttgccaagaaagtcggcaacgaagcctacaacgtggtctggcagtcttacgttcagtacctgagcaacagcacgttcagctggacgccccagtatcagttgttcggcgccaactctttccaggccaacgtgcaggttgatgtgtcgaccaacctcgtcaatatcgggctgggccaacagtcgatactcgacaatgccggcctgctgggttcggcgacgagcggtggccccgacacctccatcaccctggtgaacaactacggtgcgatccaccccggcctcagccaactgtccacgggcatcgatggcaggcagatcagcacgcccatctacgtggcctcggcacaagtagtcaccggccagaccgtgctaacccccgtcgagaccattctggtgtggttcgaacagaacgtgcagaccagcaccatgttcagcacctcacgctcgcaatcggtcgaaatcgacctgaccttcgataacagtgcgacccgcctctactctggcggtctctggaccatcccgtag

SEQ ID NO: 1450 - DNA, 504 bp, Pseudomonas sp.
atgcgctggttgcttgccctgttctgtttgtcgtttgtcacggtgtcccaggcttctgccgtggaaaccctggacggcaaggtcatcgagaaaatcctgattctcaagtcgtcccatcaattgcaattgatcaatgacggcaagccgctcaagacctatcgaatttccctgggcaagcgccccaaggggccgaagctgatggaaggcgacaagcgcaccccggaaggcttctactgggtcgactggcgcaagatcagcgaccgcttcaacctggcgatgcacatttcctacccgaacatcagtgactcggcccgcgcccgtcgtgaaggcgtcgagcccggcggcatgatcatgatccacggcacgccagacagcgaagacactccggaagacctgttccacaccctggactggaccgacggctgcatcgccatgcgcaacatggacatgcgcgaagtctggaacctggtgccggacggcacgatgatcgagattcgtccgtaa

SEQ ID NO: 1451 - DNA, 504 bp, Pseudomonas sp.
atgcgctggttgcttgccctgttctgtttgtcgttcgtcacggtgtcccaggcttctgccgtggaaaccctggacggcaaggtcatcgagaagatcctgattctcaagtcttcccatcaattgcaattgatcaatgacggcaagccgctcaagacctatcgcatttccctgggcaagcgccccaaggggcccaagctgatggaaggcgacaagcgcaccccggaaggtttctactgggtcgactggcgcaaggtcagcgaccgcttcaacctggcgatgcacatttcctatccgaacatcagcgactctgcccgcgcccgtcgtgaaggcgtcgaacccggtggcatgatcatgatccacggcaccccggacagcgaagacacccccgaagacctgttccataccctggactggactgacggctgcatcgccatgcgcaacatggacatgcgcgaagtctggaacctggtgccggacggcacgatgatcgaaatccgcccgtaa

SEQ ID NO: 1452 - DNA, 504 bp, Pseudomonas sp.
atgcgctggttgcttgccctgttctgtttgtcgttcgtcacggtgtcccaggcttctgccgtggaaaccctggacggcaaggtcatcgagaaaatcctgattctcaagtcttcccatcaattgcaattgatcaatgacggcaagccgctcaagacctatcgcatttccctgggcaaacggcccacggggccaaagctgatggaaggcgacaaacgcaccccggaaggcttctactgggttgactggcgcaaggtcagcgaccgcttcaacctggcaatgcacatttcctacccgaacatcagcgactccgcccgcgcccgtcgtgaaggcgtcgagcccgggggcatgatcatgatccacggcactccggacaccgaggacaccccggaagacctgtttcacactctggactggaccgacggctgcatcgccatgcgcaatatggacatgcgcgaagtctggaacctggtgccggacggcacgatgatcgaaatccgcccgtaa

SEQ ID NO: 1453 - DNA, 504 bp, Pseudomonas sp.
atgcgctggttgcttgccctgttctgtttgtcgttcgtcacggtatcccaggcttctgccgtggaaaccctggacggcaaggtcatcgagaaaatcctgattctcaagtcttcccatcaattgcaattgatcaatgacggcaagccgctcaagacctatcgcatttccctgggcaagcgccccaaggggccgaagctgatggaaggcgacaaacgcaccccggaaggcttctactgggtcgactggcgcaagaccagtgataaattcaacctggcaatgcacatttcctacccgaacatcagcgactctgcccgcgcccgtcgtgaaggcgtcgagcccggcggcatgatcatgatccacggcaccccggacaccgtggacaccccggaagacctgttccacaccctggactggaccgacggctgcatcgccatgcgcaacatggacatgcgcgaagtctggaacctggtgccggacggcacgatgatcgagattcgtccgtaa

SEQ ID NO: 1454 - DNA, 504 bp, Pseudomonas sp.
atgcgctggttgcttgccctgttctgtttgtcgttcgtcgcggtgtcccaggcttctgccgtggaaaccctggacggcaagctcatcgagaaaatcctgattctcaagtcttcccatcaattgcaattgatcaatgacggcaagccgctcaagacctatcgcatttccctgggcaagcggcccaaggggccaaagctgatggaaggcgacaaacgcaccccggaaggcttctactgggttgactggcgcaaggtcagcgaccgcttcaacctggcgatgcacatttcctacccgaacatcagcgactctgcccgcgcccgccgtgaaggcgtcgagcccggcagcatgatcatgatccacggcaccccggacaccgaggacaccccggaagacctgttccacaccctggactggactgacggctgcatcgccatgcgcaatatggacatgcgcgaagtctggaacctggtgccggacggcacgatgatcgaaatccgcccgtaa

SEQ ID NO: 1455 - DNA, 504 bp, Pseudomonas sp.
atgcgctggttgcttgccctgttctgtttgtctttcgtcgcggtgtcccaggcttctgccttggaacccctggacggcaaggtcatcgagaaaatcctggttctcaagtcgtcccatcaattgcaattgatcaatgacggcaagccgctcaagacttatcgcatctccctgggcaagcgtcccaaggggccgaaactgatggaaggcgacaagcgcaccccggaaggcctctactgggtcgactggcgcaaggtcagtgataaattcaacctggcgatgcacatttcctacccgaacatcagcgattcggcccgcgcccgtcgtgaaggcgtcgagcccggcggcatgatcatgatccacggcaccccggacaccgaagacaccccggaagacctgttccacaccctggactggaccgacggctgcatcgccatgcgcaacatggacatgcgtgaagtctggaacctggtgccggacggcacgatgatcgagattcgtccgtaa

SEQ ID NO: 1456 - DNA, 504 bp, Pseudomonas sp.
atgcgctggttgcttgctgttttttgcttatcgttcgtcactgtcactcaggcttcctccacggaaacgctggatggcaaagtcatcgaaaaagttctggttctcaaatcagcccatcaattgcaattgatcaatgatggcaagccgatcaagacctatcgcatttccttgggcaaacgccccaaggggccgaagctgatggagggcgacaagcgcacccccgaaggcttttattgggtggactggcgcaagatcagcgaccgtttcaacctggcgatgcacatctcctaccccaatatcagcgacgccgcccgtgcccggcgcgaaggcgtcgagcctggcggcatgatcatgatccacggcaccccggacaccgaagacaaccccgaagacctgttccatacgctggactggaccgatggctgcatcgccatgcgcaacatggacatgcgcgaggtttggggtttggtgccggatggcacgatgattgagattcgcccttaa

SEQ ID NO: 1457 - DNA, 504 bp, Pseudomonas sp.
atgcgctggttgcttgctgttttttgcttatcgttcgtcgctgtcacccaggcttcctccacggaaacgctggatggcaaagtcatcgataaagttctggttctcaaatcagcccatcaattgcaattgatcaatgatggcaagccgatcaagacctatcgcatttccctggggaaacgccccaaggggccgaaactgatggagggcgacaagcgcacccccgaaggcttttattgggtggactggcgcaagatcagcgaacgtttcaacctggcgatgcacatctcctaccctaatatcagcgactccgcccgtgcccggcgcgaaggcgtcgagcctggcggcatgatcatgatccacggcaccccagacaccgaagacaaccccgaagacctgttccatacgctggactggaccgacggctgcatcgccatgcgcaatatggacatgcgcgaggtttggggtttggtgccggacggcacgatgattgagattcgcccgtaa

SEQ ID NO: 1458 - DNA, 504 bp, Pseudomonas sp.
atgcgctggttgcttgccgttttttgcttatcgttcgtcgctgtcacccaggcttcctccacggaaacgctggacggccgagtcatcgaaaaagttctggttctcaaatcagcccatcaattgcaattgatcaatgacggcaagccgatcaagacctatcgcatttccctgggcaaacgccccaaggggccgaagctgatggagggcgacaaacgcacccccgaaggcttttattgggtggactggcgcaagatcagcgaccgtttcaacctgtcgatgcacatctcctaccccaacatcagcgacgccgcccgtgcccggcgcgaaggcgtcgagcctggcggcatgatcatgatccacggcaccccggataccgaagacaaccccgaagacctgttccacaccctggactggaccgacggctgtatcgccatgcgcaacatggacatgcgcgaagtctggggtctggtgccggacggcacgatgatcgagattcgcccgtaa

SEQ ID NO: 1459 - DNA, 504 bp, Pseudomonas sp.
atgcgctggttgcttgccctgttttgcttgtcgttcgtcgctgtctcccaggcttccgttgcggaaacgctggacggcaaagtcatcgaaaaagttctcgtgctcaagtccgcccaccaattgcaattgatcaatgacggcaagccgatcaagacctatcgcatctcattgggaaaacgacccatcggcgcgaaactcatggaaggcgacaaacgcacgcctgaaggtttttactggctggactggcgcaaggtcagcgaccgtttcaatctggcgatgcacatctcctacccgaacatcagtgactccgtgcgctcccggcgtgaaggcgtcgaacccggtggcatgatcatgatccacggcaccccggacactgaagaaaaccccgaagacctgttccacacactggactggaccgacggctgcattgccatgcgcaacatggacatgcgcgaggtttggggtttggtgccggacggcacgatgatcgaaatccgcccgtaa

SEQ ID NO: 1460 - DNA, 504 bp, Pseudomonas sp.
atgcgctggttgcttgccgtgttttgcatgtcgttcgtcgctatttcccaggcctccacggcggaaaccctggatggcaaagtcgtcgaaaaagtcctggtgctcaagtcggcccatcaactgcaattgatcaacgacggcaagccgctcaggacttatcgcatttcattgggaaaaagaccggtcggtccgaaactcatggaaggcgacaaacgcacacctgaaggtttttactgggtggactggcgcaagaccagcgaccgtttcaacctgtcgatgcacatttcctacccgaacatcagcgacgccgcccgcgcccggcgcgaaggcgtcgaacccggcggcatgatcatgatccacggcactccggataccgaagacaaccccgaagccctgttccacaccctggactggaccgacggctgcatcgccatgcgcaacatggacatgcgcgaggtctgggggctggtgccggatggcacgatgatcgagattcgtccgtag

SEQ ID NO: 1461 - DNA, 504 bp, Erwinia sp.
atgcgctggttgctcgctcttttctgctgctcggttatcgctgtctcccacgcttccgcgacggataccctggacggcaaggtcatcgaaaaagtcctggtcctcaagtcggcccatcagttgcaactgatcaacgacggcaaacccttcaagacctaccgcatttccctgggcaaacagcccaagggcccgaaactcatggaaggcgacaagcgcacgccggaaggcttctactggctggactggcgcaagaccagcgaccgcttcaacctggccatgcatatttcctacccgaacatcagcgattccgcgcgttcgcgccgcgagggcgtggagcccggcggcatgatcatgatccatggcaccccggacagcgaagactaccccgagcagtacttccacaccctggactggaccgacggctgcatcgccatgcgcaacgtcgacatgcgcgaagtctggggcctggtcccggacggcacgatgatcgaaatccgcccctga

SEQ ID NO: 1462 - DNA, 504 bp, Pseudomonas sp.
atgcgctggttgctcgcgttcctctgcctgtcgttcgttgctgtcacccaggcttccaccgtggagactctggacggcaaagtcatcgaaaaagtcctggtgctcaaatccgcccatcagttgcaactgatcaacgacggcaagcccatcaagacctaccgcatctccttgggcaagaaccccaaggggcagaagctcatggaaggcgatcgacgcacgcccgaagggttctattggctggactggcgcaaggtcagcgaccgcttcaacctggccatgcatatttcctacccgaacatcagcgatgccgcccgctcgcgccgtgaaggcgtaaaccccggcgggatgatcatgatccacggcaccccggacaccgaggaaaacccagaggacctgttccacaccctggactggaccgacggctgcatcgccatgcgcaacgtcgacatgcgcgaagtctggggcctggtcccggatggcacgatgatcgagatccgcccctga

SEQ ID NO: 1463 - DNA, 504 bp, Pseudomonas sp.
atgcgctggttgtttgcccttctctgcttgtcgctcactgttgcgtcccacgcctctacggtagaaaccctggacggcaagatcatcgaaaaagtgctggtcctcaagtcggcccaccaactgcaactgatcaacgacggcaagccgctcaagacctatcgcatttccctgggcaagcagcccaaggggccaaaactgatggaaggcgataaacgcacgccggaaggcttctactggcttgactggcgcaagaccagcgaccgcttcaacctggccatgcacatctcctacccgaatatcagcgactccgcccgctcacgccgcgaaggcgtgccaccgggcagcatgatcatgatccacggcacgccggacagcgaagattaccccgagcagttcttccataccctggactggaccgacggctgcatcgccatgcgcaacgtcgatatgcgagaagtctggggtctggtcaaggacggcaccatgatcgaaatccgcccctga

SEQ ID NO: 1464 - DNA, 516 bp, Pseudomonas sp.
atgcgctggttgcttgccctgttctgcctgtcgttcgttaccgtctcccaagcgtccttcgtgaccactgtgacgcctgcgaataccccgttcatcgagaaagtcctggtgctcaaatcggctcatcaattgcagctgatcgccgacggcaagccgctcaagacctatcgtatttccttgggcaagggcgctaaaaaaggtccgaagttgatagaaggcgacaaacgcacacctgaaggtttctattggatcgactggcgcaagaccagcgacaaattcaatctgtcgatgcacatctcctacccgaacatcagcgattcggcccgcgcccgtcgcgaaggtgtcgagcccggcgggatgatcatgatccacggcacgccggattcggaagaaaccccggaagacctgttccacaccctcgactggactgacggctgcgtcgccatgcgcaacgttgatatgcgcgaagtgtggaacctggtgccggatggcacgatggtcgaaatccgcccttga

SEQ ID NO: 1465 - DNA, 516 bp, Pseudomonas sp.
atgcgctggttgcttgccctgttctgcctgtcgttcgtcagcgtctcccaagcgtccttcgtgaccaccgtgacgccggcgaataccccgcttatcgagaaagttctggtgctcaaatcggcgcatcaactgcagttgattgccgacggcaagccgctgaagacctatcgcatctccctgggcaagggcgcgaaaaaaggcccgaagctgattgaaggcgacaaacgcacaccggaaggtttctattggatcgactggcgcaagaccagcgacaaattcaacctgtcgatgcacatttcctatccgaacatcagcgactccgcccgcgcccggcgtgaaggcgtcgagcctggcgggatgatcatgatccacggcacgccggattccgaagaaaccccggaagacctgttccacaccctcgactggacggacggctgcgtcgccatgcgcaacgttgacatgcgcgaagtgtggagcctggtgccggatggcacgatggttgaaatccgcccttaa

SEQ ID NO: 1466 - DNA, 504 bp, Pseudomonas sp.
atgcgttggttgcttgctctgatctgcctgtcgttcgccacgctgtccccggcctccacggtgcaaacccttgacggtaaaacggtcgagaaagtcctggtcctcaagtccgcccaccagctgcagctgatcaacgacggcaagccgctcaagacctatcgcatttccctgggcaagaaccccaagggccacaagctgatcgaaggcgaccgccgcacccccgaaggcctctactggatcgactggcgcaagaccagcgaccgcttcaacctggccatgcacatttcctaccccaacatcagcgacgccgcccgcgcccgccgcgaaggcgtgaagccgggcagcatgatcatgatccacggcacccccgacaccgaagactacccggaacagtggtttcacaccctggactggaccgacggctgcatcggcatgcgcaacgtggatatgcgcgaagtgtggaacctggtcaaagacggcaccctcatcgagattcggccgtaa

SEQ ID NO: 1467 - DNA, 504 bp, Pseudomonas sp.
atgcgttggttgcttgctctgctctgcctgtcgttcactaccctttcgccggcttctaccgtggagaccctgggcggcaaaaccgtcgaaaaagtcctggtgctcaagtccgcccaccaattgcaactgatcaacgacggcaagccgatcaagacttaccgcatttccctgggcaaaaaccccaagggccacaagctgatagagggcgaccgccgcaccccggaaggcctgtactggatcgactggcgcaagaccagcgaccgcttcaacctggccatgcacatctcctaccccaatatcagcgacgccgcccgcgcgcgccgcgaaggcgtgaagcccggcagcatgatcatgatccacggcacgcctgacaccgaagactaccccgaacagtggttccacaccctggactggaccgacggctgcatcgccatgcgcaacgtcgatatgcgtgaagtctggaccctggtcaaagacggcaccctgatcgagattcggccgtaa

SEQ ID NO: 1468 - DNA, 516 bp, Pseudomonas sp.
atgcgctggttgcttgccctgttctgcctgtcgttcgctatggtctcgcaagcgtcattcgtgaccaccgtgaagccttcaaacaccccgatgatcgaaaaagtcctggtgctcaaatcggctcatcgactgcagttgattgccgacggcaagccgctcaagacctaccgaatctcgcttggcaagggcgcgaaaaaagggccgaaactgatcgaaggcgacaaacgcacgccagaaggtttctattggatcgactggcgcaagaccagcgagaaattcaacctgtcgatgcacatttcctatccgaacatcaccgattcggcccgcgcccgccgtgaaggcgtcgagcctggcgggatgatcatgattcacggcacgccggacacggaagaaaaccccgaagacctgctgcacaccctggactggaccgacggctgcatcgccatgcgcaacgtcgatatgcgcgaagtgtggagtctggtgccggacggcacgatgatcgaaatccgcccttaa

SEQ ID NO: 1469 - DNA, 504 bp, Pseudomonas sp.
atgcgttggttgcttgctctgttctgtctgtcgttcgccacgctgtcgtcagcctccaccctgcacaccctgcacggtaaaacggtcgagaaagtcctggtcctcaaatccgcccatcaattgcagttgatcaacgacggcaagccgttcaagacctaccgcatttccctgggcaaaaaccccaagggtcaaaagttgatcgaaggcgaccgccgcacacccgaaggcctctactggatcgactggcgcaagaccagcgagcactacaacctggccatgcacatctcctaccccaatatcagcgactcggcccgcgcccgccgcgaaggcgtgaacccgggcagcatgatcatgatccacggcacacccgactccgacgaatacccggagcagtggttccacaccctggactggaccgacggctgcatcggcatgcgcaacgtcgacatgcgcgaagtctggaacctggtcaaagacggcaccctgatcgagattcggccgtaa

SEQ ID NO: 1470 - DNA, 504 bp, Pseudomonas sp.
atgcgttggttgttcgctgtgttctgcctgtcgtttgccacgctgtcccaggccaccgccgccgacccgctgcagggtcgggtcatcgagaaagttctggtgctcaagtccgcccaccaactgcaattgatcaacgacggcaagccgctgaagacctaccggatttcccttggccgcaaccccaggggacccaagttgatcgagggtgaccgccgcacgccggagggtttctactggatcgactggcgcaagaccagcgacaagttcaacctgtcgatgcacatctcctaccccaacatcagcgatgccgcccgtgcccgccgcgaaggcgtcaaccccggcagcatgatcatgatccacggcaccccggactccgaggactacccggaacagtggctgcacaccctggactggaccgacggctgcattggcatgcgcaacgtcgacatgcgtgaagtctggagcctggtcaaggatggcacgctggtagagattcgcccctga

SEQ ID NO: 1471 - DNA, 504 bp, Pseudomonas sp.
atgcgttggttgcttgccgttttctgcctgtcgtttgccgcgctgtcccaggcttccgccgccgacccactgcaaggtcgaatgattgaaaaggtcctggtcctcaagtccgcccaccagttgcaactgatcagcgacggcaagcccctgaagacctaccgcatttccctgggcaggaatcccaaggggcagaaactgatagaaggcgatcgccgtacgccggaaggtttctactggatcgactggcgcaagaccagcgacaaattcaacctgtccatgcacatttcctacccgaatatcagcgatgccgcacgcgcccgtcgcgaaggcgtcaatcccggcagcatgatcatgatccacggcactccggactccgaggactacccggagcagtggctgcataccctggactggaccgacggctgcgtcggcatgcgcaacgtcgacatgcgtgaagtgtggaacctggtcaaggacggcaccctggtggaaatccgcccctga

SEQ ID NO: 1472 - DNA, 504 bp, unknown
  environmental sample
atgcgttggttgcttgccctgctttgcctgtcgttcgccacgctggccccggcctccaccctgcaacccccgggcgccctgcctgtggaaaaagtcctggtgctcaagtccgctcatcaactgcagttgatcaacgacggcaagcccttcaagacctatcgcatctccctgggcaagaaccccaaaggtcacaagctgatcgagggcgaccgccgcacgccggaaggcctgtattggatcgactggcgcaagaccagcgaccgcttcaacctgtccatgcatatctcctacccgaatatcagcgacgccgcacgcgcacgccgcgaaggggtgaagcccggcagcatgatcatgatccacggcactcccgacaccgaggattacccggagcagtggttccacaccctggactggaccgacggctgcatcggcatgcgcaacgtggatatgcgcgaagtctggaacctggtcaaagatggcaccctcatcgagattcgtccgtaa

SEQ ID NO: 1473 - DNA, 501 bp, Pseudomonas sp.
atgcgttggttgcttgccgttttctgcctgtccttcgccgcgctgacccaggcttccgccgacccgctgcaaggtcggatgattgaaaaggtcctggtcctcaagtccgcccaccagttgcaactggtcagcgacggtaagccactgaaaacctaccggatttctctgggcaggaaccccaagggacagaaacaggttgaaggcgatcgccgtacaccggaggggttctactggatcgactggcgtaagaccagcgacaaattcaatctatcgatgcacatttcctatcccaatatcagcgatgccgcacgcgcccgccgcgaaggcctcaaccccggcagcatgatcatgatccacggcacaccggactccgaggactacccggagcagtggctgcatacccttgactggaccgacggttgcgtcggcatgcgcaacgtcgacatgcgcgaagtgtggagcctggtcaaggacggcaccttggtggaaattcgcccctga

SEQ ID NO: 1474 - DNA, 558 bp, Pseudomonas sp.
atgcgctggttgtttgcccttttctgcctcagtgtggcttcggtgtcccaggcagcgtttaccgaaaccatcgtgaccaagcctattgaaaaggtcgcgccctcgcctctccaactaaaacccgcaaccactgcgcagatcgacaagatcctggtgctcaagtccgagcgtcgcctgcaactgatcagtggcggcgccccgctcaagacctatcgcatctccttgggcaagcagcccaaggggcccaagttgcgcgaaggcgacaagcgcacgccagaaggtttctactggatcgactggcgcaaggagagcgaccgctacaacctggcgatgcacgtgtcctacccgaacatcagcgattcggcgcgggcccgacgcgaaggcgtgccacccggtggcatgatcatgatccatggcacgccactcgatgaagagtaccccgaagaggtattccacaccctggactggactgaaggctgcatcgccatgaccaaccgcgacatgcgcgaagtgtggaacatggtgccggacggcacgatgatcgaaattcgcccctga

SEQ ID NO: 1475 - DNA, 522 bp, Pseudomonas sp.
atggaagcccatcacgtgaaatccctccttgcagtgctctccctcatcgccctgccggtcatggccgccgaacccaccctttatgggcgttacgaatacatcgccctgccggaaatcggcgggcaggtcctcaaggcgaaaatggacaccggagccctgaccgcgtcgctgtcggccaaggacatcgaaaccttcaagcgtgacggcgaagactgggtgcgtttccgcctcggcaccaaggacgcgaacaacaaggtctacgagcacaagatcgcgcgcatcagcaagatcaagacccgttccgaagaggaagaggaggatagcgaaatgatcgcacccaccaagcgcccggtggtcgacctggaactgtgcctgggcaacgtcaagcgcacggtcgaggtcaacctgacggaccgcagcagcttcaactatccgttgctgatcggcgccaaggcattgcgcgagttcggggcggcggtgaacccggcgcggcgttttacggccgacaagccggattgctga

SEQ ID NO: 1476 - DNA, 519 bp, Pseudomonas sp.
atggaagcccatcacgtgaaatccctccttgcagtgctctccctcatcgccctgccggtcttggccgccgaacccaccctctatgggcgttacgaatacatcgccctgccggaaatcggcgggcaggtcctcaaggcgaaaatggacaccggcgccctgaccgcgtcgctgtcggccaaggacattgaaaccttcaagcgtgacggcgaggactgggtgcgtttccgcctcgctaccaaggatgcgagcaataaggtctacgagcacaagatcgcgcggatcagcaagatcaagacccgctccgaagaggaagaggatgacgaagcggcagcacccaccaagcggccggtggttgatctggaattgtgcctgggcaacgtcaagcgcacggtcgaggtcaacctgaccgaccgcagcagcttcaactatccattgttgatcggtgccaaggccttgcgtgagtttggggcggcggtgaatcctgctcggcggtttacggcggataagccggattgttga

SEQ ID NO: 1477 - DNA, 507 bp, Pseudomonas sp.
gtgaaatcccttcttgcactgctttcactcatcgccctgccggtcatggccgccgagccgaccctgtacggtcgctacgaatacatcgcgctaccggaaatcggcggcgaagtgctcaaggccaagatggacaccggcgccctgaccgcgtcgctgtcggccaaggacatcgaaaccttcacccgcgacggcgaagactgggtgcgcttccgtctcgccaccaagggcgcgagcaataaggtttacgaacacaaggtcgcgcggatcagcaagatcaagacccgttccgaagaggacgaagatgacagcgaagtgatcgcgcccaccaagcgaccggtggtggatctggagttgtgcctgggcaatgtcaaacgcacggtcgaggttaacctcaccgatcgcagtagcttcaattacccattgttgatcggcgccaaggccttgcgcgagtttggcgcggcggtgaatccggctcgcaggtttacggcggacaagccggattgttga

SEQ ID NO: 1478 - DNA, 534 bp, Pseudomonas sp.
atgctcactctcctggaaacccattacgtgaaatccctccttgcagtgctctccctcatcgccctgccggtcatggccgccgagccgaccctgtacgggcgttatgaatacatcgccctgccggaaatcggcgggcaggtcctcaaggccaaaatggatactggcgccctgaccgcgtcgctgtcggccaaggacatcgaaaccttcaagcgtgacggtgaagactgggtgcgtttccgcctgggcaccaaggatgcgggcaaccaggtctacgaacacaaggtcgcgcgcatcagcaagatcaagacccgcaccgaagaggacgaggaggacagcgaagtcgttgcgccgaccaagcgtccggtggtcgatctggagctgtgcctgggcaacgtcaagcgcacggtcgaggtcaatctgactgaccgcagcagctttaactatccgttgctgatcggtgccaaggcattgcgcgagttcggggcggcggtgaacccggcgcggcggtttaccgcggacaagcccgattgctga

SEQ ID NO: 1479 - DNA, 507 bp, unknown
  environmental sample
atgaaatcagttctcgccctgctttccctgatggcccttccggtgctggccgccgagccgaccctgtacgggcgctacgaatacatcgcgttgccggaaatcggcggcgaagtgctcaaggccaagatggataccggcgccttgaccgcctcgctgtcggccaaggacatcgagaccttcacccgtgacggcgacgattgggtgcgcttccgcctggcgaccaaggatgcgagcaacaaggtctacgaacacaagatcgcccgcatcagcaagatcaagacccgttccgaagaggatgaagaggacgacgaaaagatcgcccccaccaagcgcccggtggtcgatctggaattgtgcctgggcaacgtcaagcgcacggtcgaggtcaacctgaccgaccgcagcagtttcaattacccgctgttgattggtgccaaggcattgcgtgagttcggtgcggcggtgaacccggcgcggcggtttacggcggataagccggactgctga

SEQ ID NO: 1480 - DNA, 507 bp, unknown
  environmental sample
atgaaatcggtcctcgccttgctttccctggtagcccttccagtactggccgccgagccgaccctgtacgggcgctacgaatacatcgcgctgccggaaatcggcggtaaggtacttaaggccaagatggacaccggcgccctgaccgcctcgctgtcggccaaggacattgagacctttacccgtgatggcgatgactgggtgcgcttccgcctggcgaccaaggacgcggacaacaaggtctacgaacacaagatcgcccgcatcagcaagatcaagacccgttccgaagaggatgaagaggacgacgaaaagatcgcccccaccaagcgcccggtggtcgatctggaattgtgcctgggcaacgtcaagcgcacggtcgaggtcaacctgaccgaccgcagcagtttcaattacccgttgttgattggggccaaggcgttgcgtgagtttggcgcggcggtgaacccggcgcggcggtttacggcggataagccggagtgttga

SEQ ID NO: 1481 - DNA, 507 bp, unknown
  environmental sample
atgaaatcggtcctcgccttgctttccctggtagcccttccagtactggccgccgagccgaccctgtacgggcgctacgaatacatcgcgctgccggaaatcggcggtgaagtgctcaaggccaagatggacaccggcgccctgaccgcctcgctgtcggccaaggacatcgagacctttacccgtgatggcgatgattgggtgcggttccgcctggcgaccaaggatgcgagcaacaaggtctacgaacacaagatcgcccgcatcagcaagatcaagacccgttccgaagaggatgaggacgacgacgaaaagatcgcccccaccaagcgcccggtggtcgatctggcgttgtgcctgggcaacgtcaagcgcacggtcgaggtcaacctgaccgaccgcagcagtttcaattacccgttgttgattggggccaaggcgttgcgtgagttcggcgcggcggtgaacccggcgcggcggtttacggcggataagccggagtgttga

SEQ ID NO: 1482 - DNA, 507 bp, Pseudomonas sp.
gtgaaatccctccttgcactgctgaccctcgtggccctgccggtcatggccgccgagccgaccctgtacgggcgctacgaatacatcgcgctgccagaaatcggtggtgaagtcctcaaggcgaaaatggacaccggcgccctgaccgcgtcgctgtcggccaaggacattgaaatgttcacccgtgacggcgacgactgggtgcgtttccgcctcggcaccaaggacgcgagcaacaaggtctacgagcacaaaatctcgcggatcagcaagatcaagacccgctccgaagaggacgaggacgacaaggacgaggccgcccccaccaagcgtccagtcgtcgatctggagctgtgcctgggcaacgtcaagcgcacggtcgaggtcaacctcactgaccgcagcagcttcaactatccgctgctgatcggcgccaaggccttgcgcgaattcggtgcggcggtgaacccggcacgccgctttaccgcggacaaacccgactgctga

SEQ ID NO: 1483 - DNA, 504 bp, Pseudomonas sp.
gtgaaatccctccttgcactgtttgccctcgtcgccctgccggtcatggccgccgaaccgaccctgtacgggcgttatgaatacatcgcgctgccggaaatcggtggcgaggtgctcaaagccaagatggacactggcgcgctgaccgcctcgctgtcggccaaggacattgagaccttcacccgcgacggtgaaaactgggtgcgcttccgcctcggcaccaaggacgccagcaacaaagtgtacgagcacaagatcgcacggatcagcaagatcaagagccgctcggacgaagaggacgaaggcgacagcactgaagtcgccaaacgcccggtggtcgatctggaactgtgcctgggcaacgtcaagcgtaccgttgaggtcaacctgaccgaccgcagcaacttcaactacccgctgctgatcggtgccaaggccttgcgcgagtttggcgccgcagtgaacccggcgcggcgtttcaccgccgacaagccagactgctaa

SEQ ID NO: 1484 - DNA, 507 bp, Pseudomonas sp.
gtgaaatctctccttgcactgcttgccctcgtggccctgccggtcctggcctccgagccgaccctgtacgggcgttatgaatacatcgcgctgccggaaatcggcggtgaagtcctcaaggccaaaatggacaccggcgccctgaccgcgtcgctgtcggccaaagacatcgaaaccttcacccgcgacggcgacgagtgggtgcgctttcgcctcgccaccaaaggcgcgagcaacaaggtctatgaacacaaggtcgcgcgtatcagcaagatcaagaaccgtgccgatgaagaagatgaagacaaggccgtgagcgaagtgaccaagcgcccagtggtcgatctggaactgtgcctgggcaacgtcaagcgcaccgtcgaggtcaacctcaccgaccgcagcagcttcaactatccgctgctgatcggcgccaaagccctgcgcgaattcggcgcagcagtgaacccggcgcgtcgctttacagccgacaaacccgactgctga

SEQ ID NO: 1485 - DNA, 507 bp, Pseudomonas sp.
gtgaaatccctccttgcactgtttgccctcgtcgccctgccggtcatggccgccgagccgaccctgtacgggcgttacgaatacatcgcgctgccggaaatcggtggtgaggtgctcaaggccaagatggacaccggcgcgctgaccgcttcgctgtcggccaaggacattgagaccttcacccgcgatggcgaagactgggtgcgttttcgcctcgctaccaaggatgccgataacaaggtctacgagcacaaggtcgcgcggatcagcaagatcaagagtcgctccgacgaggacgatgaagagcgcgacgtcaccgaagtcgccaagcgtccggtggtcgatctggagctgtgcctgggcaacgtcaagcgcaccgttgaggtcaacctgaccgaccgcagtcacttcaactatccactgctgatcggcgccaaggccctgcgcgagttcggcgcggcagtgaacccggcacggcgtttcaccgccgacaagccggactgctaa

SEQ ID NO: 1486 - DNA, 501 bp, Erwinia sp.
gtgaagtccgtccttgcactcctgtccctgctggcgctgccggtcatggccgccgagccgaccctctacgggcgctacgaatacattcaactgccggaaatcggcgaaaccctcaaggccaagatggacaccggcgccctgaccgcctcgctgtcggccaaggatatcgagacctttacccgcgatggcgaggaatgggtgcgcttccgcctggcgaccaaggacgccgacggcaaggtctacgaacacaaggtggcgcggatcagcaagatcaagagccgcgccgatgaggacgaagacaaggaagaggcccaggtggccaagcgtccggtggtcgacctggaaatgtgcctgggcaacgtcaagcgcaccgtcgaggtcaacctgaccgaccgcagcagcttcaattacccgctgctgatcggcgccaaagccttgcgcgagttcggcgccgcggtgaacccggcccggcgttttaccgcggacaagcccgactgctga

SEQ ID NO: 1487 - DNA, 501 bp, Pseudomonas sp.
gtgaaatccgtccttgcactcctgtccctgctggcgctgccggtcctggccgccgagccgaccctctacgggcgctacgaatacattcaactgccggaaatcggcgaaaccctcaaggccaagatggacaccggcgccctgaccgcctcgctgtcggccaaggacatcgagaccttcacccgcgatggcgaggagtgggtgcgcttccgcctggcgaccaaggatgccgacggcaaggtctacgaacacaaggtggcgcggatcagcaagatcaagagccgcgccgatgaagacgaagacaaggaagaggcccaggtggccaagcggccggtggtcgacctggaaatgtgcctgggcaacgtcaagcgcaccgtcgaggtcaacctgaccgaccgcagcagcttcaattatccgctgctgatcggcgccaaggccctgcgcgagttcggcgccgccgtgaacccggcccggcgttacaccgcggacaagcccgattgctga

SEQ ID NO: 1488 - DNA, 504 bp, Pseudomonas sp.
gtgaaatccatcctcgcattgttagcccttgtggccctgccggtcatggcagccgagccgaccctttatggtcgttacgaatacatcaagctgccggaaatcggtggccaggtcctcaaggccaaaatggacaccggcgcgctgacggcttccctgtcggccaaagacatcgaaaccttcacccgcgatggcgaagactgggtgcgcttccgtctgggtaccaaggatgcaagcagcaaggttttcgaacacaaagtcttgcggatcagcaaaatcaaaagccgcgccgacgaggaagatgaaaaggacacggcggacgtcgccaagcgtccggtcgtcgagctggagctgtgcctgggcagcatcaagcgcacggtcgaggtcaacctgaccgaccgcagcagtttcaattacccgctgctgatcggtgccaaggcattgcgtgagtttggcgcggcggtgaacccggcgcggcggtttgtggcggataaacccgactgctga

SEQ ID NO: 1489 - DNA, 501 bp, Pseudomonas sp.
gtgaaatctctccttgctctgttagccctggctgccctgccggtgatggccgccgagccgaccctgtacgggcgctacgaatacatccagttgccggagatcggcgaaaccttcaaggccaagatggacaccggcgcgctgacggcttcgctgtcggcccgtgacatcgagaccttcacccgcgatggtgaggattgggtgcgcttccgtctcagtggcaaggatgtgagcaacaaggtctacgaacacaaagtggcgcgcatcagcaagatcaagaaccgtgctgacgaagatgaagacggcgaagaaaccagcgtcgccaagcgcccggtggtggacctggaaatgtgcctgggcaacgtcaagcgcaccgtcgaggtcaacctgaccgatcgcagcagcttcaactacccgctgctgatcggtgccaaggccctgcgtgaattcggcgccgccgtgaacccggcccgccgctataccgccgacaaacccgactgctga

SEQ ID NO: 1490 - DNA, 504 bp, unknown
  environmental sample
gtgaaatcaatcctggcgctattgtccctgctggcgttgcctgtcatggctgccgagccgacgctttatggtcgctacgaatacatcaaggtctcggaattcggcgaaaccttcaaagccaagatggacaccggcgcgctgaccgcatcgctgtcggccaaggatattgaactgttcaagcgcgatggcgatgactgggtgcgtttccgcctggccaccaaagacgccagcaacaaggtttacgagcacaaggtgtcgcgtatcagcaagatcaagagccgttcggaaaacgatgatgacgaagatgaagccatcgaccccaccaaacgcccggtggtggacctggagctttgcctgggtaatgtgaaacgcaccgtggaagtcaatctggtggaccgcagccacttcaactacccactgctgatcggtgccaaggcgttgcgcgagtttgatgcggcggtgaatcctgcgcgccgatataccgctgataagccggattgctga

SEQ ID NO: 1491 - DNA, 504 bp, unknown
  environmental sample
gtgaaatccgttctcgcattgctgtccgtattggcgctgccggtcatggccgccgaacccacgctgtatggtcgctttgaatacatcaaactgccggaaatcggtggtcaggtcttcaaggccaagatggacaccggcgcactgactgcctcgctgtcggccaaggacatccagaccttcacccgcgacggcgacgattgggtacgttttcgcctggccaccaaggacgccgacaacaaggtgtacgagcacaagatctcgcgtatcagcaagatcaagaaccgcgccgaggaagacgacgacggcgagggcgccgaagtctcgcagcgccccgtggtggacctggaactgtgcctgggcgacgtcaagcgcaccatcgaggtcaacctggtcgaccgcagcaagttcaactaccccctgttgatcggcgccaaaggcctgcgcgagttcaaggccgcggtcaaccccgcccgccgtttcgtcgccgacaagccggactgctga

SEQ ID NO: 1492 - DNA, 612 bp, Pseudomonas sp.
gtgggagcgagcctgctcgcgaaagatctgaagaacgaacgaattccctactggcggtctaaaattccgcgttcgacgccccaattgcccaaggaagcccattacgtgaaatccctccttgcactgctttccctcgtggccctgccggtcctggctgctgagccgaccctgtacgggcgctacgaatacatcgcgctgccggaaatcggtggcgaagtcctcaaggccaagatggacaccggcgccctgaccgcgtcgctgtcggccaaagacatcgaaaccttcacccgtgatggcgacgagtgggtgcgtttccgcctcgctaccaaaggcgcgagcaacaaggtctacgagcacaaggttgcgcggatcagcaagatcaagactcgctccgaagaagacgaggacgacaaagaagcggtcgaacccaccaagcgtccggtggttgatctggaactgtgcctgggcaacgtcaagcgcaccgtggaggtcaacctcaccgaccgcagcagcttcaactaccctttgttgatcggtgccaaagccttgcgtgagttcggcgcggcggtgaacccggcacggcgctttaccgcggacaaacccgactgctga

SEQ ID NO: 1493 - DNA, 501 bp, Pseudomonas sp.
gtgaaatccatgcttgccctgttgtcgctgctggcgctgccggtcatggccgccgagccgacgatctatggtcgttacgagaacattgccttgcctgagcttggcgaaacgctgaaggccaagatggataccggtgcctataccgcatcgctgtcagccaaggatatcgagctgttcaatcgcgatggcgaggaatgggtgcggttccgcctggcgaccaaggagtcggacggcaaggtctatgagcacaaggtctcgcgcatcagcaagatcaagggccgcgccgaggaagaggacgaaggcgatgcaccggagctctccaagcggccagtggttgacctggagctgtgcctgggtgacgtgaagcgcaccgtcgaggtgaacctggtggaccgcagccacttcaactatccgctgctggtgggtgccaaggcgctgcgcgagttcaaggcggcagtgaacccggccaagcgctttaccgcagacaagcctgactgctga

SEQ ID NO: 1494 - DNA, 501 bp, unknown
  environmental sample
gtgaaactgctattcgcctcgctcgccctggttgccttgcccgtcatggccgccgaaccgaccctttacggtcgctacgaatacatccagttgccggagatcggcgaaaccttcaaggccaagatggacaccggcgcattgacggcttcgctgtcggcccgcgacatcgaaaccttcacccgtgacggcgacgactgggtgcgtttccgccttggcggcaaggacgctaccgacaaagtctacgaacacaaggtctcgcgtatcagcaagatcaagagtcgctccgacgaggacgacgacaaggacgaagccagcgtggccaagcgcccggtcatcgacctggaaatgtgcctgggcaaggtcaagcgcaccgtcgaggtcaacctcaccgaccgcagcagcttcaactacccgttgctgatcggcgccaaggccctgcgtgaattcgacgctgcggtaaacccggcccgtcgctacactgccgacaaaccggactgctga

SEQ ID NO: 1495 - DNA, 501 bp, unknown
  environmental sample
gtgaaaccgatcctggcgcttctgtccctgttggcgctgcccgtcatggcagccgaacccacgctgtatggccgctacgaaaacatcagcgttcccgaaataggcaagaccttcaaggccaagatggacaccggtgcgttgactgcttcgctgtccgccaaggacgtcgagctgttcaagcgcgatggtgacgattgggtgcgtttccgcctcgccacggatggggccggcaacaaggtctatgaacacaaggtgtcgaggatcagcaagatcaaaagccgggcagacggcgatgacgaagacgaagaccttgatccggtcaagcgtccggtgatcgatctggagctgtgcctgggcgacaagaagcgcacggtcgaggtcaatctggttgaccgtagccatttcaactacccgctgttgatcggtgccaaggccttgcgcgagtttgatgcggcggtcaacccggccaggcgctacaccgcagataaacccgattgctga

SEQ ID NO: 1496 - DNA, 501 bp, unknown
  environmental sample
gtgaaatcattgtttgccatgctgaccctgttgacgctgccggtgatggccgccgaacctacgctgtacgggcgctacgagaatatcgcgctgccggagattggccagacgctcaaggccaagatggatacgggcgcctatacggcgtcactgtcggccaaggacatcgagctgtttacccgcgatgggcaggagtgggtacgtttccgtttggcgaccaaggatgacgacggcaaggtttacgagcaccaggtctcgcgcatcagcaagatcaagggccgtgccgatgacgaggatgagggcgacacacccgagagcgccaagcggccggtggtagacctggagctgtgcctgggagacgtgaagcgaaccgtggaggtcaacctggtggatcgcagcaacttcaattacccactgctggtgggggccaaagcgttgcgcgagttcaaaggcgcggtgaaccctgccaaacgatttaccgctggcaagcctgactgctga

SEQ ID NO: 1497 - DNA, 504 bp, Pseudomonas sp.
ttgaaaccactgattgccctgctcggcctgctgtccctgccggtgatggccgccgagcccgacctctatggccgctacgaatacatcggcgttgccgatatcggccagaccttcaaggccaagatggacaccggtgcgctgaccgcctcgctgtcggccaggaacatcgagcagttcacccgtgacggcgaggactgggtgcgtttccgcctggccaccaaggacgccaacgacaaggtctacgaacacaagctcgcgcgcatgagcaagatcaagaaccgcgccgacgaagaggacgaggaaggtgccgatatcgcccaccgcccggtgatcgacctggaactgtgcctgggcgacgtcaagcgtacggtcgaggtcaacctcaccgaccgcagcagcttcaactacccgctgctcatcggcgccaaggccctgcgcgagttcaacgccgcggtcaacccggcccgtcgctacaccgccggcaagccggactgcggcaagtaa

SEQ ID NO: 1498 - DNA, 504 bp, unknown
  environmental sample
gtgaagactgttctggcgctgttgtccctgctggcgttgcctgccatggccgccgatccgaccctctacggtcgttacgagaacatcaaggttcctgaagtgggcgagacgttcaaggccaagatggacacgggtgcggtgaccgcttcgttgtcggccaaggacatcgagctgttcaagcgcgacggcgagcaatgggtacgtttccgcctggccagcgaaggcgccagcaacaaggtgttcgagcacaagctggcgcgcatcagcaaaatcaagggccgtgccgacgaagacgatgaggacgagggtggcgtcgaggccgccaggcgcccggtgatcgagctgcaactgtgcctgggcaaggagcagcgcacggtagaggtgaacctggtggaccgcagccacttcaactacccgttgctgatcggcgccaaggcgctgcgtgagttcaatgcagcggttaacccggcacgtcgttataccgccgacaagcccgattgctga

SEQ ID NO: 1499 - DNA, 501 bp, unknown
  environmental sample
gtgaaatccatgcttgccttgctgtgcaccttgtctctgcccgtcatggcggcggaccccatgctctatgggcgctacgaacacgtcggcctgccggaactcggcgaaaccctcaaggccaagatggacaccggtgcctggaccgcctcgctgtcggccaaggacatcgagcgcttcagccgcaacggcgacgactgggtacgcttccgcctggcgaccccggacgccgacggcaaggtctacgagcacaagctggcgcgcatcagcaagatcaagagccgcgccgacgaggacgatgaaggcgaggcggccggcttcgccaagcggccggtgatcgacctggacctgtgcctgggcaacgtcaagcgcaccgtcgaggtgaacctcaccgaccgcagcagcttcgactacccattgctgatcggcgccaaggccctgcgcgagttcaaggcggccatcgatccggcgcagcgctatactgcggacaagccggactgctga

SEQ ID NO: 1500 - DNA, 1425 bp, Pseudomonas sp.
atgtcgataccacgcttgaagtcctacctttccattattgccaccgtgctggtgctcggtcaggcggtcaccgcccaagcggtcgaactgcctgactttacgcaactggtcgaacaggcttcgcctgcggtcgtgaacatcagtaccacgcaaaagctgccggatcgcaaagtcagccagcaaatgcccgacctcgaaggtttgccgccgatgctgcgcgaattcttcgaacggggcatgccgccacaatcccgttcacctcgcgaccgtcagcgtgaggcaacctctctgggttcgggtttcatcatctcttccgatggctatatcctgaccaacaaccacgtgatcgccgatgctgacgaaatcctcgttcgcctggctgatcgcagcgaaatgaaagccaagctggtcggtactgatccacgttccgatgtggcgctgctgaaaatcgaaggcaaggatctgccagtgctgaagctcggtaaatcccaggacctgaaggccggccaatgggttgtcgcgatcggttcgccgttcggctttgaccacacggtgacccaaggcatcgtcagtgccgtcggtcgcagcctgccgaacgaaaactatgtgccgttcatccagaccgacgtgccgatcaacccgggtaactcgggcggcccgctgttcaacctgaacggtgaggtggtcgggatcaactcgcagatctatacccgctccggtggcttcatgggtgtgtcgtttgctatcccgatcgacgtggccatggatgtttccaatcagctgaaatccggtggcaaggtcagccgtggctggctgggtgtcgtgattcaggaagtgagcaaggacctggccgagtcgttcggtctggaaaaaccggcgggtgcgctggttgctcagatccaggatgatggcccggctgccaagggtggcctgcaagtgggcgacgtgatcctgagcatgaacggtcagccaatcgttatgtcggccgacctgccgcaccttgttggcgcattgaaggctggtgcaaaagccaatctggaagtgattcgtgacggtaagcgcaagaatgtcgagctgaccgttggtgccattccggaagaaggtaaggagctgggcgccgagccgaaatccagcatcgagcgcagcagcaatcgcctcggtgtctccgtggtcgagctgacggacgaacagaagaaaaccttcgatctcaaaggtggtgtggtgatcaaggaagtccaggacggtcctgccgccatgatcggcttgcagccgggtgatgtgatcacccacctgaacaaccaggccattggttccaccaaggagttcgcggacatcgccaaggcgctgccaaagaaccgctcggtatcgatgcgggtactgcgtcaggggcgtgcgagctttatcaccttcaaactggctgaataa

SEQ ID NO: 1501 - DNA, 1425 bp, Pseudomonas sp.
atgtcgataccacgcttgaagtcttacctttccattattgccactgtcctggtgctcggtcaggcggtcaccgcccaagcggtcgagttgcccgactttacgcaattggtcgagcaggcgtcgcctgcagtcgtgaacatcagtaccacgcaaaagctgccggatcgcaaagtcagcgagcagatgcctgatctcgaaggtttgccgccgatgctgcgcgaattcttcgagcggggcatgccgccacaatcgcgttcacctcgtgaccgtcagcgcgaggcaacctccctgggctcgggattcatcatctcttccgatggctacatcctgaccaacaaccacgtgatcgccgatgctgacgaaatcctcgtccgcctggctgatcgtagcgaaatgaaagccaagctggtcggtaccgatccacgctccgacgtggcgctgctgaaaatcgaaggcaaggatctaccggtgttgaaactcggtaaatcccaggacctgaaggccggccaatgggttgtcgcgatcggttcgccgttcggctttgaccacactgtgacccaaggcatcgtcagtgccgtcggtcgcagcctgccgaacgaaaactatgtgccgttcatccagaccgacgtgccgatcaacccgggtaactcgggtggtccgctgttcaacctgaacggtgaggtggtcgggatcaactcgcagatttatacccgctccggtggcttcatgggtgtgtcgtttgcgatcccgatcgatgtggccatggatgtttccaatcagctgaaatccggtggcaaagtcagccgtggctggctgggtgtcgtgattcaggaagtgagcaaggacctggccgagtcgttcggtctggagaagccggcgggtgcgctggttgcccaaatccaggatgatggcccggctgccaagggtggcctgcaagtgggcgacgtgatcctgagcatgaacggtcagccaatcgttatgtcggccgacttgccgcatctcgttggcgcgttgaaggcgggtgcaaaagccaatctggaagtcattcgtgacggcaagcgcaagaatgtcgagctgaccgttggtgccattccggaagaaggtaaagagctgggcgccgagccgaaatccagcatcgagcgcagcagcaatcgcctcggtgtttccgtggtcgagctgactgacgaccagaagaaaacctacgacctcaaaggtggtgtggtgatcaaggaagtgcaggacggccctgccgccatgatcggcttgcagccgggtgatgtgatcacccacctgaacaaccaggcgatcggttccaccaaggagttcgcggacatcgccaaggcgctgccgaagaaccgctcggtgtcgatgcgggttctgcgtcaggggcgtgcgagcttcatcaccttcaaactggctgaataa

SEQ ID NO: 1502 - DNA, 1425 bp, Pseudomonas sp.
atgtcgataccacgcttgaagtcctacctttccattattgccaccgtgctggtgctcggtcaggcggtcaccgcccaagcggtcgaattgcctgactttacgcaactggtcgaacaagcctcgcccgcggtcgtgaacatcagtaccacgcaaaagctgccggatcgcaaagtcagccagcaaatgcccgacctcgaaggcctgccgccaatgctgcgcgaattcttcgagcggggcatgccgccgcaatcgcgttctcctcgtgaccgtcagcgcgaggcaacttccctgggctcgggttttatcatctcgtctgatggctacatcctgaccaataaccacgtgatcgccgatgcagacgaaatcctcgtccgtctggccgatcgcagcgaaatgaaggccaagctggtcggtaccgatccacgttccgacgtggcgctgctgaaaatcgaaggcaaggatctgccggtgctcaagctcggtaaatcccaggacctgaaggcaggccagtgggtggttgctatcggttcgccgttcggctttgaccatacggtgacccaaggcatcgtcagcgccgtcggtcgcagtctgccgaatgaaaactatgtgccgttcattcagaccgacgtgccgatcaacccgggtaactcgggcggcccgctgttcaacctcgacggtgaagtggtcgggatcaactcgcagatctatacccgctccggtggcttcatgggcgtgtcgtttgcaatcccgatcgacgtggccatggacgtttccaatcagctgaagtccggtggcaaggtcagccgtggctggctgggcgtggtgattcaggaagtgagcaaggatctcgccgagtcgtttggccttgagaagccggcgggtgcgctggtggcccagatccaggatgatggcccggctgccaagggtggcctgcaagtgggcgacgtgatcctgagcatgaacggtcagccaatcgtcatgtcggctgacctgccgcacctcgttggcgcattgaaggctggcgccaaggccgatctggaagtgattcgtgacggcaagcgcaaaaatgtcgagctgaccgtcggtgccattccggatgaagacaaggaaatgggcgccgagccaaaatccagcatcgagcgcagcagcaatcgcctcggtgtttccgtggtcgaactgactgacgaccagaagaaaacctacgacctcaaaggtggtgtggtgatcaaggaagtgcaggacggtcctgccgccatgatcggcctgcagccgggtgatgtgatcacccacctgaacaaccaggccatcggttccgccaaggagttcgcggacatcgccaaggcgctgccaaagaaccgttcggtgtcgatgcgggtactgcgtcaaggtcgtgcgagcttcatcaccttcaagctggctgaataa

SEQ ID NO: 1503 - DNA, 1425 bp, Pseudomonas sp.
atgtcgataccacgcttgaagtcctacctttccattattgccaccgtgctggtgctcggtcaggcggtcaccgcccaagcggtcgaattgcctgactttacgcaactggtcgaacaggcctcgcccgcggtcgtgaacatcagtaccacgcaaaagctgccggatcgcaaagtcagccagcaaatgcccgacctcgaaggcctgccgccaatgctgcgcgaattcttcgagcggggcatgccgccgcaatcgcgttctcctcgcgaccgtcaacgcgaggcaacttccctgggttcgggttttatcatctcctctgacggctacatcctgaccaataaccatgtgatcgccgacgcggacgaaatcctcgtccgtctggccgatcgcagcgaaatgaaggccaagctcgtcggcaccgatccgcgttccgacgtggcgctgctgaaaatcgaaggcaaggatctgccggtgctcaagctcggtaaatcccaggacctgaaggccggccagtgggtggttgctatcggttcgccgttcggctttgaccacacggtgacccaaggcatcgtcagcgccgtcggtcgcagtctgccgaatgaaaactatgtgccgtttattcagaccgacgtgccgatcaacccgggtaactcgggcggcccgctgttcaacctgaacggtgaagtggtcgggatcaactcgcagatctatacccgctccggtggcttcatgggcgtgtcgtttgcaatcccgatcgacgtggccatggatgtttccaatcaactgaaatccggtggcaaggtcagccgtggctggctgggcgtggtgattcaggaagtgagcaaggacctcgccgagtcgttcggcctggagaaaccggcgggtgcgctggtggctcagatccaggatgatggcccggctgccaaaggtggcctgcaagtcggcgacgtgatcctgagcatgaacggtcagccaatcgtcatgtcggccgacctgccgcacctcgttggcgcattgaaggctggcgccaaggccgatctggaagtgattcgtgacggcaagcgtaaaaatgtagagctgatcgtcggtgccattccggatgacgacaaggacatgggcgccgagccaaaatccagcatcgagcgcagcagcaatcgcctcggtgtttccgtggtcgaactgactgacgaccagaagaaaacctacgacctcaaaggtggtgtggtgatcaaggaagtgcaggacggtcctgccgccatgatcggtctgcagccgggtgatgtgatcacccacctgaacaaccaggccatcggttccgccaaggagttcgcggacatcgccaaggcgctgccaaagaaccgttcggtgtcgatgcgggtactgcgtcaaggtcgtgcgagcttcatcaccttcaaactggctgaataa

SEQ ID NO: 1504 - DNA, 1428 bp, Pseudomonas sp.
atgtcgataccacgcttgaagtcttacctatccatttttgccactgtactggtgctcggtcaggcggtcgctgctcaagcagtcgagttgcctgattttacgcaactggtcgaacaggcctcgcctgctgtggtgaacatcagtaccacgcagaagctgccggatcgcaaagtgagcgagcagatgcctgacctcgaaggcttgccgccgatgttgcgagaattcttcgagcgtggcatgccaccacagtcgcgttcacctcgcggtgatcgccagcgcgaagcccagtcgttgggttcggggtttatcatctcgtctgacggctacatacttaccaacaatcatgtgatcgccgatgccgacgaaattctcgttcgtctggctgaccgcagtgagctgaaagccaagctggtcggcaccgatccacgttccgacgtggccttgctgaaaatcgaaggcaaggatctgccggttctcaaacttggcaaatcccaagacctgaaggccggccagtgggtggtcgcaatcggctcgccattcggtttcgaccataccgtgactcagggcatcgtcagcgctgtcggtcgcagtctgccgaacgaaaattatgtgccgttcatccagaccgacgtgccgatcaacccgggcaactccggtggaccgctgttcaacctggcgggcgaagtcgtcgggatcaactcacagatctacacccgttccggcggcttcatgggcgtgtcgttcgcgattcctatcgacgtagccatggacgtatccaatcagctgaaaagcggcggcaaagtcagccgtggctggttgggcgttgtcattcaggaagtgaacaaggatctggccgagtcgttcggtcttgaaaaaccggccggtgcgctggtggctcagatccaggacgatggcccggcagccaagggtggtctgcaagtgggcgacgtgatcctgagcatgaacgatcaaccgatcgtcatgtcagcagatctgccgcacctggtgggcgcactgaaagctggctcgaaagccaacctggaagtgatccgtgaaggcaagcgcaagaatgtcgagctgacggtcggcgctatcccggaagaaggcaaagagctggacgcattgccgaaatccagtattgagcgcagcagcaatcgcctgggtgtttccgtggccgagctgaccgacgagcagaagaaaacctacgacctcaaaggtggtgtggtgatcaaggaagtccaggacggtcctgcttccatgattggcttgcagccgggcgacgttatcactcacctgaacaatcaggcgattggttccaccaaggagttcactgatatcgccaaggcgctgccgaagaaccgctcggtgtcgatgcgggttctgcgtcaaaatcgcgccagcttcatcaccttcaaactggctgaataa

SEQ ID NO: 1505 - DNA, 1431 bp, Pseudomonas sp.
atgtcgataccacgcttgaagtcttatctctccatttttgccaccgtgctggtgctcggtcaggcggtcgctgcgcaagcggtcgagttgcctgacttcacgcagttggtcgagcaagcctcgcccgcggtggttaacatcagcaccacccaaaagttgccggaccgccgggtgtccagcgagcaaatgcctgaccttgaaggattgccgccaatgctgcgtgagttctttgagcggggcatgccgcagcaaccacgttcccctcgcggcgatcgtcagcgtgaggctcaatccctgggctcgggtttcatcatttcgcctgacggctacatcctgaccaacaaccatgtgattgccgatgccgacgagattcttgtgcgcctcgccgatcgcagtgagttgaaagccaagctaatcggtaccgatccgcgctctgacgtcgctttgctcaaaatcgaaggcaaagacctgccggtgctcaagcttggcaagtcgcaggacctgaaagccggtcagtgggtcgtggcgatcggttcgccgttcggctttgatcacacggtgacccaaggtattgtcagcgccatcggccgtagcctgccgaacgaaaactatgtgccgttcatccagaccgacgtgccgatcaacccgggcaactccggaggtccgctgttcaacctggccggtgaagtggtcggcatcaactcgcagatctacacccgctccggcggcttcatgggcgtatcgttcgcgatccctatcgatgtggcgatggacgtttccaatcagctgaaaagcggcggtaaagtcagtcgtggctggttgggtgtagtgatccaggaagtgaacaaggatctggctgaatcgttcggtctcgagaaacccgccggagcactggtggctcagatccaggatgatggtccggctgccaagggcggcctgcaagtgggcgacgtgatcctcagcatggacggtcaaccgatcgtcatgtccgccgatctgccgcacctggtgggcgcgctgaaggctggctcgaaagccgatcttgaagtgatccgcgaaggcaagcgcaagaacgtcgagctcaccgtcggcgctattcccgaagaaggcaaagaattggaagccctgcctaaatccagtgtcgagcgcagcagcaatcgcctgggtgtttccgtggccgagctgaccgaggaacagaagaaaaccctcgacctcaagggtggtgtggttatcaaggaagttcaggacggtcctgctgccctgatcggcttgcagccgggcgatgtgatcactcacctgaataaccaggcgatcggctcctccaaggagttcacggacattgccaaggcgctgccgaagaaccgctcggtgtcgatgcgggttctgcgccaggggcgcgccagcttcatcaccttcaaactggctgagtga

SEQ ID NO: 1506 - DNA, 1431 bp, Pseudomonas sp.
atgtcgatacttagcttgaagtcttatctttccatttttgccaccgtgctggtgctcggtcaggcagttcctgctgcgcaggcggccgatctgcctgacttcacccaactggtcgaacaagcttcgccagccgtggtgaacatcagtaccacgcagaaactgccggatcgcaaggtcaaccagcagatgcccgatctggaaggcctgccaccgatgctgcgcgagttcttcgaacgtggcatgccgccgcaacagcgctccccgcgtgatggtcgccagcgtgaagcgcaatcgctgggttcgggcttcatcatttcgccggacggctacatcctcaccaataaccatgtgatcgccgatgccgacgagatcctcgtgcgtctggctgaccgcagcgagatgaaagccaagctgatcggcactgacccacgctccgacgtggcgctgctgaaaatcgaaggcaaggatctgccggttctcaagctcggcaaatcccaggatctgaaggccggtcaatgggtggtcgccatcggttctccattcggctttgaccacaccgtcacccaaggtatcgtcagcgccgttggccgcagcctgccaaacgaaaactatgtgccgttcatccagaccgacgtgccgatcaacccgggcaactccggtggcccgctgttcaacctcaacggcgaagtggtcggcatcaactcgcagatctatacccgttccggcggcttcatgggcgtgtcgttcgccattccgatcgatgtcgcgatggacgtttccaatcagctcaagagcggtggcaaggtcagccgtggctggctgggtgtggtcatccaggaagtgaacaaggatctggcggaatcgttcggtctggataaacctgccggtgcgctggttgcgcagattcaggatgacggtccggcagccaagggcggcctgcaggtcggcgacgtaattctgagcatgaacggccagccgatcgtcatgtccgcagacctgccgcatctggtcggcgcgctgaaggctggcgccaaagccaatctggaggtgatccgcgagggcaagcgcaagaatgtcgagctgacggtcggcgcaattccggacgaggataaggaattggacacgctggcgaagtccggcgctgaaagcagcagcaaccgcctcggtgttgcagtcggcgagctgaccgctgagcagaagaaagcctacgaccttaaaggtggtgtggtgatcaaggaggtgcaggatggtcctgccgccctgatcggcctgcagccaggcgacgtgatcacccacctgaacaaccaggccatcggttcggccaaggagttcacggatatcgccaaggcgctgccgaagaaccgctcggtgtcgatgcgcgttctgcgccagggtcgcgccagcttcatcaccttcaaactggccgaataa

SEQ ID NO: 1507 - DNA, 1431 bp, Pseudomonas sp.
atgtcgataccacgcttgaagtcctacttcaccattcttgccaccgtgctggtgcttgggcaggccgtttctgctcaggcggccgagctgcctgatttcacccaactggtcgagcaggcctcgcctgcggtggtgaacatcagtaccacgcagaaactgccggaccgccgggtttccaattcggctcagatgcccgatctcgaaggcctgccgccaatgctgcgcgagttcttcgaacggggcatgccccagccacgctctccgcgcggggatcgtcagcgcgaagcgcagtcgctgggttccgggttcatcatctccgcggacggttacatcctcaccaacaaccacgtgatcgccgatgcggacgaaattcttgtgcgtctggccgatcgcagtgagctgaaagccaagctgatcggtaccgacccacgctccgatgtagcactgctgaaaatcgatggaaaagacctgccggtgctgaaactgggtaaatcccaggacctcaaggccggccagtgggtggtggccatcggctcgccgttcggcttcgaccataccgtgactcagggtatcgtcagtgccatcggtcgcagcctgccgaacgaaaactacgtgccgttcatccagaccgacgtgccgatcaacccgggcaactccggtggcccgctgttcaacctggccggtgaagtggtggggatcaactcgcagatctacacccgctccggtggtttcatgggcgtgtctttcgccatcccgatcgatgtggcgatggacgtttccaaccagctgaaaaccggtggcaaagtcagccgtggctggcttggcgtggtaatccaggaggtcaacaaggacctggctgaatccttcggcctggagaaaccggccggcgcgctggtggcacagatccaggatgatggcccggcggccaagggcggcctgcaagtgggtgacgtgatcctcagcctcaatggccagcccatcgtcatgtcggccgacctgccgcacctggtaggcgcgctgaaggccggggccaaggccaacctggaagtgatccgcgacggcaagcgcaagaatgtcgagctgaccgtcggcgctattcctgaagaagacaaagacctgagcatgctgcccaagtcgggtgtcgagcgcagcagcaaccgtctgggtgtagcggtggtcgagctcaacgatgagcagaagaaagccttcgacctcaagggcggggtagtcatcaaggaagtccaggacggtcctgcggcgctgatcggcttgcagccgggcgacgtgatcactcacctgaacaatcaggcgatcacttcggcgaaggagttcactgaaatcgccaaggcattgccgaagaaccgctcggtgtccatgcgggtactgcgtcaggggcgagccagcttcatcaccttcaagctggccgagtaa

SEQ ID NO: 1508 - DNA, 1437 bp, unknown
  environmental sample
atgtcgataccacgcttgaagtcctatctatccataatcgccacggtattggtgctgggccaggctttgcctgcgcaagcagtcgagttgcctgacttcacccaattggtcgagcaggcctcgccagctgtggtgaacatcagcaccacgcaaaaactgccggatcgcaaagtctccaatcagccaatgccggaccttgaaggcctgccgccaatgctgcgcgagttcttcgagcgcggcatgccccaaccgcgcacgccccgtggcggtggtggtcagcgtgaagcgcagtccctgggttccggcttcatcatttcgccggacggctacatcctcaccaacaaccacgtgattgccgacgccgacgagatcctggtgcgcctggccgatcgcagtgaactcaaagccaaactggtcggcaccgatccacgttccgatgtggccttgctgaaaattgaaggcaaggacctgccggtgctgaaactgggtaaatcccaggacctgaaagccgggcaatgggtggtcgccatcggttcgccgtttggcttcgaccataccgtgacccaaggtatcgtcagcgccatcggccgcagcctgccgaacgaaaactatgtcccgttcatccagaccgacgtgccgatcaacccgggtaactccggtggcccactatttaacctggcgggcgaagtggttgggatcaactcgcagatctacacccgttccggtggtttcatgggggtgtctttcgccatcccgattgacgtcgccatggacgtttccaaccagctcaaaagcggtggcaaggtcagtcgcggctggttgggcgtggtgatccaggaagtgaacaaggatctggctgaatccttcggtctcgataagccggccggtgccctggtcgcgcagatccaggacgacggcccggcagccaaaggtggcctgcaggtcggcgacgtgatcctgagcatgaacggccagccgatcgtcatgtcagccgacctgccgcatctggtgggcgcgctcaaggctggcagcaaggccaagctggaagtgatccgcgatggcaagcgtcagaacgttgagctgaccgttggcgccatccctgaagagggcgcaaccctggatgccctgggcaacgccaagccgggtgccgagcgcagcagcaatcgcctgggcattgccgtggccgagctgacccctgagcagaagaagaccttcgacctcaagagcggcgtcgtgatcaaggaagtgcaggacggtcctgcttcgctgatcggcctgcagcccggtgatgtgatcactcacctgaacaatcaggcaatcgacagcaccaagcagttcaccgacatcgccaaggcgttgccgaagaatcgttcggtgtcgatgcgcgtattgcgtcagggacgtgcaagcttcattacgttcaagctggccgagtaa

SEQ ID NO: 1509 - DNA, 1440 bp, Pseudomonas sp.
atgtcgataccacgtttgaagtcttacctatccatagtcgccacggtgttggtgctgggccaggccttacctgcgcaagcagcggagctgcctgacttcacccaattggttgagcaggcctcgcctgccgtggtgaacatcagtaccacgcaaaaactgccggatcgcaaagtctccaaccagcagatgccagacctggaaggcctgccgccgatgctgcgtgagttcttcgagcgcggcatgccgcaacaacgcgctccccgtggtggcggtggtggtcagcgtgaggctcagtccctgggctctggcttcatcatctcgccggatggctatatcctcaccaacaatcatgtgattgccgacgccgatgagatcctcgtgcgcctggccgatcgcagtgagctgaaagccaagctggtgggcaccgacccacgctccgacgtggcgttgctgaagatcgaaggtaaagacctgcctgtgctcaagttgggcaaatcccaggacctgaaagccgggcaatgggtagtcgccattggttcgccgtttggttttgaccacaccgttacccaaggcatcgtcagcgccattggccgcagcctgccgaacgaaaactacgtaccgttcatccagaccgacgtgccgatcaatccgggtaactccggtggtccgctgttcaacctggcgggcgaagtagtcggtatcaactcccagatctacacccgttccggtggcttcatgggcgtttcgttcgccatcccgatcgacgtggccatggatgtttccaaccaactgaaaagcggcggcaaggtcagccgcggctggttgggcgtggtgatccaggaagtgaacaaagacctggctgaatccttcggcctcgacaagccggctggtgccctggtcgcgcaaatccaggacgacggcccggctgccaaaggtggcttgcaagtgggtgacgtgatcctgagcatgaacggccagccgatcatcatgtcggccgacctgccgcatctggtgggcgcactcaaggctggcagcaaggccaagctggaagtgatccgtgaaggcaagcgccagactgttgagctgacggtgggcgcaatccctgaagaaggcgcgacactggatgccctgggcaacgccaagcctggtgccgagcgcagcagcaatcgcctgggtatcgccgtggccgagctgaccgatgagcagaagaagaccttcgacctcaagagcggcgtcgtgatcaaggaagtacaggacggccctgcctctctgatcggcttgcagccgggtgacgttattacccacctgaacaaccaggcgatcgataccaccaagcaattcaccgacatcgccaaggcgttgccgaagaaccgctcggtgtcgatgcgtgtgctgcgtcaagggcgtgcgagcttcatcaccttcaaactggctgagtaa

SEQ ID NO: 1510 - DNA, 1428 bp, Pseudomonas sp.
atgtcgataccacgcttgaaaacctatctttccatctttgccactgtgcttgtgctcggtcaggccgttcccgctatggcggtcgaattgcctgacttcactgagctggtcgagcaagcctcgcctgcggtggtgaacatcagtaccacccagaaactgccggaacgcagggtgatggatcagcagatgccggacctggaaggtttgccgccgatgttgcgcgagttcttcgagcgcgggatgccgcaaccgcgttcgcctggcggtggtcgtcagcgtgaagcgcagtccctgggctcgggtttcattatttcgcccgacggttacatcctgaccaataaccacgtgattgccgatgccgacgagatcctggtgcgcctggcagaccgcagtgagctcaaggccaagctgatcggcactgacccgcgttctgacgtggcgttgctgaagatcgaagggaaagatctgcccgtgctcaagctgggcaaatcccagaacctgaaagccggccagtgggtcgtggccatcggttcgccgtttggcttcgaccataccgtaacccagggcatcgtcagcgccatcggtcgcagcctgccaaacgaaaactacgtgccgttcatccagaccgacgtgccgatcaacccaggcaactccggtgggccgctgttcaacctcgacggtgaagtcgtggggatcaactcccagatatatacccgttcgggcggcttcatgggcgtgtccttcgcgattccgatcgacgttgccatggacgtgtccaatcagctgaaaaccgaaggcaaggtcagccgcggctggttgggcgtggtcattcaggaagtgaacaaggacctggccgagtcgttcggcctggagaaacctgccggtgcgctggtggcgcagatccaggagggtggtccggctgccaagggtggcctgcaagtgggcgacgtgatcctgagcatgaatggccagccgatcgtcatgtccgctgacttgccacatctggtgggcgccctcaaggccggttccaaggctaatctggaagtgattcgcgaaggcaagcgcacaaacgtcgaattgaccgtcggcgccatccctgaggaaggcaaggagctggactcgctggccaagtcaggcgtggaacgtagcagcaatcgtctgggcgtggctgtggcggagcttacgccagagcaaaaacggaccctggagctgcaaggtggtgtagtgatcaaggaggtgcaggaggggcctgcggccatgatcggcctgcaaccaggagacatcatcactcacctgaacaaccaggcaatcggttcggccaaggagttcaccgacatcgccaaggcgttgccgaagaatcgttcagtctcgatgcgggttctgcgtcagggccgtgcgagtttcattaccttcaagctggccgagtga

SEQ ID NO: 1511 - DNA, 1398 bp, Pseudomonas sp.
atgtcgataccacgtttgaagtcttacttatccatagtcgccacagtgctggtgctgggtcaggccttacctgcgcaagcggtcgagttgcctgacttcacccaactggtggagcaggcctcgcctgccgtggtgaacatcagtaccacgcagaagctgccggatcgcaaggtctcgaaccagcagatgcccgacctggaaggcttgccgcccatgctgcgcgagttcttcgagcgagggatgccgcaaccacgctccccccgtggcggcggtggccagcgcgaagcccaatccctgggctccggtttcatcatttcgcctgatggctatatcctcaccaacaaccacgtgattgccgatgccgacgagattctcgtgcgcctggccgaccgcagtgaactcaaggccaagctgattggcaccgatccgcgttctgacgtggccttgcttaaaatcgatggcaaggatttaccggtgctcaaactgggcaagtcccaggacctgaaggccggtcagtgggtggtcgcgatcggttcaccgttcggctttgaccataccgttacccaaggtatcgtcagcgccatcggtcgcagcctgccaaacgaaaactacgtgccgttcatccagaccgacgtgccaatcaacccgggtaactccggtggcccgctgttcaacctggccggcgaagtggtgggcatcaactcgcagatctacacccgctccggtggcttcatgggcgtgtccttcgcgatcccgatcgatgtggccatggacgtctccaatcagctcaaaagcggcggcaaggtcagccgtggctggttgggcgtggtgatccaggaagtgaacaaggacctggctgagtccttcggtctcgacaagccggccggtgccctggttgcgcagattcaggacaatggccctgcggccaaaggcggcctgaaagtcggtgacgtcatcctgagcatgaacggccagccgatcatcatgtcggcggacttgcctcatctggtcggcgcgctcaaggccggcggcaaagccaagctggaagtgattcgtgacggcaagcgccagaacgtcgaactgaccgtgggtgccatcccggaagaaggcgcgaccctggatgccctgggcaacgccaagccaggtgccgagcgcagcagtaaccgcctgggtatcgccgtggttgaactgaccgccgagcagaagaaaaccttcgacctgcaaagcggtgtggtgatcaaggaagttcaggacggcccagccgccttgatcggcctgcaaccgggtgacgtgatcactcacttgaacaatcaggcaatcgataccaccaaggaatttgccgacatcgccaaggcgttgccgaagaatcgctcggtgtcgatgcgcgtcctgcgtcaa

SEQ ID NO: 1512 - DNA, 1389 bp, Pseudomonas sp.
atgtcgataccacgtttgaagtcttacctttccatagtcgccacggtgctggtgctgggtcaggccgttaccgcgcaagcggcggaactgcctgacttcacccagctggtagagcaagcctcgcctgccgtggtgaacatcagtaccacgcagaagctgccggagcgtaaagtctcgaaccagcagatgcctgaccttgaaggcctgccgccgatgctgcgggagttcttcgagcgcggtatgcctcagccgcgttcaccccgtggcggcggtggcggtcagcgtgaagcccagtccctggggtcgggttttatcatttcgcctgatggctacatcctcaccaataaccacgtgatcgccgacgccgacgaaatcctcgtgcgcctggcagatcgcagtgagctcaaggccaagctggtcggcaccgatccacgctccgacgtggctttgctgaagatcgaaggcaaggacctgcccgtgctgaaactgggtaagtcccaggatctgaaagccgggcaatgggtggtggccatcggttcgccgtttggctttgaccacaccgtgacccagggcatcgtcagtgccattggtcgtagcctgccgaacgagaactacgtgccgttcatccccccccccccccccccggtggggatcaactcgcagatctacacccgttccggcggtttcatgggcgtctccttcgccatcccgattgatgtggccatggatgtttccaaccagctcaaagccggtggcaaggtcagccgtggctggttgggcgtagtgatccaggaagtgaacaaagacctggccgagtcctttggcctggacaagcctgctggcgccctggtcgcgcagattcaggacgacggcccggcggccaaaggcggcttgcaggttggcgatgtgatcctgaccatgaacggccagccgattgtcatgtcggccgacctgccgcacctggtcggcgcactcaaggcgggcagcaaggccaagctggaagtgatccgcgaaggcaagcgccagaacgtcgagctgaccgtgggcgcgatccctgaagaaggtcaggagcttggcgcgctgggcggtaaatcgggtgccgagcgcagcagcaatcgcctgggcatcgccgtggtcgagttgactgacgagcagaagaagagcttcgacctcaagagtggcgtggtgatcaaggaggtccaggacggcccggccgccctgatcggcctgcaaccgggtgatgtgatcacccacttgaacaaccaggcgatcaactccaccaaggaattcaccgacatcgccaaggcgctgccgaagaatcgctcggtgtcgatgcgcgtcctgcgtcaagggcgtgccagcttcatcaccttcaagctggccgagtaa

SEQ ID NO: 1513 - DNA, 1425 bp, Pseudomonas sp.
atgtcgataccaagcttgaagtcctatctgtccattttcgccacggtcctgctcctcgggcaggcggtggcggcccaggccgcggaattgcccgatttcacccagttggtggagcaggcctcgccggccgtggtgaacatcagtaccacccagaaactgccggaccgcaaggtgtcggatatccaggggctggaaggcctgcctccggagatccagcagttcttccgcggcttcccgcaaccgcgcagcccgaaaggtggcggtcggcagcgtgaagcacagtcgctggggtcggggttcatcatctccaatgacggttatatcctgaccaacaaccacgtggtggccgatgcggatgagatcctcgtacgcctggccgaccgcagcgagctcaaggccaagctggtcggcaccgatccgcgttccgacgtggccctgctgaagatcgacggcaagaacctgccgaccctcaagctcggcaagtccaaggacctcaagcccggccagtgggtagtcgccatcggttcgccgttcggctttgaccacaccgtgacccagggtatcgtcagcgctgtgggccgcagcctgccgaacgagaattatgtgccgttcatccagaccgacgtgccgatcaacccgggcaactccggtggtccgctgttcaacctcaacggtgaagtggtcgggatcaactcgcagatctatacccgctccggtggcttcatgggcgtctccttcgccatcccgatcgacgtggccatggatgtttccaaccagttgaaggccggtggcaaggtcagccgtggctggctgggcgtggtcatccaggaggtcaacaaggacctggccgagtcgttcggcctggacaagccggccggtgcgctggttgcccaggtgcaggatgatggtccggcggccaagggcggcctgcaggtcggtgacgtgatcctcagcatgaatggccagccgatcgaaatgtcggccgacctgccgcacctggtcggtgcactgaaggcgggcgagaaggccaagctggaagtggtgcgtgaaggccagcgcaagaccatcgagctgaccgtcggcgcgattcctgacgaaggcaaggaaatggacagcggcaggtcggccggtgccgagcgcagcagcaaccgcctgggcgtttccgtcgccgacctgagcgacgagcagaagaaggccaacgacctggtcaagggcggcgtggtcatcaaggaagtccaggatggtcccgcggcactgatcggcctgcagccgggcgatgtgatcacccacctgaacaaccaggcgatcaccgatgccaagcagttcaccgagatcgccaaggccctgccgaagaatcgttcggtgtcgatgcgtgtcctgcgtcagggacgtgccagcttcatcaccttcaagctggccgagtaa

SEQ ID NO: 1514 - DNA, 1437 bp, Pseudomonas sp.
atgtcgatgcctcgattgaaaccttacttacccattcttgcggccgtgatgatgctcgggcaggcagttccggccttggcggatgcgccgttggtgcagttgcccgacttcacgcagttggttgaacaagcctccccggcggtggtgaacatcagcaccacgcaaaaattacctgagcgccgtgtgtcaagcatggggcaaatgccagacctggaagggctgccgcccggtttgcgggactttttcgagcgcagcatgccgcaagcaccacgcagcggcggcgggcgtcagcgcgaagctcaatcgttgggttcgggttttatcatttcgcctgatggctatgtcctgaccaacaaccacgtcgtggcggatgcagatgaaatcatcgtgcgcctgtcagaccgcagcgaaatgaaagccaagctggttggcaccgatccacgctctgacgtggcgctgctgaaaatcgaaggcaaaaacctgccagttctgaaactgggcaagtcgcaagacctcaaagcggggcagtgggtggttgccatcggttcaccgttcggttttgaccataccgtgacccaaggcatcatcagcgccatcggccgcagcctgccgaacgaaagctacgtgccttttatccagactgacgtgccgatcaacccgggtaactccggcggcccgctgtttaacctggctggtgaggttgtgggtatcaactcgcaaatctacacccgctccggtggtttcatgggcgtgtcgtttgccatccctatcgacgtagcgatggacgtgtccaaccagcttaaaagcggtggcaaagtcagccgtggctggttgggtgtggtgattcaagaggtcaacaaagacctggctgaatccttcggtctggacaagccagccggtgcgctggtggctcaagtgctcgatgacggcccggcagccaaaggcggcctgcaagtgggtgacgtgatcctgagcatgaatggccagccaattgtgatgtctgccgacctgccgcatctggtgggtgctctcaaggcgggcagcaaggcaagccttgaagtggtgcgtgacggcaagcgtaaaaccctggacctgaccgtgggcgcgattcctgacgaaggcaaagagatggactcgccgagcggtgccgagcgcagcagcaaccgtctgggtgtttctgtggtggacctgagcgaggagcagaagaaagccaacgacatcaagggtggcgtgatcatcaaggatgttcaggacggccctgcggccctgatcggcctgcaaccaggtgatgtcattacgcacttgaacaaccaggcgattaccgatgccaaacagttcactgacattgcaaaggcgctgccaaaaaaccgttcagtgtcgatgcgcgtgctgcgtcaaggtcgtgccagctttattaccttcaaactggcggagtaa

SEQ ID NO: 1515 - DNA, 1434 bp, Pseudomonas sp.
atgtcgataccaagcttgaaatcttatctgtccattttcgccgctgtcctgctgctcgggcagacagtcgcggcccaggccgcggagctgcccgatttcacccagttggtggagcaggcttcgccggcggtagtgaacatcagtaccacccagaagctgccggaccgcaaggtctcggagcagatccagggcctggaaggcttgccgccggaaatccagcagttcttccgcggtttcccgcaaccgcgcgggaaggggggcggtggcggcggtcggcagcgtgaggcgcagtcgctgggctcggggttcatcatctccgatgacggctatatcctgaccaacaaccacgtggttgccgacgccgacgagatcctggtgcgcctggctgaccgcagcgagctcaaggccaagctggtcggcaccgatccgcgttccgacgtggcgctgctgaagatcgacggcaagaacctgccgaccctcaagctgggcaagtccaaggacctgaagccgggtcagtgggttgtcgccatcggctcgccgttcggctttgaccataccgtgacccagggcatcgtcagtgccgtgggccgcagcctgccgaacgaaaactacgtgccgttcatccagaccgacgtaccgatcaacccgggcaactccggtggtccgctgttcaacctcaacggtgaagtggtcggcatcaactcgcagatctacacccgttccggtggcttcatgggcgtgtccttcgcgattccgatcgatgtcgccatggacgtttccaaccagctgaagagcggtggcaaggtcagccgcggctggctgggcgtggtgatccaggaggtcaacaaggatctcgccgagtccttcggcctggacaagccggccggtgcgctggtggcccaggtacaggacgatggtccggcggcgaaaggcggcctgcaggtcggcgacgtgatcctcagcatgaacggccagccgatcgagctgtcggccgacctgccgcatctggtgggtgcactgaaggcgggcgagaaagccaagctggaagtggtgcgtgaagggcagcgcaagaccattgacctgacggtcggtgcgatcccggatgaaggcaaggaaatggatatcgccaagtccgccggtgccgagcgcagcagcaatcgcctcggggtttccgtcgccgacctgaccgatgaccagaagaaagccaacgaccagctcaagggcggcgtggtgatcaaggaagtgcaggacggtccggcggccctgatcggtctgcagccgggcgacgtgatcacgcacctgaacaaccaggcgatcaccgatgccaagcagttcaccgatatcgccaaggccctgccgaagaatcgctcggtatcgatgcgcgtactgcgccagggacgtgcgagcttcatcaccttcaagctggccgaataa

SEQ ID NO: 1516 - DNA, 1416 bp, Pseudomonas sp.
atgcctcgattgaaatcttacttacccatttttgctgccgtgatgatgcttgggcaggcggtaccggccctggctgaagctcagctaccggacttcactcaattggtcgagcaagcctcgcccgctgtggtgaatatcagtaccacgcaaaagctgccggaccgtaaagtctccagcatgcaaatgcctgatctggaaggcctgccgccgggtctgcgggatttctttgaacgcagcatgccgccaggcggtggtcaaggcggacgtcagcgcgaggcccagtctctgggttcgggctttatcatctcgcctgacggctacatcctgaccaacaaccatgtggttgcggatgcggatgaaatcatcgtgcgtctgtctgaccgcagcgaaatgaaagccaagctggtgggcactgacccacgttccgatgtggcgttgttgaaaattgaaggcaaaaacctgcctgttctgaaactgggcaagtctcaggaccttaaggccgggcaatgggtcgtggcgatcggctcgccgttcggctttgaccacacggtgacccaaggcatcattagcgccatcggccgcagcttaccgaatgaaagctacgtgccgttcatccaaactgacgtgccgatcaacccgggtaattcgggtggtccgctgttcaacctggcaggcgaagtcgtgggtatcaactcgcagatctacacccgctccggtggcttcatgggcgtgtctttcgctattccgattgatgtcgcgatggatgtttccaatcagctcaagactggcggcaaagtgagccgaggctggttgggtgtggtgattcaagaggtcaacaaagacctggctgagtcgttcggtctcgacaaacctgccggtgctctggttgctcaggtgctggataacggcccggctgccaagggcggcctgcaagtgggtgacgtgatcctgagcatgaacggtcaaccgattgttatgtcggcagacctgccgcacttggtgggcgccctcaaggcgggcagcaaagcgacccttgaagtgattcgtaacggcaagcgccaaacgctggacctgactgtcggtgcgatcccggacgaaggtaaagagctggcaggcaccaccggtgctgagcaaagcagcaaccgtctgggcgtgtccgtgtcggacttgagcgatgagcagaagaaggccaacgacattaagggtggcgtgatcatcaaagacgtacaggacggtcctgcggcgttgattggtctgcaacctggcgacgtgattactcacctcaacaaccaggcgatctccgatgccaagcaattcactgaaattgccaagtcattgccgaaaaatcgttcggtgtcgatgcgtgtactgcgtcaaggtcgtgccagcttcattacctttaagctggctgagtaa

SEQ ID NO: 1517 - DNA, 1416 bp, Pseudomonas sp.
atgcctcgattgaaatcttatctacccatttttgcagccgtgctgatgctcgggcaggcagtgccggtcatggctgaagcgcagttacctgacttcacccagttggtcgaacaagcctcaccggccgtggtgaacatcagtaccacgcaaaaattgccagaacgacgggtctccagcatgggccagatgcccgacctcgaaggcctgccgccggggctgcgcgagttctttgaacgcagcatgccacccgccggcaaaggtggccgtcagcgcgaggcgcagtccctgggctcgggtttcatcatctctcccgatggttacatcctgaccaacaaccatgtagttgcagatgccgatgaaatcatcgtgcgcctgtctgatcgcagcgagatgaaagccaagctggtgggcaccgacccgcgctccgacgtggctttgctgaaaatcgaaggcaagaacctgcccgtgctgaaactgggcaagtcccaggatctcaaggccggccagtgggtagttgccatcggttcgccatttggctttgaccacaccgtgacccagggcatcatcagcgccatgggccgcagcctgcccaatgaaagctatgtgccgtttatccagactgacgtgccgatcaacccgggcaactcgggtgggccgctgttcaacctggcgggtgaagtggtggggatcaactcgcagatctacacccgctcgggcggctttatgggcgtttccttcgcgatccctatcgatgtggcgatggacgtggccaaccagctcaaggccggtggcaaggttagccgtggctggttgggcgtggtgatccaggaggtcaacaaggacctggccgaatccttcggcctggaaaaacctgccggtgccctggtggcccaggtactggataacggcccggcggcccaaggcggcctgcaagtgggcgatgtgatcctgagcatgaatggtcagccgatcgtcatgtcggcggatttgccccatctggtgggcgcactcaaggccggcagcaaggcgacccttgaagtgattcgtgacggcaagcgcaaaaacctcgacctgaccgttggcgccatccctgatgacgcgaaagacattgcttcgggtaacggcgctgagcaaagcagcaaccgcctgggcgtgtctgtggcagacctgagcgaagagcagaagaaagccaacgacatcaagggtggcgtgatcatcactgatgtacaggacggccctgcggccctgatcggcctgcagcctggtgacgtgattactcacctgaacaaccaggccatcagcaatggcaaggagttcactgaaatcgccaaggcattgccgaagaaccgttcggtgtcgatgcgggttctgcgccaggggcgtgccagcttcataaccttcaagctggcggagtaa

SEQ ID NO: 1518 - DNA, 1416 bp, Pseudomonas sp.
atgcctcgattgaaatcttatctacccatttttgcagccgtgctgatgctcgggcaggcagtgccggtcatggctgaagcgcagttacctgacttcacgcaattggttgagcaggcttcgccagctgtagtgaatatcagcaccacgcaaaagctccctgagcgccgcgcctcaagcttgggccaaatgcccgatctggaaggtttgccacctggcctgcgtgacttttttgagcgcagcattccgcccagtggcaaaggtggtcgtcagcgcgaggcccagtcactgggttcgggtttcatcatctcgcccgatggcttcatcctgaccaataaccacgtggtagcagacgccgatgaaatcatcgtgcgcttgtctgatcgcagtgaaatgaaagccaagctcgtaggcacggatccacgttccgacgttgcgttgctgaaaatcgaaggcaagaacctgcctgtccttaagctgggcaagtcccaggaccttaaggccggtcagtgggtagttgccatagggtcaccgtttgggtttgaccacaccgtaacccaaggcattatcagtgccatcggtcgcagccttccaaatgaaagctacgtgccttttatccagactgacgtaccgatcaacccgggcaactcgggtggtccgctgttcaacctggcgggcgaagtggtgggtatcaactcgcaaatctacacccgctcgggcggtttcatgggcgtgtctttcgcaatccctatcgatgtggcgatggacgttgccaatcagctcaaggctggcggcaaagtcagccgtggctggttgggtgtggtgattcaagaggtcaacaaagacctggccgaatcctttggtctggaaaaaccggcaggtgcgctggtggcccaggtacttgataacggcccggctgccaaaggcggtctgcaagtcggcgacgtgattctgagcatgaatggtcagccgatcgtcatgtcggcagatttgccgcatctggttggcgcactcaaggctggcagcaaggcaacgcttgaagtgattcgtgacggcaagcgcaaaaatctggacctgacggtcggtgccatccctgatgacgcaaaagacattgcttctggcgcaggtgctgagcaaagcagcaaccgtcttggcgtgtccgtggcggacctgagtgaagagcagaagaaagccaatgacatcaagggtggcgtgatcatcactgacgttcaggacggtcctgctgccctgatcggcctgcaacctggtgacgtgatcactcacctgaacaatcaggccattaacaacggcaaggaattcactgaaattgccaaggcattgccgaagaatcgttcggtgtcgatgcgggttctgcgtcaaggtcgcgccagcttcattaccttcaaactggccgagtaa

SEQ ID NO: 1519 - DNA, 1431 bp, unknown
  environmental sample
atgtcaataccacgcttgaaatcctacctaacgatgttcgccgccgtgctgatgcttggccaggtgctcaccgcccaggccgaggaagccctgccggacttcaccaccctcgtcgagcaggcctcgccggccgtggtcaacatcagtaccaagcagaagctgcccgaccgcgtcgccgccgggcagatgccggacctggaaggcctgccgccgatgttccgcgagttcttcgagcgcaacatgccgcagcagccgcgttcgccgcggggtgaccgccagcgcgaggcgcagtcgctgggctcgggcttcatcatttccagcgatggctacgtgctgaccaacaaccatgtggtggccgatgccgacgagatcatcgtccgcctgtcggaccgcagcgagctgcaggccaagctggtcggcaccgacccgcgcaccgacgtggctctgctcaaggtcgaaggcaagaacctgccgacggtcaagttgggtgactccgagaaactcaaggtgggcgaatgggtattggccatcggttcgccgttcggcttcgaccattcggtgaccaaaggcatcgtcagcgccaagggccgtaccttgccaaacgacacctatgtaccgttcatccagactgacgtggccatcaacccgggtaactccggcggcccgctgttcaacatgaagggcgaggtggtgggtatcaactcgcagatcttcacccgctccggtggcttcatgggcctgtcattcgccatcccgatcgatgtggcgatcgatgtgtccaaccagctgaagaaagacggtaaggtcagccgcggctggctgggcgtggtcattcaggaggtcaacaaggacctggcggaatccttcggtctggaaaaaccggccggtgccctggtggcccaggtgctggaaaacggcccggcagccaagggcggcctgcaggtgggcgacgtgatcctgagcatgaacggccagccaatcgtcatgtcggccgacctgccacacctggtgggcggcctcaaggatggcgagaaggccaagctggaaatcatccgcaacggcaagcgccagaccctggacatcagcgtcggcgcgctgccggacgatgatgccgacatcggcaccggtgccgatggcagtgccgagcgcagcagtaaccgtctgggtgtgtcggtcgccgacctgaccgccgagcagaagaaatccctggagctcaaaggcggtgtggtcatcaaggaagtgcaggatggcccggcagcgctgatcggtctgcgtccgggtgatgtcatcagccacctgaacaaccaggccatcggttcggccaaagagttcaccgaaatcgccaaggagctgccgaagaaccgttcggtgtcgatgcgcgtgctgcgtcagggccgcgccagcttcatcaccttcaagctcgctgaataa

SEQ ID NO: 1520 - DNA, 1428 bp, unknown
  environmental sample
atgtcgataccacgtttgaagtcttgtttctcattgatggctgcagtgctgatgctcggccagatcgctgcggtccaggcagaagacctgccggatttcacggggttggtcgaacaggcctcgcctgccgttgtaaacatcagcacccgccagaaaatgcccgagcgtgccctggccggccagggcgcggaccttgaaggcctgccgccgatgctgcgcgagtttctcgagcgcagcgtgccgccgggctcacgctcgcccggtcgcggggatcgccagcgcgaggcccagtcgctgggctcgggtttcatcatttccgatgacggctatgtcctgaccaacaaccatgtggtcgatggcgctgacgaaatcctcgttcgtctgtccgatcgcagcgagctcaaggccaagctggtcggcactgacccgcgcactgatgtcgcagtcctgaaaatcgaaggcaagaacctgccaacggccaaactgggtaactccaataccctcaaggtgggggagtgggtactggccatcggctcgccgttcggcttcgaccattcggtgaccaagggcattgtcagtgccaagggccgcagcctgccgaatgacacctatgtgccgttcatccagaccgacgtggcgatcaacccgggtaactccggtggcccgctgttcaacatgaaaggcgaggtggtgggcatcaactcgcagatctttacccgctccggtggcttcatgggcctgtcgttcgccatcccgatcgatgtggcgatggacgtggccaaccagctcaagtccagcggcaaggtcaatcgtggctggctgggcgtggtcatccaggaagtgaacaaggacctggctgagtccttcggtctggagcggccggccggtgccctggtggcgcaggtgctcgaagacagcccggcggccaagggtggcctgcgtgtcggtgacgtgatcctcaccgccaacggccagccgattgtcatgtccgccgatctgccgcacctgatcggcaacctcaaggatggcagcaaggccgagctggaagtgatccgcgacggcaagcgccagacggtcaacgttaccgtcggcgccctgccggacgaaggccaggagatgggggtgccgggcgccggtgtcgagcgcagcagcaatcgcctgggcgtttcggtgatcgagctgaccgctgaacagaagaagagcctggaactcaagggtggcgtggtcatcaaggaagtccagggcggcccggcggcgctgatcggcctgcagagtggtgatgtgctcacccatctgaacaatcaggagatcgtgtcggccaagcagtttgccgaagtggccaagagcctgcccaagaaccgctcggtgtccatgcgcgtcctgcgccagggccgcgccagcttcatcaccttcaagctggccgaatag

SEQ ID NO: 1521 - DNA, 1404 bp, Pseudomonas sp.
atgatggtcgccaccgtgctgatgctcggccaggcgctcaccgcccaggccgacgaagccctgccggacttcaccacgctggtcgagcaggcctcgcccgcggtggtcaacatcagcaccaagcagaagctgccggaccgccgcgtcgcccagggccagatgccggacctggaaggcctgccgccgatgttccgcgaattcttcgagcgcaacatgccgcaacagccgcgctcgccccgtggcgatcgccagcgtgaggccatgtcgctgggctctggcttcatcatttccagcgatggctatgtgttgaccaacaaccatgtggtcgccgatgccgacgagatcatcgtccgcctgtcggaccgcagtgagctgcaggccaagctgatcggcaccgatccccgtaccgacgtggccttgctcaaggtcgatggcaagaacctgcccaccgtgaaactgggtgactccgagaagctcaaggtgggcgagtgggtattggccatcggttcgccgttcggcttcgaccattcggtgaccaagggcatcgtcagcgccaagggccgcaccctgcccaacgatacctatgtgccgttcatccagaccgacgtggccatcaacccgggtaactccggtggtccgctgttcaacatgaagggcgaagtggtgggtatcaactcgcagatcttcacccgttcgggcggcttcatgggcctgtcgttcgccatcccgatcgatgtggcgctcgacgtttccaaccagttgaagaaagacggcaaagtcagccgcggctggctgggcgtggtgattcaggaggtcaacaaggacctggccgaatccttcggcctcgacaagccggccggcgccctggtagcccaggtgctggaaaacggcccggccgccaagggtggcttgcaggtgggtgacgtgatcctgagcatgaacggccagccgatcgtcatgtcggccgacctgccgcacctggtcggcagcctcaaggatggcgagaaagccaagctggaaatcatccgcaacggcaagcgccagaccctggacgtggccgtgggcgccatgccggacgacgacgccgacatcaccgccggtgccgacggcagcaccgagcgcagcagcaaccgcctgggtgtcgcggtcgccgacctgaccgccgagcagaaaaaatccctcgagctcaagggcggcgtggtgatcaaggaagtccaggatggtccggcagcgctcatcggcctgcgcccgggtgacgtcatcagccacctgaacaaccaggccatcggctcggccaaggaattcaccgaaatcgccaaggaactgccgaagaaccgctcggtgtcgatgcgcgtgctgcgtcagggccgtgccagcttcatcaccttcaagctcgctgaataa

SEQ ID NO: 1522 - DNA, 1440 bp, Pseudomonas sp.
atgttgataccaagctttaagtcctatctttcactgatggccgccgtgctgatgttggggcaggttgctactgcccaggccgaggcgttgccggatttcaccacgctcgtcgagcaagcgtcgccggctgtggtgaacatcagcacccgtcagaagttgccggatcgtgcggtcgccgggcagatgcctgatctcgaaggtctgccgccgatgttgcgcgaattccttgagcgcagcatgccgaatcaggggccgcgcgcgccgggctccccaaaaggggatcgccagcgtgaagcacaatccctcggttcaggtttcatcatttccgctgacggctatgtcctgaccaacaatcatgtggttgaaggtgccgacgaaattctggtccgcctttccgaccgcagtgagctgaaagccaagctggtcggcaccgatccacgtaccgacgtggccgtgctgaagatcgaaggcaaggatttgccgacggtgaaactgggtgattccgagaagctgaaagttggcgagtgggtattggccatcggttcgccgtttggctttgatcactcggcgaccaaaggtatcgtcagcgccaaaggccgcagtctgccaaacgacacatatgtgccgttcatccagactgacgttgcgatcaatccgggtaactcgggtggtccgctgttcaacatgtcgggtgaggtggtggggatcaactcccagatattcacccgttcgggcggcttcatgggcctttcgttcgcgattccgatcaacgtcgcgatggacgtagccaatcagctcaaggccagcggcaaggtgaatcgcggctggctgggcgtcgtcattcaggaggtcaacaaagacctggctgaatcgttcggtctggacaagccggccggtgcgctggttgcccaggtacttgaagacggtccggctgccaagggcggcctgcaagtgggcgatgtgatcctcaacgccaatggccatccaatcgtgatgtcggctgacttgccgcaaatcgtcggcaacctcaaggacggcagcaaggtccagttggacgtgatccgcgaaggcaagcgcaagatgctggacgtaacggtcggcgcgttgccggatgaaggtcaggaaatgggtgcggcggacggtgcaggcgctgagcgcagcagcaaccgcatgggcgtgaccgtagcggacttgactgccgagcagcagaagagcctcgacctgaagggcggcgtcatcatcaaggaagtgcaggaaggtccagcttccctgatcggtctgcagccaggcgatgtgatcactcacctgaacaatcaggcgatttcgtcggccaagaacttcactgaggtggcaaaaggcctgccgaagaatcgttcggtttccctgcgtgtgctgcgccaaggtcgcgccagcttcattaccttcaagcttgcggagtag

SEQ ID NO: 1523 - DNA, 1503 bp, Pseudomonas sp.
ttgaggtctttgagtcagttgcttgtactgcttaattttttgctcgttaccaacgggagctatatgtcgataccacgcatgaaatcctacttttcactgattgccgctgtgctcatgctcggccaggttgctacggctcaagccgagaacctgccggattttaccggactggtcgagcaggcctcgccagcagtggtgaatatcagtacgcgccagaaactgcctgatcgcgccatagccaatcagcagatgcctgacctggaaggcttgccgcccatgctgcgcgaatttctcgagcgcagcatgccgccagggtcgcgtccgccgggagccggcaagggtgatcgtcagcgcgaagcccagtcattgggctcgggctttatcatttcccccgatggttacattctgaccaataaccatgtgatcgacggtgccgacgagattcttgtgcgtctttctgatcgcagcgagttgaaagccaagctgatcggtaccgactcgcgcaccgacgttgcggttctgaaaattgacggcaaagacctccctacagcgaaactgggcaactccaacacgctcaaggtgggtgagtgggtgctggcgatcggctcgccattcggcttcgatcactccgtgaccaaaggcattgtcagcgccaagggtcgtagtctgccaaacgacacatatgtgccgttcattcagacggacgttgccatcaacccgggtaattcgggtggcccgctgttcaacatggcgggtgaggtagtcgggatcaactcgcagatatttacccgctccggtggtttcatggggttgtcgttcgcgattccgattgacgtcgccatggatgtggccaatcagctcaaggccagcggtaaagtcagccggggctggctgggtgtggttatccaggaagtgaacaaggaccttgccgaatcgtttggtctggacaagcctgccggtgcgctggttgctcaggtgcttgaagatggcccggctgccaagggtggcctgcaggttggcgacgtgattctgagtgccaacggtcagccaatcatcatgtcggctgacctgccgcacttgataggcaacctcaaggacggcagcaaggccgaacttgaagtgattcgcgacggcaagcgtcagaagctgacggtcactgttggcgcgctgcctgacgaaggccaggaaatgggcgatgttgctggcacaggcgccgaacgcagcagcaaccgtctgggcgtgtcggtgatcgaactgactgccgagcagaagaaatccctggacctcaagggcggtgtggccatcaaggaagtcacaggtggtccggcttcgctgattggcctgcagccgggtgatgtgatcactcatctgaacaaccaggcgattacgtccagtaagcagttcactgaagtggcgaaaagcctgcccaaggatcgctctgtttcgatgcgtgttctgcgtcagggccgtgcgaccttcatcaccttcaagctgtccgagtaa

SEQ ID NO: 1524 - DNA, 1413 bp, Pseudomonas sp.
attccgagattgaaatcctgtttgtctgtagtggccgggctggttctgcttggtcagaccctggttgccaatgctcaactgcccgacttcacccccttggtcgagcaagctgcacccgcggtcgtcaacatcagtacccgacagaagattccggatcgcctggcgggagcgcagattcccgatctggaggggctgccgccgatcttccgggagttcttcgagcgcagcttcccgccgggactgggtaaacccggtggtggtcgccagcgcgaggcgcagtcccttggttcgggattcatcatctcccgcgacggctacgtgctgaccaacaaccacgtggtcgccgacgccgacgagatcatcgtgcgcctgtccgaccgcagcgagctgcaggccaagctggtgggcgccgacccgcgcagcgacgtggccctgctcaaggtcgacggcaagaacctgccgaccgtcaaggtcggttcggcgaacgacctcaaggtcggcgagtgggtgctggcgatcggttcgccgttcggcttcgatcattcggtgaccgccggtatcgtcagcgccaaggggcgcagcctgccgaacgagagctacgtacccttcattcagaccgacgtggccatcaaccccggcaactccggcggtccgctgttcaacctgaacggcgaagtggtgggtatcaactcgcagatcttcacccgttccggcggcttcatggggctgtccttcgccattccgatcgacgtggccatggacgtcgccaaccagctgcgcaccgagggcaaggtcagccgcggctggctgggcgtggtgatccaggaggtcaacaaggatctcgccgagtccttcggcctggacaagccggccggtgccctggtggcgcagatcatggaaggcggcccggcggacaagagcggactgcaggtgggtgacgtgatcctcagcatgaacggccagccgatcgtcatgtccgccgacctgccgcacctggtgggcgccctcaagccgggcagcaaggcgagcatggagatcgtccgcaagggttcgcgcaagaccctgaacgtgaccgttggcgccttgccggcggaaggcgaggagctggccagcatccagggtggcgagcgcagcagcaatcgcctgggggtggtggtcgctgagctgagcagcgagcagaagcgtgtcctggacatccgcggtggcgtggtgatcaaggaggtgcagaacggtccggcggcgctgatcggcttgcgtcccggcgacatcatcacccacttgaacaaccaggccatcgactccacggccacctttgccaaggtcgcccaggccctgccgaagaaccgctcggtgtcgatgcgcgtgctgcgcgaagggcgtgccagcttcatcaccttcaagctggccgaatga

SEQ ID NO: 1525 - DNA, 1434 bp, unknown
  environmental sample
atgtcgataccacgcatgaaatcctacttttcattgattgccgctgtgctgatgctcggtcaggtggctacggcgcaggccgaaaacctgccggacttcaccgggctggtcgagcaggcatcgcccgcagtggtgaatatcagtacgcgccagaagttgccggaccgtgccgtcgccaatcagcagatgcctgatctggaaggcctgccgccgatgcttcgcgagtttctcgagcgcagcatgccgccgggttcgcgtccgccaggctcgggtgcaggcaagggcgatcgccagcgtgaggctcagtccctcggctcgggcttcatcatctcccctgatggctacgtgctgaccaacaaccacgtaatcgatggcgctgacgagattctcgtacgcctgtccgatcgcagcgagttgaaggctaagctggtcggtaccgatccgcgtaccgacgttgccgtgctgaaaatcgatggcaaggacctgccgaccgccaaactgggcaattccaatacgctcaaggtcggcgaatgggttctggcgatcggctcgccgttcggtttcgatcactccgtgaccaagggtatcgtcagtgccaaggggcgcagcctgcctaacgacacctatgtgccgttcattcagaccgacgtggccatcaacccgggtaactccggtggcccgctgttcaacatggctggcgaggtcgtcgggatcaactcgcagatcttcacccgctcaggtggtttcatgggcctgtcgttcgcgattccgatcgacgtcgccatggatgtcgccaaccagctcaaggctaatggcaaagtcagccgcggctggttgggtgtggtcatccaggaggtgaacaaggacctcgccgagtcgtttggcctggacaagcctgccggcgcgctggttgcgcaggtgcttgaagatggcccggctgccaagggcggtgtgcaggtgggtgacgtgattctgagcgccaacggccagccaatcgtcatgtcggctgacctgccgcacctgatcggcaacctcaaggacggcagcaaggccgaacttgaagtgattcgcgacggcaagcgtcagaagctgacggtcaccgtcggcgcactgcctgatgaaggtcaggagatgggcgatgttggcggtacgggtgccgagcgcagcagtaatcgtctgggcgtatcggtgatcgagttgaccgccgagcagaagaagtccctggacctcaaaggtggcgttgccatcaaggaagtcacaggtagcccggcttcgctgatcggtctgcaggcgggtgatgtgatcactcacttgaacaatcaggcgcgtcctccgccggcgacgacggccgacagcgttgccgttctcctcgcgggtcctcgggcgtaccgtcactccgcggcgtccgtgcgtgctcgttccatgaccgtttag

SEQ ID NO: 1526 - DNA, 1425 bp, unknown
  environmental sample
atgcataccctaaaacgctgtatggctgcgatggtggccttgctggccttgagcctggcgatgacggcccgggcagaactgccggacttcacgcctttggtcgaacaggcgtcgccggcggtggtgaatatcagtacgcggcagaagctgccggatcgcgccatggcgcgcgggcagctgtctatccccgacctcgaagggctgccgccgatgttccgcgacttcctcgaacgcagcatcccgcaggttccgcgcaatccgcgcggccagcagcgcgaggcgcaatcgctgggttccggcttcatcatctccaacgacggctacatcctcaccaacaatcacgtcgtggccgatgccgacgagatcctggtgcgcctgtccgaccgtagcgagcacaaggccaagctggtcggcgcggacccgcgcagcgacgtggcggtgctgaagatcgaggcgaagaacctgccgaccctgaaactgggcgattcgaacaagctgaaagtgggcgaatgggtcctggccatcggttcgccgttcggcttcgatcactcggtcaccgccggtatcgtcagtgccaagggtcgtagcctgccgaacgagagctacgtacccttcatccagaccgacgtggcgatcaacccgggtaactccggcggtccgctgctgaacctgcagggcgaagtggtcggcatcaactcgcagatcttcacccgttccggcggcttcatgggcctgtccttcgccattccgatcgatgtcgcgctgaacgtcgccgaccagttgaagaaagccggcaaggtcagtcgcggctggctgggcgtggtgatccaggaagtgaacaaggatctcgccgagtccttcggcctcgacaagccgtccggcgcgctggtggcgcaactggtggaagacggcccggcggccaagggtggcctgcaggtgggcgatgtgatcctcagcctgaacggccagtcgatcaacgagtccgccgacctgccgcacctggtgggcaacatgaagccgggcgacaagatcaacctggacgtgattcgcaacggccagcgcaagtccctgagcatggcggtaggcagccttccggacgacgacgaggaaatcgcctcgatgggcgctccgggcgccgagcgcagcagcaaccgcctgggcgtgaccgtcgccgacctgaccgccgagcagcgcaagagcctggatatccagggcggcgtggtgatcaaggaagtccaggacggtccggccgcggtcatcggcctgcgtccgggcgatgtcatcacccacctggacaacaaggcggtgacctcgaccaaggtcttcgccgacgtggccaaggccctgccgaagaaccgttcggtttcgatgcgggtgctgcgccagggacgcgccagcttcattaccttcaagctggccgaataa

SEQ ID NO: 1527 - DNA, 1422 bp, Azotobacter sp.
atgtcaaaggttggttttaagtccttcgcctccgttttggcaggtgccctgctgctcgggcagtcgctcttcgtgcaggcgcaattaccggagttcacctcgctggtggaggaagcctcgccggcggtagtcaatatcagtacccggcaaaagcttcccgatcgctccacggttcagggattgcctgatctcgaggggcttccgccgcttttcagggagttcctggagcgcagcattccgcaacttccgcgtactccggataacgggcggcagcgtgaggcgcactccctgggctcgggtttcatcatttctccagatggctatgttctaaccaacaaccatgtggtggccgatgccgatgaaatcatcgtgcgtttgtccgatcgcagtgagctcgaggccgagctggtcggggccgatcctcttaccgatgtagctttgttgaaggtcaagggttcgaatctccccacagtcaaactgggacgtaccgaccaattgagagtcggggaatgggttctggccatcggttcccctttcggtttcgatcattccgtgactgcgggcatcatcagtgccacggggcgaagcctgccgaacgagagttacgttcctttcatccagaccgatgtggccatcaatcccggtaactccggcgggccgctcttcgatctggatggacgggtcataggcatcaactcccagatattcacccggtcggggggcttcatgggcttgtctttcgcgattcccatcgaggttgccatgggcgtggccgatcagttgaaggccactggcaaggttgctcgcggttggttgggagtaatcattcaggaagtcaacaaggatctggctgagtcctttggtctggatcggccggccggagcgttggtcgcccaggtcttggaggatggaccggcggacaagggcggtttgcaggtcggcgatgtcattctcagcctagatggtcatcctattgtgatgtcggccgatctgccgcatctggttggggggctcaaacccggggctgcagccaatctcgaggtggtgcgtgacggcaagcggaggaacatcgctatcactgtcggggccttgccggaggaggggaatggggttcagccgagtatcgcgggcacggaacagagcagcaatcgccttggagtgacggtcaccgaactgacggctgagcagaagaaatcccttgatctcaagggtggtgtggtcattcgcgaagtgctgaacggtccggccgcattgatcggactgcggcctggcgatgtagttacccatttgaacaatcagccgatcgactcggcgaagacctttgccgaagtggccggtgcgttgccaaaaggccggtcggtatccatgagggtgctgcgccaggggcgtgccagtttcattactttcaaactggccgagtga

SEQ ID NO: 1528 - DNA, 1410 bp, Pseudomonas sp.
atgattcttcgtagaaacttcctggctgctgtggccggtgtagcgctgtttggacagacgctcatggcccacgctgaactgccggatttcacgcctctggtggaggatgcatcgcccgcggtagtgaacataagcaccaagcaaaagcagccgatgcgcggcaacgcgcaggcgcaaatgcctgatctagaaggcattccgcccatgttccgcgagtttttcgagcacgggatgcctcaacaacccgagcgtcgtcgtgaagctcagtcgttgggttccgggttcattatttccgaagacggctacgtcctgaccaacaatcacgttgtagccgacgctgacgagatcatggtgcgcctgccggatcgcagcgagatgcaagccaagctggtcggtgccgacccgcgcagcgatgtggccctgctgaaaatcgaaggcgacggcctgccaacggtcaagatcggcagctccgacgagctgaaggccggtgagtgggtggttgcgattggctcgccgttcggtttcgaccacacggtgaccgcaggtgtggtcagcgccaaaggtcgcagcctgccgaacgaaagttatgtgcccttcatccagaccgacgtggcgatcaatccgggtaactccggcgggccgctgttcaacctggaaggcgaagtggtaggtatcaactcgcagatcttcacccgctccggtgggttcatggggttgtcgttcgccatcccgatcgacgtcgccatggacgtggccaaccagctgcgcgaagacggcaaggtcagccgcgggtggcttggcgttgtcattcaggaagtgaacaaggacctggccgagtcgttcggtctcgagcgtcccgcgggtgcgctggtcgcgcaggtgatggatggtggtccggcagccaagggcggcttgaaggttggcgatgtgatcctcagcgttaacggcaagtcaatcgacatgtccggtgacctgccgcatctgattggcgcgatgaaaccggacagcaaagccaagcttgaagtggtgcgtgacggccagcgcaagacgctaaccatcgacatcggcgcgcttccagaagacggcaccatcatggcttcggccgatggttcgggtggcaactcccagagcaacaaccgcctcggtgtttctgtagccgagctgaccgatgcgcagcgtcaggcgctggaggtctccggtggcgtggtgatccgcgacatcagccaggggcctgccgcgatgattggtttgcgcccgggtgacgtcatcacccacctgaacaacgaagcgatcgattcggtccagcagttcagccaagtggtcaaggatttgcccaagaaccgctccgtatcgatgcgggtattgcgtgaaggccgcgccagtttcatcaccttcaaactgcccaagtaa

SEQ ID NO: 1529 - DNA, 1281 bp, Pseudomonas sp.
gtgagtgatcacatcacccggctgcagaccgatcagcgaagccgggccgccggtgacttccttgatggcgacgccgcctttgatgtccagggatttcttctgctcggcggtcagctcgatcaccgatacgcccagacgattactgctgcgctcggcacccgtacctccaacatcgcccatttcctgaccttcatcaggcagcgcgccgacggtgaccgtcagcttctgacgcttgccgtcgcgaatcacttcaagttcggccttgctgccgtccttgaggttgccgatcaggtgcggcaggtcggccgacatgacgatgggctggccgttggcgctcagaatcacgtcacccacctgcacaccgcccttggcagccgggccgtcttcaagcacttgcgcaaccagcgcgccggcaggcttgtccagaccaaacgactcggcaaggtccttgttcacttcctggatgaccacacccagccagccgcggctgactttgccgttggccttgagctggttggccacatccatggcgacgtcgatcggaatcgcgaacgacaggcccatgaaaccaccggaacgcgtgaagatctgcgagttgatcccgacgacctcgccagccatgttgaacagcgggccaccggagttacccgggttgatggccacgtcggtctgaatgaacggcacgtaggtatcgttaggcaggctgcgccccttggcactgacgatacccttggtcacggagtgatcgaaaccgaacggcgagccgatcgccagaacccattcaccgaccttgagcgtattggaattgcccagtttggcggttggcaggtccttgccctcaatcttcagaacggcaacgtcggtacgcggatcggtaccgaccagcttggccttcaactcgctgcgatcggacaggcgtacgagaatctcgtcagcaccatcgattacatgattgttggtcagcacgtagccgtcaggggagatgatgaagcccgagccgagggactgagcttcacgctggcgatcacccttgcctgcacccgagcccggcggacgcgaacctggcggcatgctgcgctcgagaaactcacgaagcatcggcggcaggccttccagatcaggcatctgctgattggcgacggcacggtccggcaacttctggcgcgtactgatattcaccactgcgggcgatgcctgctcgaccagcccggtgaagtccggcaggttttcggcctgggccgtagcaacctgaccgagcatcagcacagcggcaatcaatga

SEQ ID NO: 1530 - DNA, 1158 bp, Pseudomonas sp.
atggacgcaaacgataacgcgtttattctggataaacgcggtgtcctgaagtttttcgcgaacaagctcgctcctacagaggggcgacgtagcgtcagggagcggtcttttcgagattcaagcagggcgggctccatctggatgccgcccttttttgtgcaagagattatgcaaagcagcagcaacctatttcctgtcgccctgatcagcgccgaacggcgcggtgatctgagcgaagatgtgtatcgtttgaaacccggtaacagccccgacttcaccgtcgagctggctgtgacacgccttggcatggccgatgagtcgtcctcccgtggcgtgccggtgatcttgctgcacggcagtttttccaatcgccgtttctggttttcccccaagggcctggggttgggcgcttacctggcccgccaggggttcgacgtctggattccggaaatgcgcggtcacggcctgtcccagcgtaaccacgactaccgcaagaaccgtgttgccgactacgcacgctatgacctgccggccatcggtgcatttgtccgcgagcagagcgggcaggtgccgcactggatcggtcactcgctgggcggtactacactggccgcagcgctgggtggcgagtacatcggtgagccggtcgtggcctcggcggcgtttttcggcactcaggtgagccgcacctactggccattgaagattccaccggtggagtggagcgggcgcttcattctcaagcgttttgcccagttgtcgggctcaaggctcaagcgcggcccggaggacgagcccatcggcctggccctggaaagcatgcgctggttcggcttgttcgggcgcttcggtgatgccgacaaggactggtgggcaggcctggccgaggtcaagttgccggtgcttgccgtcagcgctgccggcgatcatcaggatcctgcgtgggcttgtcgaaaactgttcgagcaattcggttccgagcacaagcaattcatcaacctggggcgcgagcagggcttcggcgacaatttcggtcacgtggaaatgctcgtcagcaaggcagcccaggctgaagtctggcctttggtgacgcgctggctggccgatcagcagacacctttgccgggcgcgcaacaggatttggtcgtggcagtctga

SEQ ID NO: 1531 - DNA, 1017 bp, Pseudomonas sp.
atgccgcccttttttgtgcaagagattatgcaaagcagcagcaacctatttcctgtcgctctgatcagcgccgaacggcgcggtgatctgagcgaagatgtgtatcgtttgaaacccggtaacagccccgacttcaccgtcgaactggctgtgacacgccttggcatggccgatgagtcgtcctcccgtggtgtgccggtgatcctgctgcacggcagcttttccaatcgccggttctggttttctcccaagggcctgggattgggggcttacctggcccgccaggggttcgacgtctggattccggaaatgcgcggtcacggcctgtcccagcgtaaccatgactaccgcaagaaccgtgtcgccgactacgcacgctatgacctgccggccattggcgcgttcgtgcgcgaacagagtgggcaggtgccgcactggatcggtcactcgttgggcggtactacactggccgctgcattgggtggcgagtacatcggtgagccggtcgtggcctcggcggcgtttttcggtacgcaagtcagtcgcacctactggccattgaagattccaccggtggagtggagcggtcgcttcattctcaagcgttttgcccaactgtccggctcaaggctcaagcgcggtccggaggatgagcccatcggcctggccctggaaagcatgcgctggtttggtttgttcgggcgcttcggtgatgccgacaaggactggtgggcaggcctggccgaggtcaagttgcccgtattggcggtcagtgccgcgggtgatcatcaggacccggcctgggcgtgtcgcaaactgttcgagcagttcggttccgggcacaagcaattcatcaacctggggcgcgagcagggcttcggcgacaatttcggtcacgtggaaatgctcgtcagcaaggcagcccaggctgaagtctggcctttggtgactcgctggctggccgatcagcagacgccgttgccgggcgcgcaacaggattttgccgcggcaatctga

SEQ ID NO: 1532 - DNA, 1017 bp, Pseudomonas sp.
atgccgcccttttttgtgcaagagattatgcaaagcagcagcaatctatttcctgtcgccctgatcagcgccgagcgtcgtggtgatctgagcgaagatgtataccgtttgaaacccggtaacagccccgacttcaccgtcgaactggctgtgacgcgccttggcatggccgatgagtcgatttcccgtggcgtgccggtgatcctgctgcatggcagcttttccaatcgccgtttctggttctcccctaagggcctggggttgggtgcttatctggctcgacaggggtttgacgtctggattccggaaatgcgcggtcacggtttgtcccagcgtaaccacgattaccgcaagaaccgtgtggccgactatgcccgctatgacctgccggctatcggagcatttgtccgcgaacagagtgggcaagtgccgcactggatcggtcactcgctgggcggtacgacgctggccgcagcgctgggtggcgagtacatcggtgagccggtggtggcctcggcggcgtttttcggcacccaggtgagccgcacctactggcctttgaagattccaccggtggagtggagcagtcgattcattctcaagcgttttgcccagttgtccggctcaaggctcaagcgcggtccagaggacgagccgattggcctggccctcgaaagcatgcgctggttcggcttgttcgggcgcttcggcgatgccgacaaagactggtggagaggcctggccgaggtaaaattacccatattggcggtcagtgccgcaggtgaccatcaggacccggcctgggcgtgtcgcaaactgttcgagcaattcggttccgagcacaagcaattcatcaatttgggacgcgagcagggttttgccgacaacttcggtcacgtggaaatgctcgtcagcaaagcagcccaggctgaagtctggccattggtgacgcgctggctggccgatcagcagacacttttgccgggcgcgcaacaggatttggccgcagcaatatga

SEQ ID NO: 1533 - DNA, 1017 bp, unknown
  environmental sample
atgccgcccttttttgtgcaagagattatgcaaagcagcagcaacctatttcctgtcgccctgatcagcgccgaacggcgcggtgatctgagcgaagatgtgtatcgcttgaaacccggtaacagccccgacttcaccgtcgaactggctgtgacacgccttggcatggccgatgagccgtcatcccgtggcgtgccggtgatcctgctgcacggcagcttttccaatcgccggttctggttttctcccaagggcctggggttgggcgcctatctggcgcgcctggggttcgacgtctggattccggaaatgcgcggccatggcctgtcccagcgcaaccacgactaccgcaagaaccgggtcgccgactacgcacgctatgacctgccggccatcggcgcgttcgtgcgtgaacagagcgggcaggtgccgcactggatcggtcactcgctgggcggtactacactggccgcagcgctgggtggcgagtacatcggtgagccggtggtggcctcggcggcttttttcggtacacaagtcagccgcacctattggccattgaagattccgccggtggagtggagcagtcgcttcattctcaagcgttttgcccagttgtccggagcaaggctcaaacgcggcccggaggacgagccgatcggcctggccctggaaagcatgcgttggttcggcctgttcgggcgctttggcgatgccgataaagactggtgggccggtttggccgaggtcaggttgccggtgctcgccgtgagtgcagcgggtgatcatcaggatcctgcgtgggcgtgccgaaaactgttcgagcagttcggttccgagcacaagcaatttatcaatctgggtcgtgatcaggggttcagcgacaatttcggtcacgttgaaatgctcgtcagcaaacctgcccaggccgaagtctggccattggtgacccgctggctggcggatcagcagacacccttgttgggtgaacaaggggatttggccgcggcggtttga

SEQ ID NO: 1534 - DNA, 990 bp, Pseudomonas sp.
atgcaaagcagcagcaacctatttcctgtcgccctgatcagcgccgaacggcgcggtgatctgagcgaagatgtctatcgtttgaaacccggtaacagccccgacttcaccgtcgaactggctgtgacacgccttggcatggccgatgggtcgtcctcccgtggtgtgccggtgatcctgctacacggcagcttttccaatcgccggttctggttttctcccaagggcctggggttgggtgcttacctggcccgcctggggttcgacgtctggattccggaaatgcgcggtcacggcctgtcccagcgtaaccacgactaccgcaagaaccgtgtcgccgactacgcacgctatgacctgccggccattggcgcgttcgtgcgcgaacagagcgggcaggtgccgcactggatcggtcactcgctgggcggtactacgttggccgcagcgttgggtggcgagtacatcggtgagccggtcgtggcctcggcggcgtttttcggtacacaagtcagccgcacctactggccattgaagattccgccggtggagtggagtggtcgcttcattctcaagcgttttgcccagttgtccggttcaaggctcaagcgcggtccggaggacgagcccatcggcctggccctggaaagcatgcgctggtttggcttgttcgggcgcttcggcgatgccgacaaggactggtgggcaggcctggccgaggtcaagttgcccgtattggcggtcagtgccgcgggtgatcatcaggacccggcctgggcgtgtcgcaagctgttcgagcagttcggttccgagcacaagcaattcatcaatctggggcgcgagcagggcttcggcgacaatttcggtcacgtggaaatgctcgtcagcaaggcagcccaggctgaagtctggcctttggtgacgcgctggttggccgatcagcagacacctttgccgggcgcgcaacaggatttggccgcggcaatctga

SEQ ID NO: 1535 - DNA, 1140 bp, Pseudomonas sp.
atggtcgtaaacgataacgcgtacttgctggataaacgcgttgttctgacgtccttcgcgagcaggctcgctcccacactggccggctctttcagatattcaagtagggcgggctcctctggatgccgcccttttttgtgcaagagcattatgcaaagcagcagcaacctatttcctgtcgccctgatcagcgccgagcggcgcggtgatctgagcgaagacgtctatcgcttgaaacccggcaacagccccgacggcaccgtcgaactggctgtgacacgcctgggtctggccgatgagccgacggtgcgtggcgtgccggtgattctgttgcacggcagcttttccaatcggcggttctggttctctcccaaaggtctggggttgggggcttatctgacgcgtctgggcttcgatgtgtggatcccggaaatgcgcggtcatggtctgtctcagcgcaatcaggactatcgcaagaaccgcgttgccgactacgcgcgttacgacttgccggccattggggcctttgtgcgcgaacagagcggccaggtcccacactggatcggtcactcgctgggtggcattacgctggcggcggcgctgggtggggaatacatcggcgagcctgtcgtcgcgtctgccgcgttcttcggcacgcaggtcagccgtacctactggccgttgaagtttccaccggttgagtggagcgggcgtttcatcctcaagcggtttgctcaactgtcaggttcacgcctcaagcgcggcccggaggacgagccgattggcctggccctggaaagcatgcgctggtacgggctgttcgggcgttttggcgatgccgacaaggactggtgggcgggtttggccgagattcagttaccggtgttggccgtgagtgccgcgggcgatcatcaggacccgacctgggcctgccgcaagctgttcgatcaggtcggctccgagcacaagcaattcatcacccttggccgcgagcaaggctttggcgataatttcggtcatgtggaaatgcttgtcagcaaatctgcgcaaactgaagtctggccgttggtggcgcgttggctggcagatcaacagacgcctttgctgggtgaaaagccggatttggcctcggccgtttga

SEQ ID NO: 1536 - DNA, 1140 bp, Pseudomonas sp.
atggtcgtaaacgataacgcgtactcgctggataaacgcgttgttctggcgtccttcgcgagcaggctcgctcccacactggccggctcttttagatattcaagtagggcgggctcctctggatgccgcccttttttgtgcaagagcattatgcaaagcagcagcaatctatttcctgtcgccctgatcagcgccgagcggcgcggtgatctgagcgaagacgtctatcgtttgaaacccggcaacagccccgacggtaccgtcgaactggctgtgacacgcctgggcctggccgatgagccggcggtgcgtggcgtgccggtgattctgttgcacggcagtttttccaatcgacggttctggttctctcccaaaggtctggggctgggggctcatctgacgcgtctgggattcgatgtgtggattgcggaaatgcgcggtcacggcctgtctcagcgcaaccaggactatcgcaacaaccgcgtcgccgactatgcgcgttacgatctgccggccattggcgcgttcgtacgcgagcaaagcggccagatcccgcactggattggccactcgctgggcgggatcaccctggcggcggcgctgggcggcgaatacatcggcgaaccggtggtggcctctgcggcgtttttcggcacgcaggtcagccgcacctactggccattgaagtttccaccggtggaatggagcgggcgctttattctcaagcgttttgcccagctgtcaggttcacggctcaagcgcggcccggaggacgagccgattggcctggctctggaaagcatgcgctggtacgggctgttcggtcgttttggcgatgctgacaaggactggtgggcgggtttggccgaggttcagttgccagtgctggccgtgagcgccgcgggcgatcatcaggatccgacctgggcctgccgcaagctgttcgatcaggtcggctccgagcacaaacaattcatcacccttggccgcgagcaaggctttagcgataatttcggtcacgtggaaatgcttgtcagcaaggctgcgcagactgaagtctggccgttggtggcgcgctggctggcggatcaacagacgcctttgctgggtggaaagccggatttggacgcagccgtttga

SEQ ID NO: 1537 - DNA, 1017 bp, Pseudomonas sp.
atgccgcccttttttgtgcaagagattatgcaaagcagcagcaacctgtttcctgtcgccctgatcagcgccgagcggcgcggtgatctgagcgaagatgtctaccggttgaaacccggtaacagccccgacggcaccgtagaattggcggtgacgcgccttggcatggctgatgaatcggcctcccgtggcgtgccggtgatcctgttgcacggcagtttttccaatcggcgtttctggttctcccccaaggggttgggcctgggagcctatctgacgcgcctgggattcgatgtctggatcgcggaaatgcgcggtcacggcctgtcccggcgcaaccagaactatcgcaagaaccgtgttgccgactacgcgcgttacgatctgcccgccattggcgcgttcgtgcgcgagcaaagcggccaggtcccgcactggatcggccattcgctgggcggtatcaccctggcggcggcgttgggcggccaacacattggcgagcccgtggtcgcgtccgcggcgttctttggcacgcaagtcagccgcacctactggccgctgaagattccaccggtggaatggagtggtcgtttcatcctcaagcgctttgcccagctgtccggttcacggctcaagcgtggcccggaggacgagccgattggcctggccctggaaagcatgcgctggtacggtctgttcgggcgctttggcgatgccgacaaggactggtgggcgggcctggccgaggtcaggatgccagtgctggcggtgagcgccgcgggcgatcatcaggacccggcctgggcttgtcgcaagttgttcgaccagctgggttccgagcacaagcaattcatcaacctgggacgcgagcagggttttgccgataatttcggtcatgtggaaatgttggtaagcaaagctgcccaggctgaagtctggccgttggtcgctcgctggctggtggatcagcagacgccgttgctcggtgatcaagcggatttggccgcggcgatctaa

SEQ ID NO: 1538 - DNA, 996 bp, Pseudomonas sp.
atgcaaagcagcagcaacctatttcctgtcgccctgatcagcgccgaacggcgcggcgatctgagcgaagatgtgtatcgtttgaagcccggcaacagccccgacttcaccgtcgaactggctgtgacgcgtctcggcttggccgatgaaccatcctcccgcggcgtgccggtgatcctgctgcacggcagcttttccaatcgccggttctggttttctcccaagggcctggggttgggtgcttatctggctcgcttgggattcgacgtctggattccggaaatgcgcggtcacggcttgtcccagcgtaaccacgactaccgcaagaaccgtgtcgccgactacgcgcgctacgatctgccagccatcggtgcatttgtgcgtgaacagagcgggcaggtaccgcactggatcggtcattcgctgggcggtattaccctggcggcggcgctgggtggcgagtacatcggtgagccggtcgtggcctcggcggcgtttttcggcacccaggtcagtcgcaactattggccactgaagattccgccggtggagtggggcggccgcttcattctcaagcgctttgcccagttgtccggttcaagactcaagcgtggcccggaggacgagccgatcggcctggccctggaaagcatgcgttggtacggactgttcggacgctttggcgatgccgataaaaactggtgggcgggtttggccgaggtcaagttgccggtgcttgcagtaagcgctgcaggtgatcatcaggatcctgcatgggcttgccgcaaactgttcgatcagctcggttccgggcacaagcaatttatcaatctgggtcgtgatcaaggttttgccgataatttcggccatgttgaaatgcttgtcagcaagcccgcccaggccgaagtctggcctttggtggcccgctggctggcggaccagcagacaccattgttgggagagcaacgggatctggccgcagcaatccgagcctga

SEQ ID NO: 1539 - DNA, 990 bp, Pseudomonas sp.
atgcaaagcagcagcaacctgtttcctgtcgccctgatcagcgccgagcgccgcggtgatctgagcgaagatgtctaccgcttgaaacccggtaacagcccggacggcaccgtagaactggcggtgacgcgcctcggcatggccgatgaaccggcatcccgtggcgtgccggtgatcttgttgcacggcagtttttccaatcgacgtttttggttctcccccaaggggctgggcctgggtgcctatctggcgcgcctggggttcgatgtctggattgcggaaatgcgcggtcacggcctctcccggcgcaaccagagctatcgcaagaaccgagttgccgactatgcacgatacgacctgccagccatcggcgccttcgtacgcgagcaaagcggccaggttccgcactggatcggccattcactgggcggcatcaccctggcggccgcactgggtggccaatacattggggaacccgtggtggcgtccgcggcgctttttggcacgcaagtcagtcgcacttactggccgctgaagattccaccggtggaatggagcggtcgtttcatcctcaagcgctttgcccagctctccggttcacggctcaagcgtggcccagaggacgagccgattggcctggccttggaaagcatgcgctggtacggtctgttcgggcgctttggcgatgccgacaaagactggtgggcgggcctggccgaggtcaggatgccggtgctggcggtgagcgccgcgggcgatcatcaggaccctgcctgggcttgtcgcaagctgttcgatcagttgggttgcgagcacaagcaattcattaacctggggcgcgagcagggttttgccgataatttcggtcatgtcgaaatgttggtcagcaaagccgcccaggctgaagtctggccgttagtcgctcgctggctgtcagatcagcagacgccgttgctcggtgatcaagcggatttggccgcggcgatctaa

SEQ ID NO: 1540 - DNA, 990 bp, Pseudomonas sp.
atgcaaagcagcagcaacctatttcctgtcgccctgatcagcgccgagcgacgcggtgatctgagcgaagacgtttatcgtttgaaaccgggcaacagccctgactggtccgtggaaatcgcggtgacccgtctcggcatggccgatgagccggcgtcgcgcggcgtgccggtgatcttgctgcacggcagtttttccaaccggcgcttctggttttcgccaaaaggcctgggccttggcgcctatctgacgcgactgggcttcgatgtgtggatcccggaaatgcgcggtcatggcctgtcccagcgcaacgaggactaccgccgcaaccgggtcgccgactatgcccgttacgatctgccggcgattgccgcgttcgtccgtgagcagagcgggcagattccgcactggatcggccactcgctgggtggcatcacgctggcagccgcgttgggcggcgaatacctcggtgagcctgcggtggcgtcggcggcgtttttcggcacccaggtcagccgcacctactggccgttgaagattccgccggtggaatggagcgggcgcttcattctcaagcgttttgcccagttgtccggttcgcgactcaagcgcggccccgaggacgagccgatcggtctggcgctggaaagcatgcgctggtacgggctgttcggtcgtttcggcgacaaggacaaggattggtgggcaggcctggccgatgtgcaggtgccggtgctggcggtgagcgctgcgggggatcatcaggatccggcctgggcctgccggaagctgttcgaacagattggctccgagcacaagcagttcatcaatctgggccgagagcagggcttcaacgatcagttcggccatgtcgaaatgctggtcagcaaggcggcgcaggctgaggtctggccgctggtggcgcgctggctggcagatcagcacacgccattgcttggcgagaagccggatctggcggcagcggtctga

SEQ ID NO: 1541 - DNA, 996 bp, Pseudomonas sp.
atgcaaagcagcagccacctatttcctgtcgccctgatcagcgccgaacgacgcggtgatctgagcgaagacgtctatcgtttgaaacctggcaacagccccgacggcaccgtcgaactggctgtgacacgtctcggcatggccgacgagcccgccgtgcgtggcgtgccggtgattctgttgcacggcagcttttccaatcgacggttctggttttccccaaagggcttgggtctgggcgcctatctggcgcgccagggcttcgatgtgtggatcgcggaaatgcgcggccatggcttgtcccagcgcaaccagaactatcgtaataaccgcgttgccgactacgctcgatacgatctgcctgccattggcgcctttgtgcgcgagcaaagcgaccaggtcccgcactggatcggtcactccctcggcggcatcacactggccgcggcattgggcggcgagtacatcggcgaatcagtcgtggcttctgcggcatttttcggtacacaggtcagccgaacctactggccattgaaatttccgccggtggagtggagcgggcgctttattctcaagcgtttcgcccagctgtccggctcgcggctcaagcgcggcccggaagacgaaccgatcggcctggccctggaaagcatgcgctggtatggcctgttcggccgttttggcgatgccgacaaggattggtgggccggactggccgacgtccagttgccagtgctggccgtgagtgccacgggtgaccatcaggatcccgcctgggcctgccgtaagctgttcgatcagctggggtccgagctcaaacaattcatcaccctgggtcgcgaacagggctttggcgataatttcggtcacgtggaaatgctcgtcagcaaagcggcccagaccgaagtctggccattggtggcacgctggctggcggatcagcgcacacctttgctgggcgaaaaatcggattttgccactgcgatccaggcctga

SEQ ID NO: 1542 - DNA, 990 bp, Pseudomonas sp.
atgcaaagcagcagcaacctatttcctgtcgccctgatcagcgccgagcggcgcggcgatttgagcgaagacgtttaccgtttgaaacccggcaacagccctgactggtccgtggaaatcgccgtcacccgtttgggcatggctgatgactcggcgcctcgcggcgtgccggtgattttgctgcacggcagtttttccaatcggcgtttctggttttcgcccaaaggcctggggctgggcgcgtacctgacgcggttgggctttgatgtatggattccggagatgcgcggccatggtttgtcgcagcgcaacgaggaataccgacgcaatcgtgtcgccgactacgcccgttacgacttgccggcgattgccgcgttcgtgcgtgagcagagcgggcagatcccgcactggattggccattcgctgggcggcatcaccttggcggcggcgctcggtggcgaataccttggcgagccggccgtggcctcggcggcgtttttcggcacgcaggtcagtcgcacctactggccgttgaaaatcccgccggtggagtggagcagtcgctttatcctcaagcgttttgcccagttgtccggttcacgcctcaagcgcggccctgaggacgagccaatcggtctggccatcgaaagcatgcgctggtacggcttgttcggccggtttggcgacaaggacaaggattggtgggcgggtctggccgatgttcaggtgccggtattggcggtgagcgcggcgggtgatcatcaggatccgacttgggcctgccgcaagttgttcgaacagattggcgccgaacacaagcagttcatcaatctggggcgtgatcagggcttcaacgacaatttcggccatgttgaaatgctggtgagcaaagcggcgcaggttgaagtgtggcccttggtggcgcgctggttgagcgatcagcagacaccgttgctgggtgagaagccggatctggccgcagcagtctga

SEQ ID NO: 1543 - DNA, 990 bp, Pseudomonas sp.
atgcaaagcagcagcaacctatttcctgtcgccctgatcagcgccgaacggcgcggcgatctgagcgaagatgtctatcgcttgaaaccgggcaacagccctgactacagcgtcgaactggcggtcacccgcctgggcatggccgacgcctgcgaggtccgtggggtcccggtgatcctgctgcacggcagtttttccaaccgtcgcttctggtattcgcccaagggcctcggcctgggggcgtatctggcgcggttggggttcgatgtctggattcccgaaatgcgcggccatggcttgtcccaacgaaatcagggctaccgcaacaaccgcgtggccgactacgcccgttatgacttgccggccattggcgcctttgtgcgtgaacaaagcgggcaagtgccacactggattggccattccctgggcggcattaccctggcggctgccttgggcggtcactacctcggcgcgcctgccgtggcgtcggcggcgttcttcggcgcccaggtcagtcgtacttactggccgctgaaaatcccgccggtggaatggagcggacgtttcatcctcaagcgatttgcgcaattgtccggttccaggctcaagcgtggtccggaagatgagcccatcggcctggcactggagagcatgcgctggtatggcctgttcgggcgtttcggtgatgccgagaaaaattggtgggcgggtctcgccgatgtgcaggtgccggtattggcggtgagcgccgccggtgatcagcaggatccgacctgggcctgccgcaaactgttcgaccagatcggttccgagcacaagcagtttgtctgccttgggcgcgagcaaggcttcggcgatgatttcggtcacgtcgaaatgctcgtcagcaaggccgcgcaagccgaggtctggccgctggtggcgcgatggctggacgatcaaggtgcgccgttgttggccgaccagccgcgcctggcccaggcagtttga

SEQ ID NO: 1544 - DNA, 990 bp, Pseudomonas sp.
atgcaaagcagcagcaacctatttcccgtcgccttgatcagtgccgaacgtcgaggcgacctgagtgaagacgtctatcgcctgaagcccggcaacagcccggacaccacggtcgagctggccgtcacccgcctgggaatggcggacgagcccgaatcccgtggcgtgccggtgatcctgctgcacggcagtttctccaatcggcgtttctggtattcgcccaagggcatcggcctgggcgcgtatctggcgcgcatgggcttcgatgtatggatccccgagatgcgtggccacggcctgtcgcgacgtaatgccgactaccgcaagaatcgcgtcgccgactatgcgcaatacgatctgccggccatcggcgctttcgtgcgggaacaaagcggccaggttccgcactggatcggccattccctgggcggcattaccttggcggcggccctgggcggccagtatctgggagagccggcagtggcgtcggcggcgttgttcggttgtcaggtcagccgcacctattggccgttgaaaatcccggcggtggagtggggcggtcgtttcattctcaagcggtttgcccagttgtccggctcgcggctcaagcgcggtcccgaggacgaacccattggcctggccctggaaggcatgcgttggtatgggctgttcgggcgtttcggggatgggcagaaggactggtgggccggtttgtccgatgtttcgctgccggtattggcagtgagcgcggccggggatcatcaggatccgacctgggcctgccgcaagttgtttgaccagttgagttccgatcacaaacagtttgtctgcctggggcgcgaacaagggttcagcggcaatttcggccacgtcgagatgctggtgagcaaagccgcccaggccgaagtctggcctttggtggcgcgttggttgaaggatcagcagagcccgttgttggcatcgagtgccgaactggctgccgcgagttga

SEQ ID NO: 1545 - DNA, 990 bp, Pseudomonas sp.
atgcaaagcagcagcaacctttttcctgtcgccctgatcagcgccgagcggcgcggcgatctgtgcgaagacgtctatcgcttgaaacccggcaacagcccggactacagcgtcgaactcgccgtcacccggctgggcatggccgacgccaccgaaacccgtggcgttcccgtgatcctgttgcatggcagcttttccaaccggcgcttctggtattcgcccaagggtttgggcctgggggcgtacctgacgcgcctggggttcgatgtctggatacccgagatgcgcggccatgggctgtcccagcgcaaccagggctatcgcaacaatcgcgtggccgactacgcccgttacgacttgccggccatcggtgccttcgtgcgggagcagagcgggcaagtgccgcactggatcggccattccctggggggcatcaccctggcggcagccttgggcggccactacctgggggcgccggccgtggcttcggcggcgttctttggcacccaggtcagccgcacctactggccgctgaagatccccccgctggagtggagcggtcggttcatcctcaagcgtttcgcccaattgtccggcgcaaggctcaagcgcggccccgaggacgagcccatcggcctggccttggagagcatgcgttggtacggcctgttcgggcgtttcggcgatgccgagaagaactggtgggcgggccttgccgatgtgcaggtgccggtgctggcggtgagtgcagcgggtgatcaccaggacccgacctgggcctgccgcaaactcttcgagcagatcggttccgagcacaagcagtttgtctgcctgggccgcaagcagggtttcagtgacgatttcggccatgtcgaaatgctggtcagcaaagccgcgcacacggaggtctggcctctggtggcgcgttggctggaggatcagcacgctccgttgctggaaaatctgccggtcctggccgaggcggtttga

SEQ ID NO: 1546 - DNA, 990 bp, Pseudomonas sp.
atgcaaagcagcagcaacctatttccggtcgccttgatcagtgccgagcgtcgaggcgacctcagcgaagatgtctatcgcttgaagcccggcaacagtcccgacccttccgtggagttggccgtcacccgcctggggctggccgatgagcctgaagcccgggggatccccgtggtcctgctgcatggcagcttttccaatcgacgtttctggtattcgcccaagggcatcgggctgggggcctatctggcccgcgcgggattcgatgtgtggatccctgaaatgcgcggtcacggcttgtcgcgccgcaatgccgactaccgcaagaaccgtgtcgccgactacgctcggtacgatttgccggcaattgccgcctttgtccgtgagcaaagtgcgcaggttccccattggatcggtcattccctgggcggcactaccctggctgcggcgttgggcgggcaatacctgggtgatgcgggcgtggcttcggcggcgtttttcggtacccagatcagccgtacctactggccgttgaagatcccgatggtggagtggggtgggcgcctggtgatcaaacgctttgcccagttgtccggctcgcggctcaagcgtggccccgaggacgagcccatcgggctggctctggagagcatgcgctggcatggattgtttggtcgtttcggcgatgccgacaaggattggtgggcgggcctggcgcaggttacggtgcccgcactggcagtcagtgccgcaggagatcatcaggatccgacctgggcctgtcgcaagttgttcgagcaattgggtagcgagcagaaacaatttgtctgcctggggcgcgagcagggattcagcggtaatttcggtcacgtcgagatgctggtgagcaaatcggcgcagactgaggtctggccgctggtcgcgtgctggctcaaggatcagcaggctccattgctggtttctgttgccgaacccgtggctgcggtttga

SEQ ID NO: 1547 - DNA, 990 bp, Pseudomonas sp.
atgcaaagcagcagcaacctgtttcccgtcgccttgatcagcgctgagcgtcgtggcgacctgagtgaagatgtctatcgcctcaagcctggcaacagcccggacggcaccgtagaactggcggtgacacgcctgggcctggccgatgtcgcgcaaagccgtggcataccggtggtgttggtgcatggcagcttttccaatcggcggttctggtattcgcccaaaggtattggcctgggggcgtacctggcgcgccagggctttgatgtgtggatcccggagatgcgcggccacgggctttcccgacgcaaccacgactacgccaagaatcgcgtcgccgactatgctcgttacgacttgccagccatcgccgcttttgtgcttgagcaaagcgcgcagattccgcactggatcggccactcgctgggtggtacgaccttggcggcagccttgggtggccagtatctgggcgcgccggctgtcgcgtcggtggcgctgtttggctgccaggtcagtcgtacttactggccgttgaaaattccgccggtggagtggggcgggcgcttgattctgaagcgttttgcccaactctccggttcgcggctcaagcgcgggccggaagatgagcccatcggcctggccttggaaagcatgcgctggcacggtttgttcgggcgttttggcgatgctgagcgcgactggtggaaaggcctggctgaggtcgatgtgccgctgctggccgtgagtgccgcaggcgatcatcaagacccggactgggcctgccgcaagctgtttgatcaggtcggcagcgagcaccgccaatacctgtgcctggggcgcaagcaggggttcagcggtgatttcgggcatgtcgaaatgctggtcagcaaagccgcccaggccgaagtatggccattggtgcagcgttggttgaatgatccactgacacctttggtcggctcgcaggcgcctgtgctcgggagcatctga

SEQ ID NO: 1548 - DNA, 990 bp, Pseudomonas sp.
atgcaaagcagcagtgatctttttccggtggctttgctcagcgccgagcgtcgtggcgacctgagcgaagatgtctatcgtttgaaaccgggcaacagccccgatctcaccgtcgagctggcggtgacccgccttgggctggccgacgaaccgcaggcccgcggcgtgccggtcattctcctgcatggcagtttttccaaccgacgtttctggttctcgcccaagggcattggcctgggtgcctatctggcgcgggccggtttcgatgtctgggttgcggagatgcgcggccatggcctttccgtgcgcaaccaggattatcgcaagaaccgcgtcgccgattacgcccgttacgatctgccggccatcgcggctttcgttcgtgagcagagtggccagattccacactggatcggccactccctgggcggcacgaccctggcggctgctctgggcggcctgtacctgggcgcgccggcagtggcctcggcggccttgttcggttgccaggtcagtcgtacctattggcccttgaagattccgccggtggagtggagcgggcgtttgctgctcaagcgcttcgcccatctgtcgggctcgcgtctcaagcgcgggccggaggatgagccgatcggcctggcgttggaaagcatgcgttggtatggcctgttcggtcgtttcggtgacaaggagcgcaactggtgggagggtctggccgaggtcgatgtaccggtgctggcggtgagcgccgagggtgaccggcaggacccggcatgggcctgtcgaaagttgttcgagcagatcggttcgccgctcaagcgctttatctgtctgggtcgcgaggccgggttcagctcgccattcgggcacgtcgagatgctggtcagcaaaccggcgcaggccgaagtctggccgttggttgccgattggctgcgcgatccgcaggcttttctgccggttcagtcagccgaggttcagccagcgctctga

SEQ ID NO: 1549 - DNA, 990 bp, Pseudomonas sp.
atgcaaagcagcagtgatctttttccggtggctttgctcagcgccgagcgtcgtggcgatctgagcgaagacgtctatcgtttgaaaccgggcaacagtcccgatgcctcggtcgagctggcggtgacccgcctgggcatggccgacgaaccgcaggcccgtggcgtgccggtcattctcctgcacggcagtttttccaatcggcgtttctggttttcgcccaagggggttggcctgggcgcttatcttgcgcgcgccggattcgatgtctgggtgccggaaatgcgtggtcatggcctgtccgtgcgcaaccaggactatcgcaagaatcgcgtcgccgattacgcccgttatgacctgccggcaatcgcggcgttcgttcgggaacagagtggccagattcctcactggatcggccattccctgggcggcacgaccctggcggcggctctcggcggccagcacctgggagcgcccgccgtggcttcggccgcgctgttcggcagccaggtcagccgtacctactggccgctgaagattccggtggtggagtggagtgggcgttttctgctcaagcgcttcgcccacctgtccggctcgcgtctcaagcgcggcccggaggacgagccgatcggcctggccctggaaagcatgcgctggtacggcctgttcggccgcttcggcgacaaggagcgcaattggtgggagggcctggcggaggtcgacgtgccggtgctggcggtgagcgccgagggcgaccggcaggatccggcctgggcctgtcgcaagttgttcgagcagatcggctcgccgctcaagcgtttcatctgcctggggcgagcggccggtttcagctcggcattcgggcatgtggagatgctggtgagcaagccggcccaaaccgaggtgtggccgctggtggcggactggttgcgcgatcagcaggcttttatggcgcctcagtcaggcgaggttcagcaagcgtcctga

SEQ ID NO: 1550 - DNA, 990 bp, Pseudomonas sp.
atgcaaagcagcagcaacctgtttcccgtcgccttgatcagcgctgagcgtcgtggcgacctgagtgaagatgtgtatcggctgaaacccggcaacagccctgacggtaccgtcgagctggccgtgacccgcctgggcctggctgacgtcccggaaaaccggggcgtgccggtggttttgttgcatggcagtttttccaaccgccgcttctggtactcgcccaaggggatcggcctgggcgcctacctggcgcgcgaagggtttgacgtctggatcccggaaatgcgcggtcacgggctgtcccggcgcaatcaggactacgccaggaatcgtgtcgccgactatgctcgctacgacttgccggccattgccgccttcgtgcgtgagcaaagcgggcagattccccactggatcgggcattccctgggtggcacaaccctggctgcggccttgggtgggcagcaccttggcgcgccggcagtggcctcggtggcgctgtttggctgccaagtcagtcgcacgcattggccgttgaagttgccaccggtggagtggaccggtcgcctgctcttgaaacgtttcggccaattgtccggcgctcggtggaaacgcggcccggaggacgagccggcgggtgtattgattgaagccatgcgctggaatgggctgttcggccgctttggcgaaggtaagcaggattggtggaaaggcctggccgaggttgacgtgccgctgttggcggtgagcgccgccggcgatcaccaggacccggactgggcctgtcgcaagctctttgagcaggtcggctccgggcatcgccaatacctgtgcctggggcgccagcaagggttcagcggggatttcgggcatgtcgagatgctcgtcagcaaggccgcccaggctgaagtgtggccgctggtgacgcgctggttgaaaaatccgcttacacctttgctgggggcgcaggcgcaggaactggcagcggtttga

SEQ ID NO: 1551 - DNA, 990 bp, unknown
  environmental sample
atgcaaagcagcagcaacctgtttcccgtcgccctgatcagcgctgaacgtcgtggcgacctgagtgaagatgtgtaccgcctcaagcccggcaacagccccgacggcaccgtcgagctggcggttacccgtctgggcctggccgatgtcccggaaaaccgcggcatcccggttattctgttgcatggcagtttttccaatcggcgcttctggtactcgcccaagggcatcggcctgggggcttacctggcgcgcctggggtttgatgtatggatcccggaaatgcgtggtcatggcctgtccaagcgcaatcacgactacgtccgcaaccgtgtcgccgactacgcccgttatgatttaccggcgatcggcgcgtttgtgcgcgaacaaagtgcgcaggttccacactggatcggccattccctgggcggcataagcttggcggcagccctgggtgggcggcaccttggcgcgccggcggtggcttccgtggcgctgtttggctgtcaggtcagccgcacccattggccgttgaaactgccaccggttgaatggacggggcgcttgctgttgaaacgtttcggcgagctgtccggctcgcgtttcaagcgcggcccggaggacgaaccggcgggcgtgttgatcgaagcgatgcgctggaatggcctgtttggccgctttggcgaaggtaagcacgattggtggaagggcttggccgaagtcgaggtaccgctgctggccgtcagtgccgccggcgatcatcaagacccggactgggcgtgccgcaagctgtttgagcaggtaggttccgagcatcgccaatacctgtgtctgggtcgccaacagggctttatcggggatttcgggcacgtggaaatgctggtcagcaaagccgcccaggccgaggtgtggccattggtggcgcagtggctgaacgatccgttcacaccgctgttcgccacgccggccgaggtggtggcgacggtttga

SEQ ID NO: 1552 - DNA, 1026 bp, Pseudomonas sp.
atgaggaaatcactactcgccttgctgctcgtgggctgggccggtttcggccaggcgcaggtgccgctccgggagggttacccacagcgctacaccgtggtggcgggcgataccttgtggagcatcgccaaccgctttctgcgcgatccctggcaatggccggcgctctggcaggccaattccagcctcgccgaccccgatctgatctaccccggcgactccctggcgctggtacaggtcaatggcgaaccacgcctgaccctggagcgcggcgcttcccggggtacggtcaaactgtcgcctcaggtgcgccgcacgccgctggccgaggcgatcccgaccattccactgcaggccatcgacagctttctgctgagcaaccgcatcctcgaccgggccgagaccttcgacagtgcgccctacatagtcgccggcgatgccgaacgggtgctcagcggcaccggcgaccggatcttcgcgcgcggccgcttcgacccggaacaatcggcctacggcatcttccgccagggcaagacctacaccgacccgcagagcggcgaagtgctggggatcaacgccgacgagatcggcggcggcgaggtggtcgcggtcgagggcgatatcgccaccctgcaattgcagcgcaccacccaggaagtgcgcctgggcgaccgtttgttcagcggcgagccgcgggtcatcaactcgacctttgtccccagcccgccgagccgggcggtcgagggcctgatcatcgacgtgccacggggcgtcacccagatcggcgcgctggacgtggtgacgctgaacaaggggcggcgcgatggcctggctgaaggcaatgtgctggcggtgctgaagaccggtgaaaccgtgcgcgatcgggtggccggcggccaggtgaagatgccggatgagcgggccggtctgctgatggttttccgcacctacgacaaactcagctacggcctggtgctcaatgcttcccgctccctggcgatcatggacaaggtgcgtaacccgtaa

SEQ ID NO: 1553 - DNA, 1026 bp, Pseudomonas sp.
atgaggaaatcactactcgccttgctgctcgtgggctgggccggtttcggccaggcgcaggtgccgctccgggagggttacccacagcgctacaccgtggtggcgggcgataccttgtggagcatcgccaaccgctttctgcgcgatccctggcaatggccggcgctctggcaggccaattccagcctcgccgaccccgatctgatctaccccggcgactccctggcgctggtacaggtcaatggcgaaccacgcctgaccctggagcgcggcgcttcccggggtacagtcaaactgtcgcctcaggtgcgccgcacgccgctggccgaggcgatcccgaccattccgctgcaggccatcgacagctttctgctgagcaaccgcatcctcgaccgggccgagaccttcgacagtgcgccctacatagtcgccggcgatgccgaacgggtgctcagcggcaccggcgaccggatcttcgcgcgcggccgcttcgacccggaacaatcggcctacggcatcttccgccagggcaagacctacaccgacccgcagagcggcgaagtgctggggatcaacgccgacgagatcggcggcggagaggtggtcgcggtcgagggcgatatcgccaccctgcaattgcagcgcaccacccaggaagtgcgcctgggtgaccgtttgttcagcggcgagccgcggaccatcaactcgacctttgtccccagcccgccgagccgggcggtcgagggcctgatcatcgacgtgccacgaggcgtcacccagatcggcgcgctggacgtggtgacgctgaacaaggggcggcgcgatggcctggctgaaggcaatgtgctggcggtgctgaagaccggtgaaaccgtgcgcgatcgggtggccggcggccaggtgaagatgccggatgagcgggccggtctgctgatggttttccgcacctacgacaagctcagctacggcctggtgctcaacgcttcccgctccctggcgatcatggacaaggtgcgtaacccgtaa

SEQ ID NO: 1554 - DNA, 1026 bp, Pseudomonas sp.
atgaggaaatcactactcgccttgctgctcgtgggctgggccggtttcggccaggcgcaggtgccgctccgggagggttacccacagcgctacaccgtggtggcgggcgataccttgtggagcatcgccaaccgctttctgcgcgatccctggcaatggccggcgctctggcaggccaattccagcctcgccgaccccgacctgatctaccccggcgactccctggcgctggtacaggtcaatggcgaaccacgcctgaccctggagcgcggcgcttcccggggcaccatcaagctgtcgccccaggtgcgccgcacgccgctggccgaggcgatcccgaccattccactgcaggccatcgacagctttctgctgagcaaccgcatcctcgaccgggccgagaccttcgacagtgcgccctacatagtcgccggcgatgccgaacgggtgctcagcggcaccggcgaccggatcttcgcgcgcggccgcttcgacccggaacaatcggcctacggcatcttccgccagggcaagacctacaccgacccgcagagcggcgaagtgctggggatcaacgccgacgagatcggcggcggcgaggtggtcgcggtcgagggcgatatcgccaccctgcaattgcagcgcaccacccaggaagtgcgcctgggcgaccgtttgttcagcggcgagccgcggaccatcaactcgacctttgtccccagcccgccgagccgggcggtcgagggcctgatcatcgacgtgccacggggcgtcacccagatcggtgcgttggacgtggtgacgctgaacaaggggcggcgcgatggcctggctgaaggcaatgtgctggcggtgctgaaaaccggtgaaaccgtgcgcgatcgggtggccggcggccaggtgaagatgccggatgagcgggccggtctgctgatggttttccgcacctacgacaagctcagctacggcctggtgctcaacgcttcccgctccctggcgatcatggacaaggtgcgtaacccgtaa

SEQ ID NO: 1555 - DNA, 1026 bp, Pseudomonas sp.
atgaggaaatcactactcgccttgctgctcgtgggctgggccggtttcggccaggcgcaggtgccgctccgggagggttatccacagcgctacaccgtggtggcgggcgataccttgtggagcatcgccaaccgctttctgcgcgatccctggcaatggccggcgctctggcaggccaattccagccttgccgaccccgatttgatctaccccggcgactccctggcgctggtacagatcaatggtgagccgcgcctgaccctggaacgcggtgcctcccggggcaccctcaagctgtcgccccaggtgcgccgcacgccgctggtcgaggcgatcccgaccattccgctgcaggccatcgacagctttctgctgagcaaccgcatcctcgaccgggccgacgccttcgacagcgcaccctacatagtcgccggcgatgccgaacgggtgctcagcggcaccggcgaccggatcttcgcgcgcggccgcttcgacccggaacagtcggcctacggcatcttccgccagggcaagacctacaccgacccgcagagcggcgaactgctgggaatcaatgccgacgagatcggcggcggcgaggtggtcgcggtcgagggcgatatcgccaccctgcaattgcagcgcaccacccaggaagtacgcctgggcgaccgcttgttcagcggcgagccgcgggtcatcaactcgacctttgttcccagtccgccgagccgggcggtcgagggcctgatcatcgacgtgccacggggcgtcactcagatcggcgcgctggacgtggtgacgctgaacaaggggcggcgcgatggcctggctgaaggcaatgtgttggcggtgctgaaaaccggtgaaaccgtgcgcgatcgggtggccggcggccaggtgaagatgccggatgagcgggccggcctgctgatggttttccgcacctacgacaagctcagctatggcctggtgctcaacgcttcccgctccctggcgatcatggacaaagtgcgtaacccgtaa

SEQ ID NO: 1556 - DNA, 1026 bp, Pseudomonas sp.
atgaggaaatcactactcgccttgctgctcgtgggctgggccggtttcggccaggcgcaggtgccgctccgggagggttatccacagcgctacaccgtggtggcgggcgataccttgtggagcatcgccaaccgctttctgcgcgatccctggcaatggccggcgctctggcaggccaattccagccttgccgaccccgatttgatctaccccggcgactccctggcgctggtacagatcaatggtgagccgcgcctgaccctggaacgcggtgcctcccggggcaccctcaagctgtcgccccaggtgcgccgcacggcgctggtcgaggcgattccgaccattccactgcaggccatcgacagctttctgctgagcaaccgcatcctcgaccgggccgacgccttcgacagcgcgccctacatagtcgccggcgatgccgaacgggtgctcagcggcaccggcgaccggatcttcgcgcgcggccgcttcgacccggaacagtcggcctacggtatcttccgccagggcaagacctacaccgacccgcagagcggcgaactgctgggaatcaatgccgacgagatcggcggcggcgaggtggtcgcggtcgagggcgatatcgccaccctgcaattgcagcgcaccacccaggaagtacgcctgggcgaccgcttgttcagcggcgagccgcgggtcatcaactcgacctttgttcccagtccgccgagccgggcggtcgagggcctgatcatcgacgtgccacggggcgtcacccagatcggcgcgctggacgtggtgacgctgaacaaggggcggcgcgatggcctggctgaaggcaatgtgctggcggtgctgaaaaccggtgaaaccgtgcgcgatcaggtggccggcggccaggtgaagatgccggatgagcgggccggcctgctgatggttttccgcacctacgacaagctcagctatggcctggtgctcaacgcttcccgctccctggcgatcatggacaaagtgcgtaacccgtaa

SEQ ID NO: 1557 - DNA, 1026 bp, Pseudomonas sp.
atgaggaaatcactactcgccttgctgctcgtgggctgggccggtgtcggccaggcgcaggtgccgctccgggagggttatccacagcgctacaccgtggtggcgggcgataccttgtggagcatcgccaaccgctttctgcgcgatccctggcaatggccggcgctctggcaagccaactccagccttgtcgaccccgacctgatctaccccggcgactccctggcgctggtacgggtcaatggcgagccacgcctgaccctggagcgcggcgcttcccggggcaccgtcaagctgtcgccccaggtgcgccgcacgccgctggtcgaggcgatcccgaccatcccactgcaggccatcgacagctttctgctgagcaaccgcatcctcgaccgggccgagaccttcgatagcgctccctacatagtcgccggcgatgccgaacgggtgctcagcggcaccggcgaccggatcttcgcgcgcggccgcttcgacccggaccaatcggcctacggcatcttccgccagggcaagacctacaccgacccgcagagcggcgaagtgctggggatcaacgccgacgagatcggtggcggcgaggtggtcgcggtcgagggcgatatcgccaccctgcaattgcagtgcaccacccaggaagtgcgcctgggcgaccgcttgttcagtggtgagcagcgggtcatcaactcgacctttgtccccagcccgccgagccgggcggtcgagggcctgatcatcgacgtgccacggggcgtcacccagatcggtgcgctggacgtggtgacgctgaacaaggggcggcgcgatggcctggctgaaggcaatgtgctagcggtgctgaaaaccggtgaaaccgtgcgcgatcgggtggccggcggccaggtgaagatgccggatgagcgggccggtctgctgatggttttccgcacctacgacaagctcagctacggcctggtgctcaatgcttcccgctccctggcgatcatggacaaggtgcgtaacccgtaa

SEQ ID NO: 1558 - DNA, 1026 bp, Pseudomonas sp.
atgaggaaatcactactcgccttgctgctcgtgggctgggccggtttcggccaggcgcaggtgccgctccgggagggttatccacagcgctacaccgtagtggcgggcgataccttgtggagcatcgccagccgcttcctgcgcgatccctggcaatggccggcgctctggcaggccaattccagcctcgccgaccccgacctgatctaccccggcgactccctggcgctggtccgggtcgatggcgaaccacgcctgaccctggagcgcggcgcttcccggggcaccgtcaagctctcgccccaggtgcgccgcacgccactggtcgaggcgatcccgagcattccactgcaggccatcgacagctttctgctgagcaaccgcatcctcgaccgggccgacgccttcgacagcgcaccctacatagtcgccggcgatgccgaacgggtactcagcggcactggcgaccggatcttcgcgcgcggccgcttcgacccggagcaatcggcctacggcatcttccgccagggcaagacctacaccgacccgcagagcggcgaactgctgggaatcaatgccgacgaaatcggcggcggcgaggtggtcgcggtcgagggcgatatcgccaccctgcaattgcagcgcactacccaggaagtgcgcctgggcgaccgcctgttcggcggcgagccgcgggtcatcaactcgacctttgtccccagtgcgccgagccgggcggtcgagggcctgatcatcgatgtgccacggggtgtcacccagattggcgcgttggatgtggtgacgttgaacaagggacggcgcgatggcctggctgaaggcaacgtgctggcggtaatgaaaaccggcgaaaccgtacgcgaccgggtggccggtggacaagtgaagatgccggatgagcgggccggtctgctgatggttttccgcacctacgacaagctcagttacggcctggtgctcaacgcttcccgttccctggcgatcatggacaaagtccgtaacccgtaa

SEQ ID NO: 1559 - DNA, 1026 bp, Pseudomonas sp.
atgaggaaatcactactcgccttgctgctcatgggctgggccggtatcggccaggcccaggtgccgctccgggaggaccatccacagcgctacacggtggtggcgggcgataccctgtggagcatcgccagccgctttttgcgcgatccctggcaatggccggcgctctggcaggccaattccaatgttgccgacccctcgcggatctaccccggcgattccctggcgctggtgcgggtcgccggcgaaccgcgcctgaccctggagcgcggcgcctcgcacggcaccctcaagctgtcgccgcaggtgcgtcgcacgccgctggccgaggcgatcccgagcattccattgcaggccatcgacagtttcctgctgggcaaccgcatcctcgaaggggccgacgcgttcgccagcgcgccctacgtcgtcgccggcgatgccgagcgggtgctcagcgggactggcgaccggatcttcgcccgcggccgcttcgacccggaacgacccgcctacggcatcttccgccagggcaagacgtataccgacccacagagcggcgagctgctggggatcaacgccgacgagatcggcggcggcgaggtggttgcggtcgaaggcgatatcgccaccctgcgattgcagcgcaccacccaggaagtgcgcctgggcgaccgcttgttcggtggcgagccgcgggcggtcaacgccaccttcgccccgagcccgccgagtcaggcggtggacggcttgatcatcgacgtaccgcggggcgtcacccagatcggcgcgctggatgtggtgacgctgaacaagggacggcgcgatggcctcgtcgaaggcaatgtgctggcggtgatgaaaaccggcgaaaccgtgcgcgaccgggtggccggcggttcgctgaaaatgccggacgaacgcgccggtctgctgatggttttccgtacgtacgacaagctcagctacggcctggtgctcaatgcttcgcactccctggcggtgctggacaaagtacgcaacccgtaa

SEQ ID NO: 1560 - DNA, 1026 bp, Pseudomonas sp.
atgaggaaatcactactcgccttgctgctcgtgggctggaccggcatcggccaggcccaggtggcgctccgcgaggattatccacagcgctatacggtggtggcgggtgacaccctgtggagcatcgccagccgttatctgcgtgatccctggcagtggccggcgctgtggcaggccaatgccgggctcgccgatcccgacctgatctaccccggcgactccctgacgctgacccgggtcgacggccagccgcgcctgaatcttgcgcgaaccgcttcgcgcggcacgatcaagctctcgcccgaggtacgccgcacgccgctggccgaggcgatcccgagcattccgttgcaggccgtcgagagtttcctgctgagcaaccgcatcctcgaccgggccgatgccttcgaccgcgcaccctatgtggtggccggcgatgccgagcgggtgctcagcggcaccggcgaccggattttcgcccgcggccgtttcgacccggagccgtcgacctacggcatcttccgtcggggcaagacctacaccgaccccggcagcggcgaggtgctggggatcaacgccgacgagatcggcggtggcgaggtggtcgcggtcgagggcgatatcgccaccctgcgcttgctgcgcaccacccaggaagtgcggttgggcgaccgcttgttcggcagcgagccgcgcaccctcgacccggccttcgttcccagcccgccgagccgggcggtcgaggggctgatcatcgacgtgccgcgcggggtgaaccaggtcggcgcgctggacgtggtgacgctgaacaaggggcggcgcgacggcctggcccagggcaatgtgctggcggtgatgaaaaccggcgaaaccgtgcgtgaccgggtggctggcggcgaagtgaagatgcccgacgaacgggccggcctgctgatggtcttccggacctacgacaagctcagctacggcctcgtgctcagcgcttcgcgctcgctggcggtcatggacaaggtacgcaatccgtaa

SEQ ID NO: 1561 - DNA, 1026 bp, Pseudomonas sp.
atgaggaaatcactactcgccctgctgcttctggcgtcggccggtttggcgcacgggcaagtgcaactcaaggaaggttttccacagcaatacaccgtcgtagcgggcgacacgctctgggggatctcggggaaattccttcgcgaaccgtggcagtggcccgagctctggcaagccaatccgcagatcgaaaaccctaacctcatctaccccggcgactcgctgtcgctggtctacgtcaacggcgagccacgcctgacccttaatcgcggcgcctcccgaggcaccatcaagctatcgccacgcgtgcgcagtagcccggtggccgaggcgatcccgagcattccgctgaaatcgatcaacagctttctgctgagcaaccgtatcgtcgacaacgccgaggacttcgacaaggcgccttacatcgtggccggtgatgccgaacgggtcctcagcggcatcggtgaccgcatcttcgcccgcggccacttcgacccggcgcaaccggtctacggcatcttccgtcagggcaaggtctacaccgatccgcagacccaggagtttttggggatcaacgccgatgacattggtggaggcgaaatcgtcgctaccgaaggcgacgtcgccaccctggcactacaacgcaccacccaggaagtgcgcctcggcgaccgtttattcagcggcgaagagcgctcgatcaactcgaccttcatgcccagtgcgccgaaaaccgacatcaacggcttgatcatcgatgtgccgcgtggcgtgacgcagattggtgcgttggacgtggtcacgctgaacaagggccagcgcgatggtctggccgagggcaatgtattggtggtgatgaaaaccggcgaaaccgtgcgggatcgcatcaccggccagccgctgaaaatacccgatgaacgcgccggcctgctgatggttttccgcacctacgacaagctcagctacggactggtgctgaacgcatcacgatccctggcggtaatggacaaggtgcgaaatccgtag

SEQ ID NO: 1562 - DNA, 1026 bp, Pseudomonas sp.
atgaggaaatcactactcgccttgctccttctggcctcggccggttttgcgcacgggcaagtgcaactcagggaaggttttccacagcaatacaccgtggtggcaggggacacactctgggacatttccgctaaatacctgcgtgaaccgtgggaatggccgcagctttggcaggccaatccacagatcgaaaaccccaatctcatctaccctggcgatacgctgtcgctggtctacgtcaacggtcagccacgcctgaccctcaatcgcggcgcttcacgaggcaccctcaagctgtcgccacgaatccgcagctcgccggtggccgatgccattccgagcattccgctgaaatcgatcaacagcttcctgctgagcaatcgcatcgtcgacaaggcagaggattttgacaacgcgccctacatcgtcgccggcgatgccgaacgggtgctcagcggcaccggtgatcgaatattcgcccgtggccattttgacccggcccaaccggtgtacggcatcttccgtcagggcaaggtctacaccgatccgcagagtaaggagtttctggggatcaacgccgacgacatcggtggcggcgagatcattgccactgaaggcgacgtcgccaccctggccttgcaacgcaccacgcaggaagtgcgacttggcgaccggctgttcagcggcgaagagcgctcgatcaattcgaccttcatgcccagtgccccgacaaccgaaatcaacggcttgatcattgatgtgccgcgtggggtcacccagatcggcgcgctggatgtcgtcacgctgaacaaggggcagcgcgatggcctggccgaaggcaatgtattggtggtgatgaaaaccggtgaaaccgtgcgtgaccggattaccggtcagccattgaaaattcccgacgagcgggccggtttgctgatggtcttccgcacctacgacaagctcagttacgggcttgtccttaacgcatcgcgctctttggcggtaatggacaaggtgcgaaatccttaa

SEQ ID NO: 1563 - DNA, 1026 bp, Pseudomonas sp.
atgaggaaatcactactcgccttgctccttctggcctcggccggtttggcgcacgggcaagtgcaactcaaggaaggttttccacagcaatacaccgtggaatccggtgacacactctgggacatatcggggaaattccttcgtgagccgtggaaatggccggagctctggcaggccaatccacagatcgaaaaccccaatctcatctatcccggcgactcgctgtcgctggtctacgtcaatgggcagccacgcctgaccctcaatcgcggcgcttccaggggcaccatcaagctgtcgccacgcgtgcgcagcagcccggttgccgatgcgatcccaagcattccgctgcaatcgatcaacagctttctgctgagcaaccgcatcgtcgacaaggccgaggacttcgacaaggcgccttatatcgtcgccggcgatgccgaacgcgtgctcagtggcaccggtgaccgaatcttcgctcgcggccatttcgacccggctcaaccggtttacggcatcttccgtcagggcaaggtctacatcgatcctgtcagtaaagaatttttggggatcaatgccgacgacatcggcggtggcgagattgtggccaccgaaggcgacgttgccaccctggcgctgcaacgcaccacccaggaagtccgcatcggcgaccgcttgttcagcggtgaagagcgctccatcaattcgaccttcatgcccagtgcgccaaaaacccaggtcaacgggttgatcatcgacgtgccgcgcggggttacccaaattggcgcgatggatgtggtcacgctgaacaagggccagcgcgatggcttggtcgaaggcaacgtgttggtggtgttgaaaaccggtgaaaccgtgcgtgaccggatcaccggtcagccactgaaaatcccggatgagcgcgccggtctgctgatggttttccgcacctatgacaagctcagttacgggctggtgctctacgcatcacgctccctggcggtgctggacaaggtgcgaaatccttaa

SEQ ID NO: 1564 - DNA, 1026 bp, unknown
  environmental sample
atgaggaaatcactactcgccctgctgctcctggcctcggccggtatcgcgcacgggcaagtgcaacttcgggaaggttttccccagcaatacacagtggtgacgggggacacactctgggacatttccggcaaatacctgcgcgagccatggaaatggccggagctctggcaggccaacccgcagatcgaaaaccccaacctgatctatcccggcgataccctgtcgctggtctacgtcaacggccaaccgcgcctgaccctcaatcgcggcgcctcgcgcggcacgatcaagctgtcgccgcgcattcgcagctcgccggtggccgatgccatcccgagcatcccgttgcaagccatcaacagttttttgctgagcaatcgcatcgtcgacacgcctgaggagttcaacagggcgccgtacatcgtcgccggcaacgccgagcgggtcctcagcggcatgggggatcgggtctttgcccgtggcccgttcgatgcgggccagtcggcctacggcatcttccgccagggcaaggtctacaccgaccccgagaccaaggaattcttgggcatcaacgccgacgacatcggcggcggcgaggtggtcgctaccgaagacgacgtcaccaccctgaccctgcagcgcaccactcaggaagtgcgcctgggtgatcgcctgttcagcggcgaagagcgctcgatcaattcgacgttcatgcccagcgcgccgaaatcggacatcaacgggttgatcctggacgtgccccggggcgtgacccagatcggcgcgctggacgtggtcaccctgaacaagggccgccgggacggtctgaccgaaggcaatgtgctggcggtgatgaagaccggggaaaccgtacgcgaccgcatcaccggcgagtcggtgaaaatccccgatgagcgggccggcctgctgatggtgttccgcacttacgacaagctcagctacggcctggtgctgtacgcctcgcgctcgttggcagtgctcgacaaggtccgtaatccataa

SEQ ID NO: 1565 - DNA, 1008 bp, Pseudomonas sp.
ttgctgctgttgggctgggccgcgatcgcccaggcgcaggtgccacttcgggagggttatccacagcgctatacggtggccgcgggcgatacgctgtggagcatcgccggccaattcctgcgtgatccctggcaatggccggcattgtggcaggccaatgcccagatcggtgatcccgacctgctgtatccgggcgatgtcctgaccctggtccaggtttccggccagccgcagctcaacctcgagcgcggcacctcacgcggcaccctcaagttatccccacaagtacggcgtacgcccctggtggacgcgataccggctctgccactgcacgccatcgacagtttcctgctgggcaatcgcattatcgagcgcgaagaggatttccagcaggcgccctatatcgttgccggcgatgccgagcgggtcctggccggcagcggcgaccgggtgttcgcgcgcgggcatttcgacgcggggttgcctgcggcctatggcatcttccgccagggcaaggtctaccgcgatccgcagagccaggaggtattaggcatcaatgccgacgacatcggcggcggcgaggtgttggcgctcgacggtgacctggcgaccttggccctgcaacgcaccacccaggaggtgcgcccgggggatcgcctgttccccagccaggccccgtccgcggcagagaacttcgtgcccagcgcgccggatcgccccgtcgacggcttgatcatcgatgtgccacgcggcgtgacccaggtcggtgccatggatgtggtgaccctggacaagggccggctggacggcctggcacccggcaacgtgctggcggtgatgaagaccggcgaaaccgtgcgcgaccgggtcgccggcggacaagtgaagattcccgacgaacgtgccgggctgctgatggtgtttcgtacctatgaccggctgagctatggattggtgctcagcgcctcgcgttcgctggcagtgcaggacaagctgcgcaacccttga

SEQ ID NO: 1566 - DNA, 1026 bp, Pseudomonas sp.
atgaggaaaacactactcgccctgctgcttctggtctcggccggcgtggcgcaagggcaagtgcaactcagggatggttttccacagcaatacacggtggtttcgggagacacactctgggacatttccggcaaatacctgcgcgagccctggcaatggccacagctgtggcgggccaacccgcaaattgaaaaccccaacctgatctatcccggcgacacgctgacgctgagttatgtcgacggccagcctcgactgaccgtcaatcgcggcgagtcgcgcggcaccatcaaactgtcgccacgcatccgcaccagcccggtggccgaggcgatcccgagcattccgctgaaatcgatcaacgcctttctgctgagcaaccgcatcgtcgacaaggtcgaggacttcgacaaggcaccctatatcgtcgccggcgatgcggagcgggtgctttccggcaccggtgaccggatttatgcccgtggccatttcgaccccagtcagccggtgtacggcatcttccgccagggcaaggtctacaccgacccgcagaccaaggagttcctggggatcaacgccgatgacgttggtggcggcgaaatcgttgccaccgaaggcgatgtcgccaccctcgccctgcaacgcaccacgcaggaagtgcgcctcggcgaccgtttgttcagcggcgaagagcgctcgatcaattcgaccttcatgcccagcgccccgagcaccaacatcaacggtgtgatcatcgacgtgccgcgcggcgtcacgcagatcggcgtgatggacgtggtcaccctgaacaagggccagcgcgacggcctggtcgagggcaacgttctggcagtgatgaaaaccggggaaaccgtacgtgaccgggtaactggccagccgttgaaaatccccgacgaacgcgccggtttgctgatggtgttccgcacctacgaaaaaatcagttatggcctggtactcaacgcatcgcgctcgctggcggtgctcgacaaggtacgaaatccttag

SEQ ID NO: 1567 - DNA, 1023 bp, Pseudomonas sp.
atgaggaaatcactactcgccctgctgctgaccgccagcggtcttgcgcaggcgcaagtgcaactcagggaaggctatccgcaaagctacaccgttgtcgccggggacacactctgggacatttccggcaagttcttgcgtgaaccgtggaaatggcgcgagatctggcgggccaatccgcaagtccatgatcccgacctgatctaccccggtgacaccctcgcgctgacctgggtcgatggtcagccgcgtgtgacgctcaatcggggcgagtcgcgcgggaccatcaaattgtcaccgcgtgtgcgcagtacgccgatggtcgaggccattccgagcattccgctgggggcgatcaacgcattcctgatcagcaaccggattgtcgacaacgccgagcagttcgagaaagccccctacatcgttgcgggcaatgccgagcgcgtgctcagtggcaacggtgatcgtgcctatgcacggggctcgctggacccggcgcacagcgtctatggcatcttccgtcagggcaagacctacatcgatccggagaccaaggaagtactgggcatcaacgccgatgacgtcggcagcgccgaggtggttgccaccgaaggtgacgtctcgaccctgattctgcagcgctccacgcaggaagtgcgtctgggcgatcgcttgttcagcagcgaagagcgggccatcaactcgacgttcctgcccagcgctccgcaggcgccgatagaaggtttgattctggatgtgccacgcggggtgacccaggtcagcgtgctggatgtggtcaccctcaacaaaggcaaacgtgacggcctggccgagggcaacgtgctggcgatctacaaaaccagcgagacagtgcgcgaccggatcaccggtgaacaggtaaaaatccctgacgaacggtctggcctgctcatggttttccgtacgtacgacaagcttagttacgccttggtcctgcaagccaaccgatctttggccatcatggacaaggttcgaaatccttaa

SEQ ID NO: 1568 - DNA, 1026 bp, unknown
  environmental sample
atgaggaaaacactactcgccctgctgctgttgaccgccagtggtcttgcgcaggcgcaagtgcagctcagggaaggtcatccgcagcgttacaccgtggttgccggcgacacgctgtgggatatttccggcaaattcctgcgcgagccctggcgctggaaggaactctggcgcgccaacccgtcgatccgggacccggacctgatctaccccggcgacaccctgtcgctgacctacatcaacggcgagccgcatgtgcaactgacgcgtggcgaatcacgcggcactatcaagctgtcgccgcgcatccgcagcacgccgacggtcgaggccatcccgagcattccgctgggtgcgatcaacgcctttctgatcagcaaccgcatcgtcgacagccccgagcagttccagcaggcgccgtacatcgtcgccggcaatgccgagcgcgtgctcagcggccagggcgaccgcctgtatgcgcgtggcaacctggattctgtgaatcgggtgtatggcattttccgccagggcaagacctacaccgacccggtcaccagggaagtgctgggcatcaatgccgacgatatcggcagcggcgaggtggtcgccaccgaaggcgatgtctcgaccctggtgctgcaacgcaccacccaggaagtacgcctgggcgaccgcctgtttgccagcgaagagcggccggtcaattcgaccttcatgccgacgccgccggtctcgaacatcgacgggctgatcatcgacgtgccgcgcggagtgacccaggtcgccgagtacgacgtggtgaccctggatcgcggccgccgcgatggcctcgaagaaggcaacgtactggccatctacaagaccggcgagcaggtgcgcgaccgtgtcaccggtgagcaggtgaagattcctgacgagcgcgcagggctgctgatggtgtttcgcacctatgacaagctcagttacgccttggtcctgcacgccacccgatccttggccattatggacaaggtccgcaatccctaa

SEQ ID NO: 1569 - DNA, 1026 bp, Pseudomonas sp.
atgaggaaatcactcgtcgccctgctgctggtggctgtcgggggcgtcgcccaggcggcggtgcagctcaagcagggccatccggagcagtatcgggtggtcaagggggatacgctctgggacatctccggccggttcctcgaccagccttggaagtggccggaactctggcacgccaatccgcagatcgagaacccgcacctcatctatcccggtgacaccctcagcctcgtctacgtcgacggccagccgcggctgatgctcgatcgcggcgagtcgcgcggtaccgtcaagctgtcgccgcgcatccgctccacgccggtggccgaagccattcccaccattccgctggaagcgatcaacagcttcctggtcaacaaccgggtgatcgacagcatcgaactgttcgaaggcgccccctacgtggtcgccggcaatgccgagcgggtgatcagcggcaagggcgaccgtgtctacgcccgcggccagttcgacgaggagctgcccgcctacggcatcttccgccagggcaagacctacctcgacccggagaccggcgagttcctcggcatcaacgccgacgacatcggcggcggcgacctggtcgccaccgagggcgacatcgccaccctgcggctgaaccgcgtcacccaggaagtgcgtctcggcgaccgcctgttccccaccgaggagcgcgcgatcaactccagcttccagccgagctcgccggcgaccgacgtccagggcgtgatcctcgacgtgccgcgcggcgtgacccagatcggccagttcgacgtggtggcgctcaaccgcggcgcccgcgatggcctggccgagggcaacgtgctcgcggtctacaagaccggcgagacggtgcgcgaccgggtcaccggcgagcgggtgaagatccccgacgagcgcgccggcctgctgatggtgttccgcacctacgacaagctgagctacggcctggtgctgcaggccacccgctcgctggcggtgctggacaaggtacgtaacccctga

SEQ ID NO: 1570 - DNA, 243 bp, Pseudomonas sp.
atgaatagcgcccttcttctatcgaatgccattgccatcgccgtactggtggtcttccactttcagcctgatggcagcgctgatcagagtacccaatacagggcccactacgtgcaacaccaggccccgcaatgggctgtgatgagcagcacgtcggagaatcctggcatggcgcagatcgtcgatgccccagaagccgttgttctacctgccaacccaagacccgaaagctgggtattttga

SEQ ID NO: 1571 - DNA, 243 bp, Pseudomonas sp.
atgaacagcgcccttcttctatcgaatgccattgccatcgccgtactggtggtcttccactttcagcctgatggcagcgcggatcagagcccccagtacagggcccactacgcgcaacaccaggccccgcaattggctgtgatgagcagcgcatcggagaatcctggcatggcacaggtcgccgatgccccagaagccgttgttctacctgccaatccaagacccgaaagctgggtattttga

SEQ ID NO: 1572 - DNA, 243 bp, Pseudomonas sp.
atgaacagcgcccttcttctatcgaatgccattgccatcgccgtactggtggtcttccactttcagcctgatggcagcgctgatcagagcacccagtacagggcccactacgtgcaacaccaggccccgcaattggctgtgatgagcagcgcattggagaatcctggcatggcgcgggtcgccgatgacccggaagccgttgttctacctgccaatccaagacccgaaagctgggtattttga

SEQ ID NO: 1573 - DNA, 243 bp, Pseudomonas sp.
atgaacagcgcccttcttctatcgaatgccattgccatcgccgtactggtgatcttccactttcagcctgatggcagcgctgatcagagtacccagtacagggcccactccgtgcaacaccaggccccgcaatgggctgtgatgagcagcacatcggagaatcctggtatgacgcaggtctccgataccccggaagccattgttctacctgccaacccaagacccgaaagctgggtattttga

SEQ ID NO: 1574 - DNA, 1080 bp, Pseudomonas sp.
atgggcaaccaggtctttgccaacaatatggaggtttcctgcaaggcggccgatggcaagtcggtggcctgctttccggatgtctgcttcaccccgccccaggctccgccgacaccgacaggggtgcccattccctaccccaatacgggtatggccaaggacaccaccaagggcagtcggacggtgaagatcacccgtaaagaggtgatgctgaagaacaagagttacttcaagaccagctatggagacgaggccggttgcgcgccgaaaaagggcgtcatcaccagcaagatcaaaggcaaggtgtatttcaattcctggtcgatggatgtgaagttcgagggagagaatgtggtcaggaatatggatctgaccacccataaccatgcgtcgcagccgggtaatagcccaacctggccctatattgacacggccgcggcggccaacagttcccatccctgccacaacgtagtgaaggggctgaaggataacaattgccagcgtcatgtcgatgcaaacacctactccacagacgcgatcaatcgggccggagcatcagaggccttgtgtggcgatccaaaatgcaaaaaggcgatggagtgcgtgcttacaccctatgaaccatcgaactgctgcgatgggaaaacaccacaccatatagtgcctaaatcacaattcaaggagagagggaaaggtggcaaggcgctcctgctcgatgcacaaggagccaataagtacgaccccaacaaggcgccatgcatttgcgaagatggccatagccattccactggaacgcacggcgacattcatgaagagacgaacctcctcacggtgaaccatccgaccgttaagccaaaagtcaccggcaagaccattgcatcggatgcacgatggagtgttgccgaagccgaagcagttggagcggaagccgcccagaaaggggggagtaaatgcgataaggagtgcacgaaaagccaagtaagagaaagccatcaaaagatgaatatcggcccgaccgagcaaatccgtccgtcaacggccggacgcgttccagaaccttcaaatccgacaactttctga

SEQ ID NO: 1575 - DNA, 1086 bp, Pseudomonas sp.
atggccaacgaggtctatgccaacaacatggaagtgtcgtgcaagtcggccgacggcaagtccatcgcctgcttccccgacgtctgcttcactccaccgcagacacctgccaccccgcccggcgtgcccatcccctaccccaacaccggcatggccaaggacaccaccaacggcacccgtacggtaaagatcaccggcaaggaagtaatgctcaagaacaagagctacttcaaaaccagctacggcgacgaggccggctgcgcgccgaagaagggtgtgattaccagcaagatcaagggcaaggtgtatttcacctcatggtcgatggatgtgaagttcgagggggaaaatgtcgttcggaacttggatatgacgacgcacaaccatgcgtcaatgccggggaatacgcctctctggccgtatatcgacgcagttgcagcggcggctaacccttccgatccctgtcataaagtcaccaaaggcttggctgataatgattgccagcggcatgtcaaagccaatacgtactccaccggttcggtgaacagggctggagcttccgaagcgctatgcaacgatcccaaatgcaaggcggcgatggcctgtgtcctgaccccctacagtccatcaaattgctgtgacggaaaaacacctcaccatatcgtgccaaagtcccagttcaaggagcgtggcaaaggcggcaaggctctgttgctggattccaacggcgataacaagtacgacccagacaaagccccttgcatctgtgaggatggacacagccattccaccggcacccatggtgacatccatgaggagaccaacttgttaacggtaacgcacccgaaggtgtctccacacgtgactggaaagacgatcgatcccaatgctcgttgggacgtcgctgatgcggaagccgttggtgcaaaggccaccaaaaaaggtggcagccagtgcgatgaggaatgcactaaaagtcaggtaagagctggtcaccagcagatgggcatcggaccgaatgacaagatacgtccttcgaccgccggccatgtgccggaaccctccaacccaaccactttcccatag

SEQ ID NO: 1576 - DNA, 1083 bp, Pseudomonas sp.
atgaccaatgaggtctatgccaacaaccgggagatttcctgcaaggcagccagcggcaaatccatcgccgcctttcccgacgtctgcttcaccccgccgcagacaccgccgatgcctctgggcatcccgatcccgtaccccaacaccgggctgtccaaggacaccaccaagggcacgcgcaccatccgcatcacccgcaaggaagtgatgctcaagaacaagagctactacaagaccagctacggcgacgaacccggccgcgccccgaagaaaggcatcatcaccagcaagatcaagggcaaggtgtacttcacctcctggtcgatggacgtcaagttcgaaggcaagaacgtggtgcgacatatggatctgacgacccataaccatgggtcgtttccagggaatacgccgacctggccgtatctggatcagatggcggcagcgcagaatcctaacgacccttgcagcaacgtagcaaaggggttggcagataacgactgtaaccgccatatcaaagccaatacttcttcaacaggtagcgtcaaccgtaaagcggcatctgcagcgctatgtgcagacgataaatgcaaagaatccatggcctgcgtattgacaccttattcaccatcgaactgctgcgacgggaaaactcctcaccacatcgtacctaagtcgcaattcaaggagcttggcaaagctggtaaagcattgctactcgataaagccggcgaaaacaaatacgacccagataaggcaccttgtatctgtgaggatggccacagccattccacgggaacgcacggagacatacacgaggaaaccaacttgttaactgttggacacccaaaagtcgctccgcatgtaacaggtaagagcatttcccccaatgcccgctgggatgtggctgacgcggaagccgtaggtgcgaaagctacgaaaaagggaggagctcagtgcaatgaggagtgcactcaaaagcaagtccgcgctagccaccaacaaatgggcattttgccaaatgacaagatccgcccgactactgcgggtcgggtaccagagcctgtagatacgcagactttctag

SEQ ID NO: 1577 - DNA, 1245 bp, Pseudomonas sp.
atgacgcagacttcccctcgctcattgctggccgcccgtatcggcctgaccctcgcccttggcctgctggccacccacgccagcgccgccccccacccccaggtacagaacgatgcgcagcaatatcagggcgacgccctgaaactgctggagcgcctggtgaacatcgactcgggctccggctacgaggcggggctgaaccaggtgagcgacatcgccatcgccgagctggaaaaactcggcgccagtatcgagaaagtccccaacggcgctgccggcggaagccatgtgctggccaccctcaagggcaccggcaaggccaggatcctgctgatggcgcacatggacacggtgttcaaggaaggcaccgcggccgagcggccgttccgcatccaggacggtcgcgcctacggccccggggtgatggacgacaagggcggcatcgtcgccgggatctatgcgctgaaggtcctggataacctcaagttcaaggactacgcacagatcaccttcctgctcgacgccagcgaggaaaccggttccgagatcgctaccgacttgatcaagaaaaccgccaaggcccacgacgtgaccttgaacctggaaccggggcgcccggccgatggcctggtggtgtggcgcaagggcagcgccacggcgctggtcgaggtcaagggcaaggcggctcacgccggggtcgcgccggagctggggcgcaacgcggcgatggaagcggcgcaccagatcctgcaactgggcaagctgggggatgaagcgaagaaaaccaccatcaacttcaccgtgctcaaggccggcgaccgcaccaacgtgattcccgaccaggccaccgccaaggcggatgtgcgggcggcggtgccggaggagttcgaccgcatcgagaaggacctggcgcgggtgtcggccaacaagctgatcgccgacaccgaggtcaagaccaccttgcaacgcggcttgccgccgatgccgcagaccgagcagtccgatgcgctggtggccatggcccagggcatctacggcgagctggggcgcaagctgaccatcgagggcagcggcggggcggcggactccagcctgtcggccggcgtcggtacgccgaccctggatggcttcggcatcgtcggcggcaatatccacacccccgaggaatacgccgaagtcgagagcgtggcgccgcgcatctacctgctggcgcggatgatcatggagctgtcggccaagcagtga

SEQ ID NO: 1578 - DNA, 1245 bp, Pseudomonas sp.
atgacgcagacttcccctcgctcattgctggccgcccgtatcggcctgaccctcgcccttggcctgctggccacccacgccagcgccgccccccacccccaggtacagaacgatgcgcagcaatatcagggcgacgccctgaaactgctggagcgcctggtgaacatcgactcgggctccggctacgaggcggggctgaaccaggtgagcgacatcgccatcgccgagctggaaaaactcggcgccagtatcgagaaagtccccaacggcgctgccggcggaagccatgtgctggccaccctcaagggcaccggcaaggccaggatcctgctgatggcgcacatggacacggtgttcaaggaaggcaccgcggccgagcggccgttccgcatccaggacggtcgcgcctacggccccggggtgatggacgacaagggcggcatcgtcgccgggatctatgcgctgaaggtcctggataacctcaagttcaaggactacgcacagatcaccttcctgctcgacgccagcgaggaaaccggttccgagatcgctaccgacttgatcaagaaaaccgccaaggcccacgacgtgaccttgaacctggaaccggggcgcccggccgatggcctggtggtgtggcgcaagggcagcgccacggcgctggtcgaggtcaagggcaaggcggctcacgccggcgtcgcgccggagctggggcgcaacgcggcgatggaggcggcgcaccagatcctgcaactgggcaagctgggggatgaagcgaagaaaaccaccatcaacttcaccgtgctcaaggccggcgaccgcaccaacgtgattcccgaccaggccaccgccaaggcggatgtgcgggcggcggtgccggaggagttcgaccgcatcgagaaggacctggcgcgggtctcggccaataagctgatcgccgataccgaagtcaagaccaccctgcaacgcggcttgccgccgatgccgcagaccgagcagtccgatgcgctggtggccatggcccagggcatctacggcgagctggggcgcaagctgaccatcgagggcagcggcggggcggcggactccagcctgtcggccggcgtcggtacgccgaccctggatggcttcggcatcgtcggcggcaatatccacacccccgaggagtacgccgaagtcgagagcgtggcgccgcgcatctacctgctggcgcggatgatcatggagctgtcgaccaagcagtga

SEQ ID NO: 1579 - DNA, 1245 bp, Pseudomonas sp.
atgacgcagacttcccctcgctcattgctggccgcccgtatcggcctgaccctcgcccttggcctgctggccacccaggctatcgccgaaccccacccacaagtacacaacgatgcgcagcaataccagggcgatgccctgaaactgctggagcgcctggtgaacatcgactcgggctccggctacgaggcggggctgaaccaggtgagcgacatcgccatcgccgaactgaaaaagctcggcgccagcatcgaaaaagtccccaacggcgctgccggcggcagccatgtgctggccaccctcaagggcaccggcaaggccaggatcctgctgatggcgcacatggacacggtgttcaaggaaggcaccgcggccgagcggccgttccgcatccaggatggccgcgcctacggccccggggtgatggacgacaagggcggcatagtcgccgggatctatgcgctgaaggtcctggataacctcaagttcaaggactacgcacagatcaccttcctgctcgacgccagcgaggaaaccggttccgagatcgctaccgacttgatcaagaaaaccgccaaggcccacgacgtgaccctgaacctggaaccggggcgcccggccgatggcctggtggtgtggcgcaagggcagcgccacggcgctggtggaggtcaagggcaaggccgctcacgccggcgtcgcgccggagctggggcgcaacgcggcgatggaagcggcgcaccagatcctgcaactgggcaagctgggggatgaagcgaagaaaaccaccatcaacttcaccgtgctcaaggccggcgaccgcaccaatgtgattcccgaccaggccatcgccaaggcggatgtgcgggcggcggtgccggaggagttcgaccgcatcgagaaggacctggcgcgggtttcggccaacaagctgatcgccgacaccgaagtcaagaccaccttgcagcgcggtttgccgccgatgccgcagaccgagaagtccgacgcgctggtggccatggcccagggcatctacggcgagctggggcgcaagctgactatcgagggcagcggcggggcggcggactccagcctgtcggccggtgtcggtacgccgaccctggatggcttcggcatcgtcggcggcaatatccacacccccgaggagtacgccgaagtcgacagcgtggcgccgcgcatctacctgctggcgcggatgatcatggagctgtcggccaagcactga

SEQ ID NO: 1580 - DNA, 1245 bp, Pseudomonas sp.
atgacgcagacttcccctcgctcattgctggccgcccgtatcggcctgaccctcgcccttggcctgctggccacccacgccagcgccgccccccacccacaagtgcagaacgatgcgcagcaataccagggcgacgccctgaaactgctggagcgtctggtgaacatcgactcgggctccggctacgaggcggggctggaccaggtgagcgacatcgccatcgccgagctgaagaagcttggcgccagcatcgaaaaagtccccaacggcacggccggcggcagccatgtgctggccacgctcaagggcaccggcaaggcgaggatcctgctgatggcgcacatggacacggtgttcaaggaaggcaccgcggccgagcggccgttccgcatccaggacggtcgcgcctacggccccggggtgatggacgacaagggcggcatcgtcgccgggatctacgcgctgaaggtcctggataacctcaagttcaaggactatgcacagatcaccttcctgctcgacgccagcgaggaaaccggttcggagatcgccaccgagctgatcaagaaaaccgccaaggcccacgacgtgaccttgaacctggaaccggggcgcccggccgatggcctggtggtgtggcgcaagggcagcgccacggcgctggtggaggtcaagggcaaggccgctcacgcaggcgtcgcgccggagctggggcgcaacgcggcgatggaggcggcgcaccagatcctgcaactgggcaagctgggggatgaagagaagaaaaccaccatcaacttcaccgtgctcaaggccggcgaccggaccaatgtgattcccgaccaggccaccgccaaggcggatgtgcgggcggcggtgccggaggagttcgaccgcatcgagcaggatctggcgcgggtctcggccaacaagctgatcgccgacaccgaagtcaagaccaccttgcagcgcggtttgccgccgatgccgcagaccgagaagtccgatgcgctggtggccatggcccagggcatctacggcgaactggggcgcaagctgaccatcgagggcagcggcggggcggcggactccagcctgtcggccggcgtcggcacgccgaccctggatggcttcggcatcgtcggcggcaatatccacacccccgaggagtacgccgaagtcgagagcgtggcgccacggatctacctgctggcgcggatgatcatggagctgtcggccaagcgctga

SEQ ID NO: 1581 - DNA, 1245 bp, Pseudomonas sp.
atgacgcagacaccgcctcgctcgttactggccgcccgtatcggcctgaccctcgcccttgccctgctggcctcccaggccatcgccgcgcctcatccgcaagtccacaacgatgcccaacgctaccaggacgacgccctgaaactgctggagcgcctggtgaatatcgactccggttccggctatggggcagggctggaccaggtgagcgacatcgccgtcgccgagctacaaaagctcggcgccagcatcgagaaagtccccaacggcagcgccggcggcagccatgtgctggccaccctcaagggcaccggcaaggccaggatcctgctgatggcgcacatggacacggtgttcaaggaaggcaccgcggccgagcggccgttccgtatccaggacggtcgcgcctacggccccggggtgatggacgacaagggcggcatcgtcgccgggatctacgcgctgaaggtcctggataacctcaagttcaaggactacgcgcagatcaccttcctgctcgacgccagcgaggaaaccggctcgcagatcgccaccgagctgatcaagaacaccgccaaggcccacgacgtgaccctcaacctggaaccggggcgcccggccgacggcctggtggtctggcgcaagggcagcgccacggcgctggtggaggtcaagggcaaggccgcccacgccggcgtggcgccggagctggggcgcaacgcggcgatggaggtcgcgcaccaggttctacaactgggcaagctgggcgacgaagagaagaaaaccaccatcaacttcaccgtgctcaaggccggcgaccgcaccaacgtgatccccgaccaggccctggccaaggccgatgtgcgggcggcggtgccggaggagttcgaccgcatcgaaaaggacctggcgcgggtctcggccaacaagctgatcgccgacaccgaggtcaagaccagcctgcaacgcggcttgccgccgatgccgcggaccgagaagtccgacgcgctggtggccatggcccagggcatctacggcgagctggggcgcaagctgaccatcgaaggcagcggcggcgcggcggactccagcctgtcggccggcgtcggcaccccgaccctggacggcttcggcatcgtcggcggcaatatccatacgccggaggaatacgccgaggtcgacagcgtggcgccgcggatctatctgctggcgcggatgctcatggagctgtcggccaagcaatga

SEQ ID NO: 1582 - DNA, 1245 bp, Pseudomonas sp.
atgacgcagacttcccctcgctcgttgctcgccgcccgtatcggcctggctctcgccctgggcctgctggccccccaagtgatcgctgccccccacgcccaaatacacgaggccgcccggcattctcaggacgatgccctgaaactgctggagcgcctggtgaacatcgactccggttccggctatggggccgggctcgaccaggtgagcgatatcgccgtcgccgagttgcagaagctcggcgccacgatcgagaaggtccccaatggcagcgccggcggcagccatgtgctggccaccctcaagggcaccggcaaggccaggatcctgctgatggcgcacatggacacggtgttcaaggaaggcaccgcggccgagcggccgttccgcatccacgacgggcgcgcctacggcccgggggtgatggacgacaagggtggcatcgtcgccgggatctatgcgctgaaggtcctggataacctcaagttcaaggactatgcgcagatcacgttcctgctcgatgccagcgaggaaaccggctccgagatcgccactgaactgatcaagaaaaccgccaaggcccatgacgtgaccttgaacctggagccggggcgcccggccgatggcctggtggtatggcgcaagggcagcgccacggcgctggtggaggtcaagggcaaggcggcccacgccggggtcgccccggagctggggcgcaatgcggcgatggaggcggcgcaccagatcctgcaactgggcaagctgggggacgaggaaaagaaaaccaccatcaacttcaccgtgctcaaggccggcgaccgcaccaacgtgatccccgacctggccctggccaaggccgacgtgcgggcggcggtgccggaggagttcgaccgtatcgagcgggacctggcgcgggtttcggccaacaagctgatcgccgacaccgaggtcaagaccagcctgcaacgtggcctgccgccgatgccgcagaccgagcaatccgcggcgctggtggccatggcccagggcatctacggcgagctggggcgcaagctgaccatcgagggcagcggcggcgcggcggattccagcctgtcggcgggtgtcggcacgccgaccctggatggcttcggcatcgtcggcggcaacatccatacgccggaggaatacgccgaggtcgacagcgtggcgccgcggatctacctgctggcgcgaatgatcatggaactgtcggccaagccctga

SEQ ID NO: 1583 - DNA, 1239 bp, Pseudomonas sp.
atgacgttctcatttccccgctctctgctggccgccagcctcggtctgtccctcgcgctctcggccgtaaacgctttcgccgaaccgcataaacaagtgctcgccgatgccgagcagtaccagcccgaagccctgaagttactggagcgactggtcaatatcgactccggttccggttatgaaccgggcctgaaacaggtcagcgacattgccatcgatgagctgaaaaaactcggcgcaaccatcgaactggtacccaacacgccggaaaaatccaaccacgtgctggccacgctcaaaggcaccggcaaggcaaaaatcctgctgatggcgcacatggacacggtgttcaaggaaggctcggctgccgagcgaccattccacatcaaggacggccgtgcctacgggccgggggtgatggacgacaagggcggcatcgtcgccggtatctacgcgctgaaagtgctgaagaacctcgatttcaaagactatgcgcagatcaccttcctgctcgacgccagcgaagaaaccggctcggacgtcgctaccgacctgatcaagaaaaccgccaaacagcacgatgtgaccctcaacctcgaaccgggccgcccggccgatggcctggtggtgtggcgcaagggcagtgcgacggcgctggtcgaagtcaaaggcaaagccgcccacgctggtgtcgcgccagagctgggacggaacgcggcaatggaagcggcgcatcagattctgcaactgggcaagctcggcgatgaagcgaagaagaccaccatcaacttcaccgtgctcaaggccggcgatcgcaccaacgtgattccggatcaggccacggccaaggcggatgtgcgtgcggcggtgccggaggagtttgatcgcatcgagaaggatctggcgcgggtgtcgcaggacaagttgattgccgagaccgaagtgaaaacgtccttgcagcgcggtttgccgccgatgccacaaacggccgagtcggatcgcctgatggccatggcccagggaatttacggcgagattggccgcaagctgaccgaggagggcagtggtggcgcggcggatgcgagtctgtctgcaggcgttgggacgccgacgctggatggcttcggcattgtcggcggcaatattcacacgcctgaggaatatgccgaggtggcgagcgtggcgccgcggatttatctgttgtcgcggatgattatggagttggccaagccgcggtga

SEQ ID NO: 1584 - DNA, 1236 bp, Pseudomonas sp.
atgacgttctcatttccccgctccctgctggccgccagcctcggtctgtccctcgcgttctcggccgcaaacgccgctgaaccgcataagcaagtgctcgccgatgccgagcagtaccagcccgaagcgctgaagttattggaacgactggtcaatatcgactccggatccggctatgaaccgggcctgaaacaggtcagcgacatcgccatcgatgagctcaaaaaacttggcgcaaccattgaattggtgccgaacacgccggaaaaatccaaccacgtgctggccacgttcaaaggcaccggcaaggcaaaaatccttctgatggcgcacatggacacggtgttcaaggaaggctccgctgccgagcggccatttcacatcaaggacggccgtgcctacgggccgggggtgatggacgacaagggcgggatcgtcgccggtatctacgcgctgaaagtgctgaaaaacctcgacttcaaggattacgcgcagatcactttcctgctcgacgccagcgaagaaaccggctcggacgttgctaccgacctgatcaagaaaaccgccaaacagcacgatgtgaccctcaacctcgaaccgggccgcccggccgatggcctggtggtgtggcgcaagggcagtgcgacggcgctggtcgaagtcaaaggcaaggccgcccacgccggcgtcgcgccagagcttggacggaacgcggcgatggaagcggcgcatcagattctgcaactgggcaagcttggcgatgaggcgaagaaaaccaccatcaacttcaccgtgctcaaggccggtgatcgcaccaacgtgattcctgatcaggccacggccaaggcggatgtgcgcgcggcggtgccggaagagttcgatcgcatcgagaaggatctggcgcgggtctcgcaggacaaactcatagctgaaaccgaagtgaagacttccttgcaacgcggtttgccgccgatgccgcagacggccgagtcggatcgtttgatggccatggcgcaggggatttacggtgagatcggccgccagttgacggaagagggcagcggtggcgcggcggatgccagcctgtctgccggggtggggacgccgacgctggatggattcgggattgtcggcggcaatattcacaccccgcaagaatatgccgaagtggcgagcgtggcgccgcggatttatctgttgtcgcggatgatcatggaactggccaaaccgcgatga

SEQ ID NO: 1585 - DNA, 1242 bp, Pseudomonas sp.
atgacgttcaaacgctctcgctccctcctggccaccagccttggcctgaccctcgccctcggcgccttcacccccgcagctttcgccgaacctcacaaacaagtcctcgccgatgccgaacagtacaaaggtgaagccctgaaactgctggaacggttggtgaacattgactccggctccggttatgagccgggcctgacccaagtgagcgacatcgccatcgaagagttgaagaaactcggtgccactatcgaactcgtgcccaacactccggacaagagcaaccatgtgctggccacgcttaaaggcaccggcacggcgaaaatcctgctgatggcgcacatggacaccgtgttcaaggaaggctccgccgccgcgcgcccgttccacatcaaggacggccgcgcctacgggccgggcgtgatggacgacaagggcggcatcgtcgccgggatctatgcactgaaggtcctgaaaaacctggatttcaaggattatgcgcagatcaccttcctgctcgatgccagcgaagaaaccggctcggacgtcgccaccaacctgatcaagaaaaccgccaaggcccacgacgtaacactcaacctcgaaccgggccgcccggcggatggtttggtggtatggcgcaaaggcagcgccaccgctgtggtggaggtcaagggcaaggcctctcacgctggcgttgcgccggaactggggcgtaacgcggccatggaagcggcgcaccagatcctgcaactcggcaaactgggcgatgcgcagaagaaaaccaccatcaactttaccgtgctcaatgctggcgatcgcaccaacgtgattccggatcaggccaccgccaaggctgacgtgcgggcagcggtgccggaagagttcgaccggatcgaaaaagacctggcacgagtctccaaggacaagctgattcccgagactgaagtcaccactacccttaaacgcggcttgccaccgatgccgcaaacggcggagtcggatcgcttgatggccatggcccaggggatttacggcgaaattggccgcaagctgacggaagaaggtagcggcggggcggcggatgccagcctctcggccggggtgggtacgccgacgctggatgggttcgggattgtcggcgggaatattcatacacccgaggaatacgccgaggtcgagagcgtggcgccacggatttatctgctgtcgcggatgattatggagttgaccaagaagtaa

SEQ ID NO: 1586 - DNA, 1239 bp, unknown
  environmental sample
atgcgtgcatttccccgctcccctttggccttgcgccttggccttgccctcgctttgaccgccctcgcgcctagtgtgatcgccgccccgcacaaacaaatccaggctgatgccgagcaataccagggcgaagcgttgaagctgctcgaacgcctggtgaacatcgattcgggttctggctatgcgccgggcctcaatcaggtgggtgatatcgccatcgaagaactgaaaaaactcggcgccaccatcgagctcgtgcctaacacgccggacaagagcaaccacgtactggccacgctcaaaggcaccggcacgaaaaaaatcctgttgatggcgcacatggataccgtcttcaaagaaggttcggcagccgaacggccttttcatatcaaagacggccgtgcttatgggccgggggtgatggacgacaagggcggtatcgttgcgggtatttatgcgttgaaagtcctgcacaacctgaactacaaagattacgcgcaaatcacggtgctgctcgacgccagcgaagaaaccggttcggacatcgccaccgacctgatcaaaaaaaccgctaaagcccacgacatcaccctcaacctcgaaccgggtcgcccggccgatggcttggtggtgtggcgcaaaggcagtgccaccgccgtggtcgacgttaaaggcaaggcctcccacgccggtgtcgccccggagctgggccgcaatgcggccatggagctgtcgcaccaggtgctgcaattgggcaagctgggcgacgaggcgatgaaaaccaccatcaacttcaccgtgctcaaggccggcgaccgcaccaacgtgatccccgaccaagccagcgccaaggctgacgtacgtgccgccgtaccggaagagttcgaccgcatcgaaaaagacctggccaaggtctcggccaacaagctgattcccgacaccgaagtcaaaaccagcctgcaacgcggcctgccgcccatgccgcaaacggcagagtccgatgcgctggtcaccattgcccagggcatctatggcgaactgggccgtaccctgaccatcgaaggcagcggtggggcggcggactcaagcctctcggccagcgtcggtaccccgaccctggacggctttggcatcgtcggcgggaacatccacaccccggaggaatacgccgaggtgggcagcgtggcgccgcgtatttacttgttggcgcggatgatcatggaagcgggcaataaataa

SEQ ID NO: 1587 - DNA, 1230 bp, Pseudomonas sp.
atgctcttcactttcccgcgtaccctcctggccgccaccctggccttttccttcgccctgccggcctacagtgccgaaccccacaagcaggtccaggctgatgccgaacagtacaaggccgaggccctgaaactgctcgaacgcctggtgaacatcgattcaggttcaggctacgagccgggcctgacccaagtgcgcgatatcgcagtggacgagttgaaacagttgggtttcagcattgaactggtgccggacaaagccgccaacaacagccatgtgatcgccacgctcaagggcacaggcaaggccaaaatcctgctgatggcccacatggacaccgtgttcaaggaaggctcggccgccgagcgcccgttccacatcaaggacggccgcgcctatggccccggcgtaatggatgacaagggcggcatcgtcgccggcatctacgcacttaaggtcctgaagaaccagggcttcaaggactacgcgcaaatcaccttactgctcgacgccagcgaagaaaccggctccgaagccgcctccgagctgatccgcagcaccgccaagggccacgacgtaaccctcaacctcgaacccggccgcccagccgacggcctggtggtgtggcgcaaaggcagcgccaccgccgtggtcgaagtcaaaggcaaggccgcccacgccggcgtcgccccggaactgggacgcaacgccgccatggaagccgcgcaccagatcctgcaactgggcaagctgggcgatgaagacaagaaaaccaccatcaacttcaccgtgctcaaggccggtgaccgcaccaatgtgatccccgaccaagccaccgccaaggccgacgtacgcgccgccttgccggaggaatttgaccgaatcgaaaaggacctggcccgggtttcagccaacaagttgatccccgaaaccgacgtgaagaccagcctgcaacgcggcttgccgccgatgccacagacagcggagtcggataaattggtggcgattgcccagggcatttatgccgagctgggacgtaagttgaccattgaaggcagcggtggggcggcggatgcgagtttgtcggccggggtaggtacgccgacgttggatgggtttgggatagtgggcgggaatattcacacaccggaggaatatgccgaggtagagagtgtggtgccgcgggtgtatttgttgagccggatgattatggaactggccaagcgctga

SEQ ID NO: 1588 - DNA, 1230 bp, unknown
  environmental sample
atgctcttcaacttctcccgcaccctcctggccgccaccctggcgttgtccttcgccgcgccggcctacagcgtcgagccccacaaaccgatccaggcgcaagccgagcagtacaaggcagaggccttgaagctgctggagcgcctggtcaacatcgactcggggtcgggctatgaaccgggcctgacccaagtgcgcgacatcgccgttgatgagctcaaacagctgggcttcagcattgagctggtgccggataaagcggccaataacagccatgtggttgccaccctcaagggcaccggcaaggccaggatcctgctaatggctcacatggacaccgtcttcaaggaaggctcggccgccgagcgcccgttccacatcaaggacggccgcgcctatgggcccggcgtgatggacgacaagggcggcatcgtcgccggcatctacgcgctcaaagtcctcaagggccagggtttcaaggactacgcgcaaatcaccttcctgctcgacgccagcgaagaaaccggctccgaggccgcctccgaactcatccgcaacaccgccaagggccacgacgtcaccctcaacctcgaacccggccgcccggctgatggcctggtggtatggcgcaaaggcagcgccaccgcagtggtcgaagtcaaaggcaaagccgcccacgccggcgtcgccccggaactgggccgcaacgccgccatggaagcggcgcaccagatcctgcaactgggcaaactgggcgatgaagagaagaaaaccaccatcaacttcaccgtgctcaaggctggcgaccgcaccaacgtcatccccgaccaggccaccgccaaggcggacgtgcgcgcggcgctgccggaggagttcgatcgcatcgagaaggatctggtacgggtgtcggcgaacaaactgatcccggagacagaagtgaaaaccacgttgcagcgcgggttgccaccgatgccgcagacggcggagtcggataaattggtcgcgattgcccaagggatttatgcggagttgggcaagaagctgacgattgaaggcagcggcggggccgcggatgcgagtttgtcggctggggtcggcacgccgacgctggatgggtttgggattgtggggggcaatattcatacggcggatgagtatgccgaggtggagagtgtggtaccgcgggtttatctgcttagtcggatgatcatggagctgagcacacgctga

SEQ ID NO: 1589 - DNA, 1230 bp, Pseudomonas sp.
atgcgcttcgccttcccccgtaccctcctggccgccacgctggccttgtccttcgcacttccggcctacagcgccgaaccccacaaacagatccaggcggatgccgaacagtacaaggccgaggccctgaaactgctggagcgcctggtgaatatcgactcgggctccggctacggaccgggcctgacccaggtcagcgacattgccgtggatgagttgaagcagttgggcttcaacatcgaacgcataccggatgccgccgccaacagtagccatgtgatcgcgaccctcaaaggcaccggcaaagcgaagattctgctgatggcccacatggacaccgtgttcaaggaaggctccgcggccgagcgcccgtttcatatcaaagacggtcgcgcctatggccctggcgtgatggatgacaagggcggcatcgtcgccggcatctacgcgctcaaagtcctgaagaatcagggcttcaaagactacgagcgcatcaccttcctcctcgacgccagcgaagaaaccggctccgacatcgcctccgagctgattcgcaacaccgccaaggcccacgacgtcacgctgaacctggaacccggccgccccgccgacggcctggtggtgtggcgcaaaggcagcgccaccgcggtggtcgaagtcaaaggtaaagccgcccacgccggcgtcgcccccgaactgggccgcaacgccgccatggaagccgcgcatcagatcctgcaactgggcaagctcggtgatgaagaaaagaaaaccaccatcaacttcaccgtaatcaagtctggcgaccgcaccaacgtgattcctgaccaagccaccgccaaggcagatgtccgcgcggcattgccggaagagtttgatcggatcgagaaagacctggtgcgggtttccgcgaacaaactgatcccggaaaccgaagtgaccaccaccctcaaacgcggcctgccgccgatgccgcagacggcggagtcggacaagttggtagcgattgcccaaggaatttatggggagttgggtaagaagctgacgattgagggcagcggcggcgcggcggacgcgagtttgtcagccggggtagggacgccgacgttggatgggtttgggattgtgggaggcaatatccatacggcggacgagtacgcggaggtggagagcgtggcgcctcgggtttacttgttgagtcggatgattatggagttggcgaagcggtga

SEQ ID NO: 1590 - DNA, 1287 bp, Pseudomonas sp.
atggtcctgaaaacctcgacgaaccaaacacaaggacggaacaacatgcgctcattctcccgctcgccactggcagctcatctcgctttggcgcttgcgctgacagctctggcaccagcggccatggccgaaccgcacaaggcgattcaggccgatgccgagcaatacaaggacgaagccttgaagctgctggagggtctggtaaacatcgattcaggctccgggtatgtaccgggcctgaccaaagtcagtgacatcgcgattgaagaactgaaaaagctcggtgccaccatcgagctcgttccgaatacaccagaggccagcaatcatgtagttgcgaccctgaaaggcaccggcaaggcgaagattctgctgatggcacacatggataccgtgttcaaggaaggctctgcggccgagcgtccgtttcatatcaaggacggtcgtgcctatggccctggtgttatggatgacaagggcggcatcgttgctgctatctatgctctgaaggtgctgcacaacctgaaattcaccgactacgcacagatcacagtgttgctcgacgccagcgaagaaaccggttcaggcgtcgctaccgagctgatcaagaaaacagcgaaagagcacgatgtcacgctcaatctggagccgggtcgtcctgctgatggtctggtggtgtggcgcaagggttctgcgacggcactggtcgaagtcaagggcaaagcctcgcatgcgggcgttgcgccggaactggggcgtaacgctgccaccgaggttgcgcatcagatcctgcaactcggcaaactgggcgatggggagaagaaaaccaccgtcaacttcaccgtgctcaaggcgggtgatcgcaccaacgtgattcctgatcaggccagcgccaaggccgacgtgcgtgccgccgtgccggaagagttcgaccgcgtcgagcaggacctggccagggtgtcggccaacaaactggtgcctgacaccgaggtcaagaccagtctggtccgtggcttgccgccgatgccgcagaccccgcagtccgatgctttggtcgctatggcacaggacatctacggtgaactggggcgcaccctgaccatcgagggcagcggcggggcggctgattcaagtttgtctgccagcgtaggaacgccaacactggatggtttcggcatcgtcggtggcaacatccatacgcctgaagagtacgccgaggtgggcagtgtcgcgccacggatctacctgctgtcacggatgatcatgaagttgtccgggcaaccgtga

SEQ ID NO: 1591 - DNA, 1269 bp, Pseudomonas sp.
gtgtcacggcaccctccaacaacaatcaaggatcggttcatgctcttcaacttctcgcgtaccctcctggccgccaccctggccgtgtccttcgccgtgccggcctacagtgccgaaccccacaaacagatccaggcacatgccgaacagtacaaggccgaggcgttgaagctgttggaacgcctggtgaatatcgactcgggttcggggtatgagccgggcctgacgcaagtgcgcgatatcgccgtggacgagctgaaacagctgggctttgctattgaacaggtgccggataaagcggccaacaacagccacgtggttgccaccctcaaaggcaccggcaaggccaagatcctgctgatggcccacatggacaccgtcttcaaggaaggctcggcggccgagcgcccgttccacatcaaggacggccgcgcctatggccccggcgtgatggatgacaagggcggcatcgtcgccggcatctacgcgctcaaagtcctcaaggaccagggcttcaaggactacgcgcaaattaccttcctgctcgacgccagcgaagaaaccggctccgatgcggcctccgagctgatccgcaacaccgccaaggcccacgacgtcaccctcaacctcgaacccggccgccccgccgacggcctggtggtgtggcgcaaaggcagcgccaccgccgtggtcgaagtcaaaggcaaagccgcccacgccggtgtcgccccggaacttggccgcaacgcggcgatggaggttgcgcaccagatcctgcaactcggcaagctgggggatgaagagaagaaaaccaccatcaactttactgtgctcaaggccggcgaccgcaccaacgtcatccccgaccaggccacggccaaggcggatgtacgcgcggcgttgccggaagaatttgatcgcatcgagaaggatttggtgcgggtgtcggcgaataagctgatcccggacactgaagtcaccaccagcttgaaacgtggcttgccgcccatgccgcagacggcggagtcggacaagttggtggcgattgcccaggggatttatggggaactgggcaagaaactgacgattgaaggcagcggcggggcggcggacgcgagtttgtcagctggggtaggaacaccgacgttggatgggttcgggattgtcggggggaatattcataccccggaggagtatgcggaggtggagagtgtggtgccgcgggtttatttgcttagccgcatgattatggagctttcgaagcggtga

SEQ ID NO: 1592 - DNA, 1254 bp, unknown
  environmental sample
atgacctcaccgttttcccgctctctcctcgccagcgcgctggccttcggtatcgccttctccgcggcagcgcctgcctttgccgagcccaataaacaggttcaggcggatgccgagcaattcaaggacgacgcgctgaagctgctggaacaattggtcaatatcgatacgggctccggctacgagccgggactgacccaagtgcgtgacatcgtcgtcgcccagctcaaggcgctcggtgcgaccatcgagatgatccccaacaccgcgccggacaagagccagcatgtggtcgcgacgctaaaagggagcggcaaggcgaagatactgctgatggcgcacatggacaccgtgttcaaggaaggttccgccgccgcccgccccttccacatcaaggacggccgtgcgtacgggccaggggtgatggacgacaagggcggcatcgttgccggcctttacgcgctgaagattctgaagaagctcgacttcaaggactacgcgcagattaccttcctgctggacgccagcgaggagaccggttccgccgccgccaccgcgctgatccagaaggtcgccaaacagcacgatgtgaccctgaacctggagccggggcgccccgccgacggtctggtgatctggcgcaaaggcagcgccaccgcagtggttgaggtaaaaggcaaggcgtcccacgccggcgtcgcgccggaactggggcgcaacgcggccatggaggtggcgcatcagattctgcaactgggcaagctgggcgacgccgagaagaagaccacgatcaatttcaccgtgctcaacgccggcgatcgcaccaacgtcatccccgatcaggccaccgccaaggccgatgtgcgcgccgccgtgccggaagagttcgaccgcatcgagaaggatctggcgcgggtgtcggctgacaagctgatcccggacacccaagtgaccacccgcctggagcgcggtttgccacccatgccgcagacgccggaaaccgacaagctggttgatatcgcccagggcatctacggcgagatcggccgcaaactgaccatcgaaggcagcggcggcgcggccgatgcgagcctctcggccggggtcggcgtgccaaccctggatggcttcggcatcgttggcggcaatattcacacgcccgaggaatacgcggaagtcgacagcgtgtcgccgcgcatctacctgctgacgcggatgatcatggagctggcgacgcacactccgggcaagtga

SEQ ID NO: 1593 - DNA, 1254 bp, Pseudomonas sp.
atgccgttgatattttcccgctctgccctcgcctccgctctggcgcttgctgtcactttcggtggcggctccctcgctcaggcggcgactcccgacaaactggttcaggctggcgccgagcaagccaaagagcccgcgctgaagctgttggagcaactggtgaatatcgattcgggctccggttacgagccggggctgagcaaggtgagcgcaattgtcgtcgaggaactgaaaaaactcggcgcgaccattgagaccttccccaataccgcgccagataaaagcaagcatgtgatcgccacgctcaagggcacgggcaaggcgaaaattctgctcctggcgcacatggatacggtgttcaaggaaggctcggccgctgcccgccctttccacatcaaggacggacgcgcctacggtccgggcgtgatggacgataaaggcggcatcgttgccggcatctacgcactgcaaattctgaaaaatctgaattttaccgactacgcgcagatcaccttcctgctggacgccagcgaagaaaccggttcggacgctgccaccgacctgatcaagaaaaccgccaagcaacacgatgtgacgttgaacctggagccggggcgccccgctgatggcctggtcgtctggcgcaaaggcagtgcgacggcggtggtcgatgtgaagggcaaagcttcccacgccggtgtcgcgccggaactggggcgtaacgcggcaatggaagcggcgcatcagatcctgcaactgggcaaactgggcgatccggagaagaagaccaccatcaacttcacgacgatcaatgccggtgaccgaaccaacgtcattcctgatcaagccaccgccaaggccgatgtgcgcgcagcggtgccggaagaattcgaccggatcgagaaagatctcgcgcgcgtatcggctgacaaactcatcccggaaactgaagtctcgacgaagctgattcgtggcctgccaccgatgccgcaaaccgccgaaagcgacaagctggtggccattgcgcaaggcatttacggcgagctgggccgcacgctgaccatcgaaggcagcggcggcgcggccgacgcaagcctggccgcgagtgtcggcgtgcctacgctggacggtttcggcatcgtcggcggcaacatccacacgcctgaggaatacgcggaagtcgaaagcgtctcgccacggatttacctgctgacgcgcatgatcatggagctttcacgcggcacggttaaatag

SEQ ID NO: 1594 - DNA, 1257 bp, Pseudomonas sp.
atgccgttgatgttttcgcgccctgcccactcctgcgcgctggcgcttgctgtcacgcttggggtgagcgccctcgctcaggctgccgctcccgatacacgcgttcagtcggcatccgagcaatacaaggaacctgcgctcaagttgctggagcaactggtcaacatagactccgggtcgggttacgagcccggtttgactcaagtaagcgcgatcgtcattgatcagttgaaaaagctcggcgcgaccattgagaccgtacccaatactgcgcctgacaagagcagccacgtggttgcaacgttcaaaggcacaggtaaagcgaaaatattgctgatggcgcacatggatacagtattcaaggaaggctcggccgctgcccgtcctttccatatcaaggacggtcgcgcttacgggcctggggtgatggacgataaaggcgggattgtcgccggcatctacgcgctgcagattctgaaaaacattaactttactgattacgcgcagatcacctttctgctggacgccagcgaagaaacgggttcggccgccgcgaccgagctgatcaagacaaccgccaaacaacatgacgtaacgttgaatctggagccaggccgtccagccgatggcctggtcgtgtggcgcaaaggcagtgccaccgcagaggtccaggtcaagggtaaagcctcacacgccggtgttgcgccagaactgggacgcaacgcggcgatggaagctgctcatcagatcctgcagctgggacaactgggtgatgccgagaagaaaaccaccatcaacttcaccaccatcaatgccggtgaccggacgaacgtcattcctgatcaagccattgccaaggccgatgttcgtgcagcggtgcctgaagagtttgaccgcatcgagaaagaccttgcgcgagtctcggcagacaagctgatcccggaaaccgaagtctcgactcgcctgattcgcggactgccacctatgccgcaaacggcagaaactgacaggctcgtgagcatcgctcagggtatctatggcgaactggggcgcaaactgaccatcgaaggcagcggcggcgcagccgatgcaagtctggcggcgagtgtcggtgtacctacgcttgacggcttcggcatcgtcggcggcaacatccatacacccgaagaatacgccgaagtcgaaagcgtctcgccccgtatttacctgctgacgcgcatgatcatggagctctctggcgccccatccaaacagtaa

SEQ ID NO: 1595 - DNA, 1248 bp, Polaromonas sp.
atgcgtcttaacttcaagggcaccatgctcgcgtccgcttgctccctcatgctggcgctggtcgtcgccgttcccgccgcccatgcgcaggcaatggccgacaaggcggtcctcgaaaaggccgagagctacaagggcgaggcactggccttgctggagaaactggtcaacatcgactccggttcgggctatgaaaaaggcctggcccaggtgcgcgcgatttcagtggacgagctcaagaagctcggtgccagcatcgagaccgtgccttccggcgatggcggggctcacgtcctggccaccttcctcggcaccggcaaggccaggatcctgctgatggcgcacatggacaccgtcttcaaggaaggcacggcggccgccaaacctttttacatcaaggatggccgcgcctacggccccggcgtgatggacaacaagggcggcgtcctcgccggcgtgtacgcgatcaagatcctgcagcagcttcagttcaaggactatgcaaagctgactttcctgctcgacaacaacgaggagaccggttcggccattgcaacggccctgatccagaaggtggccaagcagcatgacgtcaccctgaacctggagcctggccgcccggccgatggcctggtgatctggcgcaagggcagcggcacagccacggtggaggtcaagggcaagaccgcgcacgccggtgtggcgcccgagctgggccgcaacgcggccatggaggcggcccaccagatcctgcagctcggcaagctgggcagccccgagaaacagacgacgatcaacttcaccgtgctcaaggccggtgaccgcaccaacgtgatcccggactcggccagtgccaaggccgacgtgcgcgtggccgtgccggaagagtttgaccgcatcgaaaaggacctggcgcgcgtgtcggccaacaagctgattgcggacaccgaggtcaagaccaccttgagtcgaggcctgccacccatgccgcaaaccgcccaccaggatgcgctggccgccaaagcccaggcgatttacggcgagatcggccgcaagctgacgctggaaggcagcggcggcgcggccgatgccagcctgtcggccggagtcggcgtgccaaccctggacgggtttggcattgtgggcggcaacatccacaccgaaaacgaatacgccgaggtggaaagcatcgtgccgcgcttttatctgctggcgcgcatggtgatggagttgagcaagccgaactga

SEQ ID NO: 1596 - DNA, 1251 bp, Pseudomonas sp.
atgactgttatgctccgccgcgccacgtgctctctttcattggcaatcgcttttgccttttctaccgcttccaccgtacaggctgaacctaatcaccctgttcaatcccatgccgaacagtacaaggaagaagcactcaagctactcgagcaactggtaaatattgattcgggctcgggttatgcacctggtctgatacaggtaggtcagattgcagctgatcagttgaaacagctgggcgctacgatcgagactgttccaaactctccacctgataaaagtcatcatatcgttgccacgcttaaaggcacaggcaaggccaaaatcttgctgatggcgcatatggataccgttttcaaagagggctcagccaaggagcggcctttccatataaaggatgggcgagcctacggacccggcgtgatggacgataagggcggaatcgtagcgggcatctatgcgctcaaaatattgaaagacctcaacttcaaggattacgctcaaattacctttttgctcgatgccagcgaggaaaccggttccgatgctgctactcagctgattcaacgggtggccagggagcatgacgttaccctcaatctagagccaggccggcctgccgatggcctcgtggcttggcgaaaaggaagcgcgaccgcaaccgttgacgttaccggtaaggccgctcatgcgggcgtagcgccggagctcggccgaaacgctgccatggaaatctcgcatcaggtcctccagcttggcaaactgggcgatgtcgagaagaaaactacggtcaattttactgtaatcgacgctggcgatcgcacgaatgtcatacctgacagcgcaactgccaaggcagacgtccgtgtagcagttcctgaggagtttgatcgggtcgagcaagacatggcgcgcgtctctgccaacaagctgatccaagagaccgacgtgaaaactcatctgcatcggggcttgccgcctatgcctcaaaccgccgaaacggataggctcgtgtcgatggctcaaaacatctacggtgaaattggccgcaagcttacgattgagggcagcggtggcgcagctgacgccagccttgctgcgggtgtgggcgtaccaacgctggatggctttggcatcgtaggcggcaatatccatacgccagaagagtacgccgaggtggaaagcgtcgcgccgagactttatctactggcaaggatgatcatggagctggcgcagcgtgataaaggttaa

SEQ ID NO: 1597 - DNA, 1081 bp, Pseudomonas sp.
atgcgctcatttacccgctcgccactggctgctcatctcgccctggcgcttgcgctgacagccttggcaccggcggccatggccgaaccgcacaaggccatccaggccgatgccgagcaatacaaggacgaagccttgaagctgctggagcgtctggtgaacatcgactcgggttccgggtatgtcccgggcctgaccaaggtcagcgacatcgcgatcgaagaactgaaaaagctcggagccaccatcgagctcgttccaaatacgccagaggccagtaaccacgtcatcgccaccctgaaaggcaccggcaaggcgaagattctgctgatggcgcacatggacaccgtgttcaaggaaggttctgcggccgagcgaccgtttcatatcaaggacgggcgtgcctacggcccaggggtgatggatgacaagggcggcatcgttgccgctatttatgcgctgaaggtcttgcacaacctgaagttcaccgactacgcacagatcacggtgttgctcgacgccagcgaggagaccggctcaggcgtcgctaccgagctgatcaagaaaaccgcgaaggagcatgacgtcaccctcaacctcgagccgggtcgtccggccgacggtctggtggtgtggcgcaaaggctcggccaccgcgctggtcgaagtcaagggcaaggcctcgcatgcaggcgttgcgcctgagctgggacgtaacgccgcgaccgaagttgcccatcagatcctgcaactcggcaagctgggtgacgaagagaagaaaaccaccatcaacttcaccgtgctcaaggcgggtgatcgcaccaacgtgattcccgatcaggccagcgctaaggccgacgtgcgtgctgccgtaccggaggagttcgaccgcgtcgagcaggatctggccaaggtgtcggccaacaagctggtgcctgataccgaggtcaagaccagcctggtccgtggcctgccgccgatgccgcagaccgcgcagtccgatgcattggtcgcgatggcacaaggcatctacggtgaactgggtcgcaccctgaccatcgagggcagcggcggggcggcgg

SEQ ID NO: 1598 - DNA, 1113 bp, Pseudomonas sp.
atccgacacaaggaaggaacaaccatgcgctcattttcccgcacgccgcttgctgctcatctgggcctcgcttttgtgctgacggcgttgacgccgatggtcatggccgatccgcacaaggtgattcaggccgatgccgagcaataccagggcgaggccttgaagcttctggagcgtctggtcaacatcgattcgggttccggttacgtgccgggcctgacccaggtcagcgacattgcgattgaagagcttaaaaaactcggtgccaccatcgagcttgtgccgaacacaccggaggccagcaatcatgtccttgccaccctgaaaggcaccggcaaggcgaagattctgttgatggcgcacatggacaccgtgttcaaggaaggctcggtggccgagcggccgtttcacatcaaggacggtcgtgcctacggccccggcgtgatggacgacaagggcggtattgttgccgctatctatgcactgaaggtcctgcacaacctgaaattcaccgactacgcgcagatcaccgtattgctcgacgccagcgaggaaaccggctctgtggtcgccactgaactgatcaagaaaaccgccagggaacacgatgtcactctgaacctggaaccgggtcgcccggccgatgggctggtggtgtggcgcaagggttctgccactgcgctggttgaagtcaagggcaaggcttcgcatgcaggcgttgcgccggaactgggtcgcaatgccgccaccgaagtggcgcatcagattctccagctcggcaagctgggcgatgagcaaaagaaaaccaccatcaacttcactgtgctcaaggcgggtgatcgcaccaacgtgatcccggatcaagccagcgtcaaagcggatgtgcgcgcggcagtaccggaggagttcgaccggatcgaaaaagacctcgccaaggtctcggccaacaagctggtgcccgacaccgaggtcaagaccagcctggtccgtggcctgccgccgatgccgcaaactgcgcagtccgatgcgctggtcgccatggctcaaggcatttacgcagaattggggcgcaagctgaccattgaaggcagcggcggggcggctcgtttcagc

SEQ ID NO: 1599 - DNA, 396 bp, Pseudomonas sp.
atgactgaatcacgacgtccctatggtgcgcctcagcccgagcccatcgacgacaacgaagaccgcatggggtccatggaagagctggacttcgatgaagaagaacccggcgcgagggtcggcgaccctgcttccagctctgtggagcatcgtactccccacaggcacatccatggctccagcctgaccggcaacgccgaggatgagcccaacgacgatgagctgaccccggaaaacctgatccgcgaagacggcgcccgctccgcccatgaagccggtgaagaccggccggccgactgggacctgagcattgtcgatgaagacgatatcggcggcggcaatggcctggacgaagccgaactggcccagcgcgacccgctggacggcaaacgctga

SEQ ID NO: 1600 - DNA, 396 bp, Pseudomonas sp.
atgactgaatcacgacgtccctatggtgcgcctcaacccgagcccatcgacgacaacgaagaccgcatgggttccatggaagagctggacttcgatgaagaagaacccggcgccagggtcggcgaccctgcttccagctctgtggagcatcgtactccccaccggcacatccatggctccagcctgaccggcaacgccgacgaggagcccaacgacgatgacctgaccccggaaaacctgatccgcgaagacggcgcccgctccgcccatgaagccggtgaagaccagccggccgactgggacctgagcattgtcgatgaagacgatatcggcggcggcaatggcctgggcgaagccgaactggcccagcgcgacccgctggacggcaaacgctga

SEQ ID NO: 1601 - DNA, 396 bp, Pseudomonas sp.
atgactgaatcacgacgtccctatggtgcgcctcagcccgagcccatcgacgacaacgaagaccgcatgggttccatggaagagctggacttcgatgaagaagaacccggcgccagggtcggcgaccctgcttccagctctgtggagcatcgtactccccaccggcacatccatggctccagcctgaccggcaacgccgatgaggagcccaacgacgatgagctgaccccggaaaacctgatccgcgaagacggcgcccgctccgcccatgaagccggtgaagaccagccggccgactgggacctgagcattgtcgatgaagacgatatcggcggcggcaatggcctggacgaagccgaactggcccatagcgacccgctggacggcaaaccctga

SEQ ID NO: 1602 - DNA, 396 bp, Pseudomonas sp.
atgactgaatcacgacgtccttatggtgcgcctcagcccgagcccatcgacgataacgaagaccgcatgggttccgtggaagagctggatttcgatgaagaagaacccggcgccagggtcggcgaccctgcttccagccctgcggagcatcctactccccacaggcacatccatggctccagcctgaccggcaacgccgacgaggagcccaacgacgatgagctgaccccggaaaacctgatccgcgaagacggcgcccgctccgcccatgaagccggtgaagaccagccggccgactgggacctgagcattgtcgatgaagacgatatcggcggcggcaatggcctggacgaagcagaactggcccatagcgacccgctggacggcaaaccctga

SEQ ID NO: 1603 - DNA, 330 bp, Pseudomonas sp.
atgggttccatggaagagctggacttcgatgaagaagaacccggcgccagggtcggcgaccctgcttccagctctgtggagcatcgtactccccaccggcacatccatggctccagcctgaccggcaacgccgatgaggagcccaacgacgatgagctgaccccggaaaacctgatccgcgaagacggcgcccgctccgcccatgaagccggtgaagaccagccggccgactgggacctgagcattgtcgatgaagacgatatcggcggcggcaatggcctggacgaagcagaactggcccatagcgacccgctggacggcaaaccctga

SEQ ID NO: 1604 - DNA, 402 bp, Pseudomonas sp.
atgactgattcacgacgtccttacggcgcggtccaacccgagcctatcgacgacaacgaagaccgcatgggttcgatgcgcgagctggatttcgatgaagaagaacccggcgagactatcggtggcctgacccgcgagcacgagcgtgagcaacaaatgcccagcgaacgcgtacgtgaaaaaggcacgggcgggaccgcggctgacgacgaacccattgacgacgacatgagcccggaaaacctgattcgcgaagatggcgcccgtgacgctcatgaggccggagaagacttcagcgccgattgggacttgagcattgtcgatgaggacgaaatcggcggcggcaacgggctggatgaggcggaactggcagagcgcgatccggttgatggcaatcggtaa

SEQ ID NO: 1605 - DNA, 405 bp, Pseudomonas sp.
atgactgaatcacgacgtccctacggcgctacgcagcctgaacccatagatgacaatgaggaccgcatgggctcgatgcgcgaactggattttgacgaagaggaaccgacggcggagatcggcgatgagatccctcgtcgcgaacgtgaacaccgaatgcccgacgaacgggtgcgtgaagcaggtctaaccggcgcgtccacagatgatcacgagccgacggatgatgatttaagcccggaaacgttgatccgtgaggatggtgcgcgcgatgcccgggaagaaggcgaggataacccggcggattacgacctgagcatcgtcgatgaagatgaaattggcgggggtactgggttggatgaggccgaactggcggatatcgacccgatagacggtaaaccctga

SEQ ID NO: 1606 - DNA, 405 bp, Pseudomonas sp.
atgaccgaatcacgacgtccttacggtgcgccgcagcccgagcccatcgatgacaacgaagaccgcatgggctcgatggaggagctgcatttcgacgatgaagaacccagtgccaagatcggcgacaccatccccgaggcggaactggagcaccgcctgcccgcccagcgtgtccgcgacgccggcctgaccggggcctcgaccgccgaccacgagcccaccgacgacgacctcagccctgagaccctgatccacgaagatggtgcccgttcggccaatgaagccggcgacggcgatcaggccgactgggacctgagtattgtcgatgaagacgatatcggtggcggcaatggcctggatgaagccgaactggcgcgccgcgaaccgctggacggtaaccgctga

SEQ ID NO: 1607 - DNA, 2136 bp, Pseudomonas sp.
atggcatctgcatccgagcggtccgcggtcaaaaagggcaaggcggctacccccaaggcagccgagagaaaaaccacgaaaaaatccgccgtcatcacggctgccaaggctggccagaaggtcgccagccgcaagaccgccacgccccccgtgcgggtgttgaacgtgcgaccggatggcctggattttcgcgacaccatgtatatcccgaccctggtggaagtcccggtacgccgcgaactcagcgactaccgcaagaccggggtgccggtgctcgaccagggccaggaaaatgcctgcaccggttatggcctggcgacggtggcgcattacctgctgcgcacccgccgctatcagtccgacgccacgctcgtcagcccgcacatgctgtatgacctggcccgccgttatgacgaatgggccggcgaggcggacgaaggctccagttgtcgcggggcgatgaagggctggtacaagcacggggtgtgcccggcgccgcagtggcaggccggcaaccaggccacgaccctgacccaggtgttggccgaggcggcggcgctgcgtccgctgggggcgtacttccgggtcaaccacaccgacatcgtcgccatgcacgcggcgattgccgaagtcggtgtgctgtacgccagcgccagcgtgcacgagggctggcatgtggtcggcggggatggccatatccagccctcggccaacattctcggcggccatgccttcgcgatcgtcgcctatgaccaggacggtttctggattcagaactcctggggcgagacgtgggggtacgaggggtttgcccacctgcgctacgacgactggctggccaacggtgcggatgcctgggtcgcgcggctcggcgcgccggtcaccctgcgcgtgccgttgcaggcgagctcgcaggccaaggcggtggcggcggcttcgtccagcgaaaccctgcgggagatccgcccgcacgtcatcagcctgggcaacgacggtgccttcgacccgcgtggcgacctggcgaccaccgcggccagcgtggaggaaatattcgccgtggactttgcgcgcatcaccgccggctgggcgaaaaaacgcatcgtggtgtatgcccacggcggcctggtggggcaggccggggccatcgaaaccgtggccggctaccgcgcggccctgttgcaggccgagtgttatccgctggcgttcatctggaagaccgattactggagcaccctgggcaacatgctggccgatgccgcccggcgccgacgctccgaaggggtgctggatgcgaccaaggacttcatgctcgaccgcctggacgatgcgctggagcccattgcccggctgctgaccggcaaggccgagtgggacgaaatgaaggaaaacggcctgcgtgccacggtcaatgccaacggcggtgcgcgagtggtggccaaggccctggcgcgcctggccgcccagggggtggagatccacttcgtcgggcacagcgcgggcagtatcctgctggcgccgatggtgcagtacctggtttccaggggcgcgatgaacagcgggcccatggcgcgcagccagctgaaggggctggaggtgacgatcgccagttgccacctgtgggcgccggcctgcaccgtcaagctgttccgcgagacgtacctggcgccgatccgtgaccagcgcatccagaagttcggcctgttcaccctgaccgaccaggccgagcgcgatgaccactgtgcgcatatctacaacaagtccttgttgtacctggtctccgatgcgttcgaggacaaggtgcgcatcccgctgatccggcccgaaggtgaaccgattctcggcatggagcgcttcgtcgccggcgaaagcgatctggcgcagctgttcgccagcgcctcgaacgccgactgggtacgcgcgcccaacgacttgccgatgggcaatccgaaggcctccggggcccgtcaccatggcgacttcgacaacgatgaaaccacggtccgcgcgaccctggcgcggattctcgggcaaggcggagcgcggcaggccctggtgctgtcgcaacccattgccgagcgggcgcaacggcggcgccaggtggacctggccagcagcatcggacggcggcaaccatga

SEQ ID NO: 1608 - DNA, 2136 bp, Pseudomonas sp.
atggcatctgcatccgaccggtcctcggtcaaacagggcaaggctgcggctacagcacaaaaagccgagaaaaaaaccacgataaaaaccgctgcaacggccgccaaggctggcaagaaggtcgccagccgcaagaccgccacggcccccgtccgggtgttgaacgtgcgaccggacggcctggattttcgcgacaccatgtatatcccgaccctggtggaagtgccgatccgccgggaactcagcgactaccgcaagaccagggtgccggtgctcgaccagggccaggagaacgcctgcaccggatatggcctggcgacggtggcgcattacctgctgcgcacccgccgctatcagtccgacgccacgctcgtcagcccgcacatgctgtacgacctggcccgtcgttatgacgaatgggccggcgaggcggacgaaggttccagttgtcgcggggcgatgaagggctggtacaagcacggggtgtgcccggcgccgcagtggcaggccaacaaccaggccacgaccctgacccaggtgctggccgaggaggcggcactgcgtccgctgggggcgtacttccgggtcaaccacaccgacatcgtcgccatgcacgcggcgattgccgaggtcggtgtgctgtacgccagcgccactgtgcacgagggctggcatgtggtcggtggggatggccatatccagccctcggcgaacattctcggcggccacgccttcgcgatcgttgcctatgaccaggacggtttctggattcagaactcctggggcgagacctgggggtacgagggttttgcccacctgcgctacgacgactggctggccaacggcgcggatgcctgggttgcgcggctcggtgcgccgatcaccctgcgcgtgccgctgcaggcgagctcgcaggccaagacggtggcggcggcttcgtccagcgagaccctgcgggagatccgtccacatgtcatcagcctaggcaacgacggcgccttcgacccgcgcggcgacctggcgaccaccgcggccagcgtccaggaaatatttgccgtggacttcccgcgcatcaccgccggctgggcgaaaaaacgcatcgtggtgtatgcccacggcggcctggtggcgcaggccggggccatcgaaaccgtggccggctaccgcgcggccatgttgcaggctgaatgttatccgctggcgttcatctggaagaccgattactggagcaccctgggcaacatgctggccgatgccgcccggcgccgacgctccgaaggagtgctggatgcgaccaaggacttcatgctcgaccgtctggacgacgcgctggagcccattgcccggctactgaccggcaaggcccagtgggatgaaatgaaggaaaacggcctgcgtgccacggtcaatgccaacggcggggcgcgggtggtggccaaggccctggcgcgcctggccgcccagggggtggagatccacatcgtcgggcacagcgcgggcagcatcctgctggcgccgatggtgcagtacctggtttctaagggcacgatgaacagtgggccgatggcacgcagccagctgaaggggctggaggtgaaggtcgccagttgccacctgtgggcgccggcctgcaccctcaagctgtttcgcgagacttacctggcgccgattcgcgacaaacgcatcgagaagtttggcctgttcaccctgactgaccaggccgagcgcgatgaccactgtgcacacatctacaacaagtccttgctgtacctggtctccgatgcgttcgagggcaaggtgcgcatcccgctgatccggcccgatggtgagccgattcttggcatggagcgcttcgtcaccagcgaaagcgatctggcgcagctgttcgccagcgcctcgaacgccggctgggtgcgcgcgcccaacgacttgccgatgggccatcagaatgcctccggggcccgtcaccatggcgacttcgacaacgatgaaaccacggtccgcgcgaccttggcgcggatcctcgggcaaggtggagcgcggcaagccctggtgctggcgcaacccatcgccgaacgggcgcaacggcggcgccaggtggacctggccagcagcgtcggacggaggcaaccatga

SEQ ID NO: 1609 - DNA, 1977 bp, Pseudomonas sp.
ttgaacgtacgcccggacggcctggattttcgcgacagcatgtacgtcccgaccctggtggaagtgccgatccgccgcgaactcagcgactaccgcaaggccaacgtgccggtgctcgaccagggccaggaaaacgcctgtaccgggtatggcctggcgaccgtggcgcactacctgttgcgcacccgccagtaccagtccgacgacaccgccgtcagcccgcacatgctgtacgacctggcgcggcgttacgacgaatgggccggcgaggccgacgagggctccagttgccgcggggcgatgaagggttggtacaagcacggggtctgcacggcgccgcaatggcaggtcaacaaccggaacacgaccctgaccgaggccctggcccaggaagcggcgttgcgtccgctgggcgcgtacttccgggtcaatcacaccgacatcgtcgccatgcacgcggccatcgccgaagtcggcgtgctgtacgccagcgcgaccctgcacgcgggttggtacggggtggccgcggacggccatatcgagccctcgctggacctgctcggcggccacgccttcgcgatcgtcgcgtacgaccaggacggtttctgggtgcagaactcctggggcgagcagtggggcgacggcggtttcgcccacctgcgctacgacgactggctggccaacggcgccgacgcctgggtcgcgcgcctcggcgcgccgatcaccctgcgcgcgccgttgcaggcggccgggcaggccaagagcatggcgagcgcctcgtccagcgagaccctgcgcgagattcgcccgcatgtggtcagcctgggcaacgacggcgccttcgacccgcggggcgatatagccaccacggcggccagcgtggcggagattttcgacgtggacttcccgcgcatcacccagggctggaaaaaaaaacgcatcgtggtgtacgcccacggcggcttggtggggcaggccggggccatcgagaccgtggccggctaccgcgcggccatgttgcaggccgagtgctatccgctggcgttcatctggaagaccgactactggagcaccctgggcaatatgctggccgatgccgcgcggcgccggcgccccgaggggattctcgacgcgaccaaggacttcatgctcgaccgcctggacgacgcgttggagcccatcgcccggttgctgaccggcaaggccgagtgggacgaaatgaaagagaacggcctgcgcgccaccaccgacgccgcgggcggcgcgcgggtggtggccaaggccctggcgcggctggcggctgccggggtggaaatccatctggtcgggcatagcgccggcagcatcctgctggcgccgctggtgcagtacctggtgtccaagggcacggtgagcggcgggccgctggcgcgcagccaactgaaggggctggagacgaagatcgccagctgccacctgtgggcgccggcctgcaccgtcaagctgttccgcgagagctacctggaacccatccgcgacaagcgcatccagaagttcggcctgtttaccctgaccgatcaggccgagcgcgacgacaactgcgcctctatctataacaagtccctgctgtacctggtgtccgatgcgttcgaggacagggtccgcattccgctgattcgccccgacggcgagccgatcctcggcatggagcacttcgtcgagagcgaaaacgatgtcgccaagctgttcggcgccgggtccaacgccgactgggtgcgcgcgccgaacaacctgccgatgggccatcagggcgcctccgatgcccgccaccatggcgatttcgacaacgacgaggccacggtccgcgcgaccctggcgcgtatcctcggctcgggcgggacgcggcaggtcctggcgctgccgcagcctgtcgccgagcgcgcgcaatggcggcgtcgggtcgaccaggccagcagcatcgggcgccggcaatcatga

SEQ ID NO: 1610 - DNA, 1944 bp, Pseudomonas sp.
atgtatgttccgaccctggtggaagtgccggtacgccgggagctgagcgactaccgcaaggcccaggtgccggtgctcgaccagcgtcacgaaaacgcctgcaccggttatggactggcgacggtggcccattacttgctgcgcacccgtcgttatcagttcgataacaccgatgtcagcccgcacatgctgtatgaactggcccgccgttatgacgaatgggccggcgaggtggacgagggctccagttgtcgaggggcgatgaagggctggtacaagcacggggtgtgcccggcgctgaagtggccggccggtaatcaggtcacgacccttaccgaagcgctggccgaggaggcggcgcagcgtccgctgggggcgtacttcagggtcaatcacaccgatatcgttgccatgcattcggcgatcgccgaggtgggcgtgctatatgccagtgccacggtgcacgacggctggtatgcggtcgccgcggatggccgcatccagccctcggcgaacgtgctcggcggacacgccttcgcgatagtcgcctacgaccaggatggcttctggttgcagaactcctggggcgagacgtggggacacggcggtttcgcccacctgcgctatgacgactggctggtcaacggcgcggacgcctgggtcgcgcggctaggtgcgccgatcagcctgcgtgcgccgctgcagacgtcggcaccggccaaggtgctgacggcgtcgtcgtccagcgagaccctgcgggaaattcgcccgcatgtcatcagcctgggcaacgacggcgctttcaaccctcgcggcgacctggcgaccaccgcggccagcgtgcaggaaatattcgaggtggacttcccgcgtattaccgccggctgggggaaaaagcgcatcgtggtctatgcccacggcggcctggtgacccaggcaggagccatcgagaccgtggccggctatcgtgcggcgatgttaccggccgagtgttatccgctggcgttcgtctggaagaccgactattggagcaccctgggcaacatgctggccgatgccgcccggcgtcggcgctccgaaggcgtgctggatgcgaccaaggacttcatgctcgaccgcctggacgatgcgctggagcctattgcccgcttgctcaccggtaaggccgagtgggacgaaatgaaggaaaacggcttgcgtgccaccgtcagtgccgcgggcggcgcgcgggtggtggccaaggccctggcgcgcctggctgcgcaggatccgagcgtagagattcatctggtcgggcacagtgcgggcagtattctgctggcgccgctggtgcagtacctggtgggcaagggggcgatcgacagcgggccgctggcgggcagccagttgaaggggctggagacgaagatcgccagttgccatctatgggcgccggcctgcaccgtcaagctgttccgcgagagctacctggcgccgatccgcgacaagcggatcgagaaattcggcttgttcaccctgaccgaccaggccgagcgggatgaccattgcgcgcatatctacaacaagtccctgctgtatctggtcggcgacgccttcgaggatagggtgcgcataccgctgatccggcccgagggtgagccgatcctcgggatggcgcggttcgtcgccggtgaagtcgatctggcgcagttgttcggtagtggctcgaacgccgactgggtgcgggcccccaacgatttgccgatgggccatcggaatgcttccgcggcccgccaccatggcgatttcgacaacgacgaagccacgatccgcgcgacgctggagcgcattcgtgggcagggcgcggcccggcatgctctggcgttgccgcaacctgtcgccgagcgggcgcttcgccgccgccaggtggacctggccagcagcatcgaacggaggcagccatga

SEQ ID NO: 1611 - DNA, 318 bp, Pseudomonas sp.
atgcgccgcctattactcgtttcttcgttgttgctctgtctgcccgcaggttcagccatggcccgtgtcgatgcgggtgatgtcgccacctcggcaggggtttccgcctcgctgtactcgaccttcaaggacgacaaaatggtgattcccgcccgtgacgacgcctccagtttcgtcgccagcggtggcgccatccgtggtgtctacctggagtcggtgctgcagaaaatccgccaggaaaacccaggcctcaacgccagcgatgaagaactggccagggccatcctcactcaacaggcgcagcccgccgggcgctag

SEQ ID NO: 1612 - DNA, 318 bp, Pseudomonas sp.
atgcgccgcctattgctcgtttcctcgttgttgctctgtctgcccgcaggttcggccatggcccgtgtcgacgcgggcgatgtcgctacctcggccggggtttccgcctcgctgtactcgaccttcaaggacgacaagcgggtgatccctgcccgtgacgatgccagcagtttcgtcgccagcggcggcaccatccgcggtgtctacctggagtcggtgctgcagaaaatccgccaggaaaacccggagctcaacgccagcgatgaagacctggccagggcgatccttacccagcaaaccctgcctgccgggcaatag

SEQ ID NO: 1613 - DNA, 309 bp, Pseudomonas sp.
atgcgccgcctattgctggttgcttcgttgttgctctgcctgcccgccggttcggccatggcccgtgtcgacgcgggcgatgtcgccacctcagccggggtttccgcctcgctgtactcgaccttcaaggacgacaaacgggtgattcccgcccgtgacgatgcctccagtttcgtcgccagcggcggggccatccgcggcgtctacctggagtcggtgctgcagaaaatccgccgggaaaaccccggcctcaacgccagcgacgaagaactggcccgggcgatcctgacccagcaggccggccgctag

SEQ ID NO: 1614 - DNA, 318 bp, Pseudomonas sp.
atgcgccgtctgtttttagtatcttcactcgtgctttgcttgccctttggctcagccatggcccgtgtggatgcgggcgatgtcgccacctcagccggggtatccgcatcgctgtactcaacgttcaaggatcacaaaatggtcattcccgcgcgggatgacgcctccagttttgtcgccagcggcggcacgatccgtggcgtttacctggagtcggtattgaaggaaattcgccagaatcatcccgacctgaaggccagcgatgaagacctggccagagcgatcctcgtccaagaaggtgttccagccggtcaataa

SEQ ID NO: 1615 - DNA, 318 bp, Pseudomonas sp.
atgcgccgtctgattatcatctcttcccttttgctgtgtttacccttcggctccgctatggccaaagtggatgcgggcgatgtcgccacgtcagccggggtttccgcatcgctgtactcgaccttcaaggatgacaaacgggtgattccggcccgggatgacgcctccagcttcatcgccagtggcggcgcgattcgtggtgtttatctggagtcgtacttaaagcagattcgtcaggaacatcccggtctcaacgccagcgacgaagacctggccagagccatcctcgtccaggaaggcgtagctgcaggtcaataa

SEQ ID NO: 1616 - DNA, 318 bp, Pseudomonas sp.
atgcgccgactgattattatctcctccctgatgctgtgtttacccttcggttcagcgatggccaaagtggatgcggaagatgttgccacttcagccggggtttcagcttcgctgtattcgacgttcaaggatgacaaactgatgattcccgcccgggatgacgcctcgagctttgttgccagtggcggtgagattcgcggggtttatctggagtcggtactgaaaaaaatccgtcaggacaatcccggtctcaatgccagcgatgaagacctggcccgagccatcctgattcaggaaggcaatgctaccggccaatga

SEQ ID NO: 1617 - DNA, 297 bp, Pseudomonas sp.
atgcgccgtctgttgctcatatcttcactagtgctttgtttgcccgttggttcggccatggccgatgtggatgcaaaagatgtcgccacctcggccggtgtctccgcatcgctgtactcgacgttcaaggatgacaaaatcgtgattcccgcacgggatgacgcttctagcttcgtggcgagtggcggtacgattcgcggcgtttacctggagtcggtgttgaaggagattcgacaaaatcatcccgacctcaaggctagcgacgaggagctggccagagcgatcctcgctcagtaa

SEQ ID NO: 1618 - DNA, 318 bp, Pseudomonas sp.
atgcgccgtctgattatcatttcttcccttgtgctgtgcttaccgattggctccgcaatggccgatgtggacgcgaaagatgtcgccacttcggccggggtctccgcctcgctgtactcgacgttcaaagacgacaaactgatgattcccgcacgggatgatgcttccagcttcgtggccagtggcggtgcaatccgcggcgtgtatctggagcaggccttgcagcgggtccgtcagcagaatcctggactgaacgcaagtgacgaagacctggcccgcgccatccttgtccaggacggcatgcaagccagtcaataa

SEQ ID NO: 1619 - DNA, 297 bp, Pseudomonas sp.
atgcgccgtctgttgctcatatcttcactagtgctttgtttgcccgttggttcggccatggccgatgtagatgcaaaagatgtcgccacttcggccggggtctccgcatcgctgtactcgacgttcaaggacgacaaaatcgtgattcccgcacgggatgacgcctctagcttcgtggcgagtggcggtacgattcgcggcgtttacctggagtcggtgttgaaggaaattcgacaaaatcatcccgacctcaaggcaagcgacgaggacctggccaaagcgatcctcgctcaataa

SEQ ID NO: 1620 - DNA, 315 bp, Pseudomonas sp.
atgcgcaagttagtcctgatttcttctcttatgctttgcctgccggtcggttcggcgctggcccgcgttgacgcgggtgatgtcgccacttcggcaggtgtgtccgcgtcgctgtactcgaccttcaaggacgacaaaatggtgattccggcccgtgacgacgtgtctgcattcgtcgccagcggcggggccattcgtggggtttatcttgagtcggtactgcaacaggtgcgccaagccaaccctggcttgaacgccagtgatgaagacctggccaatgcgattctggtgcactacgaaggcgtgcagcagtag

SEQ ID NO: 1621 - DNA, 318 bp, unknown
  environmental sample
atgcgtcgtttactgatcgcttcttcgcttgttctctgcctgcccttcggcgcagccctggctgatgtcgacgctggtgatgtcgctacgtcggcgggggtatcggcttcgctgtactccaccttcaaggatgacaaacgggtgattccagcccgtgatgatgcctcctcgttcatcgccagtgatggtgcgattcgtggcgtctacctggagtcgatgattcagcgcgttcgtcagcaaaaccccggtttgcaagccagcgatgaagatattgcccgggcgatcctgacccaggatgagctgggcagtgaacgttga

SEQ ID NO: 1622 - DNA, 297 bp, Pseudomonas sp.
atgcgccgtctattgctcatatcttcactagtgctttgtttgcccgttggttcggccatggccgatgtagaggcaaaagatgtcgccacctcggccggtatctccgcatcgctgtactcgacgttcaaagatgacaaaatcgtgattcccgcccgggatgacgcctctagcttcgtggcaagtggcggtacgattcgcggcgcttatctggagtcggtgttgaagcaaattcgacaagatcaccccgacctccaggccagcgatgaagacttggccaaagcgatcctcgctcaataa

SEQ ID NO: 1623 - DNA, 321 bp, Pseudomonas sp.
atgcgccgcatatttatcatttcttccctggtactttgtttacccttcggctcggctctggccaaagtggatgcgggtgacgtcgccacttccgccggggtttccgcctcgctgtactcgacgttcaaagacgacaaactcatgattcccgcccgggatgacgcttccagcttcgtcgccagcggcggtgcgatccgtggtgcttatctggaggcgctgttgaaaaaggtccgccaggataatcccgccctcaacaacgcaagcgacgaagacctggcccgcgccattctcgtccgggaaggcgttgccaccgatcactga

SEQ ID NO: 1624 - DNA, 318 bp, unknown
  environmental sample
atgcgttattcactgcttgttccggcactgctgctgtgcattcccgcagggtccgccctggcccgtgtcgacgcgggcgatgtggccacctcggcaggggtttctgcttcgctctactccacattcaaggatgacaaacggatcattccggcgcgcgacgagctgtctgcgttcgtggccagtggcggtgcgattcgcggggcgtatgtggagtcggcgctggagcaggtacgccagagccatccaggattgcaggccagtgatgaagaactggccaaggcgctgttgtcgcaggatgaggttgtcgcggatcattga

SEQ ID NO: 1625 - DNA, 318 bp, unknown
  environmental sample
atgcgccacctactcctcgctcctgcgctgctgctcctgctgcctgccggtgctgccctggcccgcgtcgatgcgggcgacgtcgccacctcggccggtgtttccgcttcgctttactcgaccttcaaggacgataaacggatcatcccggcacgcgatgaactttctgccttcgttgccagtggcggtgcaatccgtggcgcctatgtggagtcggcgctggaacaagcccgcagggaccaccctgggctgcaagccaatgatgaagagctggcccgggccattctgtcgcaggatgatcggatagccgatcattga

SEQ ID NO: 1626 - DNA, 318 bp, unknown
  environmental sample
atgcgccacctactgctcgcccctgcgctgctgctcctgatgcctgccggtgctgccctggcccgcgtcgatgcgggcgacgtcgccacctcggccggtgtttccgcttcgctgtattcgaccttcaaggatgacaaacggatcatcccggcccgtgacgaactttcagcgttcgtcgccagcggcggtgccatccgcggcgcctatgtggagtcggcgcttgaacaggcccgcaaggaccatcctgggctgcaggccaacgatgaagagctggcccgggccatcctgtcgcaagatgaccctgtggctgaccattga

SEQ ID NO: 1627 - DNA, 318 bp, Pseudomonas sp.
atgcgccccttactgctcgcttcatcgctgctgctcctgctgcccgccggcgccgccctggcccgcgtcgatgccggtgacgtcgccacctcggcggggatctccgcctcgctgtactccaccttcaaggacgataagcgcattgtcccggcccgcgacgagttgtcggccttcgttgccagtggcggcgtgattcgtggcgcctacctggagtcggcactggcgcaggctcgccatgacaacccagggttgcagatcagcgacgaggaactggcaaaggcgctgttgtcgcaggatgacgccgcggtcggtcaatga

SEQ ID NO: 1628 - DNA, 270 bp, Pseudomonas sp.
atgatcaagaacacattggccgccgtcattgccactgccaccctgttgagcgccggtgcggcgctggccgaccgtcccggagccggctgggtgagcatcgaaaaagccatcgagaccgccaagaccaaggccggctatatcgagatctacaagattgaggccgacaacgacggctattgggaaggcgaaggccgcaagtccgacggcgtggtctacgaattccgcatcgacggcgcctcgggcaacgtcatccgcgaccagaaagactga

SEQ ID NO: 1629 - DNA, 270 bp, Pseudomonas sp.
atgttgaagaagacgcttgccgcattacttgccaccgccagcctgctgggcgctggagcggccctggccgaccgtccgggggccggttggatcaccattgaaaaagccattgaaaccgcaaagaccaaagccggctacgtggagatctacaagatcgaagcggacaacgatggctattgggaaggcgaagggcgcaagtccgatggcagtgtctatgagtttcgcatcgacggcgcctcgggcaatgtgctgcgcgaccagaaggactga

SEQ ID NO: 1630 - DNA, 270 bp, Pseudomonas sp.
atgttgaagaagacgcttgtcgcattgcttgccaccgccagcctgctgggcgccggagcggccctggccgaccgcccgggggccggttggatcaccattgaaaaagccattgaaaccgcaaagaccaaagccggctacgtggagatctacaagatcgaagcggacaacgatggctattgggaaggcgaagggcgcaagtccgatggcagtgtctatgaatttcgcatcgacggcgcctcgggcaatgtgctgcgcgaccagaaggactga

SEQ ID NO: 1631 - DNA, 270 bp, Pseudomonas sp.
atgcttaagaaaaccttagccgccgttgtcgcaaccaccgccttgctcagtgctggagccgccctggcggacaaaccgggcgcaggctggatcaccatcgaaaaagccatcgagaccgccaagaccaaggctggttacgtccagatctacaagatcgaagccgataacgatggctactgggaaggtgaggggcgcaaggccgatggcgtggtctatgagttccgcatcgatggtgagtcgggcaatgtgttgcgcgatcagaaagactga

SEQ ID NO: 1632 - DNA, 270 bp, Pseudomonas sp.
atgatcaagaaaaccctcgccgctttcgtcgccactgcctccctgctcagcgccggtgccgcgctggccgatcgtccgggcgcaggctggatcagcattgaaaaagccgtcgaaaccgcgaagaccaaggccggctacgtggagatctacgagatcgaagccgataacgacggctactgggaaggcaaaggccgcaaggccgacgggattgtctatgagttccgtatcgacggcgcttcgggcaacgttctgcgcgaccagaaagactga

SEQ ID NO: 1633 - DNA, 270 bp, unknown
  environmental sample
atgatcaaaaagacattcgcagccctgatcgccactgctggtttgctcagcgccggtgccgccctggcggacaaaccaggcgcaggctggatcaccatcgaaaaagccatcgaggtcgccaagaccaaggccggttatgtcgaggtctatgagatcggcgccgacaatgacggctactgggaaggcgaagggcgcaaggccgacggcactgtttacgaattccgcattgatggcgcttccggcaatgtgctgcgggaccagaaggactaa

SEQ ID NO: 1634 - DNA, 270 bp, unknown
  environmental sample
atgatcaaaaagacattcgcagccctgatcgccactgctggtttgctcagcgccggtgccgccctggcggacaaaccaggcgcaggctggatcaccatcgaaaaagccatcgaggtcgccaagaccaaggccggttatgtcgaggtctatgagatcggcgccgacaatgacggctactgggaaggcgaagggcgcaaggccgacggcattgtctacgaattccgcatcgacggcgcctcgggtaatgtgctccgcgaccaaagggactaa

SEQ ID NO: 1635 - DNA, 270 bp, Pseudomonas sp.
atgatcaaaaaaacctttgccgctgttgttgccactgctgccttgttcagtgccggtgccgcgatggccgatcgtcccggtgcgggctgggtcaccatcgaaaaggcgatcgagatcgtgaagaccaaggccggttacgtcgaagtctatgagatcgaagcggacaacgatggctactggaaaggtgagggccgtaaggcggatggctccgtttatgaattccgtatcgatggcacgtccggtaacgtactgcgcgatcagaaagactga

SEQ ID NO: 1636 - DNA, 270 bp, Pseudomonas sp.
atgctgaagaataccctcactgccatgcttgccactgccaccttgttcggcgctggcgccgccttggccgacaaacctggggccggctggatcaccatcgagaaagccatcgaaactgccaagaccaaggctggttacattgaggtctaccaggccgaagctgacgacaatggttattgggaagtcaaaggtcgcaaagctgatggtagcgtttatgaaatccgcatcgacggcgcctcgggcaatgtgttgcgcgaccagaaggactga

SEQ ID NO: 1637 - DNA, 300 bp, Pseudomonas sp.
atgaccactatccacaaatggagtgaaaaaatgatcaagaagacctttgctgcactgattgccactgcaagcctgctcagcgccggtgccgcgctggcagacaagccaggcgcaggctggatcaccatcgaaaaagccatcgataccgcgaagaccaaggcaggttatgtcgagatctacaagatcgaggccgataacgatggctattgggaaggggaagggcgcaagtctgacggtgtcgtctatgagttccgcatcgatggcgcatcgggcaacattctgcgcgatcagaaagactga

SEQ ID NO: 1638 - DNA, 270 bp, Pseudomonas sp.
atgttgaagaaaaccttagccgccctgtgtgcaaccaccgcgctgttgagcgccggcgctgcgctggcagacaagccgggtgcgggctggattccgattgaaaaagctattgaagtggcgaagaccaaggctgggtatgtcgaggtctacgccgccgaagccgataacgacggctactgggaagtcaaaggccgtaaatccgacggcgtggtgtatgaagcacgaatcgacggcgcctcgggcaatgtcctgcgcgaccagaaagattga

SEQ ID NO: 1639 - DNA, 270 bp, unknown
  environmental sample
atgttgaagaaaaccttgatcgccctgtgtgctacttccgccctgttgagcgctggcgccgccatggccgacaagccgggtgcaggctggatcaccattgagaaagccattgaggtggcgaaaaccaaggccggctacattgaggtctacgccgctgaagcggatgacaatggctattgggaagtcaaaggccgcaagtccgatggcacagtgtatgaggcgcgcatcgacggcgcttccggtaacgtgctgcgtgaccagaaagactga

SEQ ID NO: 1640 - DNA, 270 bp, unknown
  environmental sample
atgttgaagaaaaccttgatcgcactgtgtgctacttccgccctgatgagcgctggcgccgcaatggccgacaagccgggtgcaggctggatcaccattgaaaaagccatcgaggtggcgaaaaccaaggccggctacatcgaggtctacgccgctgaagcggatgacaatggctattgggaagtcaaaggccgcaaatccgatggcatcgtgtatgaggcgcgcatcgacggcgcgtccggcaacgtgctgcgagaccagaaagactga

SEQ ID NO: 1641 - DNA, 267 bp, unknown
  environmental sample
atgatcaagaaactgaccgctgccgttctggccaccgctgccctgaccaccgcacagttcgccttggcggacaagccgggcgccggctggatcaccatcgaaaaagcgatcgaaaaagccaagtcggcaggctacaccgagatctacaagatcgaagccgacgacaatggctactgggaaggcgaaggccgcaaggctgatagcctgacttacgagttccgcatcgacggcacttcaggcaacgtgctgcgcgatcagaaagactga

SEQ ID NO: 1642 - DNA, 267 bp, unknown
  environmental sample
atgatcaaaaagacattgactgccctggttgccacgtctgcgctgatgaccgccggtatggcattggccgatcgtcccggcgcgggctggatcaccattgagaaagccatagaaaccgccaaggccaagggctacaccgaggtttggaagatcgaggccgacaacgacggctattgggaaggggaagggcgcaaggccgatgctaccgtctacgagttccgtatcgatggcacctcgggcaacttcttgcgcgagcaaaaggactaa

SEQ ID NO: 1643 - DNA, 267 bp, unknown
  environmental sample
atgatcaagaaacttaccgctgccgttctcgccaccgctgccctgaccaccgcacagttcgctctggcggacaagccgggcgctggctggatcaccatcgaaaaagcgatcgaaaaagccaagtcggcaggctacacagagatctacagcatcgaagccgacgacaaaggctactgggaaggcgaaggccgcaaagcggacagcctgacgtacgaattccgcatcgacggcacctccggtaatgtcctgcgcgatcagaaagactga

SEQ ID NO: 1644 - DNA, 366 bp, Pseudomonas sp.
atgaacaacctgcttcgcggtcttgccgctttcgcattgatgagttgggccagcaccgcggcgttcgccgcgccccaggcgcacgcggacagcagcccggcgcccgccatgctgctggcgcagaacctgcccggcggcagcaacaacaatccctacaacagcccgatacgccgggccaaccccaacagcatgcagggcacccagcccagtgcgccggctgtccgcggggttaatccggtaccggtgcaacgccctccgaccctggagaacggcggcatcggcaacggttacccgcgcaccatcacccagccgcggatcatcgacccgacacccgtgaccccaccgcgtaaccaacagcagcgataa

SEQ ID NO: 1645 - DNA, 366 bp, Pseudomonas sp.
atgaacaacctgcttcgcggtcttgccgctttcgcattgatgagttgggccagcaccgcggcgttcgccgcgccccaggcgcacgcggacagcagcccggcgaccgccatgctgctggcgcagaacctgcccggcagcatcaacaacaatccctacaacagcccgatacgccgggccaaccccaacagcatgcagggcacccagcccagtgcgccggctgtccgcggggttaatccggtaccggtgcaacgtcctccgaccctggagaacggcggcatcggcaacggttacccgcgcaccatcaccccgccgcggatcatcgatccgacacccgtgacccctccgcgtaaccaacagcagcgataa

SEQ ID NO: 1646 - DNA, 363 bp, Pseudomonas sp.
atgaacaacctgcttcgcggtcttgccgtgttcgccctgatgagcggggccagcctcccggcgttcgccgcgcccccggcgcacgcggacagcaacccggcgcccgccacgctgctggcgcagaacctgcccggcagcaacaacaatccctacaacagcccgatacgccgggccaaccccaacagcatgcagggcacccagcccagtgccccggctgtccgtggggttaatccggtgccggtgcaacgccctccgaccctggagaacggcggcatcggcaacggttacccgcgcaccatcacccagccgcggatcatcgatccgacaccggtgaccccaccccgtaaccaacagcagcgataa

SEQ ID NO: 1647 - DNA, 357 bp, Pseudomonas sp.
atgaacaacctgcttcgcggtcttgccgtgtttgccctgatgagcggggccagcatcgcggcgttcgccgcaccccaggcgtcctcggacagcaccgccatgctgctggcgcagaacctgcccggcagcagcaacaacaatccctacaacagcccgatacgccgggccaaccccaacagcatgcagggcacccagcccagtgccccggctgtccgcggggttaatccggtaccggtgcaacgccctccgaccctggagaacggcggcatcggcaacggttacccgcgcaccatcacccagccgcggatcatcgatccgacacccgtgaccccaccgcgtaaccaacagcagcgataa

SEQ ID NO: 1648 - DNA, 354 bp, Pseudomonas sp.
atgaacaacctgcttcgcggtcttgccgtgtttgccctgatgagcggggccagcatcgcggcgttcgccgcaccccaggcgtcctcggacagcaccgccatgctgctggcgcagaacctgcccggcagcaacaacaatccctacaacagcccgatacgccgggccaaccccaacagcatgcagggcacccagcccagtgccccggctgtccgcggggttaatccggtaccggtgcaacgccctccgaccctggagaacggcggcatcggcaacggttacccgcgcaccatcacccagccgcggatcatcgatccgacacccgtgaccccaccgcgtaaccaacagcagcgataa

SEQ ID NO: 1649 - DNA, 324 bp, Pseudomonas sp.
atgagcggggccagcgccgtggcgttcgccgcgcctcaggcggcgcatccggacagcagcccaacgtccgccatgctgttggcgcagaacctgcccggcagtaacaacccctacaacagcccgatacgccgggccaaccccaacagcatgcagggcacccagcccagcaccccggctgtccgtggggttaatccagtacccgtgcaacgccctccgaccctggagaacggcggcatcggcaacggttacccgcgcaccatcacccagccacggatcatcgatccgacacccgtgaccccaccgcgtaaccaacagcagcgataa

SEQ ID NO: 1650 - DNA, 366 bp, Pseudomonas sp.
atgaaccatctgcttcgtacgcttgccgcgctcgccctggtcggctgggccggcagcccggcgttcgccgcgccccgggcgccgctcgcggacccaagcccgagcgccatgctgctggcgcagaacctgccgggcagcaacaacaatccctacaacagcccgatccgccgggccaaccccaacagcatgcagggcacccagcccagcgcgccgccggtacgcgggccgaccacggtgccggtgccgcggccgccgaccctggagaacggcggcatcggcaacggttatccgcgcaccggcgcgcaaccaccgcgaatcatcgacccgagtgtcaagaccgctccccgcgacccacagcagcgatag

SEQ ID NO: 1651 - DNA, 369 bp, Pseudomonas sp.
atgaacagcctgcttcgcgcactgctcgcctgcgcactgtcgagcgggaccagcatcgcggtgtacgccgcgccccaggcgcccgccgccgagtcggcgccgctggccggcgtgctgctggcgcagaacctgcccggcagcaacaacaacccctacaacagcccgatccgccgggccaaccccaacagcatgcagggcacccagcccagcgcaccgcccctgcgcgggcccaatacggtgccggtgccgcgccctccgaccctggaaaacggtggcatcggcaacggttacccacggacggccccatcgccgcggactgtagatcccacacccacgaccacaccgccgcgtaatcaaccgcagcgatag

SEQ ID NO: 1652 - DNA, 1935 bp, Pseudomonas sp.
atgttgaaagccggcctctatacgctcctggccctgctgagcctggccccgggcgcccaggccggatccatgcagtggtcgagcatccgcgacggcagcctgtacctgcgcgccgcccagccggaccggctgaagatcggctggagcccagcctggcagagcgacgccaatcgcgagcagttgtacctgctgcagcccgacggccagttgttcaagcaactggagatccgcgccgaccaggcctatggcgagcaggacatcgagctgccagcggccgcgggcgactatcgcctgcagattcccggctacagctttcgcggattcaccgtcagccaccgcggtagcaccgcggcgcaattcgagccgaccaaggtgcatttcagcgccgaagtccacagcggcgccgagctgtacttccgggtggcggccggcgagcaggcgatactggccggcaaatattacggcggcgtcagcgtcttgcaggccagccgcctgagcgatggcgccaaggttcgcctggagctgaaagaacatccggcctacgggcaattcgaccaggtggcgctgccgccggccgaacaggaccaagtctggcgcctggccctgggcggctccggcaaggcggcgttctggctggacggcacggccaatctgtttgcccaggaggtccagcaactgcacccgctggaccagccccggggcgaggcccacctgcagctgaaagcccagatcctggggaccacgccgcacctgggtatcgccctgccctatgcccagccgccgcagtccaccttcggcctgttgcaggcgattggcgcccgcgcggccaacttctacagcttcgtcgatgtgatcgagcaggagcccgagcgggaaatcggctttcgccggctgtaccgcgagcgcttcgggatcgaccgcgacatcaccctgctggccggcaccgggcgccgcgccgtgctcgcggcggacgcccagagtttcgccggcctcgacgcctggctggccgacagcgtgcgcctggccggcaacggcctgcattacctggccttcgccgacgagcccaacctcaactacccggactacagcagctacgccctgtacttcgagcagatgctggcccgggccaaggccaatcccgaggcccgcgccgctggtgtgcggatcgccatgccggccagttcgcggctgctcgacgggccgttccgggtcggcgccgggcaacgccgcggcatcgactgggcgcgcaagctgctggagcggcacggtcaggacatcgacgccctggcctggcacgaatggatggtccgcgacctgctcgccacccgccgctaccgcgacagcgtgcgcgccgccgccgagctggtgggcctggatgccgcgggccggccgcgcaaggccctgctgctgagccagaccaatatctccagcggccgcgatctgagcccctatcagcaggacacccattacgccggcctgtggtgggcctcggtggtgatcaacgcctcggcggacggcctgctggacatgctcaactggttccaggccgccgacgagccggactaccccaagggcatgctcgcgcaacgcagcgccagccagttcagcctcaagccggtggccgtggcccagcagttcattgcccggcactggctggcccatgtgcaagccctggacaacccggccttcgaggtcgatgccctggccatgagcgaggccggccgccacagcctgctgggggtgaacaaggcgtcgcgggtgcaggcggtgagcctcgacggccccggcgacctgtgccaggccgcgccgctcaagctgagcctgctcggccccgacgaccagcctcgcgacgcggccgttgaatgccgcgatggccgggtgcacttcgagctgcccggcgaaaccctgtttgccctgacctggaaagccttatga

SEQ ID NO: 1653 - DNA, 1935 bp, Pseudomonas sp.
atgttgaagaccgctctctacacattcctggccctgctcagcctggccccgggcgcccacgccaactccatgcagtggtcgagcatccgcgacggcagcctgtacctgcgcgccgcccagccggaccggctgaagatcggctggagcccggcctggcagagcgacgccaatcgcgagcagctgtacctgctgcggcccgacggccagctgttcaagcaactggagatccgcgccgaccaggcctatggcgaacaggacatcgagctgccagcggccgcgggcgactaccgcctgcagattcccggctacagctttcgcggattcaccgtcagccaccgcggcagcacggcggcgcagttcgagccgaccaaggtgcatttcagcgccgaagtgcacagcggcgccgagctgtacttccgggtggcggccggcgagcaggcgatactggccggcaaatattacggcggcgtcagcgtcttgcaggccagccgcctgagcgatggcgccaaggttcgcctggaactgaaagaacatccggcctacgggcaattcgaccaggtggcgctgccgccggccgaacaggacgaagtgtggcgtctgtcgctgggcggctccggcaaggcggcgttctggctggacggcacggccaatctgtttgcccaggaggtccagcaactgcacccgctggaccagccccggggcgaggcgcgcctgcagctgaaagcccagatcctggggaccacgccgcgcctgggcatcgccctgccctatgcccagccgccgcagtccaccttcggcctgttgcaggcgattggcgcccgcgcggccaacttctacagcttcgtcgatgtgctcgagcaggagcccgagcgggaaatcggctttcgccggctgtaccgcgagcgcttcgggatcgaccgcgacatcaccctgctggccggcaccgggcgccgcgccgtgctcgcggcggacgcccagagtttcgccggcctcgacgcctggctggccgacagcgtgcgcctggccggcaacggcctgcattacctggccttcgccgacgagcccaacctcaactacccggactacagcagctacgccctgtacttcgagcagatgctggcccgggccaaggccaatcccgaggcccgcgcggccggggtgcggatcgccatgccggccagttcgcggctgctcgacgggccgttccgggtcggcgccgggcaacgccgcggcatcgactgggcgcgcaagctgctggagcggcacggtcaggacatcgacgccctggcctggcacgaatggatggtccgcgacctgctcgccacccgccgctaccgcgacagcgtgcgcgccgccgccgagctggtgggcctggatgccgcgggccggccgcgcaaggccctgctgctgagccagaccaatatctccagcggccgcgatctgagcccctaccagcaggacacccattacgccggcctgtggtgggcttcggtggtgatcaacgcctcggcggacggcctgctggacatgctcaactggttccaggccgccgacgagccggactatcccaagggcatgctcgcgcaacgcagcgccagccagttcagcctcaagccggtggccgtggcccagcagttcattgcccggcactggctggcccatgtgcaggccctggacaacccggccttcgaggtcgatgccctggccatgagcgaggccggccgccacagcctgctgggagtgaacaaggcatcgcgggtgcaggcggtgagcctcgacggccccggcgacctgtgccaggccgcgccgctcaagctgagcttgctcggccccgacgaccagcctcgcgacgcggccgttgaatgccgcgatggccgggtgcacttcgagctgcccggcgaaaccctgtttgccctgacctggaaagccttatga

SEQ ID NO: 1654 - DNA, 1935 bp, Pseudomonas sp.
atgctgaagaccgctttctacacattcctggccctgctcagtctggccccgggcgcccaggccgaatccatgcagtggtcgagcatccgcgacggcagcctgtacctgcgcgccgcccagccggaccggctgaagatcggctggagcccggcctggcagagcgacgccaatcgcgagcagctgtacctgctgcagcccggcggccagctgttcaagcaactggagatccgcgccgaccaggcctatggcgagcaggacatcgagctgccagcggccgcgggcgactatcgcctgcagattcccggctacagctttcgcggattcaccgtcagccaccgcggtagcacggcggcgcaattcgagccgaccaaggtgcatttcagcgccgaagtgcacagcggcgccgagctgtacttccgggtggcggccggcgagcaggcgatactggccggcaaatattacggcggcgtcagcgtcttgcaggccagccgcctgagcgatggcgccaaggttcgcctggaactgaaagaacatccggcctacgggcaattcgaccaggtggcgctgccgccggccgaacaggacgaagtctggcgcctgtccctgggcggctccggcaaggcggcgttctggctggacggcacggccaatctgtttgcccaggaggtccagcaactgcacccgctggaccagccccggggcgaggcccacctgcagttgaaagcccagatcctggggaccacgccgcgcctgggcatcgccctgccctatgcccagccgccgcagtccaccttcggcctgttgcaggcgattggcgcccgcgcggccaacttctacagcttcgtcgatgtgatcgagcaggagcccgagcgggaaatcggctttcgccggctgtaccgcgagcgcttcgggatcgaccgcgacatcaccctgctggccggcaccgggcgccgcgccgtgctcgcggcggacgcccagagtttcgccggcctcgacgcctggctggccgacagcgtgcgcctggccggcaacggcctgcattacctggctttcgccgacgagcccaacctcaactacccggactacagcagctacgccctgtacttcgagcagatgctggcccggaccaaggccaaccccgaggcccgcgcggccggggtgcggatcgccatgccggccagttcgcggctgctcgacgggccgttccgggtcggcgccgggcaacgccgcggcatcgactgggcgcgcaagctgctggagcggcacggtcaggacatcgacgccctggcctggcacgaatggatggtccgcgacctgctcgccacccgccgctaccgcgacagcgtgcgcgccgccgccgagctggtgggcctggatgccgcgggccggccgcgcaaggccctgctgctgagccagaccaatatctccagcggccgcgatctgagcccctatcagcaggacacccattacgccggcctgtggtgggcctcggtggtgatcaacgcctcggcggacggcctgctggacatgctcaactggttccaggccgccgacgagccggactaccccaagggcatgctcgcgcaacgcagcgccaaccagttcagcctcaagccggtggccgtggcccagcagttcattgcccggcactggctggcccatgtgcaagccctggacaacccggccttcgaggtcgatgccctggccatgagcgaggccggccgccacagcctgctgggggtgaacaaggcgtcgcgggtgcaggcggtgagcctcgacggccccggcgacctgtgccaggccgcgccgctcaagctgagcctgctcggccccgacgaccagcctcgcgacgcggccgttgaatgccgcgatggccgggtgcacttcgagctgcccggcgaaaccctgtttgccctgacctggaaagccttatga

SEQ ID NO: 1655 - DNA, 1935 bp, Pseudomonas sp.
atgttgaaagccggtttctacacgctcctggctctgctgagtctggccccgggcgcccaggccggatccatgcagtggtcgagcatccgcgacggcagcctgtacctgcgcgccgaccagccggaccggctgaagatcggctggagcccggcctggcagagcgacgccaaccgcgagcagctgtacctgctgcagcccggcggccagttgttcaagcaactggagatccgcgccgaccaggcctatggcgaacaggacatcgagctaccagcggccacgggcgactatcgcctgcagattcccggctacagctttcgcgggttcagggtcagccaccgcggcagcacggcggcgcagttcgagccgaccaaggtgcatttcagcgccgaagtccacagcggcgccgagctgttcttccgggtcgcggccggtgagcaggcgatcctggccggcaagtattacggcggcgtcagcgtcttgcaggccagccgcctgagcgatggcgccaaggtgcgcctggaactgaaagaacacccggcctacgggcaattcgaccaggtggcgctgccgccggccgaacaggaccaagtctggcgcctggccctgggcggctccggcaaggcggcgttctggctggacggcacggccaatctgtttgcccaggaggtccagcaactgcacccgctggaccagccccggggcgaggcgcgcctgcagctgaaagcccagatcctcgggaccacgccgcgcctgggcatcgccctgccctatgcccagccgccgcagtccaccttcggcctgttgcaggcgattggcgcccgcgcggccaacttctacagcttcgtcgatgtgatcgagcaggagcccgagcgggaaatcggctttcgccggctgtaccgcgagcgcttcgggatcgaccgcgacatcaccctgctggccggcaccgggcgtcgcgccgtgctcgcggcggacgcccagagtttcgccggcctcgacgcctggctggccgacagcgtgcgcctggccggcaacggcctgcattacctggccttcgccgacgagcccaacctcaactacccggactacagcagctacgccctgtacttcgagcagatgctggcccgggccaaggccaaccccgaggcccgcgcggccggggtgcggatcgccatgccggccagttcgcggctgctcgacgggccgttccgggtcggcgccgggcaacgccgcggcatcgactgggcgcgccagctgctggagcggcacggtcaggacatcgacgccctggcctggcacgaatggatggtccgcgacctgctcgccacccgccgctaccgcgacagcgtgcgcgccgccgccgagctggtgggcctggatgccgcgggccggccgcgcaaggccctgctgctgagccagaccaatatctccagcggccgcgatctgagcccctatcagcaggacacccattacgccggcctgtggtgggcctcggtggtgatcaacgcctcggcggacggcctgctggacatgctcaactggttccaggccgccgacgagccggactaccccaagggcatgctcgcgcaacgcagcgccaaccagttcagcctcaagccggtggccgtggcccagcagttcattgcccggcactggctggcccatgtgcaagccctggacaacccggccttcgaggtcgatgccctggccatgagcgaggccggccgccacagcctgctgggggtgaacaaggcgtcgcgggtgcaggcggtgagcctcgacggccccggcgacctgtgccaggccgcgccgctcaagctgagcctgctcggccccgacgaccagcctcgcgacgcggccgttgaatgccgcgatggccgggtgcacttcgagctgcccggcgaaaccctgtttgccctgacctggaaagccttatga

SEQ ID NO: 1656 - DNA, 1935 bp, Pseudomonas sp.
atgttgaaagccggtttctacacgctcctggccctgctgagtctggccccgggcgcccaggccggatccatgcagtggtcgagcatccgcgacggcagcctgtacctgcgcgccgaccagccggaccggctgaagatcggctggagcccggcctggcagagcgacgccaaccgcgagcagctgtacctgctgcagcccggcggccagttgttcaagcaactggagatccgcgccgaccaggcctatggcgaacaggacatcgagctgccagcggccacgggcgactaccgcctgcagattcccggctacagctttcgcgggttcagggtcagccaccgcgacagcacggcggcgcaattcgagccgaccaagctgcatttcagcgccgaagtccacagcggcgccgagctgttcttccgggtcgcggccggtgagcaggcgatcctggccggcaagtattacggcggcgtcagcgtcttgcaggccagccgcctgagcgatggcgccaaggttcgcctggaactgaaagaacacccggcctacgggcaattcgaccaggtggcgctgccgtcggccgaacaggaccaagtctggcgcctggccctgggcggctccggcaaggcggcgttctggctggacggcacggccaatctgtttgcccaggaggtccagcaactgcacccgctggaccagccccggggcgaggcccacctgcagctgaaagcccagatcctggggaccacgccgcacctgggtatcgccctgccctatgcccagccgccgcagtccaccttcggcctgttgcaggcgattggcgcccgcgcggccaacttctacagcttcgtcgatgtgatcgagcaggagcccgagcgggaaatcggctttcgccggctgtaccgcgagcgcttcgggatcgaccgcgacatcaccctgctggccggcaccgggcgccgcgccgtgctcgcggcggacgcccagagtttcgccggcctcgacgcctggctggccgacagcgtgcgcctggccggcaacggcctgcattacctggctttcgccgacgagcccaacctcaactacccggactacagcagctacgccctgtacttcgagcagatgctggcccgggccaaggccaaccccgaggcccgcgccgctggtgtgcggatcgccatgccggccagttcgcggctgctcgacgggccgttccgggtcggcgccgggcaacgccgcggcatcgactgggcgcgcaagctgctggagcggcacggtcaggacatcgacgccctggcctggcacgaatggatggtccgcgacctgctcgccacccgccgctaccgcgacagcgtgcgcgccgccgccgagctggtgggcctggatgccgcgggccggccgcgcaaggccctgctgctgagccagaccaatatctccagcggccgcgatctgagcccctatcagcaggacacccattacgccggcctgtggtgggcctcggtggtgatcaacgcctcggcggacggcctgctggacatgctcaactggttccaggccgccgacgagccggactaccccaagggcatgctcgcgcaacgcagcgccaaccagttcagcctcaagccggtggccgtggcccagcagttcattgcccggcactggctggcccatgtgcaggccctggacaacccggccttcgaggtcgatgccctggccatgagcgaggccggccgccacagcctgctgggggtgaacaaggcgtcgcgggtgcaggcggtgagcctcgacggccccggcgacctgtgccaggccgcgccgctcaagctgagcctgctcggccccgacgaccagcctcgcgacgcggccgttgaatgccgcgatggccgggtgcacttcgagctgcccggcgaaaccctgtttgccctgacctggaaagccttatga

SEQ ID NO: 1657 - DNA, 1935 bp, Pseudomonas sp.
atgctgaaagccggcctctatacgctcctggccctgctcagcctggccccgggcgcccaggccgactccatgcagtggtcgagcatccgcgacggcagcctgtacctgcgcgccgcacagccggaccggctgaagatcggctggagcccggcctggcagagcgacgccaaccgcgagcagctgtacctgctgcagcccggcggccagttgttcaagcaactggagatccgcgccgaccaggcctatggcgaacaggacatcgagctgccagcggccgcgggcgactaccgcctgcagattcccggctacagctttcgcgggttcagggtcagccaccgcggcagcaccgcggcgcagttcgagccggccaaggtgcatttcagcgccgaggtgcacagcggcgccgagctgttcttccgggtcgcggccggcgagcaggcgctactggccggcaagtattacggcggggtcagcgtcttgcaggccagccgcctgagcgatggcgccaaggtccgcctggagctgaaagaacatccggcctacgggcaattcgaccagctggcgctgccgccggccgaacaggacgaagtctggcgcctggccctgggcggctccggcaaggcggcgttctggctggacggcacggccaatctgtttgcccaggaggtccagcaactgcacccgctggaccagccccggggcgaggcgcgcctgcggctgcaaccccggatcctcggggacacgccgcgcctgggcatcgccctgccctatgcccagccgccgcagtccaccttcggcctgttgcaggcgattggcgcccgcgcggccaacttctacagcttcgtcgatgtgatcgagcaggagcccgagcgggaaatcggctttcgccggctgtaccgcgagcgcttcgggatcgaccgcgacatcaccctgctggccggcaccgggcgccgcgccgtgctcgcgtcggacgcccagagtttcgccggcctcgacgcctggctggccgacagcgtgcgcctggccggcaacggcctgcattacttggccttcgccgacgagcccaacctcaactacccggactacggcagctacgccctgtacttcgagcagatgctggcccgggccaaggccaaccccgaggctcgcgcggccggggtgcggatcgccatgccggccagttcgcggctgctcgacgggccgttgcgggtcggcgccgggcaacgccgcggcatcgactgggcgcgccagctgctggcccggcatgcccaggacatcgacgccctggcctggcacgaatggatggtccgcgacctgctcgccacccgccgctaccgcgacagcgtgcgcgccgccgccgagctggtgggcctggatgccgcgggccggccgcgcaaggccctgctgctgagccagaccaatatctccagcggccgcgacctgagcccctaccagcaggacacccattacgccggcctgtggtgggcctcggtggtgatcaatgcctcggcggacggcctgctggacatgctcaactggttccaggccgccgacgagccggactaccccaagggcatgctcgcgcaacgcagcgccagccaattcagcctcaagccggtggccgtggcccagcagttcattgcccggcactggctggcccatgtgcaggccctggacaacccggcgttcgaggtcgatgccctggccatgagcgaggccggtcgccacagcctgctgggggtgaacaaggcgtcgcgggtgcaggcggtgagcctcgacggccccggcgacctgtgccaggccgcgccgctcaggctgagcttgctcggccccgacgaccagcctcgcgacgcggccgttgaatgccgcgatggccgcgtgcacttcgagctgcccggcgaaaccctgtttgccctgacctggaaagccttatga

SEQ ID NO: 1658 - DNA, 1935 bp, Pseudomonas sp.
atgctgaaagccggtctctacacactcctggccctgctgagcctggccccgggcgcccaagccgaatccatgcagtggtcgagcatccgcgacggcagcctgtacctgcgcgccgcacaaccggatcggctgaagatcggctggagcccggcctggcagagcgacgccaatcgcgagcagctgtacctgctgcagcccgacggccagttgttcaagcaactggagatccgcgccgaccaggcctatggcgaacaggacatcgaactgccagcggccacgggcgactatcgcctgcagattcccggctacagctttcgcgggttcaccgtcagccaccgcggcagcaccgcggcgcaattcgaaccgaccaaggtgcatttcagcgccgaagtgcacagcggcgccgagctgttcttccgggtcgcggccggtgagcaggcgatactggccggcaagtattacggcggcgtcagcgtcttgcaggccagccgcctgagcgatggtgccaaggttcgcctggagctgaaagaacacccggcctacgggcaattcgaccaggtggcgctgccgccggccgaacaggacgaagtctggcgcctggccctgggcggctccggcaaggcggcgttctggctggacggcacggccaatctgtttgcccaggaagtccagcaactgcacccgctggaccagccccggggcgaggcgcgcctgcagttgaaagcccagactctcgggaccacgccgcgcctgggcatcgccctgccctatgcccagccgccgcagtccaccttcgatctgttgcaggcgattggcgcccgcgcggccaacttctacagcttcgtcgatgtgatcaagcaggagcccgagcgggaaatcggctttcgccggctgtaccgcgagcgcttcgggatcgaccgcgacatcaccctgctggccggtaccgggcgccgcgctgtgctcgcggcggacgcccagagcttcgccggcctcgacgcctggctggccgacagcgtgcacctggccggcaacggcctgcactacctggccttcgccgacgagcccaacctcaactacccggactacagcagctacgccctgtacttcgagcagatgctggcccgggccaaggccaatcccgaggctcgcgcggccggtgtgcggatcgccatgccggccagttcgcggctgctcgacgggccgttccgggtcggcgccgggcaacaccgcggcatcgactgggcgcgcaagctgttggagcggcatggcgaggacatcgacgccctggcctggcacgaatggatggtccgcgacctgctcgccacccgccgctaccgcgacagcgtgcgcgccgccgccgagctggtgggcctggatgccgggggccggccgcgcaaggccctgctgctgagccagaccaatatctccagcggccgcgacctcagcccctaccagcaggacacccattacgccggcctgtggtgggcctcggtggtgatcaacgcctccgccgacggcctgctggacatgctcaactggttccaggccgccgacgagccggactaccccaagggcatgctcgcgcaacgcagcgccagccagttcagcctcaagccggtggccgtggcccagcagttcattgcccggcactggctgaccaatgtgcaggtcctggacaactcggccttcgaggtcgatgccctggccatgagcgaggccggccgccacagcctgctgggggtgaacaaggcgtcgcgggtgcaggcggtgagcctcgatggccccgtcggcctgtgccacgcatcgcagctcaagctgagcctgctcggccccgacgaccagcctcgcgacgcgccccttgaatgccgcgatggccgggtgcacttcgagctgcccggcgaaaccctgtttgccctgacctggaaagccttatga

SEQ ID NO: 1659 - DNA, 1935 bp, Pseudomonas sp.
atgctgaaagccggcctctacacgctcctgaccctgctgagcctggccccgggcgcccaggccggatccatgcagtggtcgagcatccgcgacggcagcctgtacctgcgcgccgaccagccggaccggctgaagatcggctggaacccggcctggcagagcgacgccaatcgcgagcagctgtacctgctgcagcccggcggccagttgttcaagcaactggagatccgcgccgaccaggcctacggcgaacaggacatcgagctgccagcagccacgggcgactaccgcctgcagattcccggctacagctttcgcgggttcgccgtcagccaccgcggcagcaccgcggcgcagttcgagccgaccaaggtgcatttcagcgctgaagtgcacagcggcgccgagctgtacttccgggtcgcggccggtgagcaggcgatactggccggcaagtattacggcggcgtcagcgtcttgcaggccagccgcctgagcgatggtgccaaggttcgcctggagctgaaagaacacccggcctacgggcaattcgaccaggtggcgctgccgccggccgaacaggacgaagtctggcgcctggccctgggcggctccggcaaggcggcgttctggctggacggcacggccaatctgtttgcccaggaagtccagcaactgcacccgctggaccagccccggggcgaggcgcgcctgcagttgaaagcccagactctcgggaccacgccgcgcctgggcatcgccctgccctatgcccagccgccgcagtccaccttcgatctgttgcaggcgattggcgcccgcgcggccaacttctacagcttcgtcgatgtgatcgagcaggagcccgagcgggaaatcggctttcgccggctgtaccgcgagcgcttcgggatcgaccgcgacatcaccctgctggccggcaccgggcgccgcgccgtgctcgcggcggatgcccagagcttcgccggcctcgacgcctggctggccgacagcgtgcacctggccggcaacggcctgcactacctggccttcgccgacgagcccaacctcaactacccggactacagcagctacgccctgtacttcgagcagatgctggcccgggccaaggccaatcccgaggctcgcgcggccggtgtgcggatcgccatgccggccagttcgcggctgctcgacgggccgttccgggtcggcgccgggcaacgccgcggcatcgactgggcgcgcaagctgctggcgcagcacggtgaggatattgacgccctggcctggcacgaatggatggtccgcgacttgctcgccacccgccgctaccgcgacagcgtgcgcgccgccgccgagctggtgggcctggatgccgcgggccggccgcgcaaggccctgctgctgagccagaccaatatctccagcggccgcgacctcagcccctatcagcaggacagccattacgccggtctgtggtgggcctcggtggtgatcaacgcctccgccgacggcctgctggacatgctcaattggttccaggccgccgacgagccggactaccccaagggcatgctcgcgcaacgcagcgccagccagttcagcctcaagccggtggccgtggcccagcagttcattgcccggcactggctgaccaatgtccaggtcctggacaactcggccttcgaggtcgatgccctggccatgagcgaggccggccgccacagcctgctgggggtgaacaaggcgtcgcgggtgcaagcggtgagcctcgatggccccgtcggcctgtgccacgcgtcgcagctcaagctgagcctgctcggccccgacgaccagcctcgcgacgcgccccttgaatgccgcgatggccgggtgcacttcgagctgcccggcgaaaccctgtttgccctgacctggaaagccttatga

SEQ ID NO: 1660 - DNA, 1935 bp, Pseudomonas sp.
atgctgaaaaccgcgctctgcgccgccctggcgctgctgggcctgccctccggggcccgggccgagcccatgcaatggtcgagcatccgcgacggcagcctgtacctgcgccccgcccagccggacaccctgcgcatcagctggagcccggcctggcagagcgacgccaaccgcgagaagctgtacctgctggcacccgacggccagctggcgcggcaactggatatccgcgccgaccaggcctacggcgagcaagacatcgcactggcgccggcggcggacgactatcgcctgcagattcccggctacagctttcgcggtttcaccgtcagccaccaggacagcacggccgcgcagttcgagccgaccaaggtgcatttcagcgccgaagtacgcagcggcgccgagctgttcttcaaggtcgcggccggcgagcgggcgatcctcgccggcaagtactacggcggcgtcagcctgttgcaggccagccgcctgagcgacggcgccaaggtgcgcctggccctggaacagcatggggattacgggcagttcgatcaggtggcgctgccgccggccgagcgcgacgaagtctggcgcctgtccctgggcggcgccggcaaggcggcgttctggctcgacggcacggccaacctgttcgcccaggacgcccgccaactgcaaccgctgcgcctgccccgcggcgaggtgcgcctgcacctgcaagcgcccctcctcgggccgaccccgcgcctgggcatcgccctgccctatgcccagccgccgtcgtcgaccttcggcctgttgcaggcgatcgacgcccgggcggccaacttctacagcttcgtcgatgtgatcgagcaggaacccgagcgcgaaatcggttttcgccggctgtaccgcgagcgctttaacatcgaccgcgacatcaccctgctggccggcaccgggcgccggccggtactggcggccgatgcccagagcctggccgggctcgacgcctggctggccgacagcgcgcgcctgcccggccagggcctgcattacctggccttcgccgacgaacccaacctcaattacccggactacgccacctacgccgcctacttcgaccgcatgctggcccaggtcaaggccaaccccgaggcccgcgcggccggggtacggatcgccatgccggccagttcgcgcctgctcgacgggccgttccggatcggcgccgggcaacgccgcggcatcgactgggcgcgcaagctgctggcgcggcacggcgacgacatcgacgccctggcctggcacgaatggatggtgcgcgacctgctcgccacccgccgctaccgcgacagcgtgcgcgccgccgccgagctggtgggcctggacgccaccggccggccgcgcaaggccctgctgctgagccagaccaatatctccagcggcccggaccttagcccctatcaacaagacacccattacgccggcctgtggtgggcctcggtggcgatcaacgcctcggccgacggccagctggacatgctcaactggttccaggccgccgacgaacccggctaccccaagggcatgctcgcccagcgcagcgccagccagttcagcctcaagccggtggccgtggcccagcaattcattgcccggcactggctggccacggtgcaggccctggacaacccggccttcgaggtcgatgccctggccatgcgcgaggccggccgccacagcctgttgggggtgaacaaggccgcgcgcgcgcaggcggtgagcctggaaggcccgcccgagctgtgccgcgccgcgccgttcgccctgagcctgctgggccccgacgaccagcctcgcgccgccagcgttgaatgccgcgatggccgcgtgcgcttcgagctgcccggcgaaaccctgtttgccctgacctggaacgcgttatga

SEQ ID NO: 1661 - DNA, 1929 bp, Pseudomonas sp.
atgaaaccctgttccctgctcgccctgatgctgatctcggcggccactgccttgaacgccgcgcccctgcaatggggcgatatccgcgacggcagcctgtacctgcaagccgaggccggcgacaccctgcacctgcgctggagcccggcctggcagagcgacgccaaccaggagcagctgtacctgctgcgcccggacggccagttgctgcaacagctggagatccgcgccgaccaaccctacggccagcgggaagtccaactgcccgcggcccagggcgactaccgactgcaggtgccgggctacagctttcgcaacttcaagatcagccacgacagcgccaccctggcccagttcgaaccggccaaggtgcatttcagcgccgacgtgcccagtggcgtggagctgtattttcgcgtggccgccggagagcaggcggtactggcgggcaagtattacggtggggtcagcgtgctccaggccacgcgcctgagtgaccaccagttgctgcgcctgaagctggtggagcacccgcagtacggtcagttcgaccagatccaactgccggtggcccagcaggacgaggtctggcgcctgtccctgggcggctcgggcaaggtggcgttctggctcgacggcaccgccaacctgttcgcccaggacctgcgccagttgcacccgctgcaatggacaccgggccgggtcgagctgagcctcaagccgcagatgcgcggccccagcccgcacctggggatcgccctgccctatgcccagccgccgcagtcgacctttgaactgctgcgggccctggggccgcgggcggccaacttctacagcttcgtcgatgtgattcagcaggagccccagcgcgagctgggctttcgccggctgtaccgcgaaacgttcaagatcgaccgcgacattaccctgctggcgggcaccgggcgccgcgcggtgctggcagccgacagccagagcttcgccggcctcgacgcctggctggcggacagcgtgcgcctgggtaaccagggcctgcactacctggcgtttgccgacgaacccaacctcaactaccccagctacaccgtgttcgccagctacttcgagcgcatgctggagcgcgccaaggccaaccccgaggcccgggccgcaggcgtgcgcattgccatgccggtcagttcgcggctgctggacgggccgttccgcatcggtgccgggcagcgccgcggcatcgactgggcgcgccagttgctgcaggcccacggcgccgatatcgacgccctggcctggcacgagtggatggtccgcgacctgctggccacccgccgctaccgcgacagcgtgcgcgccgccgccgacctggtaggcctggatgacctgggccggccgcgcaaggcgctgttgctgagccagaccaatatctccagcggcccggacctgagcccctatcagcaggacactcactacgccgccctgtggtggatgtcggtggtggccaatgcctcccaggacggcctgctggacatgctcaactggttccaggccgccgatgagcccgagtaccccaagggcatgctggcccagcacgacgcccagcgcttcagcctgaagccggtggccgtggcccagcaattcatccagcggcactggctggggcaggtccaggcgctggacaacccggccttcgaggtggatgccctggcactgcgcgatggcccccgccacagcctgctgggcgtgaccaagaccccgcgcgcacaaaccatcgacctggatggcgccgagcagatctgccaggccggcccgagcctggaactgctcggcgccgacgggcacagccgctccgccgccgtgcagtgcagcaatggccgggcccagttgcaggtgcccggtgaaaccctgtttgccttgacctggaaaaccctatga

SEQ ID NO: 1662 - DNA, 1929 bp, Pseudomonas sp.
atgaaaccctgttccctgctcgccctgatgctgatctcggcggccactgccctgcacgccgcgcccctgcaatggggcgatatccgcgacggcagcctgtacctgcaagccgaggccggcgacaccctgcacctgcgctggagcccggcctggcagagcgacgccaaccaggagcagctgtacctgctgcgcccggacggccagttgctgcaacagctggagattcgcgccgaccaaccctacggccagcgggaagtccaactgcccgcggcccagggcgactaccggctgcaggtaccgggctacagctttcgcaacttcaaggtcagccacgacagcgccaccctggcccagttcgaaccggccaaggtgcatttcagcgccgacgtgcccagtggcgtggagctgtattttcgcgtggccgccggagagcaggcggtactggcgggcaagtattacggtggggtcagcgtgctccaggccacgcgcctgagtgaccaccagttgctgcgcctgaagctggtggagcacccgcagtacggtcagttcgaccagatccaactgccggtggcccagcaggacgaggtctggcgcctgtccctgggcggctcgggcaaggtggcgttctggctcgacggcaccgccaacctgttcgcccaggacctgcgccagttgcacccgctgcaatggacaccgggccgggtcgagctgaacctcaagccgcagatgcgcggccccagcccgcacctggggatcgccctgccctatgcccagccgccgcagtcgacctttgaactgctgcgggccctggggccgcgggcggccaacttctacagcttcgtcgatgtgatccagcaggaaccccagcgcgagctgggctttcgccggctgtaccgcgaaacgttcaagatcgaccgcgacatcaccctgctggcgggcaccgggcgccgtgcggtgctggcagccgacagccagagcttcgccggcctcgacgcctggctggcggacagcgtgcgcctgggcaaccagggcctgcactacctggcgttcgccgacgaacccaacctcaactaccccagctacgccgtgttcgccagctacttcgggcgcatgctggagcacgtcaaggccaaccccgaggcccgggccgcaggtgtgcgcattgccatgccggtcagttcgcggctgctggacgggccgtttcgcatcggtgccgggcagcgccgcggcatcgactgggcgcgccagttgctggaggcccacggcgccgatatcgacgccatggcctggcacgagtggatggtccgcgacctgctggccacccgccgctaccgcgccagcgtgcgcgccgccgccgacctggtgggcctggatgacctgggccggccgcgcaaggcgctgttgctgagccagaccaatatctccagcggcccggacctgagcccctatcagcaggacactcactacgccgccctgtggtggatgtcggtggtggccaatgcctcccaggacggcctgctggacatgctcaactggttccaggccgccgatgagcccgagtaccccaagggcatgctggcccagcacgacgcccagcgcttcagcctgaagccggtggccgtggcccagcaattcatccagcggcactggctggggcaggtccaggcgctggacaacccggccttcgaggtggatgccctggcactgcgcgatggctcgcgccacagcctgctgggcgtgaccaagaccccacgcgcgcaaaccgtcgacctggacggcgccgagcagatctgccaggccggcccgagcctggagctgctcggcgccgacgggcacagccgctccgccgccgtgcagtgcagcaatggccgggcccagttgcaggtgcccggtgaaaccctgtttgccttgacctggaaaaccctatga

SEQ ID NO: 1663 - DNA, 1929 bp, Pseudomonas sp.
atgaaaccctgttccctgctcgccctgatgctgatctcggcggccactgccctgcacgccgcgcccctgcaatggggcgatatccgcgacggcagcctgtacctgcaagccgaggccggcgacaccctgcacctgcgctggagcccggcctggcagagcgacgccaaccaggagcagctgtacctgctgcgcccggacggccagttgctgcaacagctggagattcgcgccgaccaaccctacggccagcgggaagtccaactgcccgcggcccagggcgactaccggctgcaggtaccgggctacagctttcgcaacttcaaggtcagccacgacagcgccacccgggcccagttcgaaccggccaaggtgcatttcagcgccgacgtgcccagtggcgtggagctgtattttcgcgtggccgccggagagcaggcggtactggcgggcaagtattacggtggggtcagcgtgctccaggccacgcgcctgagtgaccaccagttgctgcgcctgaagctggtggagcacccgcagtacggtcagttcgaccagatccaactgccggtggcccagcaggacgaggtctggcgcctgtccctgggcggctcgggcaaggtggcgttctggctcgacggcaccgccaacctgttcgcccaggacctgcgccagttgcacccgctgcaatggacaccgggccgggtcgagctgagcctcaagccgcagatgcgcggccccagcccgcacctggggatcgccctgccctatgcccagccgccgcagtcgacctttgaactgctgcgggccctggggccgcgggcggccaacttctacagcttcgtcgatgtgatccagcaggaaccccagcgcgagctgggctttcgccggctgtaccgcgaaacgttcaagatcgaccgcgacatcaccctgctggcgggcaccgggcgccgggcggtgctggcagccgacagccagagcttcgccggcctcgacgcctggctggcggacagcgtgcgcctgggcaaccagggcctgcactacctggcgttcgccgacgaacccaacctcaactaccccagctacgccgtgttcgccagctacttcgggcgcatgctggagcacgtcaaggccaaccccgaggcccgggccgcaggtgtgcgcattgccatgccggtcagttcgcggctgctggacgggccgtttcgcatcggtgccgggcagcgccgcggcatcgactgggcgcgccagttgctagaggcccacggcgccgatatcgacgccatggcctggcacgagtggatggtccgcgacctgctggccacccgccgctaccgcgccagcgtgcgcgccgccgccgacctggtgggcctggatgacctgggccggccgcgcaaggcgctgttgctgagccagaccaatatctccagcggcccggacctgagcccctatcagcaggacactcactacgccgccctgtggtggatgtcggtggtggccaatgcctcccaggacggcctgctggacatgctcaactggttccaggccgccgatgagcccgagtaccccaagggcatgctggcccagcacgacgcccagcgcttcagcctgaagccggtggccgtggcccagcaattcatccagcggcactggctggggcaggtccaggcgctggacaacccggccttcgaggtggatgccctggcactgcgcgatggcccgcgccacagcctgctgggcgtgaccaagaccccgcgcgcacaaaccatcgacctggacggcgccgagcagatctgccaggccggcccgagcctggaactgctcggcgccgacgggcacagccgctccgccgccgtgcagtgcagcaatggccgggcccagttgcaggtgcccggtgaaaccctgtttgccttgacctggaaaaccctatga

SEQ ID NO: 1664 - DNA, 1929 bp, Pseudomonas sp.
atgaaaccctgttccctgctcgccctgacatggctctgggcagcctcatccctgcacgcggcgcccatgcaatggggcgacatccgcgacggcagcctgtacctccaggccgacaccgccgacaccctgcaactgcgctggagcccggcctggcaaagcgacgccaaccaggagcagctgtacctgctggccccagacggccagttgctgcaacagctggagattcgcgccgaccagccctacggccagcgcgacgtgccgctccccgccgcccagggcgactaccgactgcaggtgccaggctatagcttccgcaacttcaaggtgttccacgacagcgccacccgtgcccagttcgagccggccaaggtgcacttcagtgccgacgtgcccagcggggtcgagctgtactttcgcgtggctgcaggtgagcaagcggtgctggccggcaaatactacggcggagtcagcgtgctgcaggcggtccggctgagtgacggccagcgggtgcgcctgcagctcgaagaacacccgcaatacggcgagttcgaccaggtggcgctgcccgaggccccgcaggacgaaatctggcgcctgtccctgggtggctcgggcaaggtcggcttctggctcgacggcagcgccaacctgttcgcccaggacctgcgccaactgcacccgctgcaatggaccccggcgcaggtcgagctcagcctcaaaccgcaagtgcgtggccccagcccgcaattggggatcgccctgccctacgccgaaccaccaccgtcgaccttcgaactgttgcgcgccctcggcccgcgggcggccaacttctacagtttcgtcgatgtgatcaaggccgagcccgaacgcgagctgagttttcgcaagctgtaccgcgaaaccttcgggatcgatcgcgacatcaccctgctggcgggcaccggacgccgtgcggtgctggatgccgacagcaccagcttcgccgggctcgacgcctggctggccgacagtgtgcgcttgggcaaccagggcctgcactacctggccttcgccgacgagcccaacctcaactaccccagctatggggcgtttgccagctacttcacgcggatgctggagcacaccaaggccaaccccgaggcccgggcggccggcgtgcggatcgccatgccggcgagttcccggctgctggacgggccgttccggatcggtgccgggcagcgccgcggcatcgactgggcgcggcaactgctggccgagcacggccacgacatcgatgccctggcctggcatgaatggatggtccgcgacctgctggccacccgccgctaccgcaacagcgtgcgcgccgccgccgacctggtggggctcgacgaacagggccggccgcgcaaggccctgctgctgagccagaccaacatctccagcggcccggacctcagcccctatcagcaagacactcactatgccgccctgtggtgggcctcggtggtgatcaacgcctcccaggatggcctgctggacatgctcaactggttccaggccgccgatgagcctgagtaccccaagggcatgctggcccagcgcaacggccagagcttcagcctgaaaccggtggcggtggctcagcagttcatccagcagcactggctggcgcaggtccaggccctggacaacccggccttcgaagtcgacgccctggccctgcaggatggccggcgccacagcctgctgggggtggccaagacaccccgcgcccagaccatcgcgctgagcggcgcgctgcagatctgccagtccggcccgagccttgccctgctcggccccgacggtcgcaggcgcagcgctgaggtgcagtgcagcgatggccgagcagtgttccaactgcccggtgaaaccctgtttgccttgacctggaaaaccctatga

SEQ ID NO: 1665 - DNA, 1929 bp, Pseudomonas sp.
atgaaaccctgttccctgctcgccctgatgctgatctcggcgaccactgccctgcacgccgcgcccctgcaatggggcgatatccgcgacggcagcctgtacctgcaagccgacgccggcgacaccctgcacctgcgctggagcccggcctggcagagcgacgccaaccaggagcagctgtacctgctgcgcccggacggccagttgctgcaacagctggagattcgcgccgaccaaccctacggccagcgggaagtccaactgcccgcggcccagggcgactaccggctgcaggtcccgggctacagctttcgcaacttcaaggtcagccacgacagcgccacccgggcccagttcgaaccggccaaggtgcatttcagcgccgacgtgcccagtggcgtggagctgtattttcgcgtggccgccggagagcaggcggtactggcgggcaagtattacggtggggtcagcgtgctccaggccacgcgcctgagtgaccaccagttgctgcgcctgaagctggtggagcacccgcagtacggtcagttcgaccagatcccgctgccggtggcccagcaggacgaggtctggcgcctgtccctgggcggctcgggcaaggtggcgttctggctcgacggcaccgccaacctgttcgcccaggacctgcgccagttgcacccgctgcaatggacaccgggccgggtcgagctgagcctcaagccgcagatgcgcggccccagcccgcacctggggatcgccctgccctatgcccagccgccgcagtcgacctttgaactgctgcgggccctggggccgcgggcggccaacttctacagcttcgtcgatgtgatccagcaggaaccccaacgcgagctgggctttcgccggctgtaccgcgaaacgttcaagatcgaccgcgacatcaccctgctggcgggcaccgggcgccgggcggtgctggcagccgacagccagagcttcgccggcctcgacgcctggctggcggacagcgtgcgcctgggcaacctgggcctgcactacctggcgttcgccgacgaacccaacctcaactaccccagctacgccgtgttcgccagctacttcgggcgcatgctggaacacgtcaaggccaaccccgaggcccgggccgcaggtgtgcgcattgccatgccggtcagttcgcggctgctggacgggccgtttcgcatcggtgccgggcagcgccgcggcatcgactgggcgcgccagttgctggaggcccacggcgccgatatcgacgccatggcctggcacgagtggatggtccgcgacctgctggccacccgccgctaccgcgccagcgtgcgcgccgccgccgacttggtgggcctggatgacctgggccggccgcgcaaggcgctgttgctgagccagaccaatatctccagcggcccggacctgagcccctatcagcaggacactcactacgccgccctgtggtggatgtcggtggtggccaatgcctcccaggacggcctgctggatatgctcaactggttccaggccgccgatgagcccgagtaccccaagggcatgctggcccagcacgacgcccagcgcttcagcctgaagccggtggccgtggcccagcaattcatccagcggcactggctggggcaggtccaggcgctggacaacccggccttcgaggtggatgccctggcactgcgcgatggcccgcgccatagcctgctgggcgtgaccaagaccccgcgcgcacaaaccatcgacctggacggcgccgagcagatctgccaggccggcccgagcctggagctgctcggcgccgacgggcacagccgctccgccgccgtgcagtgcagcaatggccgggcccagttgcaggtgcccggtgaaaccctgtttgccttgacctggaaaaccctatga

SEQ ID NO: 1666 - DNA, 1929 bp, Pseudomonas sp.
atgaaaccctgttccctgctcgccctgatgctgatctcggcggccactgccctgcacgccgcgcccctgcaatggggcgatatccgcgacggcagcctgtacctgcaagccgaggccggcgacaccctgcacctgcgctggagcccggcctggcagagcgacgccaaccaggagcagctgtacctgctgcgcccggacggccagttgctgcaacagctggagattcgcgccgaccaaccctacggccagcgggaagtccaactgcccgcggcccagggcgactaccggctgcaggtaccaggctacagctttcgcaacttcaaggtcagccacgacagcgccacccgggcccagttcgaaccggccaaggtgcatttcagcgccgacgtgcccagtggcgtggagctgtattttcgcgtggccgccggagagcaggcggtactggcgggcaagtattacggtggggtcagcgtgctccaggccacgcgcctgagtgaccaccagctgctgcgcctgaagctggtggagcacccgcagtacggtcagttcgaccagatcccgctgccggtggcccagcaggacgaggtctggcgcctgtccctgggcggctcgggcaaggtggcgttctggctcgacggcaccgccaacctgttcgcccaggacctgcgccagttgcacccgctgcaatggacaccgggccgggtcgagctgagcctcaagccgcagatgcgcggcccgagcccgcacctgggaatcgccctgccctatgcccagccgccgcagtcgacctttgaactgctgcgggccctggggccgcgggcggccaacttctacagcttcgtcgatgtgatccagcaggaaccccagcgcgagctgggctttcgccggctgtaccgcgaaacgttcaagatcgaccgcgacatcaccctgctggcgggcaccgggcgccgtgcggtgctggcagccgacagccagagcttcgccggcctcgacgcctggctggcggacagcgtgcgcctgggcaaccagggcctgcactacctggcgttcgccgacgaacccaacctcaactaccccagctacgccgtgttcgccagctacttcgggcgcatgctggagcacgtcaaggccaaccccgacgcccgggccgcaggtgtgcgcattgccatgccggtcagttcgcggctgctggacgggccgtttcgcatcggtgccgggcagcgccgcggcatcgactgggcgcgccagttgctggaggcccacggcgccgatatcgacgccatggcctggcacgagtggatggtccgcgacctgctggccacccgccgctaccgcgccagcgtgcgcgccgccgccgacctggtgggcctggatgacctgggccggccgcgcaaggcgctgttgctgagccagaccaatatctccagcggcccggacctgagcccctatcagcaggacactcactacgccgccctgtggtggatgtcggtggtggccaatgcctcccaggacggcctgctggacatgctcaactggttccaggccgccgatgagcccgagtaccccaagggcatgctggcccagcacgacgcccagcgcttcagcctgaagccggtggccgtggcccagcaattcatccagcagcactggctggggcaggtccaggcgctggacaacccggccttcgaggtggatgccctggcactgcgcgatggtccgcgccacagcctgctgggcgtgaccaagaccccgcgcgcacaaaccatcgacctggacggcgccgagcagatctgccaggccggcccgagcctggagctgctcggcgccgacgggcacagccgctccgccgccgtgcagtgcagcaatggccgggcccagttgcaggtgcccggtgaaaccctgtttgccttgacctggaaaaccctatga

SEQ ID NO: 1667 - DNA, 1929 bp, Pseudomonas sp.
atgaaaccccgttacctgttcgccctgctgctgatcacggcgatcccttcgctgcacgcggcgcccatgcaatgggccgatatccgcgacggcagcctgtacctgcaggtcgacacccccgacaccctgcaactgcgctggagcccggcctggcaaagcgatgccaaccaggagcagctgtacctgctgcaacccgatggtcagttgctgcaacagctggacattcgcgccgatcaaccctacggccagcgcgagatccaactgcccgccgcccggggcgactatcggctgcaggtgccgggctacagctttcgcaacttcaaggtcagccacgacagctcgaccctggcccagttcgaaccggccaaggtgcatttcagcgccgatgtgcccagcggcgtcgagctgtactttcgcgtggccgccggcgaacaggcacaactggccggcaagtattacggcggggtcagcgtgctccaggccacacgcctgagcgacggcgagcagcggcgcctggcgttggtggagcatccgcagtacgggcagttcgaccggattgccctgcccgtggccgggcaggacgaaatctggcgcctgtccctgggcggctcgggcaaggtggcattctggctcgacggcagcgccaacctgttcgcccaggacctgcgccagttgcacccgctgcaatggaccccgagccgggtcgaactgaccctcaagccacaagggcgcggtcccagcccgcagttggggatcgccctgccctatgccgaaccgccgccatcgaccttcgacctgctgcgggccctggggccgcgggcggccaacttctacagcttcgtcgatgtgatccgccaggagcccggacgggagctgagcttccgccgcctgtaccgcgagacgttcagcatcgagcgtgacatcaccctgctggccggcaccgggcgccgcgcggtgctggaggcggacagcagcagtttcgccgggctcgacgcctggctggcggacagcgtgcagctgggcaaccagggcctgcactacctggcgttcgccgacgaacccaacctcaactaccccaactatggggtgtttgctgactatttcgcgcggatgctggaacacaccaaggccaaccccgaggcccgggccgccggggtgcgcatcgccatgccggtcagctcgcgactgctggacggcccctttcgcgtcggcgccgggcagcgccggggcatcgactgggcccgccaactgctggccgagcacgcgcccgacatcgacgccctggcctggcacgagtggatgatccgcgacctgctggccacccgtcgctatcgtgccagcgtgcgcgccgccgcggatctggtgggcctggaccagcaaggccggccgcgcaaggcgctgctgctgagccagaccaatatctccagcggcccggacctgagcccctaccagcaggacacccactacgccgccctgtggtggacctcggtggtgatcaacgcctcccaggacggcctgctggacatgctcaactggttccaggccgccgacgaaccggaataccccaagggcatgctggcccagcaggatgcccagcgcttcagcctcaagccggtggccgtggcccagcagttcatccagcaacactggctgggcgaggtccagtccctggacaacccggcttttgaagtggatgccctggccctgcgggacggcccgcgccacagcctgctgggggtggccaagaccccgcgggagcagaccatcgatctggggggcgcgccacagctctgcgagtccgcccccagcctgcaactgctcggggccgatggccgcgcccgcgccggccagttgcagtgcagccaaggccgggccagcttccagctgcccggtgaagccctgttcgccttgacctggaacaccctatga

SEQ ID NO: 1668 - DNA, 1299 bp, Pseudomonas sp.
gtggatatgcgcaaaggcgccttgatcagtggggattcagcgtcctattcggacctcaatcgcctcaaccagctcaaggtcggcgacaagaacagcgaaggcaacctgcgcaaagtggcgcaggagttcgagtcgctgttcctcggtgaaatgctcaagtccatgcgttcggccaccgaggccctgggcaaggacaacccgatgaacacgccggaagccaagcaataccaggaaatgtacgaccagcagttggccgtttccatgtcccgcgaaggcgggggtatcggcctggccgatgtgctgttgcgccagatgtcgaagaacaagccgctggcctcgggcgaggcggccaccttgtctgccgccaagcagcaagaggcgctggacaaggccaaggcgccagtgcctacgcctgtggcggccggaacgctgcccgatgggcctttgtcgcgcagcaacggccagcgtccgctctgggcctcgcgggctgtgagcgcgccgcaaggggccgagggcattcaccgcaacgacatggaattgatcaaccagcgccgcctggccctgccgccgaaactggccgaccgcctgctcgccgggctggtgccttcggcgtcggtcaagcctgaggccgtggcgcagaacgtcttgccggatcgtgccgttgccgccgtcaagccggctaccggtgagctggccaatggtgactggctggccgcgctcaaggctgtcgagcccaaaggcgacatgcaggtttacggtcgcgccgtggcccagccaccgctggcaccggcgcgcaaggccttccgcgatgccgatgaattcgtcaacgccatgctgccaatggccaaggaagccgctgatcgcatcggggtcgacccacgttacctggtggcccaggccgcgttggaaaccggttggggcaaatcggtgatgcgccagcccgatggcagcagcagccacaacctgttcggtatcaaggccagcaagaactggacgggcgattcggcgcgggcgatcaccagcgagttccgcaatggcgagatggtcaaggagacggccgagttccgttcctatgcttcgtaccgcgacagtttccacgacttggtcaacctgctgcaaagcaacagtcgctatcaagatgtgctgaagtcggccgataacccggaacagtttgtacgcgagttgcagaaggccggttacgccaccgacccgaactacgccaacaagatttcgaacatagcccggcagatgacgagttaccaaaactacgcctcggctggtgccaccacgactttataa

SEQ ID NO: 1669 - DNA, 1308 bp, Pseudomonas sp.
atggttgatatgcgcaaaggcgccttgatcagcggggattcgggttcttactcggacctgaatcgcctcaaccagctcaaggtcggcgacaagaacagcgaaggcaacctgcgcaaagtggcgcaggaattcgagtcgctgttcctcggcgaaatgctcaagtccatgcgttcggccaccgaggccttgggcaaggacaatccgatgaacacgccggaagccaagcagtaccaggaaatgtacgaccagcagttggccgtttccatgtcccgcgaaggcggtggtatcggcctggccgacgtgctgctgcgccagatgtccaagaacaagccgctggcgtctggcgaggcggcaacattgtcggctgccaagcagcaagaggcgcaggacaaggtcgccaaggcgccggtaccgacgccagtggcagccgggaccctgcccaccgatggcccgttgtcgcgcaccaatggccagcgtccgttgtgggcttcgcgggccgtgagtgcgccgcaaggggccgagggcgtccaccgcaacgacatggaattgctcaaccagcgccgcctggccctgccgccgaaactggccgaccgcctgctcgccggcctggtgccttcggcgtcggccaatgccgatgtgcctgcgcagaacctgctgcctgatcgcgccatcgccgccgtcaagccggccaccggcgaactggccaatggcgactggctggccgcgctcaaggcgtccgagcccaaaggcgacatgcaggtctatggtcgcgccgtggcacagccaccgctggcaccggcgcgcaaggccttccgcgatgccgatgaattcgtcaacgccatgctgccaatggccaaggaagcggcggaccgcatcggtgtcgacccgcggtacctggtggcccaggccgccctggaaaccggttggggtaaatcggtcatgcgccagcccgatggcaacagcagccacaacctgttcggcatcaaggccagcgcgaattggaagggcgattcggcgcgggcgatcaccagcgaattccgcaatggcgcgatggtcaaggagacggccgagttccgttcctacgcctcgtaccgcgacagtttccatgatctggtcaatctgttgcaaagcaacagtcgctatcaagatgtactgaagtcggccgataacccggaacagtttgtacgcgagttgcagaaagccggttacgccaccgacccgaactacgccagcaagatttcgaacatagcccggcagatgacgagttaccaaaactacgcttctgcaggcgccaccacgactttataa

SEQ ID NO: 1670 - DNA, 1305 bp, unknown
  environmental sample
atggatatgcgcaagggcgctttgatcagcggggattcgggttcctactcggacctgaaccgcttgaaccagctcaaggttggcgacaagaacagcgacggcaacctgcgtaaagtggcgcaggaattcgagtcgctgtttctcggcgaaatgctcaagtccatgcgttcggccaccgaggccttgggcaaggacaaccccatgaatacgcccgaggccaagcaataccaggaaatgtacgaccagcaattggccgtttccatgtcccgcgagggcggcggtatcggcctggccgatgtgctgctgcgccagatgtccaagaacaaaccgctggcgcccggtgaggcggccacgttgtcggctgccaagcaacaagaggcgctggacaaggtcgccaaggcaccggtgccgacaccggtggctgccgggaccctgcctactgacggtccattgtcgcgtaccagcggccaacgtccattgtgggcgtcgcgggccgtgagtgcgccgcaaggggccgagggtgtccaccgcaacgacatggaattgctcaaccagcgccgcctggccttgccgccgaaactggctgaccgtctgctcgccggcctggtgccttcggcgtcggccaataccgatgtgcccgcacagaacctgctgccggatcgcaccatcgccgccgtcaagccggccaccggcgaactggccaatggcgactggttggccgcgctcaaggctgccgagcccaaaggcgacatgcaggtctatggtcgtgccgtggcccagccaccgctggccccagcgcgcaaggccttccgcgatgccgatgaattcgtcaacgccatgctgccaatggccaaggaagccgccgaccgcatcggtgtcgacccgcgctacctggtggcccaggctgccctggaaaccggttggggcaaatcggtcatgcgccagcccgatggcagcagcagccacaacctgttcggcatcaaggccagcgccaattggaagggcgattcggcgcgggcgatcaccagcgaattccgcaatggcgcgatggtcaaggagacggccgagttccgttcctatgcctcgtatcgcgacagcttccacgacttggtcaacctgctgcaaagcaacagtcgctatcaagatgtgttgaagtcggccgataacccggaacagtttgtacgcgagttgcagaaagccggttacgccactgatccgcactacgccagcaagatttcgaacatagcccggcagatgacgagttaccaaaactacgcttctgcaggcgccaccacgactttataa

SEQ ID NO: 1671 - DNA, 1305 bp, Pseudomonas sp.
atggacatgcgcaagggtactttgatcagcggggattcgggctcctactcggacttgaaccgcctgaaccaactcaaggttggcgacaagaacagcgacggcaacctgcgtaaagtggctcaggaattcgagtcgctgttccttggcgaaatgctcaagtccatgcgttcggccaccgatgcgctgggcaaggacaatccgatgaacacgccggaagccaagcagtaccaggaaatgtacgaccagcagttggccgtctccatgtcccgcgaaggcggtggtatcggcctggccgatgtgctgctgcgccagatgtccaagaacaaaccgctggcgccaggcgaggcggcaagcttgtcggccgccaagcagcaagaggcgctggacaaggtcgccaaggcagcggtgccaacgccagtggccgccggcacgctgcccgacggtcctctttcacgctccaacggccagcgtccgctgtgggcttcccgggcggtgaacgtgccgcaaggggcgggcgagggtactcatcgcaatgacatggagctgatcaaccagcgccgcctggccttgccgccgaaactggctgaccgcctgcttgccgggctggtgccttcggccgcggccaacgccgatgtgcctgcacagaacgtcctgacggatcgcgccatcgccgccgtcaagccggcgactggcgaattggccaatggcgactggttggccgcactcaaggccgccgagccgaaaggcgacatgcaggtctatggccgcgccgtggcccagccaccgctggcaccggcacgcaaggccttccgcgatgccgacgaattcgtcaacgccatgttgccaatggccaaggaagcggccgaccgcatcggtgtcgacccgcgttacctggtggcccaggccgctctggaaaccggttggggcaaatcggtcatgcgccagcccgatggcagcagcagtcacaacctgttcggtatcaaggccagcgccaattggaagggcgattcggcccgggcgatcaccagcgaatttcgcaatggtgcgatggtcaaggagacggccgagttccgttcctacgcctcgtaccgcgacagtttccacgacttggtcaacctgctgcaaagcaacagtcgctatcaagatgtgctgaagtctgccgataacccggaacagtttgtacgcgagttgcaaaaggccggttacgccaccgatccgcactacgccagcaagatttcgaacatagcccggcagatgacgcgttaccaaaactacgcttctgcaggcgccaccacgactttataa

SEQ ID NO: 1672 - DNA, 1305 bp, Pseudomonas sp.
atggacatgcgcaaaggcactttgatcagcggggattcggggtcctactcggacttgaaccgcctgaaccagctcaaggttggcgacaagaacagcgacggcaacctgcgcaaagtggcgcaggaattcgagtcgctgttcctcggcgaaatgctcaagtccatgcgttcggccaccgatgcgctgggcaaggacaatccgctcaatacgcctgaagccaagcagtaccaggaaatgtacgaccagcagttggccgtttcgatgtctcgcgaaggcggcggtatcggcctggccgatgtgctgctgcgccagatgtccaagaacaaaccgctcgcgccaggcgaggccgcaagcctgtcggctgccaagcagcaagaggcgctggataaggtcgccaaggttgcggtgcccacgccagtggctgccggaacgctgcccgacgggcctctttcgcgctccaacggccagcgcccattgtgggcgtcccgggccgtgaatgctccgcaaggggcgggcgagggcactcaccgcaacgacatggaactgatcaaccaacgccgcttggccttgccgccgaaactggcggaccgtctgctcgccgggctggtgccttcggcgtcggtcaatgccgaggcgcccgcgcagaacgtcttgacggatcgcgccatcgccgctgccaaaccggccactggcgaactggccaacggcgactggctggcggcgctcaaggcttccgagccgagcggggggatgcaggtttacggtcgctcggtggcacagccaccactggcaccggcccgcaaggccttccgcgatgccgacgaattcgtcaacgccatgttgccgatggccaaggaagctgcggaccgcatcggtgtcgacccacgttacctggtggcccaggccgccctggaaaccggttggggcaaatcggtcatgcgccagcccgatggcaccagcagtcacaacctgtttggtatcaaggccagccagagctggaaaggcgattcggcgcgggccatcaccagcgagttccgcaacggcgagatggtcaaggagacggccgagttccgctcctacgcctcgtatcgcgacagtttccatgacttggtcaatctgttgcaaagcaacagccgctatcaagatgtgctgaagtcggccgataaccccgaacagtttgtacgcgagttgcaaaaggccggttacgccaccgacccgcactacgccagcaagatttcgaacatagcccggcagatgacgagttaccaaaactacgcttcggcaggcgccaccacgactttataa

SEQ ID NO: 1673 - DNA, 1305 bp, Pseudomonas sp.
atggatatgcgcaagggcgctttgatcagcggggattcgggttcctactcggacctcaatcgcctgaaccagctcaaggtcggcgacaagaacagtgacggcaacctgcgcaaagtggcgcaggaattcgagtcgctgttcatcggtgaaatgctcaagtccatgcgtgcggcgaccgagtcgatgggcaaggacaatccgctcaataccgctgaagccaagcagtaccaggaaatgtacgaccagcagttggccgtttccatgtctcgcgagggcggtggtattggcctggccgacgtgctgctgcgccagatgtccaagaacaaacccctggtgtcaggcgaggcggcaacgctgtcggccggcaagcaggagcaagcgttggacgaggccgtcaaggccccggtgccgacgcccattgccgccggcacgttgcccgacgggccattgtcgcgctccaacggccagcgtccgctgtgggcttcgcgggccgtgagtgcgccgcaaggggcaggcgagggcgttcaccgcaacgacatggaattgctcaaccagcgccgcctggccttgccgcccaaactggccgatcggctgcttgccgggttggtgccttcggctgccgccgcgcctgacgtcaaggcgcagaatattttgccggatcgtgccatcaccgccgtcaagcctgccaccggcgaactggccaatggcgactggctggccgcgctcaaggcgtcagagccgagcgagtccatgcaggtgtacgggcgtgccgtggcgcagccacccctggcgccagcccgcaaggccttccgcgatgctgacgagttcgtcgatgccatgctgccaatggccaaggaagccgcggaccgtatcggcgtggaccctcgttacctggtggcccaggcggccctggaaaccggctggggcaagtcggtcatgcgtcagcctgatggcagcagcagccacaacctgttcggtatcaaggccagcaagaactggacgggcgattcggcgcgggcgatcaccagcgaattccgcaatggcgagatggtcaaggagacggcccagttccgttcctacgcttcgtatcgcgacagcttccatgacctggtcaatctgctgcaaagcaacagtcgctatcaagatgtgctgaagtcggccgataacccggaacagtttgtgcgtgagttgcagaaggccggttacgccaccgacccgaactacgccagcaagatttcgaatatagcccggcagatgaccagttaccaaaactacgcttcggctggcgccactacgactttataa

SEQ ID NO: 1674 - DNA, 1308 bp, Pseudomonas sp.
atggatatgcgcaagggcgctttgatcagtggggactcgggctcctactcggacctgaaccgcctgaaccaactcaaggttggcgacaagaacagcgatggcaacctgcgcaaggtggcccaggaattcgagtcgctgttcctcggcgaaatgctcaagtccatgcgttccgccaccgaggcattgggcaaggacaacccaatgaatacgcctgaagccaagcagtatcaggaaatgtacgaccagcagttggccgtttccatgtctcgcgagggtggcggtatcggcctggccgatgtcctgctgcgccagatgtccaagaacaagccgctggcgccgggcgaagcagccgctgcgtcggctgccaagcagcaagaggcgctggacaaggtcaaggcggtgcccaccccggtggctgccggaacattgcccaccaacgggccattgtcgcgcctcagcggccagcgtccgctctgggcttcgcgggccgtcagcgcaccgcaaggggcgggcgagggcagtcatcgaaacgacatggagctgctcaaccagcgtcgactggccttgccgccgaaactggccgaccgtctgttggccgggctggtgccgtcggcatcgaccaacgctgatatcaatgcgccggtccagaacatccgctcggatcgcgctgtcagcgccacccagtccacctccggcgaaatggccaatggcgactggctggccgcgctcaaggcctccgggtcgagtggggacatgcaggtctatggtcgcgccgtggcacaaccaccactggcgccggcccgcaaggccttccgggatgccgacgaattcgtcaacgccatgttgcccatggccaaggaagcggcggcccgcatcggcatcgatccgcgatacctggtggctcaggcggccctggaaaccggctggggcaagtcggtcatgcgccaacccgatggcagcagcagccacaacctgttcggcatcaaggccagccagaactggaagggcgattcggcgcgggcaatcaccagtgagttccgcaatggcgagatggtcaaggagacggccgagttccgttcctacgcctcgtatcgcgacagcttccatgacctggtcaatctgctgcaaagcaacagtcgctatcaagctgtgctgaagtcggccgataacccggaacagtttgtacgcgagttgcaaaaggccggttacgccaccgacccgcactacgccagcaagatttcgcatatagcccggcagatgaccagttcccagaactacgcatccgcaggcgccaccacgactttataa

SEQ ID NO: 1675 - DNA, 1290 bp, Pseudomonas sp.
atggatatgcgcaagggtatgggcgtcagcggcaacgattcgggttcctactcggacctcaatcgcttgaaccagctgaaggtcggcgacaagaacagcgacggcaatatgcgcaaggtggcgcaggaattcgagtcgctgtttattggcgagatgctcaagtccatgcgttcggccaccgacacgctcggccaggacaatccgctcaataccgaggcggccaagcagtaccaggaaatgtacgaccagcagctggccgtttcgatgtcccgcgaaggcggcggcattggtctggcagacgtgctgatgcgtcagatgtcgaagaacaaaccgctggcaccgggcgaagcggcaacgctgtccgcggccaagcaggaagcggcgaaagcggcagcccatacgccgatcgctgccggcacggtcggcaccgatggcccgttgtcgcgcatcaatggccagcgtccgttgtgggcttcgcgtgccgtcaatgcaccgcaagcggcgggcgagggcggccatcgcaacgacatggaattgatcaatcagcgtcgcctggccttgccgccaaaactggccgatcgcttgctcgccggtctggtgccgtcggccacggtgaacgctgcaagcgtcaataaggcgccgttgccggaaagcaccgcagccgccaccggcacgggcgcgttgtacaacggcgactggctggcgaacgcgcaagcggcagcgaatcccggcctgcagattcacgggcgcgccattgcgcaaattccgctggcgccggcaaagaaagcgttcacttcctcggatgaattcgtcaacaccatgctgccaatggccaaggaagcggccgagcgcattggcgtcgatccgcgttatctggtggcccaggctgcgctggaaaccggttggggcaaatcggtcatgcgcgcccaggatggcagcagcagccacaacctgttcggcatcaaggccagcagcaactggaagggtgattcggcacgcgccattaccagcgaattcaggaatggcgcgatggtcaaggagacggcgcagttccgttcctacgactcttacaaagacagtttccatgacctggtaacgctgctgcaaagcaacgatcgctatcaagatgtgctgaagtcggccgataacccagaacagtttgtacgcgagttgcaaaaggccggttacgcaaccgacccgaactacgcgaacaagatttcgcagatagccaagcagatgacgagttaccaaaactacgctgcagcgggcgcttcaaccacgcctctatag

SEQ ID NO: 1676 - DNA, 1296 bp, Pseudomonas sp.
atggatatgcgcaagagcggtctggtcagcagcagcgactccggttcctattcggacttgaatcgcttgaatcagctcaaggtgggcgacaagaacagtgacggcaacatgcgcaaggttgcgcaggaattcgagtcgctgttccttggtgaaatgctcaagtccatgcgctcggccaccgaagcgctgggcaaggacaacccgctcaacacgccggcggccaagcagtatcaggaaatgtacgaccagcagttggccatttccatgtcccgtgagggcggtggtattggtctggcagacgtgctgatgcgtcagatgtcgaagaacaaaccactggcgccgggtgaggcggcagcggcatccgcggccaagcaggaagcggcgaaagccgccgtgccgacgccgattgcggcgggcaccgtggccaccgacggtccgttgtcgcggctcaatggtcagcgtccgttgtgggcttcgcgctcggtgaaagcgccggcaggcgagggcacgcatcgcaatgacatggagctgatcaatcagcgtcgtctggccttgccaccgaaactggcggatcgcttgctcgccggtctggtgccttcggcaacgactgctgcgaccgccaacaaaccgttgttgcctgagcgtggcgtcgcgacgcctgcggcagcgaccggtgccggtccgctgttcaatggtgactggctggcctcgcaaacggacacgaaatcgagcggacgcctgcaggtttacggccgtgccatggcgcagattcccctggcaccgccgaagaaagccttcagttccgccgacgaattcgtcaacaccatgctgccgatggccaaggaagccgccgagcgcattggcgtcgatccgcgttacctggtagcccaggcggcgctggaaaccggttggggtaaatcggtcatgcgcgcccaggatggcagcagtagccacaacctgttcggcatcaaggccggcaccagttggaagggcgattcggcgcgggccatcaccagcgaattcaggaatggcgagatggtcaaggagacggccgagttccgttcctacgactcgtacaaagacagcttccatgaccttgtgactttgctgcaaaccaacaatcgctatcaagatgttgtgaagtcggccgataacccagaacagtttgtacgcgagttgcagaaagccgggtatgcaaccgacccggattacgcaagcaagatctcgcagatagccaagcagatgacgagttaccaaaactacgctgcggcgggcgcttccaccacgcctctatag

SEQ ID NO: 1677 - DNA, 1284 bp, Pseudomonas sp.
atggacatgttcaagagtggccgagtgagcagtagcgattcaggtgctttctccgacctgaaccgccttaaccagctcaaggtcggcgataaaaacagtgacgcgaacatgcgcaaggtggcgcaggagtttgagtcgctgttcctcggcgaaatgctcaagtccatgcgctcggccaccgaagcgctgggcaaggacaacccgctcaataccgcagaagccaagcagtatcaggaaatgtacgaccagcaattggcggtttccatgtcccgcgagggcggtggtattggccttgccgacgtgctgatgcggcagatgtcgaagaacaaaccgctggcgcccggtgaagcggcaacgttgtccgccgccaagcaagaggccgcgaaagccgccgcgcaaacgccgatcgcggcgggcacagtggcgatcaatgggccgctgtcgcgggtcaatggcgagcgcccgttgtgggcttcacgttcggtcaaggcgccgacaggcgagggcacgcacagcaatgatatggcgctgatcaatcagcgacgtctggcattgccaccgaaactggctgaccgtttgctcgccggcctggtgccatcggccacgtcgaccgcgactgcggcggtcaacaagacggcattgccggagcgcaccaccattaccggtgccgggcctctgtacaacggcgactggttggccaatgcgcaggccgcgtcgaacgggggcctgcagattcacggtcgggccatcgcccagattccactggcgccggcgaagaaagcgttcagctctgccgatcaattcgtcaacaccatgctgccaatggccaaggaagcggcggaccggattggcgtcgatccacgttacctggtggcccaggctgccctggaaaccggttggggcaaatcggtcatgcgcgcgcaggatggcagcagtagccacaacctgttcggcatcaaggccagcagtaattggaagggcgattcggcgcgggcaatcaccagcgaattcagaaatggcgagatggtcaaggagacggccgagttccgctcctacgcctctttcaaggacagtttccatgaccttgtcacgttgttgcagacgaataatcgctatcaagatgtgctgaagtcggccgataacccagaacagtttgtacgcgagttgcaaaaggccggttacgcaaccgacccggactacgcaagcaagatttcgcagatagccaagcagatgacgagttaccagaactacgctgcggcgggcgtttccaccacgcctttatag

SEQ ID NO: 1678 - DNA, 1299 bp, Pseudomonas sp.
atggatatgcgcaagggcggattgggggtcagcagcagcgattcgggttcctattcggacctcaatcgcctgaaccagctcaaggtcggcgacaaaaacagcgacggcaacatgcgtaaggttgcgcaggaattcgagtcgctgtttctcggtgaaatgctcaagtccatgcgctcggccactgaaacgctgggccaggacaatccgctcaacacgccggcagccaagcagtatcaggaaatgtacgaccagcagttggccgtttccatgtcccgtgagggtggcggtattggtctggctgacgtgctgatgcgtcagatgtcgaagaacaaaccgatggccccgggcgaggccgctgccgcgtcagccgccaagcaagcggccgcgaaagccgccgtggaaaccccgattgccgccggtacggtcgccaccaacgggccgctgtcgcgcctcaatggcgagcgtccgttgtgggcttcgcgctcggtgaagtcggcaagtgcgggcgagggcactcatcgcaatgatatggcgctgatcaatcagcgacgtctggcgctgccgccgaaactggccgaccgcttgctcgcagggctggtgccgtcggcatcgaccactgctgcgaccgccgcgacggcgcagaacaacatccaaatgccgcagaacaccaagaccggtgccggtcccctgtacaacggcgattggctggcttcgcaaacggatgcgacatccagcggacgcctgcaggtttatggtcgtgccatggcgcaaataccgctggcaccggcgaagaaagcgttcagttccgccgacgaattcgtcaacaccatgctgccgatggccaaagaggccgccgaacgcattggggtcgatccgcgttacctggtggcgcaggccgccctggaaactggatggggcaaatcggtcatgcgcgcccaggatggcagcagcagtcacaacctgttcggcatcaaggccggcagcagttggaaaggcgattcggcgcgcgcgatcaccagcgaattcaggaatggcgagatggtcaaggagacggctcagttccgttcctatgactcttacaaggacagcttccatgaccttgtgacgctgctgcaaaccaacaatcgctatcaagatgttgtgaagtcggccgataacccagaacagtttgtacgcgagttgcaaaaggccggttacgcaaccgacccggactacgcaagcaagatttcgcagatagccaagcagatgacgagttaccagaactacgctgcggcgggcgctaccaccacgcctctatag

SEQ ID NO: 1679 - DNA, 1287 bp, Pseudomonas sp.
atggacatgcgcaagagcgggctggtcagcagcagcgattcgggatcctactcggacctcaatcggcttaaccagctcaaggtcggcgacaagaacagcgacggcaacatgcgcaaggtggcgcaggaattcgagtcgctgttcctcaacgagatgctcaagtcgatgcgctcggccaccgaagccctgggccaggacaacccgctgaacaccgcggcggccaagcagtaccaggaaatgtacgaccagcaactggcggtctcgatgtcccgcgagggcggcggcattggtctggccgatgtgctgatgcgccagatgtcgaagaacaaaccgctggccccgggcgaggcagccgagttgtcggcggccaagcaggaagcggccaaggccgcggtgcagaccccgattgccgccggcaccacggctaccgatgggccgctgtcgcgcctcaacggtcagcgccccttgtgggcgtcgcgttcggtccacgcgccgcaaggggcaggtgagggcggcgggcacagcaacgacatggcgctgatcaaccagcgccgcctggccttgccgccgaagctggcggaccgtctgctggccgggctggtgccgtcggcctctggggctgccgcaagcaacgccaacaccacgctgccggcccgcgccaccaccgaaggcaacgcgctggtgaaaggcgactggctgccggcgcaaagttactccgccgaacgcggtcgcctgcaggtctacggtcgggccattgcccagccaccactggcgccagcgaaaaaatccttcagctcgccgagcgaattcatcgacaccatgctgccgatggccaagcaggctgctgatcgcatcggcgtcgatccgcgttatttggtggcccaggccgcgctggaaaccggctacggcaaatcggtcatgcgccaggccgacggcaacagcagccacaacctgttcgggatcaagaccggcagcacctggaagggtgcccaggcgcgggcgatcaccagcgaattccgcaacggcgcgatggtcaaggagacggccgagttccgttcctatgcctcctaccaggacagcttccacgacctggtgaccttgttgcagagcaacaatcgctatcaagaagtgctgaagtcggccgataacccggaacagtttgtacgcgagttgcaaaaggccgggtacgccaccgacccgaactacgccagcaagatttcgcagattgccaaacaaatgaagagttacgagaactacgccgcggcgagttctcccatgcatttataa

SEQ ID NO: 1680 - DNA, 1287 bp, Pseudomonas sp.
atggatatgcgcaaaggcagtctggtgggcacgggcgattcgggttcctactccgacctcaatcgtctgaaccagctcaaggtcggcgacaagaacagcgatgcgaacatgcgcaaggtggcgcaggaattcgaatcgctgttccttggcgaaatgctcaagtcgatgcgttcggccaccgaggcgttgggtaaagacaacccgatgaacaccccggccgccaagcagtatcaggaaatgtacgaccagcaactggccgtctcgctgtcccgcgagggcggtggtatcggcctcgccgacgtgctgatgaagcagatgtcgaagaacaggccgttggccccgggtgaggctgcggctgcgtctgccgccaagcaggaagccgcgaaagccgctgccgtgcagacaccgattgcggccggcacgaccgccaccaacgggccgttatcgcgactcaatggcgagcgtccattgtgggcatcgcgctccgggcatgtctccaataccgaagcctcgcacagcaatgacatggcgatgatcaacaagcgtcgcctggcgctgccaccgaagctggcggaccgtctgctcgcaggtctggtgccgtcggccacgccgaccacggccaatgcattgccgcagcgcgccgcgaccacggctaccaccggcgccggcccgctgtacaacggcgactggctgacccgtgccgaagacgcgaaagcgtccggcgggcagatgcagatttacggccgggcgatggcgcagattccgctggctccggccaagcgcgccttcagctccgccgacgaattcgtcaacaccatgctgccgatggccaaagaggccgccgctcgaattggcgtcgatccgcgttatctggtggcgcaagccgcgctggaaaccggctggggcaaatcggtcatgcgcgcccaggatggcagcagcagccacaacctgttcggcatcaaggccagcagcaactggaccggcgattcggcgcgggcgatcaccagcgagttccgcaacgggcagatggtcaaggagacggccgagttccgttcctacgcctcgtacaaagacagtttccacgatctggtgactttgctgcagaccaacaatcgctatcaagatgttgtgaagtcggccgataacccagaacagtttgtacgcgagttgcaaaaggccggttacgcgaccgacccgaactacgcgacgaagatttcgcagatagccaagcagatgaacagttttgaaaactacgctgcggcgggcgtttccacccagcctttataa

SEQ ID NO: 1681 - DNA, 1263 bp, Erwinia sp.
atggatattcgcaagagcggtctggtcagcagcggcgattcgggttcctactcggacctcaaccggcttaaccagctcaaggtcggcgacaagaacagcgacgccaacatgcgcaaggtggcgcaggaattcgagtcgctgttcctcaacgaaatgctcaagtccatgcgctcggccaccgaagcgctgggcaaggacaacccgctcaacaccccggcggccaagcagtaccaggaaatgtacgaccagcagctggcggtttccatgtcccgcgagggtggcggtatcggcctggccgatgtgctgatgcgccagatgtcgaagaacaaatccaccaacccggccgcggcggcgaccttgcctggcgcgcaggttgataaggtcgtgacgccaaccgccatcgctgccggcaccaccgccctgggcggcccgttgtcgcgggtcaatggccagcgtccgttgtgggcctcccgtgcactggaaccgcagcgcgcggaaggcagtggtacccacaacgatatggcgctgctcaaccagcggcgcatttccctgccgagcaagctgaccgatcgtttgctggcgggcatcgtgccgtcggccgacagtgccgccaccaaccggacggccttgccggaacgcaccacggccgctaccgacgcgctggtcaagaacagctcgcgcagctttgccgcggtgccgcacgcacgcatgcagatctacggtcgcgccgtggcccagccaccgttggcgccggcgaagaaagccttcagttcggcggacgaattcgtcgccaccatgctgccgatggcgcagcaggccgccgaccgcatcggagtcgatccacgctacctggtcgcccaggccgcgctggaaaccggctggggcaaatcggtgatgcgccagcaggacggtagcagcagccacaacctgttcggcatcaaggccggcagcagctggaagggcgaccaggcgcgggcgatcaccagcgaattcagaaatgggcagatggtcaaggagacggccgagttccgttcctatgcctcgtatcaggacagcttccacgacctggtgaccttgttgcagagcaacaatcgctatcaagaagtgctgaaggcggccgataaccccgaacagtttgtacgtgaattgcagaaagccgggtatgcaaccgacccggactacgcaagcaagatttcgcagattgccaagcagatgaagagctacgagaactacgctgcggcgggcgcttccacgaatttataa

SEQ ID NO: 1682 - DNA, 1269 bp, Pseudomonas sp.
atggccatggacatgcgtaacagcggcctgaccagcacggcggattcgggttcgtattccgacttgaatcgcctgaaccaactgaaggtcggcgacaagaacagcgaaggcaacatgcgcaaggtggcgcaggaattcgagtcgctgttcttgagcgagatgctcaagtccatgcgctcggccaccgaggccctgggcaaggacaacccgatgaacaccccggccgccaagcagtaccaggaaatgtacgaccagcaactggcggtttccatgtcccgcgaaggcggcggcatcggcctggccgatgtgctgatgcgccagatgcagaagaacaagccggtggacgcccaggcggccaccttgcagggcccggcggcggccgaggcggtcaagaaagtcgatgtgccgacgcaaattgccgccggcacccaggccgagggcccactggggcgttccaatggccagcgtccactgtgggcctatcgcgtggcggagccccaggcgggcgctgcagcggcccacagcaacgacatcgcactgatgaaccagcgccgtatcgccttgccgagcaagctgaccgatcgcctgctcgccggtatcgtgccgagcaccgacaccaccaccgttgcccaggcggcgccgctgcgtaacagcgcggccgccgacaatgtggtcaacagcaccgcgcgcacgtttgccgtgccgagcgggcgcatgcaggtctacggccgcgccgtggcccagccgccattggcaccggtgaagaaggcgttcagctcccaggatgagtttgtcgcgaccatgttgccgatggccaaggcggcggccgcgcgtatcggcgtcgatccgaagtacctggtggcccaggccgccctggaaaccggttggggcaagtcggtgatgcgcgccgaagatggcagcagcagccacaacctgttcggcatcaaggccggccagagctggcagggcggccaggcccgtgcgatcaccagcgagtttcgtgatggggcgatggtcaaggaaacggcgcagttccgttcctacgcctcctatcaggacagcttccatgatctcgtgacattgctgcaaagcaatgatcgctataaagaagttgtgaaatcggccgataaccccgaacagtttgtacgcgagttgcaaaaagccgggtacgccacggacccggcctacgccagcaagatttcgcagatcgcaaaaaccatgaacagttaccagaattacgctgccgcgggcgcgaccactcatttataa

SEQ ID NO: 1683 - DNA, 1266 bp, Pseudomonas sp.
atggatatgcacaaaagcgggttcaccagcacggcggattcggggtcttactccgacctcaaccggctgaaccagctcaaggtcggcgccgacaagaacagcgaaggcaacatgcgcaaagtggcgcaggagttcgagtcgctgttcctgagcgagatgctcaagtccatgcgttcggccaccgaggcgctgggcaaggacaacccgctgaacaccccggctgccaagcagtaccaggaaatgtacgaccagcagttggcggtctcgatgtcccgcgaaggcggcggtatcggtttggctgatgtgctgatgcgccagatgcagaagaacaagccggtcgaggcgcagtcctcgaccttgcaaggcccggcggcggccgagccggtcaaggccaagaaggttgatgtgccgactgaaatcggcgccggcaccctggctaatggcccgttggggcgctccaatggccagcggccgttgtgggcttaccgcgttgcagagccgcaaggcgccagtgcgcacaccaacgacatggaactgatgaaccagcgccgcatggcgttgccgagcaagctgaccgatcgcctgctggccggtatcgtgccgagcactcagcccgccacgcaggccgcgagtgcgccactgcgtaacagcgccgccaccgataacgtggtcaacagcaccgcgcggaactttgccgtgccgagcgggcgcatgcaggtctatggccgagcgattgcccagccaccgctggcgccggcgaaaaaagccttcagctcgcaggatgaatttgtcgccaccatgctgccgatggccaaggcggccgccgcgcgcatcggcgtggatcccaagtacctggtggcccaggccgcgctggaaaccggctggggtaaatcggtgatgcgcgccgaggacggcagcagcagccacaacctgttcggcatcaaggccgggcagagctggcagggcggccaggcgcgtgcaatcaccagcgagtttcgtgatgggtcgatggtcaaggaaacggcgcaatttcgctcctacaactcctaccaggacagcttccacgacctcgtgacattgctgcaaagcaatgatcgctataaagaagttgtgaaatcagccgacaacccggaacagtttgtacgcgagttgcaaaaagccggatatgcaaccgatccggactacgccagcaagatttcgcagatcgccaaaacgatgaacagttaccagaatttcgctgccgctggcgcaaccacacatttataa

SEQ ID NO: 1684 - DNA, 1263 bp, Pseudomonas sp.
atggatatgcgcaaaagcggcatcagcagcacggcggactcggggtcttactccgacttgaaccggcttaaccagctgaaggtcggcgacaagaacagcgacggaaacatgcgcaaagtggcgcaggaattcgagtcgctgtttctcagcgaaatgctcaagtcgatgcgcaaggccaccgatgccgtgggcgaagacaacccgctgaacaccgatgccgccaaacagtaccaggacatgtacgaccagcagctggctgtgtcgatgtcccgcgagggcggcggcatcggcctggcggatgtgttgatgcgtcagatgcagaagaacaagccgttggacgcccaggcggccaccctgcaaggccccggtgcagtggaaccggcgaagaaagtcgatgtgccgaccgagatcgcggccggcacccaggcctccggcccgctgggccgctccaatggtcagcggccgttgtgggcgtaccgtgtggctgagccccaggtcggcggcgcggcgtcccacagcaatgacgtggcactgatgaatcagcgccgcattgccttgccgagcaagctgaccgaccgcctgctcgccggcatcgtgccgaccgcgccggtggccatcgacgccaaaagcgcgccgctgcgcaacagcgcggccgccgacaatgtggtcaacagcagcgcacgtgcgtttgccgcgccgagcgggcagatgcaggtgtacgcccgcgctgtggcccagccaccgttggcgccggcgaagaaagcgttcagctcgcaggatgaatttgtcgccaccatgctgccgatggccaaagcggccgctgcgcgcattggtatcgatccgaagtacctggtggcccaggccgccctggaaaccggttggggcaagtcggtgatgcgcgcccaggatggcagcagcagccacaacctgttcggtatcaaggccggcaaaagctggcagggcgagcaggcccgtgcgatcaccagcgagtttcgtgatggggcgatggtcaaggaaacggcgcagttccgttcctatacgtcctaccaggacagtttccacgacctcgtcacgttgctgcaaagcaatgaccgctataaagatgttgtgaaatcagccgacaacccggagcagtttgtgcgcgagttgcaaaaagccggatacgcaaccgacccggattacgccagcaagatttcgcagatcgcaaaaacgatgggcagttaccagaattacgctgccgctggcgcaaccacacatttataa

SEQ ID NO: 1685 - DNA, 657 bp, Pseudomonas sp.
atgattgacgtgactgtctggagcgtaaccctgccggtgcaaacaccggcgcaggtcgtggcgaccaaagccatgccgaccttgaagaacaagtatttcgacaataacggccagaggatcatcttctgggcgcccgtcaccggctcccataccggtaacagcaaatacccgcgttccgaactgcgggaaaccagcagggacgggaaacaccgcaactggcgctacaacagcggcaccaacaccctcaagggcgagctgtcggtgaaccaggtgccttccgaaggccgcgtggtggtggcgcagattcacgccaaggatgcgccgacgcccttgttgaaactggtataccgctacgaaaagggcaccggcaatatcgacgtggaataccgggtcaagcccaaggacaagaagagcccggtgatctacaccgtgcccaaggtgccattgaacaaatccttctcgtacacgctgcaaatggacaagcaaggccagctctcggtgctgatcggcaagagcggcaaacaggtgaagctggacaagtcctggcagggctacaacttctatttcaaggccggcgtctacaccctggataacaagggctactccaatgaaggcgggaaagtgacctacaccaagctgagcgtcagtcacaaatga

SEQ ID NO: 1686 - DNA, 657 bp, Pseudomonas sp.
atgattgacgtaactgtctggagcgtaaccctgccggtgcaaacgccggcgcaggtcgtggcgaccaaagccatgccgaccttgaagaacaagtatttcgacaataacggccagaggatcatcttctgggcgcccgtcacaggctcccataccggtaacagcaaatacccgcgttccgaactgcgggaaaccagcagggacgggaaacaccgcaactggcgctacaacagcggcaccaacaccctcaagggcgagctttcagtgaaccaggtgccttccgaaggccgcgtggtcgtggcgcagattcacgccaaggacgcccccacgccgttgttgaagttggtgtaccgctacgccaagggcaccggcaatatcgacgtggagtaccgggtcaagcccaaggacaagaagagcccggtgatctacaccgtgcccaaggtaccgttgaacaaatccttctcatacacgctgcaaatggacaagcaaggccagctctcggtgctgatcggcaaaggtggcaaacaggtaaaactggacaagtcctggtacggctataacttctatttcaaggctggcgtctacaccttggataacaagggctactccaatgaaggcgggaaagtgacctacaccaaactgagcgtcagtcacaaatga

SEQ ID NO: 1687 - DNA, 657 bp, Pseudomonas sp.
atgattgacgtgactgtctggagcgtaacactgccggtgcaaacgccggcgcaggtcgtggcgaccaaagccatgccgaccttgaagaacaagtatttcgacaataacggccagcggatcgtcttctgggcgcccgtcaccggctcccataccggtaacagcaaatacccgcgttccgaactgcgggaaaccagcagggacgggaaacaccgcaattggcgctacaacagcggcaccaataccctgaaaggggaattgtcggtgaaccaggtgccttcggaaggtcgtgtggtggtggcgcagattcacgccaaggaagcgccgacgcccttgttgaaactggtgtaccgctacgaaaagggcatcggcaatattgacgtggaataccgggtcaagcccaaggataagaagagcccggtgatcttcaccgtgcccaaggtgccgttgaacaaatcgttctcgtacacactgcaaatggacaagcaaggccagctctcggtgttgatcggcaaaagcggcaaacaggtgaagctggacaagtcctggcaaggctacgacttctacttcaaggctggcgtctacaccttggataacaagggctactccaatgaaggcgggaaagtgacctacaccaagctgagcgtcagtcacaaatga

SEQ ID NO: 1688 - DNA, 657 bp, Pseudomonas sp.
atgatcgacgtaacagtctggagcgttaccctgccggtgcaaacgcccgcgcaggtcgtggcgaccaaagccatgccgagtttgaaaaacaagtatttcgacaataacggccagcggatcgtcttctgggcgcccgtcaccggctcccataccggtaacagcaaattcccgcgttccgaactgcgggaaaccagcaaggatgggaagcatcgcaattggcgctacaacagcggcaccaacacactcaagggcgaactgtcggtcaaccaggtgccgtcggaaggccgtgtggtggtggcgcagattcacgccaagaatgccccgacgccgttgttgaaactggtttaccgctacgaaaagggcaccggcaacattgacgtggaataccgggtcaagcccaacgacaaaaagagcccggtgatctacaccgtgcccaaggtgccgttgaacaaatccttctcctacacgttgcaaatggacaagcaaggccagctcacgatgctgatcggcagcagcggcaaacaggtgaagctggacaagtcctggtacggctacgacttctatttcaaggccggcgtctacacgctggacaacaagggttattccaacgaaggcgggaaagtgacctacaccaagctgagcgccagtcacaagtga

SEQ ID NO: 1689 - DNA, 657 bp, Pseudomonas sp.
atgattgacctcactgtctggaacattaccctgcccgtgcaaacgccggcgcaggtcgtggcgaccaaagccatgccgaccctgaaaaacaagtacttcgacaacaacggccagcggatcgtcttctgggcgccggtcactggctcccataccggtaaaagcgaatacccgcgctcggaactgcgggaaaccggcaaagacggaaagctgcgcaactggcgctacaacagcggcaccaacaccctcaagggcgagctgtcggtgaaccaggtgccttccgaaggccgcgtggtagtggcacagattcacgccaaggacgcgccgacgccgttgttgaagctggtgtatcgctacgaaaagggtaccggcaatatcgacgtggaataccgggtcaagcccaaggacaagaagagcccggtgatctacaccgtgcccaaggtgccgttgaacaaatccttctcgtacacgctgcaaatggacaagcaaggccagctctcggtgctgatcggcaacagtggcaaacaggtgaagctggacaagtcctggcaaggctacgacttctatttcaaggccggcgtctacaccttggacaacaaaggctattccaacgaaggcggaaaagtgacctacaccaaactggacgtcagccacaaatga

SEQ ID NO: 1690 - DNA, 657 bp, Pseudomonas sp.
atgattgacctgactgtctggaacattaccctgcccgtgcaaacgccggcgcaggtcgtggcgaccaaagccatgccgaccctgaaaaacaagtacttcgacaacaacggccagcggatcgtcttctgggcgccggtcactggctcccataccggtaaaagcgaatacccgcgctcggaactgcgggaaaccggcaaagacggaaagctgcgcaactggcgctacaacagcggcaccaacaccctcaagggcgagctgtcggtgaaccaggtgccttccgaaggccgcgtggtagtggcacagattcacgccaaggacgcgccgacgccgttgttgaagctggtatatcgctacgaaaagggtaccggcaatatcgacgtggaataccggatcaagcccaaggacaagaagagcccggtgatctacaccgtgcccaaggtgccgttgaacaaatccttctcgtacacgctgcaaatggacaagcaaggccagctctcggtgctgatcggcaacagtggcaaacaggtgaagctggacaagtcctggcaaggctacgacttctatttcaaggccggcgtctacaccttggacaacaaaggctattccaacgaaggcggaaaagtgacctacaccaaactggacgtcagccacaaatga

SEQ ID NO: 1691 - DNA, 657 bp, unknown
  environmental sample
atgattgacctgactgtctggaacatcaccctgcccgtgcaaacacccgcgcaggtcgtggcgaccaaagccatgccggccctgaaaaacaagtatttcgacaataacggccagcggatcgtcttctgggcgccggtcacgggctcccataccggcaaaagcgaatacccgcgctccgaactgcgggaaaccagcaaagacggaaaactgcgcaattggcgctacaacagcggcatcaataccctcaagggcaccctggccgtaaaccaggtgccttccgaaggccgcgtggtcgtggcgcagatccacgccaaagacgcccccacgccgttgttgaagctggtgtaccgctacgccaagggcaccggcaatatcgacgtggagtaccgggtcaaacccaaggacaagaagagcccggcgatctacaccgtgccaaacgtaccgctgaacaaagccttctcctactcgctgcaaatggacaagcaaggcaagctctcggtgctgatcaacaacgttggcaaacaggtgaagctggactcgtcctggtacggctacgatttctatttcaaggccggcgtctacacgctggataacaaaggttattccaacgaaggcgggaaagtgacctacaccagactggacgtcagccacaaatga

SEQ ID NO: 1692 - DNA, 657 bp, Pseudomonas sp.
atgatcgatttgactgtctggaacatcaccctacccgtgcagaccccggcgcaagtcgtggcgaccaaggccatgccgacgctgcagaacaagtatttcaaccgctccggcgagcggattgtcttctgggcgccggtgaccggctcccacaccggtaaaagtgactacccgcgctccgaattgcgcgaaaccaccaaagacggcaagttgcgcaactggcgttacaacagcggcgtcaataccctcaaaggtactttggcggtgaaccaggtcccttccgagggccgtgtagtcgtcgcgcagatccacgccaaggatgcccctacgccgctgttgaaactggtgtatcgctacgccaagggcaccggcaacatcgatgtggaatatcgggtaaaacccaaggacaagaagagcccggtgatctataccgtgccgaaagtggcactgaacaaaaccttcagctactccctgcaaatggacaagcaaggcaagctcacggtgctgatcaacaacgttggcaagcaggtgaagctggaccgcgcctggcatggctacaacttttacttcaaggccggcgtctacaccctggacaacgtcggttcttccagcgaaggcgggaaagtgacctacaccaaactggacgtcagccataaatga

SEQ ID NO: 1693 - DNA, 657 bp, Pseudomonas sp.
atgatcgacctgaccgtctggaacctcacgctgcccatccaaacaccggccctgaccgttgcgaccaaagccgtcccgacgctgcgcaacgcgtacttcaccaacactggtgacaaaattgtgttctgggcgccggtgacgggttctcacacgggcaaaagcgaatacccgcgttccgagctgcgggaaacctcgaaagacggcaagttgcgcaactggcgctacaacagcggcatcaacagcctgaagggaacgctgtccgtgaaccaggtgccttcggtcggtcgcgtggttgtcgcgcagatccatgccaaggatgcgcctgctcccctgctgaaactggtgtaccgcttcgccaagggcagcggcaacctggacgtcgaataccgggtcaagcccaaggacgcgaagagcccggtgatctttaccgtgccgaacgttgccttgaacaaagtcttcacttactccttgcaaatggacaaacagggccaactctcggtgctgatcaacaacgcaggcaagcaggtgaagctggatccgtcctggtacggctacaacttctacttcaaggccggcgtctacaccctggacaacgtcgggtattccaccgaaggcgggaaagtgacctacaccaaactggacgtcagccataaatga

SEQ ID NO: 1694 - DNA, 657 bp, Pseudomonas sp.
atgattgacctgactgtctggaacatcacccttccgatacaaaccccggccctgaccgttgcgaccaaggcggtgccgaccctgcgcaaccagtatttcacccacactggcgacaagatcgtgttctgggctccggtaaccggttcccacacaggtaagagcaagtacccgcgctccgagctgcgggaaacctcgaaagacggcaagctgcgcaactggcgatttaacagcggggtcaataccctcaaaggcaccctggctgtgaatcaggtgccctcggccggtcgcgtggtcgtcgcgcagatccacgccaaggacgcacccgccccattgctcaagctcgtctaccgtttcaccaagggtgtcggcaacctggatgtcgaataccgggtcaagcccaaggatgcaaaaagcccggtgatgttcaccgtgccgaacgttgccttgaacaaagtctttacctacaccctgcagatggacaaacagggcaaggtcaccgtactgatcaacaaccttggcaaacaggtgaagctggatccgtcctggtatggctacaacttctacttcaaagcgggcgtctacaccctggacaacgtcggctatgccaccgaaggcgggaaagtgacctactccaaactggacgtcagtcataaatga

SEQ ID NO: 1695 - DNA, 657 bp, Pseudomonas sp.
atgattgacctgactgtctggaacatcaccctgcccgtgcaaacgccggccctgaccgtagccaccaaggccatgccgacgctgcagagcccgtatttcaaccgcaacggcgagcgcatcgtgttctgggcaccggtgaccggttcccacaccggcaaaagcgacttcccgcgctccgaactgcgggaaaccggtaaggacggcaagctgcgcaactggcgctacaacagtggcctcaacaccctcaacggcaccttgtcggtaaaccaggtaccgtcggaaggacgggtcgtggtggcgcagatccacgccaaggacgcccccgccccgctgctgaaactggtgtatcgctacgccaagggcaccggcaacctcgacgtggaataccgggtcaagcccaaggacgtgaagagcccggtgctcttcagcgtgccgaacatggcgctgaacaaagccttcacctatgcgttgcagatggacaagcaaggcacgctcaccgtgctgatcaacagcctcggcaagcaggtcaagctgaacccttcctggtacgcctacgacttttacttcaaggccggcgtctacaccctggacaacgtcgggtacgccagcgaaggcgggaaagtgacctacaccaggctggacgtcggccataaatga

SEQ ID NO: 1696 - DNA, 5040 bp, Pseudomonas sp.
atgccagaacccattcttcgcccggtaatgcctgtcgcccgcgacctgcacctggatttgctcaaggcgcgtgtgcccggttggtacagcgcagccatcgtgcagcgccagcgggagctgagcgatcatacgcttgagctgccggactggtacgcaaaggccccctacgaaaccagggccagcctcaagagcagtcacttccgctaccgcgaaatcttgaatcaggtcgacaacgtcctgggcgatatccaggacatccgcgcctttgccgagccgctgctggagcaggcgatcaaggctgaattcaagcagacgctcgacgtcaaccaggtttatttcgtccgcaagtatggacggcaagtccgcggtgatttcttcggcgcactcgtgctggataagggcgatagccagttcaaccagtacgagtaccacggctcttcattgctggaggccgcgctggccaatttcgaacccgacgaagaaaaccggcccggttgtgccgattgcacgctgatcaccacccagcgtccgttctacggtggggaggtcatgccgtccaccagcgcctttcgggcgggggcgttgccgattgcgccgcaagccttcgccaggctatgccgcacattggacctggggcgtctctatcaagaacacatcaacgcgatcgtgcgaccgccaaacgaggcatcacgcaaccagttggatcgccaactgcgtgatcatcaccggcaaggtttggcgctgagcatggagatcgcccgggccaagggggatatcagtcaggcggcttttcgaatgttgcaacaggtcgtcggcgatcaggatgcgatcactttggacgaccgcgcggtgaccttcacgtcactgaaagtcttcgatatcgaactggttggcccgttgctgatcggaccggagcgtgaaaacagccggcgagtcgagcggctcgtggcctactttcccggtgatcccgagcagccgctgaaggagtttgcttccagcgccgacttcatggcgcaaacgcggcggcgcctgcacggcatcggctatcggcgctttttcagccgttttgtcccgctgcgcaagcaaggcgtttttttcgagcagttcaaccggttctaccaaccttccgacctgaaaaatagcctggtcgactacccgctcaaaccgaacctgcgacggctgcccatggacacttcgcccattcccgccccgttgtgggagtcgttgcggctacgccaggtccagaagatccagctcgacgcccgcgcggtagcggtgcccactggtgacgaagacaagaaagcccgcctggcgcgccaggagagttatctgaacgcggtcatcgacgtgctcaacctgggcgcgttcgtcgtgccagggttggggccgctgatgttgacggtaggggccgtgcagatgttcaacgaggcttttgaaggcatcgaagcgttcgagcgcggggagacccgggaaatgtgggcgcatttttccagcgtcgccctcaacaccgcgttcgtggccacgggcgccgcagtgctgccacatatccaatggtccaacaccgtggaacagctggaaccgctccggttgaacaacggcgaggcacggctctggcgcccggacctggctccctaccggagcgatctcgtcccatccgctggcgcagtgccggacgcgcgaggcctgcaccgggtcaacggacgcccgatcctggcgctggatggccagcactatgaagtgcagttggaaccggcaacgcagcggtaccgcattcgccatccctcccggccggatgcctatcagcccaagctgacggacaatggcagcggcgcgtggcgtcatgaactggagcatccccatggctggacgggtgcgaagttgatgaaacggcttgggcatcgggtcgagcatttcagcccggcggagctggagcagatccgcatcgccagcggcaccgctgaggacgtgttgcggcgtatgcacgtagagggcgcaccgatgccggcgttgctggccgatacgctcacgcgtttcgacatttgccgacaaatcgagacattgaccgcgcaactgcaaagcgaggaggcgctggactacgacaaagccgagccgatgacccaactgcacttgctcacgcgctatggtccgtggccaaaaggcttgcaactggaggtggtcgatcgctcgggccggcgactatggcactacgcacctgatccgcaagctggcgccgcggcccgaggtgtcagcctcgccgaagcgaacgtgcgcacgccttcggtgttgaaaaacctgatcgaggcggtggatgccgccggcggcgacctgctggccgatgcgagcccggccatcgcgaaaaccgatatgccggctcgggttcgtcagttgcgcaagcagctcgccgagatcgtggtgcgcgaaaaagtgagtctgttcaacgattactatgccaagcaggacctctcgagcgacccgcgcgcgacgctgatcaaatcccgtttcccttcggtccccgccgcggcaatcgaccagatgctggcccttgccacatcggctgaaacacagcagatggacgcctgggatttcgccgatgccgcccagaccaaacccatcccgctgcgtatcgccgaagagctgcgtcatttccagcgcacggtgcggatgaaccgcgcctacgaggggctgtatcaagaggcgctggccactgccgatacgccccgactggccctggcgacgctggaaaccttgtcgggatggagtgacacggtgcgcatcgagttgcgcgcagatgacctcacgggcgacttgatcggtgcgatcgggccacagggtgcgcagcagaccaaatacgtgatcaaggatggcggtgcctacaagtccttggacgaccaaggcaacgacctgagccactggggcagcctctacgatgcgttgcagcgtgccctgccggatgccgaacgccaggccatgggccgtccttcgattcatcagggcgatctgttgaaacaggccatcggtgctgcgccggcaagccgggattccctggcaagcctgttgaagctaccgccggtaatgccgtcgtataaatcgccgatgcgtctggcatccggccaggtcggctacccgctaggcggtttgcgcgaacggttggggttgagtcggtccccgcaaagtcgggttcttgagctgtacccggactacaccgagcaagaagtccaggccttgctggaggcatttggcgacggcgccgtcgctgaactgaagcgacgcaaggtcgagttgcagatgcttgatcgcgacctggacctctgggccaacacaccgggctggcgcgaggtgggtcgccagcgtcatcaactggtggaaccgcaggccaggcgcgcggtggctgagcggatcaagcgttgttggcggcgccaggtcccggtggtaacggcagtggacggcagcagggtgggttatgagctggtcttgagccaacaatatgtcggggagcttcccgacctgaccgccaatttcagccatgtggcgtcgctgaagctgaacgacatgggacttacgcaagagggcagcgaaagtttcctgaccggtttttcttcccttcgctggttggacatgaccctcaacaggctgaccgatgtacccgccgccctgggcgcaatgaatggcctgaccaggctccaattggggtcgaatcagatccgcttgaccagtcgcagcgtcgggacgctgcaagacctgacccagctcaagatcctcaatctggaaaacaacccgctggatcggttgccggatttcagccacttccccgccttgcgcggcctgtatctgaaaagcaccgatataagcgtttggccccgcggcctcggtgagctgcccctggaacgcgttgacttacgcgacaatcggttgaccgaagtcccggacgacctgattgatccaccgccagcgcgcgcgctcatcacggcgcgcctcaatggcgtgaccctgttgcagggaaatccgttgagcgaactgactcagcagcgcttgggtgagtactgggcgaacatctccctgacgcatccgcaatggatggctctgcgctcgcccggagcgtttggtcatgccctgcctggcaggccttcgaacgtgcagcagtggttgcgtaatttgccaagcaccgaactggaggcaagaaaggacttgtggcgaagcctggcgcgcgagccacagtccaaggagctgttcaggttattgaatcgattggcgggttcttatcagggcgaagaaaactacccggacctccaggcgcgcgtctggcagatgcttgaggcggccagggactctacgcagttgcgtcgtgaactgttcgagctggccggcgccccggcgtgcgaggaccgcgcggcgttgtcgttcagctacttggaaatcaggttgatgatccacaacgcccgggccctggctgggggaacggatgaggcggcggtgttggtccgcctggcgaaagggctgtttcgtctcgatgaggtggaacgcattgcgctgcaggatattcagcagcgtcgtgatgcgatcaatgcgcgtcgtgatcttacggcagcgcagaaggcccaacacctacagcagatcgaagaggtcgaggttcgcctggcctatcgtgtcgggctgaaggcgcgactggaactgcccaaacagcccgcaggcggacgcttcctgatgctggccggtgtcacgcaagaggcgcttgatgcggctgccgagcaggtcctggccctggacgattcgcctgagcagttccaatcgctggtgggacgggatttctggattgattacctgaaggaacaccatccgacgtccttccaggcattgacggatacgctgattgccaaccagattgaactggatgaggcaaaggccgcagggaccctggaggcagccgattatgcctctcagtccgaggcgctggccttgcagttcaaagtcaaggaggcggagctgattcagtcattgactcaatcggagctggatgcgctaccggaaagtaccgagctgtag

SEQ ID NO: 1697 - DNA, 5040 bp, Pseudomonas sp.
atgccagaacccattcttcccctcgtgaagcctggaacccgcggcctgcacttggacctgctcaagacccgtattcccggttggtacagtgacgccatcgtgcagcgccagcgggagctgagtggccatgcgctggagcttccagactggtatgcgacggccgcccacgaaaccaggagcagcctgaaaagcagccattcgcgcttccgcgagaccctgaaccagatcgacaacgccttgggcgatatccaggacattcgcgccttcgccgagccgttgctcaaccaggcaatccaggctgaattcaagcagacgctcgacgtcaaccaggtttatttcgtccgcaagtacggacggcaagttcgcagcgatttcttcggcgcactcgtgctggataaaggcgacagccagttcaaccagtacgaataccatggctcttcgctgctggaggccgcgctggccaacttcgaacctgacgaagagaaccggcccggttgtgccgattgcacgctgatcaccacccagcgtccgttttacggtggccaggtcatgccgtccaccagcgcctttcgcgcgggggcgttgccgattgcgcccgaggccttcgccaggctatgtcgcacattggacctggggcgccagtatcaagaacacatcaacgcgatcgtgcgaccggcagatgaggcgtcacgcgacgcgttggatcgccaactgcgtgatcatcaccggcaaggtttggcgctgagcatggaggtcgcccgggccaagggggacatcagtcaggcggcttatcgaatgttgcaacaggtgatcggcgaccaggacgcgatcaccttggacgaccgcgcggtgaccttcacttcgctgagcgttttcgacatcgagttggttggccccgtgctgatcggaccggagcgtgaaaacagccggcgagtcgagcggctcgtggcctaccttcccggtgatcccgagcagccgctgaaggaatttgcttccagcgccgacttcatggccgaaacgcggcggcgcctgcacggcatcgcctatcggcgctttttcagccgttttgtgccgctgcgcaagcaaggcgttttttttgagcagttcaaccggttctaccaaccttccgacctgaaaaatagcctggtcgactacccgctcaaaccgaacctgcgacggctgcccatggacacttcgcccattcccgccccgttgtgggagtcgttgcggctacggcaggtccagaagatccagctcgacgcccgcgcggtagcggtgcccactggtgacgaagacaagaaagcccgcctggcgcgccaggagagttatctgaacgcggtcgtcgatgtgctcaacctgggagcgttcgttgtgccagggctggggccgctgatgctgacggtaggggcggtgcagatgttcaacgaggcctttgaaggcatcgaagcgttcgagcgcggtgagacccaggaaatgtgggcgcatttttccagcgtcgccctcaacaccgcgttcgtggccacgggcgccgcagtgctgccgcatatccaatggtccaacgccgtggagcagttggaaccgctccgattggacaacggcgagtcacggctctggcgtccggacctggccccctaccggagcgatctcgtcccacctgccggcgcagtgccggacgcgcgaggcctgcaccgggtcaacgggcgccagatcctggcgctggatggccagcactatgaagtgcagttggatccggctacgcagcggtatcgcattcgccatccctcccgaccggatgcctatcaacccaagctgacggacaatggcagcggtgcgtggcgccatgaactggagcatccccatggctggacgggtgcgaagttgatgaagcggcttgggcatcgggtcgagcatttcagcccggcggagctggagcagatccgcatcgccagcggcaccgctgaggacgtgctgcggcgtatgcatgtagagggcgcaccgatgccggcgttgctggccgatacgctcacgcgtttcgacatttgccgacaaatcgagacgctgaccgcgcaactgcaaagcgaggaggcgctggactacgacaaagccgagccgatgacccaactgcacttgctcacgcgctatggtccgtggccaaaaggcttgcaactggaggtggtcgatcgctcgggccggcgtctatggcactacacacctggtccgcaagctggcgccgcggcccgaggtgtcagcctcgccgaagcgaacgtgcgcacgccttcggtgttgaaaaacctgatcgaggcggtggatgccgccggcggcgacctgctggccgatgcgagcccggccatcgcgaaaaccgatatgccggctcgggttcgtcagttgcgcaagcagctcgccgagatcgtggtgcgcgaaaaagtgagtctgttcaacgattactatgccaagcaggacctatcgagcgacccgcgcgcgacgctgatcaaatcccgcttcccttcggtccccgccgcggcaatcgaccagatgctggcccgtgccacatcggctgaaacacagcagatggccgagtgggatttcgccgatgccgcccagaccaaacccatcccgctgcgtatcgccgaagagctgcgtcattttcagcgcacggtgcggatgaaccgcgcctacgaagggctgtaccaagagccgctggccactgccgatacgccgcgactggccctggcgacggtgaaaaccttggcgggatggagtgacacggtgcgcatcgagttgcgcgcagatgacatcacgggcgacttgatcggggcgatcgggccacagggcgcggagcagaccaaatacgtgatcaaggatggcggtgcctataagtccttcgacgaccaaggcaacgatctgagccactggggcagcctttacgatgcgttgcagcgtgccctgccggatgccgaacgccaagccatgggccgtccttcgattcatcagggggacctgttgaaacaggccatcggtgcggctccggcaagccgagatttcctggcaaacctgttgaagctgccgccagtcaagccgtcgtataaatcgccgatgcgtctggcatcgggccaggtcggctacccgctaggcggtttgcgcgaacgattggggttgagtcggtcgccgcaacggcgggtccttgagctgtacccggactacaccgagcaagaagtccaggccttgctggaggcattgggcgatggcgccgtcgctgaactgaagagacgtaaggtcgagttgcagatgctcgatcgcgacctggacctctgggccagcacgccgggctggcgcgaggtgggtcgccagcgtcatcaattggtggatccgcaggccaggcgcccggtggctgagcagatcaagcgttgttggcggcgccaggtcccggtggtaacggcagtggacggcagcagggtgggttatgaactggacttgagccaacactctgtcggggcgcttcccgacctgacagccgatttcagccatgtggcgtcgctgaagctgaacgacatgggacttacgcaagtgggcagtgaaagtttcctggccggttttgcctcccttcgctggttggacatgaccctcaacaggctgaccgatgtgcccgccgccctgggggcaatgaatggcctgacccggctcaaattgggatcgaatcagatccgcttgtccagtcgcagcgttgggacgctgcaagacctgacccagctcaagatcctcaatctggaaaacaatccgctggatcggttgccggatttcagccacttccccgccttgcgcggcctgtatttgaaaagcaccgatataagcgtttggccccgcggcctcggtgagctgcccctggaacgcgttgacttacgcgacaatcggttgaccgaagttccggacgacctgattgatccgccgccatcgcgcgcgctcatcacggcgcgcctcaatggcgtgaccctgttgcagggaaatccgttgagcgaactgactcagcagcgcttgggtgagtattggatgaacatctccttgtcgcatccgcaatggatggctctgcgctcgcccggagcgtttggtcatgccctgcctgacaggccttcaaacgtgcagcagtggttgcgtcatttgccaagcagcgagctggaggcaagaaaggccttgtggcgaagcctggcgcgcgagccgcagtccaaggaactgttcaggttattgaatcgattggcgggttcttatcagggcgaagaaaactacccggacctccaggcgcgcgtctggcagatgctcgaggcggccagggactctacgcagttgcgtcgtgaactgttcgaactggccggcgccccggcgtgcgaggaccgcgcggcgttgtcgttcagctacctggaaatcaggttgatgatccacaacgcccgggccctggctgggggaacggacgaggcggcagtgctggtccgcctggcgaagggactgtttcgcctcgatgaggtggaacgtattgcgctgaaagatattcagcagcgtcgtaatgcgatcaaggcgcgtcgtgatcttacggccgcgcagaaggcccgacacctacagcagattgaagaggtcgaggttcgcctggcctatcgtgtcgggctgaaggagcggctggaactgcctaaacagcccaaaggcggacgcttcctgatgctggccggtgtcacgcaagaggcgcttgatgcggctgccgagcaagtcctggccctcgacgattcgcctgagcagttccaatcgctggtggggcgggatttctggatcgattacctgaaggagcatcatccgacgtccttccaggccctgacggatacgctcatcgccaagcagattgaactggatgaggcaaaggccgccggaaccctggaggcagccgattatgcctctcagtccgaggcgctggccttgcagttcaaagtcaaggaagcggagctgattcagtcgttgactcaatcggagctggatgcgctaccggaaagtaccgagctgtag

SEQ ID NO: 1698 - DNA, 4095 bp, Pseudomonas sp.
gtggcctaccttcccggtgatcccgagcagccgctgaaggagtttgcttccagcgccgacttcatggcgcaaacgcggcggcgcctgcgcggcatcggctatcggcgctttttcagccgttttgtcccgctgcgcaagcaaggcgtttttttcgagcagttcaaccggctctaccaaccttccgagcaggagaacagcctggtcgactacccgctcaaatcgaatctgcgacggctgcccatggacacttcgcccattcccgccccgttgtgggagtcgttgcggctacgccaggtccagaagatccagctcgacgcccgcgcggtagcggtgcccactggtgacgaagacaagaaagcccgcctggcgcgccaggagagttatctgaacgcggtcatcgacgtgctcaacctgggcgcgttcgtcgtgccagggttggggccgctgatgttgacggtaggggccgtgcagatgttcaacgaggcttttgaaggcatcgaagcgttcgagcgcggggagacccgggaaatgtgggcgcatttttccagcgtcgccctcaacaccgcgttcgtggccacgggcgccgcagtgctgccgcatatccaatggtccaacaccgtggaacagctggaaccgctccggttgaacaacggcgaggcacggctctggcgcccggacctggctccctaccggagcgatctcgtcccatccgctggcgcagtgccggacgcgcgaggcctgcaccgggtcaacggacgcccgatcctggcgctggatggccggcactatgaagtgcagttggaaccggcaacgcagcggtaccgcattcgccatccctcccggccggaagcctatcagcccaagctgacggacaatggcagcggcgcgtggcgtcatgaactggagcatccccatggctgggcgggtgcgaagttgatgaaacggctggggcatcgggtcgagcatttcagcacggcggagctggagcagatccgcatcgccagcggcaccggtgaggacgtgctgcggcgtatgcacatagagggcgcaccgatgccggcgttgctggcggatacgaccacgcgtttcgacatttgccgacaaatcgagacgttgaccgcgcaactgcaaagcgaggaggcgctggactacgacaaagccgagccgatgacccagctgcacttgctcacgcgctatggtccgtggccaaaaggcttgcaactggaggtggtcgatcgctcgggccggcgactatggcactacgcacctgatccgcaagctggcgccgcggcccgaggtgtcagcctcgccgaagcgaacgtgcgcacgccttcggtgttgaaaaacctgatcgaggcggtggatgccgccggcggcgacctgctggccgatgcgagcccggccatcgcgaaaaccgatatgccggctcgggttcgtcagttgcgcaagcagctcgccgagatcgtggtgcgcgaaaaagtcagtctgttcaacgattactatgccaagcaggacctctcgagcgacccgcgcgcgacgctgatcaaatcccgtttcccttcggtccccgccgcggcaatcgaccagatgctggcccttgccacatcggctgaaacacagcagatggacgcctgggatttcgccgatgccgcccagaccaaacccatcccgctgcgtatcgccgaagagctgcgtcatttccagcgcacggtgcggatgaaccgcgcctacgaggggctgtatcaagagccgctggccactgccgatacgccccgactggccctggcgacgctggaaaccttgtcgggatggagtgacacggtgcgcatcgagttgcgcgcagatgacctcacgggcgacttgatcggcgcgatcgggccacagggtgcgcagcagaccaaatacgtgatcaaggatggcggtgcctacaagtccttggacgaccaaggcaacgacctgagccactggggcagcctctacgatgcgttgcagcgtgccctgccggatgccgaacgccaggccatgggccgtccttcgattcatcagggcgatctgttgaaacaggccatcggtgctgcgccggcaagccgggattccctggcaagcctgttgaagctaccgccggtaatgccgtcgtataaatcgccgatgcgtctggcatccggccaggtcggctacccgctaggcggtttgcgcgaacggttggggttgagtcggtccccgcaaagtcgggttcttgagctgtacccggactacaccgagcaagaagtccaggccttgctggaggcatttggcgacggcgccgtcggtgaactgaagcgacgcaaggtcgagttgcagatgcttgatcgcgacctggacctctgggccaacacaccgggctggcgcgaggtgggtcgccagcgtcatcaactggtggaaccgcaggccaggcgcgcggtggctgagcggatcaagcgttgttggcggcgccaggtcccggtggtaacggcagtggacggcagcagggtgggttatgaactggtcttgagccaacaatatgtcggggagcttcccgacctgaccgccaatttcagccatgtggcgtcgctgaagttgaacgacatgggacttacgcgagagggcagcgaaagtttcctgaccggtttttcttcccttcgctggttggacatgaccctcaacaggctgaccgatgtacccgccgccctgggcgcaatgaatggcctgaccaggctccaattggggtcgaatcagatccgcttgaccagtcgcagcgtcgggacgctgcaagacctgacccagctcaagatcctcaatctggaaaacaacccgctggatcggttgccggatttcagccacttccccgccttgcgcggcctgtatctgaaaagcaccgatataagcgtttggccccgcggcctcggtgagctgcccctggagcgcgttgacttacgcgacaatcggttgaccgaagtcccggacgacctgattgatccaccgccagcgcgcgcgctcatcacggcgcgcctcaatggcgtgaccctgttgcagggaaatccgttgagcgaactgactcagcagcgcttgggtgagtactgggcgaacatctccctgacgcatccgcaatggatggctctgcgctcgcccggagcgtttggtcatgccctgcctggcaggccttcgaacgtgcagcagtggttgcgtaatttgccaagcaacgaactggaggcaagaaaggacttgtggcgaagcctggcgcgcgagccacagtccaaggagctgttcaggttattgaatcgattggcgggttcttatcagggcgaagaaaactacccggacctccaggcgcgcgtctggcagatgcttgaggcggccagggactctacgcagttgcgtcgtgagctgttcgagctggccggtgccccggcgtgcgaggaccgcgcggcgttgtcgttcagctacctggaaatcaggttgatgatccacaacgcccgggccctggctgggggaacggatgaggcggcggtgttggtccgcctggcgaaagggctgtttcgtctcgatgaggtggaacgcattgcgctgcaggatattcagcagcgtcgtgatgcgatcaatgcgcgtcgtgatcttacggcagcgcagaaggcccaacacctacagcagatcgaagaggtcgaggttcgcctggcctatcgtgtcgggctgaaggggcgactggaactgcccaaacagcccgcaggcggacgcttcctgatgctggccggtgtcacgcaagaggcgcttgatgcggctgccgagcaggtcctggccctggacgattcgcctgagcagtttcaatcgctggtgggacgggatttctggattgattacctgaaggaacaccatccgacgtccttccaggcattgacggatacgctgattgccaaccagattgaactggatgaggcaaaggccgcaggaaccctggaggcagccgattatgcctctcagtccgaggcgctggccttgcagttcaaagtcaaggaggcggagctgattcagtcattgactcaatcggagctggatgcgctaccggaaagtaccgagctgtag

SEQ ID NO: 1699 - DNA, 5043 bp, Pseudomonas sp.
atgccagaaccgattcttggccctgtgcgccccgaaagccgcggcctgcacttggacctgctcaaggcccgtattcccggctggtacagcggcgctatcgtgcagcgtcagcaggagttgagcgaccatgagctggaacttccagactggtacgtgaagacttcccacgaaaccaggaccagcctcaaacacagtcactcccgctaccgcgaaaccctgaaccagatcgacaatgtgctgggcaacatccaggacctccgcgcctttgccgagccgctgcttacccaggcgatccagactgaattcaagcaaacactgaacgtcaaccaggtgtatttcgtccgcaagtacgggctcaagatgcgcgatgatttttttggcgcgctcgtcctcgataacgagggcagtcatttcgatcgctacgaataccgcggcacttcgctgctggaggccgcgctggccaatttcgagcccgacgaagagaacaaacccggctgcaccgactgcaacctcattaccacggtgcgtccgttttatggtggcgaggttgtgccctctatcaacgcctttcgcgccggggagttgccgatcgcgcccgaggcctttgcccggctgtgccgcaaactggacctgggacaccggtatcaagaacacatcaacgccatcgtacggccgatcaaccacgaggtacgcagccagttggatcgccaactgcgcgaccatcacaaagagggattggcgttgtgtgtcgaggtggccagggccaagggcgacatcagcgtggccgtctaccgaatgttgcagcaagtggtcagcgaccaacgtgcgatcttgcttgatggccgggcggtgacgttcacctcattgagcattttcggtatcgagctggttggtccagtgctgatcggccccggccgtgaaagcagtcgccgggcggagcgggtcgtggcctatatgccgggcgatcccgaacagcctctcaaggaatatgcctccagcgctgaattcatggtcgatcttcggcggcgcctgcacggtatcgcttaccggcgattcttcagtcgttttgtgccgttgcgtcagcaaggcgcttttttcgagcagttcaaccacctctatcaatcttccacagaggcagatgatcaggtcgatttccctctcaaatcgtcgttgcggaatctgcccatggcaacggcagcctttcccgaacctttatgggaatcgctgcgtctcaggcagatccagaagatccaggtcgatgcccgggcggtggcggtgcccaccggtgatgaggacaagaaagcccgtctggcgcggctggacagttacctggatgccgtgatcgatgtcttcaacctggcagcgttcgtggtgccagggcttgggccgctgatgctgacggtgggcgccgtacagatgttcaacgaagcgttcgagggcatcgaagcgttcgaacgtggggagacccgggaaatgtgggcgcacttttcaagcgtggccctcaacacggcattcgtcgccaccggcgcggcggtgttgccgcacattcaatggtcgagcacggtggatcagttggagccggtccaactggccaacggtgaatcacgcctctggcgccccgacctgacgccttatcagagtgtgcgggaaccacccgcgacctcggttccggatgctcaagggctgtaccgggtcgatggccgggacgttgtgccgctggacggccagtattacgaggtgcaacaggaaccgacgacccggcgctatcgcattcgtcacccttcccgggggccggacgcttatcagcccgggctgacggacaacggcagcggtgcctggagccatgaactggaacagccgcgaagctgggagggggcgacgttgatgcgccgactcggccattgcgtcaaagatttcagtgacgctgatctggagcagatccgcacggccagtggtacgagcgaggaggtgctgcggcggctgcatgtcgagggcgagccgatgcctgctttgctggccgacacgatcaagcgcttcgacctgtgccgacaagtcgaccgtttcattgagcaactgcaaagcgaagacccgctgcggtatgaagcagccgatccgatgacccagctgcatctactcgctggctacggtccttggccaaaggggctgagattgacggtggtcgacggctcgggcaagacgctttgggaatatgctcgtccatcggaagggggcgccccggttcgagatgtcatcatccccgaggggaaagtccgcacgccttcggtgctgaagaatctgatccaggcggtggatgctgcggggggcgacctgttggtcggtacgaccccggcgattgcgaaaacgaatatggacgctcgggtccggcagttgcgcaaaaaacttgccgccgtggtggcgcgcgaaaaggtgcaactgttcaacgatcattacgccaaaggtgacgtgtcgagcgacccgcgtgcaacgctgatcaaatcccgtttcccctcggttccggcggcggcaatcgaccagatagtagcgtttgccagcccgaccgagcatcagcagatggccgcttgggacttcacggatgccacccagaccaaacccatcccactgcgcatcgccgaggagctgcgtgactaccagcgagcgctgcgtttgaaccgggcatacgaaggtttacaccgtgaaacgctggccacggctgacacgcctcggttggcgttggcgaccttgaaaaccttgcccggttggagtgatacggtgcgcatcgagctgcgcgaagatgacgtttcaggcgttgtgatcgggagtatcgggccacaagacccgacgcagaccaagatcgtggtcaaggacgatgatcgttacaaggcctttgacgacaatggcaatgatctgagccactgggggagtctctacgatgccttgcagcatgccctcccggatgccgagcgtcaggccatgggccggccttcgatgcatcagggcaatctcttgcaagcggctattggtgcaacgccattagaccaagtcgcgctggcgcagctcttgaaaatgccaccgctcaaaccctccttcaagtcgccgatgcgcctggcttcgggcaaggttggctatcccatgagtggggtacgggaccggctgggcctgggccggtcgcgggaacgtcgggtgctggacttgtacccggactatacgagcgagcaagtccagagcctgctgcggtccttgggtgatgaagccgttccggaactcaagcggcgtaaaatcgagttggatacgctgcgccgggacctggatcactgggccagcctccccctgatgctggatgtgggtaatgaccgtatccggcgggtgccgccagcggtcaggcaaggggtggctgagcgcatcaaacggtgctggaggcgccagacgccggtcgttacggcggtggatggcagcagggtcgggtatgagcttgatttgagtgggcaggacgtaggaacgttgccgggcctgtcggccgactttagccatgtggcctcgctaaagcttcgagacatgaggttgtcggaatcctcctgcgacagattcctcacgggcttctcctcgcttcgctggttggacatgtccagcaacaggttgaccgatattcctgcatcgctggggttgatgaatggtttgaccaggctgcagttgcggtcgaatcaaatcaggttgacaccccgcggcattcagatcctggaggggcgtgccagtctgaaaattctcaacctggatcataattcgctgggccggttaccggacttcagccctctgaccaacctgcgcggattgagtctgagggacactggaattgacacctggcctaccggtttgcgcgatcagccgctggaacagattgatttacgcaacaaccaactgaccgatgtgccggctgatctgacttccccgccagtcgagcgtgctcatgccacggcacgtgtcaatggcgtgaccctgatccaaggtaatccgttgagcgaggcgacccagcagcgcttgcgtgattactggacgaaccttttcccattgcatcccgaatgggtggccttgcgtttgtacggtgcgtttgagcctgccccggcgcaaaggctgtcgaatgtggatctatggttgcgagacctgcccacggagcaattgcaggacaaaaaggcgttgtggcaaagcctgaaggctgaagcccaatccagggagttttttcagctgttgaaccgattggccggctcctaccaggaagtggaaaattatccggacctccaggcgcgtgtctggcagatgcttgaggcgatcagggattgcaccgagttgcggcgtgaactgttcgacctggctggcgcgccggcgtgtgaggatcgcgctgcgttgtccttcagctacctggaaatcaaattgatgatccacaacgccaaggccctgacggtgggagaacaggaggctgtggcgctgatccggctggccaaggggctgtttcgcctcgacgaagtggagcgcattgccctgcaggatatccagcagcggcgtgacacgatcaatgcccgccgggatctcaccaccgcgcagaagaaccggctcatcaggcagatcgaagaagtagaggtgcgcctggcctaccgggtcggcctcaagggtcgactggaactgcccggacagcccaagggtgggcgatttatccagatggccggcgttacggcagagatgctcaatgcggcggcagccgaaatcatcgcgctggatgattcaccgaagcaattgcagtcgctggttggccgggacttctggatcgattacgtgaagcaaaaacgcgcgagccttttccaggcgatgaatgatgccctcatcgccaatcagcttgagctggatgaggcgaaagcggccggaaccctggaggagcccgactatgtcagccaatccgagacactgggcttgcaacacaaggtcaaggaagcggagctgatccagttattgaccaaagaggagctggaggccctggtggaaagcacggacctgtaa

SEQ ID NO: 1700 - DNA, 5031 bp, Pseudomonas sp.
atgccagaaccgattcttggccctgtgcgcccggaaagccgcggcatgcacttggacctgctcaagacccgaattcccggctggtacagcggcgctatcgtgcaacgccagcaggaactgagcgaccatgtgctggaccttccagattggtacgtgaaggcctcccacgaaaccagggcccgcctcaagcacagtcacgcccgctaccgcgaaaccctgaaccagatcgacaatgtgctgggcaatgtccaggacattcgcgcctttgccgagccgttgctcaaccaggcgatccaggatgagttcaagcgcacgcagaacgtcaatcaggtttatttcgtccgcaagtacgggcgccaggcgcgcggtgatttttttggcgcgttggtgctcgacagcgagggcagccatttcgatcgctacgaataccacggcacttcgttgctggaggccgcgctggccaatttcgacgccgacgaagagcgcaagcctggctgtgacgactgcagcctcattactacggtgcggccgttttatacgggcgaggttgttccggccatcaacgcctttcgcgccggggcgttgccgatcacgcccgaggcttttgccaggctgtgccgcaagctggacctggggcgccgctatcaggaacacatcaacgccatcgtacggccgatcgaccaccagttggatcgccaactgcgcgcgcatcaccaagagggattggcgctttgtgtcgaggtcgcctgggccaagggcgacatcagcctggccgcttaccgaatgttgcagcaggtggtcagcgatcagcgcgaggtcatgctcgatgggcgggcggtgacgttcacctcattgaacattttcggcatcggcttggttggcccggtactgatcgggcccgaccgggagagcagtcggcgggtggaacgggtggtggcctacctgccgggcgatcctgagcaacccctcaaggaatatgcgtccagcggcgaattcatggtcgatctgcgccggcgtttgcatcgcgtcgcctaccggcgcttcttcagtcgctttgtaccgttgcgtcaattgggcggatttttccagcgtttcaaccgcctctatcagcctggcgcgccagcggatgatcaggccgattacccgctcaagtcgaaattgccggcactgcccatggagacgtcctccctgcccgaccccttgtgggaatcgctgcgtcgcaggcagatccagaagatccaggccgatgcccgggcggtggcggtgcccaccggcgatgaagacaaaaaagcccgtctggcgcggctggacagttacctggatgccgtgatcgatgtcttcaacctggcagcgttcgtggtgccagggcttgggccgctgatgctgacggtgggcgctgtgcagatgttcaacgaagcgttcgagggcatcgaagcgttcgagcgcggcgagaccagggaaatgtgggcgcatttctccagcgtggccctcaacacggcattcgtcgccaccggtgcggcggtgctgccgcacattcagtggtcgagcacggtggagcagttggaaccggtccaattggccaatggcgagtcacgcctctggcgccccgacatggtgccttaccggagtacgctggagccgccggcgaccttggtcccggatactctagggctgtaccgggtcgagggtcgagacgttgtgtcgttggacgaccagaattaccaggtgcaacaggacccgacgacccagcgctatcgcattcgtcatccttcccgcgggccggacgcctatcagcctgggctgacggacaacggtagcggtgcctggagccatgaactggaacggccgcgcagctgggaaggggctacgctgatgcgccggctcggccatcgcgtcaagaggttcagcgacgcagagctggagcagatccgtacggccagtggcaccagcgagcaggtgttgcggcggctgcatgtcgagggtgaaccgatgccggccttgctggccgacacgatcaagcgcttcgacctgtgccggcaagtcgacgatttcatcgggcaactgcaaagcgaagatccgctgcagtatgaacacgccgatccgatgacccagttgcatctactcacgggctacggtccgtggccaaaagggctcaagctcaaagtggtcgacggcgggggcaggacgctttgggagtacgttcgcccatcggaagaaggggaccgggttcgcgacgtcatcatccccgagaggaaagtccgcacaccctgggtgttgaagaatctgatcgagacggtggacgctgcggggggcgatctgttggcgggcacgagcccggcaattgcgaaaaccaatatggacgctcggatccagcagctgcgcaagacactcgccgccgtggtggtgcgggaaaaaatgcacgtgttcaacgattactacgccaaggaagacgtgtcgagcgagccgcgtgcagcactgatcaagtcgcggtttccctcggttccagcggcggccatcgaacaggtggtggcgtttgccaacccggccgagcaacagcaaatggccgcttgggacttcgcggatacgacccagaccaaacccattccactgcgtatcgccgaagagctgcgggactaccagcgagcgctgcgtttgaaccgggcctacgaagggctctatcgcgaggcgttggttgcggccgacaccccccgactggtgttggcgaccttgaagagcttgcccggatggaacgacgcggtgcgcatcgagctgcgcgacgaggtgttttcaggcgccttgatcgacagcgtcggcgcccaggacgcaatgcagaccaaggtcgtggtcaaggacggtgagcgctacaaggccttcgacgacaacggcaatgaactgagccactgggatagcctctacgaggccgtgcagcatgcgctccccgatgcggagcggcgggccatgggccgcccttcggttcatcacggcgccctcttgcagaaggctgtcggtgcaacaccattgagccgagcttcgctggcgaagcacctgcagatgcaaccgcgcaagtcatccttcaaatcaccgatgcgcctggcctcgggcaaggttggttaccccatgagtggcgtgcgggggttgttgggcctggggcggtcccccgagcgtcgggtgctggatttgtacccggactatacgagtgagcaagtccaggccctgttgcggtccctgggggatcaagccgttcccgaactcaagcggcgcaaagtcgagctggatacgctgatccgcgatctggaccgctgggccaccacccccgtatggcttgatgcgggtaatgatcgtctcgagcaactgctacccgcgatcaagcggggtgtggctaatcgaattcaatggtgctggcggcgccaaggcccgatcgttgcggcggtggatggcagcagggttggctatgagcttaatctgagcggggtggcgttagggacgctgccaggtctgtcggccgacttcagccatgtggtctcgctgaagctgcgtagcatgcgcttggcggaaccctcatgcgacaagttcctcaagagcttctccgcgctccgttggctggacatgtcgttcaaccgcctgaacgatcttcccccttcggtggagttgatggaggggttgacccggctgcacttggcgatgaatgaaatcaccctgtccgcgcgcagcattcagatccttgaagggcgtacccagctgaaaatcctcgacctgaaatggaaccccctgggccaattaccggatttcagccggttgcccgacctgcgtgggctgaatctgaacggtaccgatatcagcacttggccgactggcctgcgcgacctgccgctggaagaactcgatttgcgcaacaacgagctgaccgaagtaccgaccgaactgacggatccaccggccgagcgtgctcacgccacggcacgggtcaatggcgtgaccttcgtgcagaacaatccactgaacgaggcgacccagcagcgcttgcgtgattattgggcgaacctcgcaacgtcgcatcccgaatgggtgacctttcgttcgcctggcgcgtttgaacatgtcccagggggaaggctatcggatgtggatcgatggctgctagacctgcccagggagcaacagcaggacaaaaatacactgtggcggagcctggaggctgaaacgcagtccagggagttttttcagctgttgaaccgattggccggctcttaccaggacgtggaaaattatccggacctccaggcgcgtgtctggcagatgcttgaagcgatcagggactccaccgacttgcgccgtgagctgttcgacctggctggcgcgccggcgtgtgaggatcgcgccgcgttgtccttcagctacctggaaatcaaattgatgatccacaacgccaaggccctgatggtgggagaacaggaggctgtggcgctgatccggctggccaaggggctgtttcgcctcgatgaggtggagcgtattgccctgcaggatatccagcagcggcgtgacacgatcaatgctcgtgaggatctcaccgccgcgcaaaagaatcggctcatcaggcagatcgaagaggtggaggtgcgcctggcctaccgtgtcggtctcaagagtcgactggaactgccgggacagcccaagggtgggcgctttatccagatggccggcgttacggcagagatgctcaatgcggcggcggccgagatcctggcgctggatgattcaccgaagcaattgcagtcgctggttggccgggacttctggatcgattacgtgaagcaaaaacgcgcgagccttttccaggcgatgaatgatgccctcatcgccaatcagcttgcgctggatgaggcgaaagcggccggaaccctggaggagcctgactatgtcagccaatccgagacactgggcttgcaacacaaggtcaaggaagcggaactcatccagttattgaccgaagaggagctggacgccctggtggaaagcacggacctgtaa

SEQ ID NO: 1701 - DNA, 549 bp, Pseudomonas sp.
gtgaacaagtcgatgctggttggtgcggtattaggtgccgtcgctgtgactgctgggggggctgttgccacctacaagctggtcaatagtggccctgagtatgcgcaggtgctggcagttcagccggtcaaacaacaggtcaaaacaccgcgtgaagtatgcaaggacgtcaccgtgacccgtcaggctccggtgaaggatcaacatcagatcgccggtacggtggtcggtgcgctggctggcggccttctgggtaaccagataggcggtggtacaggcaagaagatcgccacggtcgccggtgcggtcggcggtggttacgcgggtaacaaggtgcaggaaggcatgcaggagcgtgatacctacaccaccactcagactcgctgcaacacggtcaatgacatcagcgaaaaggtcgtgggttatgacgtgaagtacgagctgaacggcaaacaaggccaggtacgcatggatcgtgatccgggcagccagattccggtcaacaaggacggtcagctgattctgggccagaacgtaccagcgcaataa

SEQ ID NO: 1702 - DNA, 549 bp, Pseudomonas sp.
gtgaacaagtcgttgctggttggtgcggtattgggtgctgtcggtgtgactgccgggggtgctgttgccacctacagcctggtgaaaagcggccctgagtatgcgcaagtgctggcagttgagccggtcaaacaacagatcaaaacccctcgcgaggtttgcaaggacgtcactgtgacgcgccagcggccggtgcaggatcagcatcagatcgccggtacggtggtcggtgcgctggctggcggtcttctggggaaccagatcggcggcggtaccggcaagaagatcgccacggtcgcgggggcggtcggcggcggttatgccggcaacaaggtccaggagggcatgcaggagcgtgacacctacaccaccactcagactcgctgcaacacggtcaatgacatcagcgacaaagtggtgggttatgacgtgaagtacgagttgaatggcaagcaaggccaggtgcgcatggatcgtgatccaggcagccagattccggtcaacaaggaaggccagctgatcctggggcagaaccaggtggcgcattaa

SEQ ID NO: 1703 - DNA, 549 bp, Pseudomonas sp.
gtgaacaagtcgttgctggttggtgcggtattgggtgctgtcggtgtgactgccggtggcgctgttgccacctacaaactggttaaaagcggccctgagtatgcgcaagtgctggccgttgaaccggtcaagacacaaatcaagactccacgtgaagtgtgcaaggacgttacggtgacccggcaagcgccggtgaaagatcaacaccagatcgccggtacggtggtcggcgccttggctggcggcctgttgggcaaccagatcggcggcggtacaggcaagaaaatcgccacagtggccggtgcggtcggcggcggttatgcgggtaacaaggtgcaggaaggcatgcaggagcgtgacacctacaccacgactcagactcgctgcaacacggtcaatgacatcagcgacaaggtcgtaggctacgacgttcgttattcgctggacggcaaggaaggcaaagtgcggatggatcgcgatccgggcaatcagattccggtcgacaaggaaggcaggctgatcctggggcagaacgaaccggccaaatag

SEQ ID NO: 1704 - DNA, 549 bp, Pseudomonas sp.
gtgaacaagtcgttgctggttggtgcggtattgggtgctgtcggtgttacagccgggggtgctgttgccacctacagcctggttaaaagcggccctgagtatgcgcaagtgctagccgttgagccggtcaagacacagatcaagactccacgtgaagtttgcaaggatgtaacggtgacccgtcaggcaccggtgaaagatcaacaccagatcgccgggaccgtggtcggcgcgctggccggtggtttgctgggcaaccagattggcggcggcaccggcaagaagattgccacggtggccggtgcggtcggtggcggttacgcgggcaacaaggtgcaggagggcatgcaggaacgtgacacctacaccaccacgcaaacccgctgcaacacggtcaatgacatcagcgacaaggtcgtcggttacgacgtgcgttactcgctcgatggcaaggaaggcaaagtgcggatggaccgcgatccgggcaaccagatcccggtcgacaaggagggcaagctgatcctttcgcagaatgaaccgggtcagtaa

SEQ ID NO: 1705 - DNA, 549 bp, Pseudomonas sp.
gtgaacaaatcgatgctggttggtgcggtattgggtgctgtcggtgtaacagccggtggtgcggtcgccacctacagcttggtaaaaagtggccctgagtatgcgcaagtattggccgtggagccggtcaagacccaaatcaagaccccgcgtgaagtgtgcaaggacgtcaccgtgactcggcagaagccggtccaggaccagcaccagatcgctggcaccgtgctcggcgccgtggccggcggcctgttgggcaaccagatcggcggcggcaccggcaagaagatcgccaccgtggcgggtgcggccggtggtggttatgccggtaacaagattcaggaaggcatgcaggaacgcgacacctacaccaccacccagactcgctgcaacacggtcaatgacatcagcgataaggttgtaggctacgacgtccgctacatgctcgacggcaaggaaggcaaagtccgcatggaccgcgacccgggcaaccagatcccggtgagcaaggaaggccaactgatcctgggccagaacgaaccggcccagtaa

SEQ ID NO: 1706 - DNA, 552 bp, Pseudomonas sp.
gtgaacaagtcgatgctggttggtgcagtattgggtgctgttggtgtgacggccgggggtgctgttgccacctacagccttgttaaaaaaagcagccctgagtatgcgcaagtcctggccgttgaaccggtcaagacacaaatcaagacgccacgtgaagtatgcaaggacgttgcagtaacccggcaagcgccggtgaaagatcaacatcagatcgccggtaccgtggtcggtgcgctggctggtggtctgttgggtaatcaaatcggcggcggtactggcaagaagatcgccactgtggccggtgcggtcggcggcggttatgcgggtaacaaggtgcaagaaggcatgcaggagcgtgacacttacaccacgacccaaactcgctgcaatacggtgaatgacatcagtgacaaggttgtaggttacgacgtgcgttattcactggatggcaaggaaggcaaagtgcggatggatcgcgatccgggtaatcagattccggtcgacaaggaaggcaagctggtcctggggcagaacgaagagaaccgctaa

SEQ ID NO: 1707 - DNA, 555 bp, Pseudomonas sp.
gtgaacaagtcgttgctggttggtgcggtattgggtgctgtcggtgtcaccgccgggggtgctgttgccacctacagcttagttaaaagcggccctgagtatgcgcaagtgctggctgtgcagccggtcaaacaacagatcaagaccccgcgtgaagtctgcaaggatgtcgcggtcacccgtcaacgcccggtcaaggatgagcatcagatcctcggtaccgtggccggcgcggtgggtggtggtttgctgggcagcatgatcggcaatggcaatggcaagaagctcgccactgtggccggtgccgtgggtggtggttatgcgggcaacaaggtgcaggaaggcatgcaggagcgtgatacctacaccaccacacagactcgctgtaacacggtcaatgacatcagtgagaaggtcgtgggttatgacgtgaagtacgacctgggcggcaagcaaggccaggtgcgcatggatcgtgacccgggcaaccagattccggtggataaagagggtcgtctgattctgggtcagaaccagaatcaacccggccaataa

SEQ ID NO: 1708 - DNA, 549 bp, Pseudomonas sp.
gtgaacaagtcgttactggttggtgcggtattgggtgctgtcggtgtgactgccgggggtgctgttgccacctacagcctggtaaaaagcggccctgagtatgcgcaagtgctggcggtgcagccggtgaaaacccagattaaaaccccgcgtgaagtctgcaaggatgttgccgtaacccggcagaaacctgtgcaggatcagcatcaaatcgtcggtacggtggtcggtgcgctggcgggcggcctgttgggtaatcaggtcggcggcggtaatggcaagaagctggccaccgtggccggtgcggtcggtggcggttacgctggtaacaaggttcaggaaggcatgcagaaccgcgatacctacaccaccacgcaaactcgttgtaataccgttaatgacatcagcgacaaggttgtcgggtacgacgtacgttacaccctggacggcaaggaaggctccgtgcgcatggatcgtgatccaggcaaccagatccccgtcgacaaggaagggcgcctggttatcggtcagaaccagccgcagcagtaa

SEQ ID NO: 1709 - DNA, 549 bp, unknown
  environmental sample
gtgaataagtcgttgctgattggtgcagtgctgggtgctgtcggtgttaccgccggaggcgccgttgcaacctacagcctcgtgaacaaaggccccgagtacgccgacgtattggccgcagagccgatcaaacagcagatcaagacgccgcgcgaagtgtgcaaggacgtcactgtgactcggcagaagccggtgcaggatcagcatcagatcgtgggcagtgtattgggcgcagtggcgggcggcttgctcggcaatcaggtcggtggtggcaacggcaagaagatcgccaccgtggccggtgccgtcggcggtggctacgccggcaacaaggtccaggagggcatgcagggtcgtgacacctacaccacgactcagacccgctgcaacacggtcaacgacatcagcgacaaggtcgtgggctacaacgtgaagtaccagctcgacggcaaggtcggccaagtgcgcatggaccgtgacccaggctcgcagatcccggtgaacaagcagggtcaattgatccttggtgagaatcaggccgggcaataa

SEQ ID NO: 1710 - DNA, 540 bp, unknown
  environmental sample
gtgaacaagtctatgcttgttggtgctgtgttaggtgctgctgtcgtgactgctggcggcgccgttgccacctatagcttggtcaagggtggtcctgagtatgcggatgtattggcggtagagccgatcaatcagcagatcaaaaccccccgtgaagtttgcaaggacgtaaccgttacccgtcaggcgccggtcaaggaccagcatcagatcgtcggtagcgtaattggcgcggttgccggtggcttgctgggtaaccagatcggtggcggtaacggcaagaagatcgctacagtcgcgggcgcggtaggtggtggttatgcgggtaacaaggttcaggaaggcatgcaggagcgtgacacctacaccactacgcagaaccgctgcacgacggtcaacgatgtaagcgacaaggttgtgggctacaacgtcaagtacaagttgaacgagaaggtgggtcaggttcgtatggagcgtgatccgggtagccagattccggtcgacaagaacggtcagctgatattgggtcaggcgcagtaa

SEQ ID NO: 1711 - DNA, 537 bp, unknown
  environmental sample
gtgaacaagtctctgttggtgggtgccgtgttgggagccgttgcggtgactgcgggtggcgcgtttgccacctacagtctggtcaacagtggtccggaatatgctgaggtgttggcagtcgatccggtcaagcaacaaatcaagacgccgcgtgaggtctgcaaggacgtgaccgtgacgcgcaaggcgccggtcaaggacgagcaccagatcgtcggcagtgtgctgggtgcggtggccggtggcttgctgggtaaccaggtcggcggtggcaacggcaagaagattgccaccgtggccggtgcggtcggtggcggttatgccggtaacaaggttcaggaaggcatgcagaaccgtgatacctacaccacgacccagacacgttgcaataccgtcaacgacatcagcgacaaggtcgtgggttacaacgtgaagtacaaggtcggtgaaaaggtcggtcaggtgcgcatggaccgcgatccgggcaatcagattccggtcgacaagaatggtcaactggtgttgagccagcagtaa

SEQ ID NO: 1712 - DNA, 576 bp, Pseudomonas sp.
atgtatggtcaggaggttcacgtgaacaagtcgttgctggttggtgcggtattgggtgctgtcggtgtcaccgccgggggtgctgttgccacctacagcctggttaaaagcggccctgagtatgcgcaagtgctggccgttcagccggtcaagcaacagatcaagaccccgcgggaggtctgcaaggacgtcgccgtgacccggcagcgtccggtcaaggatgagcatcagatcctgggcaccgtggctggcgcagtgggcggtggcctgttgggtagcatgatcggtaatggcaatggcaagaaactcgccacggttgccggtgctgttggtgggggctatgcggggaacaaggtgcaggaaggcatgcaggagcgtgatacctacaccactacgcagactcgctgtaacacggtcaatgacatcagtgacaagatcgttggttatgacgtgaagtacgacctgggtggcaagcagggccaggtgcgtatggatcgggatccgggcaaccagattccggtggataaagaagggcacctgattctcggtcagaaccagaatcagcccggccagtaa

SEQ ID NO: 1713 - DNA, 531 bp, Pseudomonas sp.
atgctggtgggtgcggtactgggtgctgtcggtgtgactgccggaggtgctgtcgcgacctacagcttggtcaacaaggggcctgagtatgcccaggtcaccgacgtgcagccgatcaagcaacaggtgaaaaccccgcgcgaagtgtgcaaggacgttaccgttacgcgccaggcgccggtcaaggaccagcatcagatcgccggcaccgtcgtgggtgcgctggccggtggcttgctgggtaaccagatcggtggtggcaccggcaagaagattgccacggtggccggtgcggtcggtggtggttatgccggtaacaaggtgcaggaaggcatgcaggagcgtgatacctacacaaccacgcaaactcgctgcaacacggtcaacgacatcagcgagaaggtggtgggctacaacgtgacctattccatcggtgatcaggtaggcaaggtgaagatggatcgcgagccgggatcgaccattccgctggacaagaatggcaagttgatcctgagcgaagcgggtcagtaa

SEQ ID NO: 1714 - DNA, 531 bp, Pseudomonas sp.
atgctggtgggtgcggtactgggtgctgtcggtgtgactgccggaggtgctgtcgcgacctacagcttggtcaacaaggggcctgagtatgcgcaggttaccgacgtgcagccgatcaaacagcaggtaaaaaccccgcgcgaggtctgcaaggacgtcgccgtcacacgccaggcgccggtcaaggaccagcaccagattgcaggtaccgtggtgggtgccattgccggcggcctgctgggtaaccagattggtggcggtaccggcaagaaaatcgccaccgtggctggtgcggtaggtggtggttatgccggtaacaaggtgcaggagggcatgcaggagcgtgacacctacaccaccacgcaaacccgctgcaacacggtcaacgacatcagtgagaaggtggtgggctacaacgtcacctactccattggtgatcaggtaggcaaggtgaagatggaccgtgagccgggctcgaccattccgctggacaagaatggcaagttgatcctgagcgaagcgggtcagtaa

SEQ ID NO: 1715 - DNA, 543 bp, unknown
  environmental sample
atgaataaatcaatgttggtaggtgccgtactgggtgctgtgggtgtgaccgctggtggggccgtcgccacctacagtctggttgatcgtggcccggactatgccgaggtgctggccgtaaccccgatcaatgaaaccgtgaaaacgccgcgggaagtgtgcaaggacgtggctgtcactcgtcaacgtcctgtgcaggaccagcaccagatcgctggcaccgctatcggcgccattgctggtggcctgctgggtaatcaggtcggtggcggtactggcaagaagattgccaccgtggcaggtgcggtcggcggtggttacgccggcaacaagattcaggaaggcatgcagcagcgagatacctataccaccaccgaaacccgctgcaataccgtgaccgacaccagcgagaagctggtgggctatgacgtgaagtatcagctgggcgagaaggtcggtaccgtgcgcatggatcgtgatccgggcagccgtattccggtcaacaagcaaggtgagctggtgctggtgcagcaggctcagtaa

SEQ ID NO: 1716 - DNA, 543 bp, Pseudomonas sp.
atgaacaagtcaatgttggtaggtgccgtgctgggtgctgtgggtgtgaccgctggtggtgccgtggccacttacagtctggttgatcgcggtccggactatgccgaagtgctggcggtaacgccgatcaacgaaaccgttaaaacgccgcgcgaggtgtgcaaggacgtgaccgttacgcgtcagcgtccggtgcaggatcagcaccagatcgccggtactgctatcggcgccatcgccggtggtctgttgggtaatcaggttggtggcggcaccggcaagaagatcgcaactgtggccggtgcggtcggcggcggttatgccggcaacaagattcaggaaggcatgcagcagcgtgacacctacaccaccactgaaacccgctgcaacaccgtgaccgataccagcgagaagctggtggggtacgacgtgaagtatcagctgggcgagaaggtcggtaccgttcgcatggaccgtgatccgggtaaccgtattccggtcaacaagcagggcgagctggtgctggtgcagcagactcagtga

SEQ ID NO: 1717 - DNA, 582 bp, Pseudomonas sp.
attgcgcagtcatgctgcgtttcgattggtcaggaggttcaagtgaacaagtctatgcttgttggtgctgtgttaggtgctgctgtcgtgactgctggcggcgccgttgccacctatagcttggtcaagggtggtcctgagtatgcggatgtattggcagtagagccgatcaaccagcagatcaaaaccccccgtgaagtttgcaaggacgtaaccgttactcgtcaggcgccggtcaaggaccagcatcagatcgtaggtagcgttattggcgcggttgccggtggtttgctgggtaaccagatcggtggcggtaacggcaagaagatcgctacagtcgcgggtgcggtaggtggtggttatgcgggcaacaaggttcaggaaggcatgcaggagcgtgatacctacaccaatacgcagaaccgctgcacgacggtcaacgatgtgagcgacaaggttgtgggctacaacgtcaaatacaagttgaacgagaaagtgggtcaggttcgtatggagcgtgatccgggcagccagattccggtcgacaagaatggtcagctgatattgggtcaggcgcagtaa

SEQ ID NO: 1718 - DNA, 591 bp, Pseudomonas sp.
gtgaacaagtcgatgatcgtcggtgccgtattgggcgcggttggcgtgaccgccggcggcgcggtcgccacttacaacctggtaggcaatagcggcccggagtacgccgaagtgctggcggtccagccgatcaacgaaaccatccagactccgcgcgaggtctgcaatgacgtggcggtgacccgccagcgtccggtcaaggaccagcaccagatcgccggtactgtcctcggcgcggttgccggtggcttgctgggcaaccagatcggcggcggtaacggcaagaagatcgctaccgtcgccggtgcggtgggtggcggctacgccggtaacaaggtgcaggagcacatgcaggaaggcgacacctataccaccaccgaaacccgctgcaagatcgtcaccgacaccagcgagaagctggtgggctacgacgtaaggtacgagttggacggcaaggtcggtcaggtgcgcatggatcatgacccgggtcggcagattcctgtgaccaaggaaggccagttgatcctcagtcagcagggcggtgtcggctcctccccgtcccagggcggcggcgcgggcgtccagcagtag

SEQ ID NO: 1719 - DNA, 498 bp, Pseudomonas sp.
gtggtaactgctggcggcgccgttgccacctatagcctggtcaagggtggtcctgaatacgcggacgtattggccgtcgagccaatcaatcagcagatcaaaaccccccgtgaagtttgcaaggacgtaaccgttacccgtcaggcgccggtcaaggaccagcaccagatcgtgggcagcgtcatcggcgcagttgccggtggtctgctcggcaatcaggtcggcggcggcaacggcaagaagctcgcaaccgtagcaggtgcggtcggtggcggttacgcaggtaacaaggtgcaggaaggcatgcaggagcgtgatacctacaccacgacgcagaaccgttgcaccaccgttaacgatgtgagcgacaaggtggtgggctacaacgtcaagtacaagctgaacgagaaggtcggtcaggttcgcatggcgagcgatccaggcagccgcattccggtcgacaaagaaggtcagctgatattgggtcaggcgcaataa

SEQ ID NO: 1720 - DNA, 534 bp, unknown
  environmental sample
gtgaacaagtcgttgctgacaggcgccgtactgggtgccgtggtggttaccgccggtggcgccttcgccacttatagtttggtcaagagccctgactcagctcaggtgctggctgtagagccgatcaatcaacagatcaagacgcctcgccaggaatgcaaggatgttgccgtgacccaccgccgtgcggtcaaggatcagcatcagatcgtcggtagcgtgctgggcgcggtcgcgggtggcctgttgggcaaccagattggtggcgggcacggcaagaccctggcaaccgtggccggtgcggctggcggcggctatgcgggtaacaaggttcaggaaaacatgcagaacggtgacacctacaccaccacggaaacccgttgcaacaccgtcaacgacatcagtgacaaggttgtgggctacaacgtgaagtatcagttggatggcaaggtcggccaggtgcgtatggatcatgagccaggcagctcgatcccggtcgacaagcaaggccagctagtgctggggcagaaatga

SEQ ID NO: 1721 - DNA, 537 bp, Pseudomonas sp.
gtgaacaaatcgttgctggttggtgcagtgttgggtgctgtcggtgtgactgccggtggtgctgtcgcgacctacagcctcgtgaaaagtggcccagagtatgctgaagtactggctgtagaccccattaatcaagagatcaagacgccgcgcaaagagtgccatgacgtggcggtcacgcaccgcaagccggtgcaggaccagcaccaggtggccggtacggtgatcggtgcggtcggtggtggcttgctgggccatctggtgggcggcggcaagggcaagaccctggcgaccgttgcaggcgccgtaggtggtggttacgcgggcaacaaggtgcaagagcacatgcagaacggtgacacctacaccaccacggaaagccgttgcaacacggtcaatgacatcagtaaccaggtcatgggctacaacgtgaagtaccagctgaacggccaggttgggcaggtgaagatggatcgtgatcctgggtccaagatcccggtgaacaaggatggccaactggtgctgacccagcagtaa

SEQ ID NO: 1722 - DNA, 486 bp, Pseudomonas sp.
gtggcgacctacagcttggtgaacaaagggccggaatacgcccaggtcactgacgtacaaccgatcaagcagcaggtgaagacaccgcgcgaagtgtgcaaggacgtgaccgtgacgcgccagcgtccggtgcaggaccagcaccagatcgccggtaccgtggtgggcgccctggccggtggcctgctgggtaaccagatcggtggcggcaccggcaagaagatcgccacggtcgcaggtgcggtgggtggtggttatgccggtaacaaggtgcaggaaggcatgcaggagcgtgacacctacaccaccacgcaaacgcgctgcaacacggtcaacgacatcagcgacaaggtggtgggctacaccgtgaagtacaccatcggtgaccaggctggtgtggtgaagatggaccacgagccaggttcgaccattccgctggacaagaatggcaagctggtgctgagccaggcgcagcccgggcagtga

SEQ ID NO: 1723 - DNA, 534 bp, Pseudomonas sp.
gtgaataagtccatgttggtcggtacggcactaggagtggttgttgccacggctggcggcgctttcgctacttatagtctggttgatcgtgggcctaaatttgccgaggttctggcggttgagccaatcaaggaaacgatcaaaacgcctcgtgaggtgtgcaaggacgtcacggtaactcgccagaagccagtgcaggatcagcatcgcatagccggaaccgcagttggtgcggtagtcggtggtctgcttggtaatcaggtaggtggaggtaacggcaagaagattgcgacggttgcgggggcggttggcggtggttacgccggtaatcaggtgcaggggaaaatgcaggccagcagtacctacaccaccaccgaaacgcgttgcagtaccgtaaccgatacgcacgacaagattgtcggttatgacgtgaaatatgatctcgctggcaaggtgggtcgtgtacagatggaccgcgacccgggtagccagattcctgtgcaggatggccagctgatgctttcgcagcaataa

SEQ ID NO: 1724 - DNA, 522 bp, Pseudomonas sp.
atgttggtcggtacggcgttgggcgtggtggtcgccacggctggtggggctttcgccacctacaccctggtcgatagggggccgaaatttgccgaggtgcttgcggtcgagcctgtcaaggagacgatccggacgccgcgtgaagtctgcaaggatgtgacggtcacccggcaaaaacccgttcaggatcagcatcgaatcgccggtaccgcggtgggtgcggtggtcggtgggttgctcggcaatcaggtcggcggcggcaccggcaagaagatcgccacggttgccggcgcggtaggcggcggctatgccggtaatcaggtgcaggagcggatgcaggccaacagcacctataccaccaccgagacgcgttgcgatacggtgaccgacagccatgacaagatcgtcggctacgacgtcaagtacgatctggatggcaaggtcggccgggtgcggatggatcgcgatccgggcagccagattccggtgcgcgatggtgagctggtgctgacgcagcagtga

SEQ ID NO: 1725 - DNA, 207 bp, Pseudomonas sp.
atgaagatcgatccgcttataagcgccacacttgccagacttgagcccaatcaggtcggcgtcctggcctggtcactgctggcgcaccccagtgtggcaggcggcattcccggtcagcccgacccggataccccgcaacccgccgagccgaccgaaccaggagagccgaccttgccggacgagccgcctcccgctcctgtcgcctga

SEQ ID NO: 1726 - DNA, 207 bp, Pseudomonas sp.
atgaagatcgatccgcttataagcgccacacttgccagacttgagcccaatcaggtcggcgtcctggcctggtcactgctggcgcaccccagtgtggcaggcggcattcccggtcagcccgacccggataccccgcaacccgccgagccgaacgaaccaggcgagccgaccttgccggacgagccgcctcccgctcctgtcgcctga

SEQ ID NO: 1727 - DNA, 207 bp, Pseudomonas sp.
atgaagatcgatccgcttataagcgccacccttgccaggcttgagcccaatcaggtcggcgtcctggcctggtcattgctggcgcaccccagcgtcgcggggggaattcccggtcaacccgacccggactacccgcaacccaccgagccgacggaacctggcgaaccgaccctgccggacgagcctcctcccgctcccgtcgcctga

SEQ ID NO: 1728 - DNA, 207 bp, Pseudomonas sp.
atgaagatcgatccgcttataagcgccacacttgccagacttgagcctaatcaggtcggcgtcctggcctggtcactgctggcgcaccccagcgcggcaggtggcattcccggtcagcccgacccggacaccccgcaaccctccgagccgagcgaacctggcgagccgaccctgccggacgagcctcctcccgctcctgtcgcctga

SEQ ID NO: 1729 - DNA, 207 bp, Pseudomonas sp.
atgaagatcgatccgcttgtaagcgccgcaattgccagacttgagcccaatcaggtcggcgtcctggcctggtcactgctggcgcaccccagcgtggcaggcggcattcccggccaacccgacccggattccccacaacccgccgagccgaccgaacctggcgagccaaccctgccggacgagccgcctcccgctcctgtcgcctga

SEQ ID NO: 1730 - DNA, 213 bp, Pseudomonas sp.
atgaagatcgatccccgaataagcgccaccttggcaaggctcgaacccaatcaggttggggtactggcctggagcctgctggcgcatcctcctgtcgacatggcggggggcatccccggccagccagatcccgataccccacagcccgccgagcccagcgagcctggcgagccgaccctgccggacgagccgccacccgcgcctgtggcctga

SEQ ID NO: 1731 - DNA, 213 bp, Pseudomonas sp.
atgaagatagatccgcgaatcagtgccaccttggccaggctggaacccaatcaggttggcgtactggcctggaccctgctggcgcatcctcccgttagcatggccggtggcattcccggccagccggatcccgattccccgcaaccccttgaacccaccgagccgggcgaaccgaccctgcccgacgaaccgcctcccgcgcctgtcgcctga

SEQ ID NO: 1732 - DNA, 210 bp, Pseudomonas sp.
atgaagatcgatccgcgaataagcgccgaattggcgaggcttgaacccaatcaggtcggtgtactggcctggtctctgctggcccatccggccaacatggcaggcggcatccctggccagcctgatcccgataccccgcaacccaaccagcccaccgaacccggcgaaccaaccctgccggacgaaccgcctcccgtccctgtggcctga

SEQ ID NO: 1733 - DNA, 207 bp, Pseudomonas sp.
atgaagatcgatccgcgaataagtgccgaactggcaaggcttgaacccaatcaggttggcgtcttggcctggtccttgttggcgcacccgccaatcatggcggggggcatccccggtcagcccgatcccgatacccccaacgaacaaccgacggaaccgggagagcccaccctgccggatgagccgccacccgcgccagttgcctga

SEQ ID NO: 1734 - DNA, 207 bp, Pseudomonas sp.
atgaagatcgatccgcgaatcagtgccgaactggcaaggcttgagcccaatcagatcggcgtcctggcttggtcactgctggcccatcctgtcgaagcggcgggtgggattcccggtgaccccgatcctgatcccaaccccacggaacccaccgaacccggtgagccgacgcttccggacgagccacctcctgctcccgtagcctga

SEQ ID NO: 1735 - DNA, 216 bp, unknown
  environmental sample
atgaagatcgatccgcgaatcagtgccgaactggcaaggcttgagcccaatcagatcggcgtcatggcctggtcattgctggcccatcctgccgaagcggcgggtggcattcccggccagcccgatcccgatactcccaacgaacaacccaacgatcccactgaacccggcgaaccgaccttgccggatgagccgcctcctgcgcctgttgcctga

SEQ ID NO: 1736 - DNA, 207 bp, Pseudomonas sp.
atgaagatcgatccgcgaatcagtgccgaactggcaaggcttgagcccaatcagatcggcgtcatggcctggtcattgctggcccatcctgccgaagcggcgggcggcatccccggccagcccgatcccgatacgcccaacgaacagcctacggaacccggcgaacccaccctgccggacgagccgcctcctgcgcctgtggcatga

SEQ ID NO: 1737 - DNA, 201 bp, Pseudomonas sp.
atgaagattgatccgagtatccgcgcccagttggcaaaccttgaacctaatcaggtcgggatgctggcctggtcgttacttgcacaccctcagatccaggcaggcggtattcccggccagccagaccccgataccccgcaacccacagaacctggcgtgccgaccctgccggatgagccgccgcctgcgcctgtggcctga

SEQ ID NO: 1738 - DNA, 210 bp, Pseudomonas sp.
atgaagatcgatccgcgaatcagcgctgaactggcaaggcttgagcccaatcagataggcgttctggcctggtcgctattggcgaatccgtcgttgagcctgtccggcggcgtacccggccagcccgatcctgatactcccaacgaacaaccgaccgaacccggcgaaccgacacttccggatgaaccgcctccggcgcctgtcgcctga

SEQ ID NO: 1739 - DNA, 198 bp, unknown
  environmental sample
atgaagatcaacccgcgaatcagcgcagaacttgcccggcttgaacccaaccagatcggcgttctggcctggtccctgatggccgaccctgcttatgcaggcggcatccccggccaacccgagccggattacccgcagcccaccgagcccggtgagccgaccctgccggatgagccgccacccgcgcctgttgcctga

SEQ ID NO: 1740 - DNA, 201 bp, Pseudomonas sp.
atgaagatcgatccgagtatccgcgcccagctggccagtcttgagcctaaccaggtgggcttgctggcctggtcgctgctggctcagccccaggtgcaggcaggtggcattcccggtcagcctgaccctgataccccgctaccgaccgagccgggcgtacctaccattccggatgagcctccacccgcgccagtagcctga

SEQ ID NO: 1741 - DNA, 198 bp, Pseudomonas sp.
atgaagatcgacccgcgaatcagtgccgaactcgcccgacttgaacccaatcagattggtgttctggcttggtccctgatggctgaccctgcctatgcgggcggtatccccggtcaacccgatcccgattttccggaaccgaccgaacctggcgaaccgacccttccggacgatccaccacccgtaccgatggcctga

SEQ ID NO: 1742 - DNA, 204 bp, Pseudomonas sp.
atgaagctcgatccgcgaatcagcgccgaactcgcccggcttgaacccaaccagattggtgtgatggcctggtccttgatggccgatcccgccgcaggcggcattcccggccagccaggtcccgatgatccctggcccaaccagcctgaagagcctggcgaacccactctccctgacgaaccgcctcccgcccctgtggcctga

SEQ ID NO: 1743 - DNA, 198 bp, Pseudomonas sp.
atgaagatcgacccccgaatcagcgcagaactcgcacggctggagcccaatcagattggtgttctggcctggtccctgatggccgaccctgcctatgcgggcggcatccccggccaacctgggccggattatccgcagcccggtgagcccggtgagcctacccggccggacgaggcaccccccgtgcccgttgcctga

SEQ ID NO: 1744 - DNA, 234 bp, Pseudomonas sp.
atgaaactcgacccgaccatcagtgccaagctggccgtgctgcagcccaacagcgttggggtgctggcctggtcgttgctggcacatccgcacccgcatagcgtgcaggcgggcggcgtgcccggtcagcctgacccggacacccccgattcaccgcaaccgggtgaacatccgccgatggagccgggcgagccgaccttgcccgacgagccgccaccagcgccgatcgcctga

SEQ ID NO: 1745 - DNA, 225 bp, Pseudomonas sp.
atgaaactcgacccgaccatcagcgccaagctggccttgctgcagcccaaccagatcggactgctggcctggtcattgctcgcccatccgccactgcaagccggtggcgtgcccgggcaacccgacccggacaccccgcaaccgccgcagccaggcgacacgccgcccatggaacccggcgaaccgaccctgcccgatgaaccgcctcccgccccggtagcctga

SEQ ID NO: 1746 - DNA, 228 bp, Pseudomonas sp.
atgaaactcgatcccgcaatcagtgcgaagctggctgtcctgcagcccaaccagatcggcttgctggcgtggtccctgctggcccatcctgctccgatgcatctgggtggcgtaccaggtcagcccgacccagacaccccgcaaccggcccaacctggcgacacgccgcccatggaaccgggtgagccaaccctgcccgacgagcctccgcctgcgccggtggcatga

SEQ ID NO: 1747 - DNA, 207 bp, Pseudomonas sp.
atgaagatcgatccaagtatcagcgcccaattggcgaaactggaacccaatcaagtgggcttgctggcgtggtcgttgctggctcatccgcacaacctggcaggcggcattccgggccagcccgagcccgatacacccgacgagcaacccatcaagccggttttgccggatcggcccgatgagcctccgcccactcctgtcgcctga

SEQ ID NO: 1748 - DNA, 228 bp, Pseudomonas sp.
atgaaactccatcccgcaatcagtgccaagctggctggcctgcagcctaaccaggtcggtatgttgccatggtcactgctggcgcacccgctgccgatgcaggcgggcggcgtgccccaccagcctgatcccgatactcctcaaccaccggaaccgggcgaaacgcagcccatggagcccggtgagccgaccttgcccgacgaaccacctcccgcgcccgtcgcctga

SEQ ID NO: 1749 - DNA, 222 bp, Pseudomonas sp.
atgaaagcctccacactcctgctcgccggtctgatgattgccagctcgggtgcagcgttcgccgaaggcggcgctgaacgcatgaagcactactgggacaacttccccatcagccagcagataccccgcaccgatagcgaacagacctcctccgagaacgggaaaaaaccccaggcacccgccgaggacccgacccgcgccagcgcgcaaccggacgcctga

SEQ ID NO: 1750 - DNA, 222 bp, Pseudomonas sp.
atgaaagcctccacactcctgctcgccggtctgatgattgccagctcgggtgcagcgttcgccgaaggcggcgctgaacgcatgaagcactactgggacaacttccccatcagccagcagataccccgcaccgatagcgaacagacgtcctccgaaaacgggaaaaaaacccaggcacccgccgaggacccgacccgcgccactgcgcaaccggatgcctga

SEQ ID NO: 1751 - DNA, 222 bp, Pseudomonas sp.
atgaaagcctcctcgctcctgcttgccggtctgctcctagccagctcgggtgcggcgttcgccgaaggcggcgctgaacgcatgaagcaatactgggacaacttccccatcagccagcagattccgcgcaccgacaccgaacaggcgtcctccgacaacggcaagaaagcccaggcgcccaccgcggacccagcccgcgacaacgcgcgaccggatgcctga

SEQ ID NO: 1752 - DNA, 219 bp, Pseudomonas sp.
atgaaaacctccaccctcctgctcgccggcctgatgctcgccagctcgggtgcagcgttcgccgaaggcggcgctgaacgcatgaagcactactgggacaacttccccatcagccagcaggcatcacgcaccgatacccagcaggcctcctccgagaccgggaaacccacccagccttccgaggaccaggttcgcgccactgcgcaaccggatgcctga

SEQ ID NO: 1753 - DNA, 288 bp, Pseudomonas sp.
atgcgcacactaaatcgcttgctgctagccagcctgattgcaatcgcgccgatggccgtgattgccgcggaggatgcgccatcggcggatccggaagtaaccattcgcacggaaggcgacaagaccatccaggaataccgccagaacggtttcctgtacgccatcaaggtcacaccgaagggcggcaaaccctactttctggtgcgcgccgacggttccgatggcaacttcattcgttcggaccagccggatatgctgattccggcgtggaaaattttcgagtggtaa

SEQ ID NO: 1754 - DNA, 288 bp, Pseudomonas sp.
atgcgcacactaaatcgcttgctgctggccggcttgattgcaatcgctccaatggccgtgatcgccgcagaagatgcgccgtcagcggacccgcaagtcaccattcgcacggaaggcgacaagaccatccaggaataccggcaaaatggctttctgtatgccatcaaggtcacgcccaagggcggcaagccctacttcctggtgcgcgctgatggctccgacggtaacttcatccgttcggatcagcccgatatgctgatccctgcgtggaaaatctttgagtggtaa

SEQ ID NO: 1755 - DNA, 288 bp, Pseudomonas sp.
atgcgcacactgaatcgcttgctgctggccagcttgattgcaatcgctccaatggccgttatcgccgcagaggatgcgccatcagccgacccggacgtgaccattcgcacggaaggcgaaaagaccatccaggaataccggcagaatggtttcctgtatgccatcaaggtcacgccaaagggtggcaagccctacttcctggtgcgcgccgatggctccgacggcaacttcatccgctcggatcagccggatatgctgatcccttcgtggaaaatctttgagtggtaa

SEQ ID NO: 1756 - DNA, 288 bp, Pseudomonas sp.
atgcgcacactaaatcgcttgctgctggccagcttgattgcagtgacaccattggcagtaatcgcggcagaggacgcgccatcagcggatccggacgtcaccattcgcacggaaggcgacaagaccattcaggaataccgccaaaacggtttcctgtacgccatcaagatcacgccaaagggcggcaaaccgtactttctggtacgtgccgatggctcggatggcaacttcatccgctcggatcagccggatatgctgatcccggcgtggaaaattttcgagtggtaa

SEQ ID NO: 1757 - DNA, 288 bp, Pseudomonas sp.
atgcgcacactaaatcgcttgctgctgaccggcttgattgcaatcgctccattggccgcgatcgccgcagaagatgcgccatcagcggacccggaagtaaccattcgcacggaaggcgacaagaccatccaggaataccggcaaaatggcttcctgtatgccatcaagatcacgccaaagggcggcaaaccctacttcctggtgcgtgccgatggctcggacggcaacttcatccgttcggatcagccggatatgctgatcccttcgtggaaaatctttgagtggtaa

SEQ ID NO: 1758 - DNA, 288 bp, Pseudomonas sp.
atgcgcacactaaatcgcttgttgctggctggcttgtttgcaatcactccattggctgtcatggcggcggacgatgcgccctcggcagacccggatgtaacaatccgcacggaaggcgataaaaccattcaggagtatcggcaaaatggttttttgtatgccatcaaggtgaccccgaaagtcggcaaaccgtatttcctggtgcgcgctgatggctccgacggtaacttcatccgctcggaccagccggatatgctgattccgtcgtggaaaatattcgagtggtaa

SEQ ID NO: 1759 - DNA, 288 bp, Pseudomonas sp.
atgcgcacactaaatcgcttgttgctggctggcttgtttgcaatcaccccattggctgtcatggcggcggacgacgcgccctcggcggacccggatgtaacaatccgcacggaaggtgacaaaaccattcaggaatatcggcaaaatggttttttgtatgccatcaaggtgaccccgaaaggcggtaaaccgtatttcctggtgcgcgctgatggctcggacggtaacttcatccgctcggaccagccggatatgctgattccgtcgtggaaaatatttgagtggtaa

SEQ ID NO: 1760 - DNA, 288 bp, Pseudomonas sp.
atgcgtacactaaatcgcctgttactggctggcttgtttgcaatcaccccgctggccgtcatggcggcggacgacgccccctcggcggacccggatgtcaccatccgcaccgaaggcgataggaccattcaggagtaccggcaaaacggctttctgtacgcgatcaaggtcacgcccaagaacggcaagccttatttcctggtccgtgccgatggcagcgacgggaatttcatccgctcggatcagccggatatgctgattccatcgtggaaaatctttgagtggtaa

SEQ ID NO: 1761 - DNA, 288 bp, unknown
  environmental sample
atgcgtacactaaatcgcctgttactggctggcttgtttgcattcaccccgttggccgtcatggcggcggacgacgcgccctcggcggacccggatgtcaccatccgcaccgaaggcgataacacgatccaggaatatcggcaaaacggctttttgtacgcgatcaaggtcacgcccaagaacggcaagccttatttcctggtacgcgccgacggtagcgatggcaatttcatacgttcggaccagccggatatgctgatcccctcgtggaaaatctttgagtggtga

SEQ ID NO: 1762 - DNA, 288 bp, unknown
  environmental sample
atgcgtacactcaatcgcctgttactgctctgcctgatcgcaggtctgcccgtcgtcaccttggcggcggatgacgcgccctcggccgatcccgaggtgaccattcgcacggaaggcgacaagaccatccaggaatatcgccaaaacggcttcctgtatgcgatcaagatcacgcccaaacatggcaagccttactttctggtacgcgccgatggctctgatggcaatttcattcgttccgaccagccggacatgctgattccgtcctggaagatcttcgagtggtaa

SEQ ID NO: 1763 - DNA, 288 bp, unknown
  environmental sample
atgcgtacactaaatcgcctgttactcgctggtttgtttgcattcaccccgatagccgtcatggcagcggatgacgctccctcggcggacccggatgtcactatccgcaccgaaggcgataaaaccatccaggaatatcggcaaaacggctttttgtacgcgatcaaggtcacgcccaagaacggcaagccttattttctggtgcgtgccgacggcaccgatgcaaacttcatccgttcggacgagccggatatgctgatcccttcgtggaaaatctttgagtggtaa

SEQ ID NO: 1764 - DNA, 270 bp, Pseudomonas sp.
ttgctgctggccggcttgattgcagtctcctccatggcagcgatcgccgcggaagacgccccttcggccgacccggaagtaaccattcgcacggaaggcgacaagaccatccaggaataccggcaaaatggcttcctgtatgcgatcaaggtcacgccaaaaggtggcaagccctacttcctagtgcgcgccgatggctccgacggcaacttcatccgttcggaccagccggatatgctgatcccttcgtggaaaatcttcgagtggtaa

SEQ ID NO: 1765 - DNA, 288 bp, Pseudomonas sp.
atgcggacactcaatcgcctgttactgctcggccttctggcaaccacgcctatcgtcacccaggcggcggacgacgccccatcggcagatcccgatgtgaccattcgcacggaaggcgatcgaaccattcaggagtaccgtcaaaacggcttcctgtatgcgatcaaaatcacgccgaaaaacggcaaaccttatttcctggtacgcgccgacggctccgacggcaatttcattcgatccgaccagccggacatgctgattccgtcgtggaagatcttcgagtggtaa

SEQ ID NO: 1766 - DNA, 288 bp, Pseudomonas sp.
atgcgtacgttaaatcgcttgctgctggtcggtctgattgctgtctcaccgttggccgcgatggcggcggatgatgcgccggggggcgaccctgaggtcaccatccgtacggacggcgacaagaccattcaggagtaccggcaaaacggtttcctgtatgcgatcaaaatcacgccgaagaatggcaaaccctattttctggtgcgtgccgatggtacggacgctaatttcatccgctcggaccagccggatatgctgatcccgtcatggaagatattcgagtggtag

SEQ ID NO: 1767 - DNA, 288 bp, Pseudomonas sp.
atgggtacattcaatcgcctgttgttgctcggccttctcgtcggcacgccggtcgcagccctggcagcggacgaagcgccctcggccgagccggaagtaaccattcgcacggaaggtgacaaaactattcaggaataccgtcagaacggcttcctgtacgcgatcaaggtcacaccgaagaacggcaagccgtacttcctggtgcgtgccgacggtagcgacgccaacttcatccggtccgaccaacccgacatgctgattccctcctggaaaatcttcgagtggtaa

SEQ ID NO: 1768 - DNA, 288 bp, unknown
  environmental sample
atgcgctcattcaatcgcctgttattgctcggtctgctggtcaccctgccagtcgtcgcccaggcggcggacgatgcgccctcggccgaccccgaggtgaccattcgcacggaaggcgaccgcaccatccaggagtaccggcagaacggtttcctgtacgccgtcaaggtcacgcccaagcacggcaagccttacttcctggtccgcgccgacggcaccgacgccaacttcatccgctccgaccaaccggacatgctgatccccgcctggaagatcttcgagtggtaa

SEQ ID NO: 1769 - DNA, 288 bp, unknown
  environmental sample
atgcgcaacgtaaaacgcctgttgctcgcgacactgctgctgagcggtccgctgatggtccaagctgctgacgatgcgccttcggccgatccggacgtgaccattcgccaggacggcgacaagaccattcaggagtaccgccagaacggcttcctgtacgccatcaagatcaccccgaagcacggcaagccgtacttcctggtgcgcgccgatggcaccgacgacaatttcatccgctccgaccagccggacatgttgatcccggcctggaagatcttcgagtggtga

SEQ ID NO: 1770 - DNA, 291 bp, Pseudomonas sp.
atgcgtacactcaatcgcctgttgctgaccggtttgtttgcattcactccgctggtaacctttgcagccgatgaagcagtcaccgcagatccagatgtaaccattcgcacggaaggcgataaaaccattcaggaataccgtcaaaacggtttcctgtacgccatcaaggtcaccccaaaagggggcaaaccgtactttctggtgcgggctgatggtactgatgccaattacatccgttccgaccagccggatatgctgattccatcgtggaaaatcttcgaatggaagtag

SEQ ID NO: 1771 - DNA, 291 bp, unknown
  environmental sample
atgcgtacgctgaaccgcttgatgctcgccggactgctggcgttcgccccgctcgtcgcgatggcggcggacgacgacgcgccctccggcgagcccgacgtaaccatccgccaggagggcgacaagaccatccaggaataccgcgtgaatggcttcctctacgccatcaaggtggttcccaagcatggcaaaccctatttcctggtccgcgccgacggcagcgatggcaacttcattcgctccgaccagccggacaagctgattccacaatgggagatcttcagctggtga

SEQ ID NO: 1772 - DNA, 291 bp, Pseudomonas sp.
atgcgtacgctgaaccgcttgatgctcgccggactgctggcgttcgccccgctcgtcgcgatggcggcggacgacgacgcgccccccggcgggcccgacgtaaccatccgccaggagggcgacaagaccatccaggaataccgcgtgaatggcttcctctacgccatcaaggtggttcccaagcatggcaaaccctatttcctggtccgcgccgacggcagcgatggcaacttcattcgctccgaccagccggacaagctgattccacaatgggagatcttcagctggtga

SEQ ID NO: 1773 - DNA, 291 bp, Pseudomonas sp.
atgcgcacactaaatcgcctgttgctggctggcttgtttgcaactgttccattggccgccatggcggcggacgatgtttcgaaacaggaaccgcaagtgacgatccgcacggaaggggacaaggtcattcaggagtaccgtcaaaatggttttctgtatgccatcaaagtcacgcccaaaggcggcaagccgtatttcctcgtacgcgccgatggtacagaggcaaactacatccgctcggatcagccggatatgctgattccggcgtgggaaattttcacctggaagtag

SEQ ID NO: 1774 - DNA, 291 bp, Pseudomonas sp.
atgcgctcactcaatcgcttgttactggctggcttctttgcaatcactcccctggccgtcatggcagccaatgatgcaccgacgccggaaccggaagtcaccatccacactgaaggcgacaaagtcattcaggagtaccgccagaacggcttcgtgtacgcgatcaaggtcacaccgaagggtggaaaaccgtactttctgatacgtgcggacggaacggaggcaaactatatccgctcggatcagccgaatatgctgattccggcgtgggaaatttttacgtggaagtag

SEQ ID NO: 1775 - DNA, 285 bp, Pseudomonas sp.
atgcgcacacttaactgcctgttattggccggtctgcttggcgttggcgcaaccatggcgcatgccgaggatccggtcactgcggaaccggacgtaaccattcgtcaagaaggcgatcgcacggtgcaggagtaccgggttaacggttttctatatgcgatcaaagtcattccaaagaatggcaagccttactttttggtgcgttcagatggcagcgacggcaatttcattcgttccgacgaccctgacatgttgattcctgcatgggaaatcttcagctggtaa

SEQ ID NO: 1776 - DNA, 285 bp, unknown
  environmental sample
atgggtacattgaatcgcctgttgctggtcggcctgttggcctgtgtcccccttgctgctcacgccgaagatccggtatccggcgacccggacgtgaccatccgccaggacggcgaccgcaccattcaggaataccgggtcaatggcttcctctacgccatcaaggtcatcccgaagaacggtaaaccctactttctcgttcgcgccgatggcagcgacggcaacttcgtacgttcggacgatccggacatgctgatcccatcgtgggaaatctttagctggtaa

SEQ ID NO: 1777 - DNA, 297 bp, Pseudomonas sp.
atgcgtacgttaaatcgcttgctgctggtcggtctgattgctgcctcaccgttagccgcgatggcggcggatgatgcgcccgcctcggagccggaagttacgatcaacacgcacacggaaggcgacaaggtcatccaggaatacagtcgcagtggcttcgtctacgcgatcaaggtcacgccaaagggtggcaaaccgtatttcctggtgcgcgccgatggcacggacgcgaactacattcgctccgaccagccggatatgctgattccgtcgtgggaaatctttacctggaagtaa

SEQ ID NO: 1778 - DNA, 288 bp, unknown
  environmental sample
atgcgcaaggtaaatcgactgatattgaccgggctgttggccttttgccctttgctcgctgttgccgcagaagatccaccttcagcggcgccggacgtgacgattcgcactgacggtgacagaaccattaaggagtaccgccagaacggctttctgtatgcggttaaaatcaccccgaaacacggcaaaccctattttctggtgcgcgccgatggtacaagccccaatttcattcgttcggaccaaccggacatgctgatcccgcagtgggaaatattcagctggtag

SEQ ID NO: 1779 - DNA, 288 bp, Azotobacter sp.
atgcacaccttccctcgcctgctgctggccggcctgctggctctgggcgcagtcggcgccttcgcccagcaggatgcgccgtccggcgaaccggacgtgaccatccgcgaggaggacgacaagaccatcgaggaataccgcgtcaatggtttcctctatgccatcaaggtcactcccaagtttggcaaaccctatttcctggtgcgcgccgacggcaacgatgccaatttcgtgcgctccgacgagccgaccatgcggatccccgcctggaaaatcttcgaatggtaa

SEQ ID NO: 1780 - DNA, 1494 bp, Erwinia sp.
atgcttcctagcactcgtgtcagcgccatgcgcaagctcccgctggccatcaccctcggtctggtttcgttggccactcaacaagccttcgcccacgggtatatcgaaagcccaaaatcccgtgccttcatgtgctccgccaccggcggcaacctcaaccgcgattgcggccccgtcacttacgaaccgcaaagtgtcgagtactcgccatcggtccagcatcactatcccaaggattactgctcgggcgacttcactaaatgcggtccggcgaacggcaccatcccagcgggcggcatcaccaacttctcccagctcaacgaacagacggcgacccgttggcagaaaaccacgatcaagccgggcatgaatgaattcacctggcactactccgccggtcacgccagcgcctactaccagttctacatcaccaagaaagactggaacccgaaccagccgctgacccgcgactccttcgagatgaccccgctgctcaatgaaaacgccggtggcgtgcgtccgccagccggtggcaagacccagcacaaggtcaacatcccggccgatcgcagcggttaccacgtgatcctggcgacctggaaaatcgccgacaccgccgccaccttctaccaggccatcgacgtcaacatcgataacgatggcgcgccgattcctgactggaagatcctcggcgcggtgcagcctgaacaactgcgtgtcggcgacaaggtcagcacccgcgtgttcaccaatgccggcgagcaacagaaccgccagacccgcctgagcatcgagaccgcggaacaggcccaggccaacacctggccgttcctgttggcgcagcaggtcaacaaagccaatgccggctacgtgatgggcgaactcaacgccaataacgaagtcgtgcccaactacggcaagaacaccatgtacgccaagaacaacagcgacgtggtacgcgtggaaatccagaaagagcagccgagcattcctggcgagctgaagctttccggcctgcaggccgagtacaccctgaaggacaacgccaccgacctgcacttcaacgccattgcccagggcggcaagtacaccatcagttcgacggtcttcaacggcaagaacgaaagcatcgctcacgtgcaagccgagcctggcaacaacaccccgcacttctccatcccgctgcgtaacgtcagcgaaggcgagtacgacgtggtggtcgtggccaagccggaaaaaggcgagcagctgcaacaaagccagcgcatcaccctgaaagccgaggaagtgggcggcggcggtgattacgacttcgtcttccccaaaggcctgaccggctacaaggccggcaccaaggtcctggccaaggacggcaacgtctatgagtgcaagccgttcccttacagcggctactgcatccagtggaacgctggcgccactcagttcgagcctggcgttggcagcaactggaaagacgcctggattcgcaagtaa

SEQ ID NO: 1781 - DNA, 1494 bp, Pseudomonas sp.
atgcttcctagcactcgtgtcagcgccatgcgcaagctcccgctggccatcaccctcggtctggtttcgttggccactcaacaagccttcgcccacgggtatatcgaaagcccaaaatctcgtgccttcatgtgctccgccaccggcggcaacctcaaccgcgattgcggccccgtcacttacgaaccgcaaagtgtcgagtactcgccatcggtccagcatcactatcccaaggattactgctcgggcgacttcactaaatgcggtccggcgaacggcaccatcccggcgggcggcatcaccagcttctcccaactcaacgagcagacggcgacccgctggcagaaaaccacgatcaagccgggcatgaatgaattcacctggtactactccgccggtcacgccagcgcctactaccagttctacatcaccaagaaggactggaacccgaaccagccgctgacccgcgactccttcgagatgaccccgctgctcaatgaaagcgccggcggcgcgcgtccgccagccggtggcaggaccaagcacaaggtcaacatcccggccgatcgcagcggttaccacgtgatcctggcgacctggaaaatcgccgacaccgccgccaccttctaccaggccatcgacgtcaacatcgacaacgatggcgcgccgattcctgactggaagatcctcggcgcggtgcagcctgaacaactgcgtgtcggcgacaaggtcagcacccgcgtgttcaccaatgccggcgagcaacagaaccgccagacccgcctgagcatcgagaccgcggaacaggcccaggccaacacctggccgttcctgttggcgcagcaggtcaacaaggccaatgccggctacgtaatgggcgaactcaacgccaataacgaagtcgtgcccaactatggcaagaacaccctgtacgccaagaacaacagcgacgtggtacgcgtggaaatccagaaagagcagccgagcattcctggcgagctgaagctgtccggcctgcaggccgagtacaccctgaaggacaacgccaccgacctgcacttcaacgccattgcccagggcggcaagtacaccatcagttcgacggtcttcaacggcaagaacgaaagcatcgctcacgtgcaagccgagcctggcaacaacaccccgcacttctccatcccgctgcgtaacgtcagcgaaggcgaatacgacgtggtggtcgtggccaagccggaaaaaggcgagcagctgcaacaaagccagcgcatcaccctgaaagccgaggaagtgggcggcggcggtgattacgacttcgtcttccccaaaggcctgaccggctacaaggccggcaccaaggtcctggccaaggacggcaacgtctatgagtgcaagccgttcccttacagcggctactgcatccagtggaacgccggcgccactcagttcgagcctggcgttggcagcaactggaaagacgcctggattcgcaagtaa

SEQ ID NO: 1782 - DNA, 1494 bp, Pseudomonas sp.
atgcctcataacaaccgcgtcaacgccatgcgcaagctgccgttggccatcaccctcggtctggtttcgttggccactcaacaagccttcgcccacgggtatgtcgagagcccaaaatcccgtgccttcatgtgctccgcaaccggcggcaacctcaaccgcgattgcggccccgtcacttacgagccgcaaagtgtcgagtactcgccatcggtccagcatcactatcccaaggattactgctcgggcgacttcactaaatgcggtccggcgaacggcaccatcccggcgggcggcatcaccagcttctcccaactcaacgagcagacggcaacccgctggcagaaaaccacgatcaagccgggcatgaatgaattcacctggtactactccgccggtcacgccagcgcctactaccagttctacatcaccaagaaggactggaacccgaaccagccgctgacccgcgactccttcgagatgaccccgctgctcaatgaaaacgccggtggcgtgcgtccgccagccggtggcaggaccaagcacaaggtcaacatcccggccgatcgcagcggttaccacgtgatcctggcgacctggaaaatcgccgacaccgccgccaccttctaccaggccatcgacgtcaacatcgacaacgatggcgcgccgattcctgactggaagatcctcggcgcggtgcagcctgaacaactgcgtgtcggcgacaaggtcagcacccgcgtgttcaccaatgccggcgagcaacagaaccgccagacccgcctgagcatcgagaccgcggaacaggcccaggccaacacctggccgttcctgttggcgcagcaggtcaacaaggccaatgccggctacgtaatgggcgaactcaacgccaataacgaagtcgtgcccaactacggcaagaacaccctgtacgccaagaacaacagcgacgtggtacgcgtggaaatccagaaagagcagccaagcattcctggcgagctgaagctgtccggcctgcaggccgagtacaccctgaaggacaacgccaccgacctgcacttcaacgccattgcccagggcggcaagtacaccatcagttcgacggtcttcaacagcaagaacgaaagcatcgctcacgtgcaagccgaggctggcaacaacaccccgcacttctccatcccgctgcgtaacgtcagcgaaggcgaatacgacgtggtggtcgtggccaagccggaaaaaggcgagcagctgcaacaaagccagcgcatcaccctgaaagccgaggaagtgggcggcggcggtgattacgacttcgtcttccccaaaggcctgaccggctacaaggccggcaccaaggtcctggccaaggacggcaacgtctatgagtgcaagccgttcccttacagcggctactgcatccagtggaacgccggcgccactcagttcgaacctggcgttggcagcaactggaaagacgcctggattcgcaagtaa

SEQ ID NO: 1783 - DNA, 1494 bp, Pseudomonas sp.
atgcctcataacaaccgcgtcaacgccatgcgcaagctgccgttggccatcaccctcggtctggtttcgttggccactcaacaagccttcgcccacgggtatgtcgagagcccaaaatcccgtgccttcatgtgctccgcaaccggcggcaacctcaaccgcgattgcggccccgtcacttacgagccgcaaagtgtcgagtactcgccatcggtccagcatcactatcccaaggattactgctcgggcgacttcactaaatgcggtccggcgaacggcaccatcccggcgggcggcatcaccagcttctcccaactcaacgagcagacggcgacccgctggcagaaaaccacgatcaagccgggcatgaatgaattcacctggtactactccgccggtcacgccagcgcctactaccagttctacatcaccaagaaggactggaacccgaaccagccgctgactcgcgactccttcgagatgaccccgctgctcaatgaaagcgccggcggcgcgcgtccgccagccggtggcaggaccaagcacaaggtcaacatcccggccgatcgcagcggttaccacgtgatcctggcgacctggaaaatcgccgacaccgccgccaccttctaccaggccatcgacgtcaacatcgacaacgatggcgcgccgattcctgactggaagatcctcggcgcggtgcagcctgaacaactgcgtgtcggcgacaaggtcagcacccgcgtgttcaccaatgccggcgagcaacagaaccgccagacccgcctgagcatcgagaccgcggaacaggcccaggccaacacctggccgttcctgttggcgcagcaggtcaacaaggccaatgccggctacgtaatgggcgaactcaacgccaataacgaagtcgtgcccaactacggcaagaacaccctgtacgccaagaacaacagcgacgtggtacgcgtggaaatccagaaagagcagccgagcattcctggcgagctgaagctgtccggcctgcaggccgagtacaccctgaaggacaacgccaccgacctgcacttcaacgccattgcccagggcggcaagtacaccatcagttcgacggtcttcaacggcaagaatgaaagcatcgctcacgtgcaagccgagcctggcaacaacaccccgcacttctccatcccgctgcgtaacgtcagcgaaggcgaatacgacgtggtggtcgtggccaagccggaaaaaggcgagcagctgcaacaaagccagcgcatcaccctgaaagccgaggaagtgggcggcggcggtgattacgacttcgtcttccccaaaggcctgaccggctacaaggccggcaccaaggtcctggccaaggacggcaacgtctatgagtgcaagccgttcccttacagcggctactgcatccagtggaacgccggcgccactcagttcgaacctggcgttggcagcaactggaaagacgcctggattcgcaagtaa

SEQ ID NO: 1784 - DNA, 1494 bp, Pseudomonas sp.
atgcctcataacaaccgcgtcaacgccatgcgcaagctgccgttggccatcaccctcggtctggtttcgttggccactcaacaagccttcgcccacgggtatgtcgagagcccaaaatcccgtgccttcatgtgctccgcaaccggcggcaacctcaaccgcgattgcggccccgtcacttacgagccgcaaagtgtcgagtactcgccatcggtccagcatcactatcccaaggattactgctcgggcgacttcactaaatgcggtccggcgaacggcaccatcccggcgggcggcatcaccagcttctcccaactcaacgagcagacggcaacccgctggcagaaaaccacgatcaagccgggcatgaatgaattcacctggtactactccgccggtcacgccagcgcctactaccagttctacatcaccaagaaggactggaacccgaaccagccgctgacccgcgactccttcgagatgaccccgctgctcaatgaaagcgccggcggcgcgcgtccgccagccggtggcaggaccaagcacaaggtcaacatcccggccgatcgcagcggttaccacgtgatcctggcgacctggaaaatcgccgacaccgccgccaccttctaccaggccatcgacgtcaacatcgacaacgatggcgcgccgattcctgactggaagatcctcggcgcggtgcagcctgaacaactgcgtgtcggcgacaaggtcagcacccgcgtgttcaccaatgccggcgagcaacagaaccgccagacccgcctgagcatcgagaccgcggaacaggcccaggccaacacctggccgttcctgttggcgcagcaggtcaacaaggccaatgccggctacgtaatgggcgaactcaacgccaataacgaagtcgtgcccaactacggcaagaacaccctgtacgccaagaacaacagcgacgtggtacgcgtggaaatccagaaagagcagccgagcattcctggcgagctgaagctgtccggcctgcaggccgagtacaccctgaaggacaacgccaccgacctgcacttcaacgccattgcccagggcggcaagtacaccatcagttcgacggtcttcaacagcaagaacgaaagcatcgctcacgtgcaagccgagcctggcaacaacaccccgcacttctccatcccgctgcgtaacgtcagcgaaggcgaatacgacgtggtggtcgtggccaagccggaaaaaggcgagcagctgcaacaaagccagcgcatcaccctgaaagccgaggaagtgggcggcggcggtgattacgacttcgtcttccccaaaggcctgaccggctacaaggccggcaccaaggtcctggccaaggacggcaacgtctatgagtgcaagccgttcccttacagcggctactgcatccagtggaacgccggcgccactcagttcgaacctggcgttggcagcaactggaaagacgcctggattcgcaagtaa

SEQ ID NO: 1785 - DNA, 1491 bp, Pseudomonas sp.
atgcttcataacaaccgcgccaccgccatgcgcaagctgccgctggccatcaccctcggcctggcttcgctggccagccaacaagccttcgcccacggttacatcgaaagtccgaagtcccgggccttcatgtgctccgcgaacggcggcaacctcaaccgcgattgcggccccgtcacttacgaaccgcaaagtgtcgagtactcgccatcggtccagcatcactaccccaaggattactgctcgggcgacttcaccaaatgcggcccggcgaacggcaccatcccggcgggcggcatcaccagcttctcccagctcaacgagcagacggcgacccgctggcagaaaaccacgatcaagccgggcatgaatgaattcacctggtactactccgccggtcacgccagcgcctactaccagttctacatcaccaagaaagactggaacccgaaccaaccgctgacccgcgactccttcgaaatgaccccgctgctcgatgaaaaagcgaacggcgcgcgtccgccagctggtggcaggaccaagcacaaggtcaacatcccggccgatcgcagcggttaccacgtgatcctggcgacctggaaaatcgccgacaccgccgccaccttctaccaggccatcgacgtcaacatcgacaacgatggcgcgccgattcctgactggaagatcctcggcgcggtgcagccggaacaactgcgtgtcggcgacaaggtcagcacccgtgtgttcaccaacgccggcgaacagcagaaccgccagacccgcctgagcatcgagaccgcggaacaggcccaggccaacacctggccattcctgttggcgcagcaggtcaacaaggccaatgccggctacgtgatgggcgaactcaacgccaataacgaagtcgtgcccaactacggcaagaacaccatgtacgccaagaacaacagcgacgtggtacgcgtggaaatccagaaagagcagccgagcattcctggcgagctgaagctttccggcctgcaggccgagtacaccctgaaggacaacgccaccgacctgcacttcaatgccattgcccagggcggcaagtacaccatcgcctccaccgtgttcaacggcaaaggcgaaagcatcgcccaccagcaggcggaagccggcaacaacaccccccacttctccatcgcgctgcgtaacgtcagcgaaggcgactatgacgtggtggtcgtggccaagccggaaaaaggcgagcagctgcaacaaagccagcgcatcaccctgaaagccgaggaagtgggcggcggtgactacgacttcgtcttccccaaaggcctgaccggctacaaggccggcaccaaggtcctggccaaggacggcaacgtctatgagtgcaagccgttcccttacagcggctactgcatccagtggaacgctggcgccactcagtacgagccgggcgttggcagcaactggaaggacgcctggattcgcaagtaa

SEQ ID NO: 1786 - DNA, 1491 bp, unknown
  environmental sample
atgcttcataacaaccgcgccaccgccatgcgcaagctgccgctggccatcaccctcggcctggcttcgctggccagccaacaagccttcgcccacggttacatcgaaagtccgaagtcccgggccttcatgtgctccgcgaatggcggcaacctcaaccgcgattgcggccccgtcacttacgagccgcaaagtgtcgagtactcgccatcggtccagcatcactaccccaaggattactgctcgggcgacttcaccaaatgcggcccggcgaacggcaccatcccggcgggcggcatcaccagcttctcccagctcaacgagcagacggcgacccgctggcagaaaaccacaatcaagccgggcatgaatgaattcacctggtactactccgccggtcacgccagcgcctactaccagttctatatcaccaagaaagactggaacccgaaccagccgctgacccgcgactccttcgagatgaccccgctgctcgatgaaaaagcgaacggcgcgcgtccgccagccggtggcaggaccaagcacaaggtcaacattcctgccgatcgcagcggttaccacgtgatcctggcgacctggaaaatcgccgacaccgccgccaccttctatcaggccatcgacgtcaacatcgacaacgatggcgcgccgattcctgactggaagatcctcggcgcggtgcagcctgaacagctgcgtgtcggcgacaaggtcagcacccgtgtgttcaccaacgccggcgaacagcagaaccgccagacccgcctgagcatcgagaccactgagcaggcccaggccaacacctggccgtacctgttggcgcagcaggtcaacaaggccaatgccggctacgtgatgggcgagctcaacgccaataacgaagtcgtgcccaactacggcaagaacaccatgtacgccaagaacaacagcgacgtggtacgcgtggaaatccagaaagagcagccgagcattcctggcgagctgaagctttccggcctgcaggccgagtacaccttgaaggacaacgccaccgacctacacttcaacgccattgcccagggcggcaagtacaccatcgcctccaccgtgttcaacagcaaaggtgaaagcatcgctcaccagcaggcggaagccggcaacaacaccccccacttctccatcccgctgcgcaatgtcagcgaaggcgactatgacgtggtggtcgtggccaagccggaaaaaggcgagcagctgcaacaaagccagcgcatcaccctgaaagccgaggaagtgggcggcggtgactacgacttcgtcttccccaaaggcctgaccggctacaaggccggcaccaaggtcctggccaagaacggcaacgtctatgagtgcaagccattcccttacagcggctactgcatccagtggaacgctggcgccactcagtacgagccgggcgttggcagcaactggaaggacgcctggattcgcaagtaa

SEQ ID NO: 1787 - DNA, 1497 bp, Pseudomonas sp.
atgcttcctagcacccgcgccagcgccctgcgcaagctgcccctggccattaccctcggcctggcatccctggccacccagcaagccttcgcccacggttacgtcgaaagtccgaagtcccgtgccttcatgtgcaactccgccgggggcaacctcaacggcaattgcggccctgtcacgtacgaaccgcaaagtgtcgagtactcgccatcggtggcccaccactacccgaaggattactgcgcgggtgacttcacccagtgcggcccggccaacggcaccattccggccggcggtatcgccagcttctcccagctcaacgagcagaccgctacccgctggcagaaaaccaccatcaagccaggcatgaatgaattcacctggcactacaaggccggccacgccagcgcctactaccagttctacatcaccaagaaagactggaacccgaaccagccgctgacccgcgactcgttcgagctgaccccgctgctcaatgaaaacgctggcggcgcgcgtccgcagagcggcagcacgaccaagcacaaggtcaacatcccggccgaccgcagcggttaccacgtgatcctggccacctggaaaatcgccgacaccgcggcgaccttctaccaggtcatcgacgtcaacatcgacaacgacggcgcaccggttcccgactggaaaatcctcggcgcggtacagcccgaagagctgcgtgtcggcgacaaggtcaagacccgcgtgttcaccaacgccggcgagcagcagaaccgccagaccgtgctgaacatcgagaccgcggaacaggccaaggccaacacctggccgttcctgctggcgcagaaggtcaacaaggccaacgccggctacctcatgggcgagctcaacgccaacaacgaagtggtgccgcactacggcaagaacaccatgtacgccaagaagggcagcgacgtggtgaacgtggaaatccagaaagaccagccgagcatcccgggcgagctgaagatttccggcctgcaagccgagtacaccctgaaggacggcgccaccgacctgcacttcaatgcgatcgcccagggcggcaagtacaccgtcagctcgaccgtgttcaacggcaagaacgaaagcatcgcccacgtccaggccgagccaggcaacaacatgccgcacttctccatcccgctgcgcaatgtcagcgaaggtgagtacgacgtcgtggtcgtggccaagccggaaaaaggcgagcagctgcaacagagccagcgcatcaccctgaaggctgaagaaacgggtggcggcaccggtgaatacgacttcgtcttccccaagggcctgagcagctacaaggccggcaccaaggtgctgggcaaggacggcaaggtctacgagtgcaagcccttcccttacagcggctactgcatccagtggaacgctggcgccattcactatgagccaggcaccggcagcaactggcaggacgcctggattcgcaagtaa

SEQ ID NO: 1788 - DNA, 1497 bp, Pseudomonas sp.
atgcttcataacatccgcgccaacgccatgcgcaagctgccgctggccattaccctcggcctggcctccctggccacccaacaagccttcgcccacggttacgtcgaaagtccgaagtcccgtgcctacatgtgcaactccgccggtggcagcctcaacgccaattgcggcgccgtcacgtacgagccacaaagtgtcgagtactcgccttcggtcgcccaccactacccgaaggactactgcgcgggtgacttcacccagtgcggcccggccaacggcaccatcccggccggcggtatcaccagcttctcccagctcaacgagcagaccgctacccgctggcagaaaaccaccatcaagccgggcatgaatgaattcacctggcactacaaggccggccactccagcgcctactaccagttctacatcaccaagaaagactggaacccgaaccagccgctgacccgcgactccttcgagctcaagccactgctcgatgaaaaggccaacggcgtgaacccaggttctggcggcaggaccaagcacaaggtcaacatcccggccgaccgcagcggttaccacgtgatcctggcaacctggaaaatcgccgacaccgcggcgaccttctaccaggccatcgacgtgaacatcgacaacgatggcgcgccggttcccgactggaaaatcctcggcgcggtacagcctgaagagctgcgtgtcggcgacaaggtcaagacccgtgtgttcaccaacgccggcgagcagcagaaccgccagaccgtgctgaacatcgagaccgcggaccaggccaaagccaacaactggccgttcctgctggcgcagaaagtcaacaaggccaatgccggctacctcatgggcgagctcaacgccaataacgaaatcgtgcctaactacggcaagaacaccatgtacgccaagaagggcagcgacgtggtgaacgtggaaatccagaaagaccagccgagcatcccgggcgagctgaagatttccggcctgcaagccgagtacaccctgaaggacggcgcaaccgacctgcacttcaacgcgatcgcccagggcggcaagtacaccgtcagctcgaccgtgttcaacggcaagaacgaaagcatcgcccacgtgcaagccgagcctggcaacaacgcaccgcacttctccatcccgctgcgcaatgtcagcgaaggtgagtacgacgtagtggtcgtggccaagccggagaaaggcgagcaactgcaacaaagccagcgcatcaccctgaaagccgaagaagtgggcggcggtaacggcgactacgacttcgtcttccctaaaggcctgagcagctacaaggccgggaccaaggtcctgggcaaagacggcaaggtctatgagtgcaagccgttcccgtacagcggctactgcatccagtggaacgcaggtgcgactcactatgagcctggcaccggcagcaactggaaggacgcctggattcgcaagtaa

SEQ ID NO: 1789 - DNA, 1494 bp, Pseudomonas sp.
atgatccactcccaccgctcgcgcagcatgagcaagcttcccctcgccctggccatcggcctggccgccctgtcctcccagcaggcgttttcccacggctacgtggaaagcccgaagtcccgcgcctacatgtgcaatgccaagggtggcaacctgaacgcgaactgcggcgcggtcacctacgagccacaaagcatcgaatacgcggagggcgccaaccatcactacccgagcacctactgccccggcgacttcacccagtgcggcccggccgatggcaccattcccgccggcggcctcaacaacttcgccccgctgaacgagcagaccgccacccgctggcagaagaccaccctcaagccgggcctgaacgaattccgctggcgcttcaccgccggccacgcctcggcctattaccagttctacatcaccaagaaggactggaacccgaaccagccgctgacccgcgattcgttcgagctcaagccgctgctgaaccaggatgcgggcggcgagactccgcagtccggctcgagcaagtccttcaacgtgaatattcccggcgatcgcagcggctaccacgtgatcctggccacctggaggatcgccaacacttccgcgaccttctaccaggccatcgacgtgaacatcgacaacaacgccgtgccgccgagcgaatggaccagcatcggcaccgtccagcccgaaccgctgcagatcggcgacaaggtgatgacccgggtcttcaccaatgccggcgagcaggccaaccgccagaccgttctggacatcggcagcgccaccgaagcccaggccaacacctggccgttcctgctcgcgcagaaggccaaccaggccaacgccggctaccggatgggcgtgctcaacgctgacggcgaggtagtcccgaactatggcgccaacagcatctacaccaaggccggcagcgatgtcgtccgcgtggagatccagaaggaccagccgaccgttcccggcgagctgagcctgtccggcctgcaaccgagctacacgctgaaggacggcgccgccgacctgcacttcaccgccatcgcccagggtggcacctacaccatcggcgccaccgtgttcaacggcaagggcgagagcatcgcccaccagcaggccgaagccggcaacaacgcgccgcacttcagcatcccgctgcgcaatgccagcgccggtgactatgacctggtcgtggtagccaagccggagaaaggcgaactgctgcaggaaacccagcgtttcagcctgaaggccgaggacaacggcggcaacggcaagtacgacttcgtgttcccggacggcctgtccaggtacaccgccggtaccaccgtactggcgaaggacggcaatacctatgcgtgcaagccgttcccgtacagcggcttctgcaagcagtggaacgccggttccaaccagttcgagcccggcgtcggctccagctggaaggacgcctggattcgccggtaa

SEQ ID NO: 1790 - DNA, 1494 bp, Pseudomonas sp.
atgatccactcccaccgctcgcgcagcatgagcaagcttcccctcgccctggccatcggcctggccgccctgtcctcccagcaggcgttttcccacggctacgtggaaagcccgaagtcccgcgcctacatgtgcaatgccaagggtggcaacctgaacgcgaactgcggcgcggtcacctacgagccacaaagcatcgaatacgcggagggcgccaaccatcactacccgagcacctactgccccggcgacttcacccagtgcggcccggccgatggcaccattcccgccggcggcctcaacaacttcgccccgctgaacgagcagaccgccacccgctggcagaagaccaccctcaagccgggcctgaacgaattccgctggcgcttcaccgccggccacgcctcggcctattaccagttctacatcaccaagaaggactggaacccgaaccagccgctgacccgcgattcgttcgagctcaagccgctgctgaaccaggatgcgggcggcgagactccgcagtccggctcgagcaagtccttcaacgtgaatattcccggcgatcgcagcggctaccacgtgatcctggccacctggaggatcgccaacacttccgcgaccttctaccaggccatcgacgtgaacatcgacaacaacgccgtgccgccgagcgaatggaccagcatcggcaccgtccagcccgaaccgctgcagatcggcgacaaggtgatgacccgggtcttcaccaatgccggcgagcaggccaaccgccagaccgttctggacatcggcagcgccaccgaagcccaggccaacacctggccgttcctgctcgcgcagaaggccaaccaggccaacgccggctaccggatgggcgtgctcaacgctgacggcgaggtagtcccgaactatggcgccaacagcatctacaccaaggccggcagcgatgtcgtccgcgtggagatccagaaggaccagccgaccgttcccggcgagctgagcctgtccggcctgcaaccgagctacacgctgaaggacggcgccgccgacctgcacttcaccgccatcgcccagggtggcacctacaccatcgacgccaccgtgttcaacggcaagggcgagagcatcgcccaccagcaggccgaagccggcaacaacgcgccgcacttcagcatcccgctgcgcaatgccagcgccggtgactatgacctggtcgtggtaggcaagccggagaaaggcgaactgctgcaggaaacccagcgtttcagcctgaaggccgaggacaacggcggcaacggcaagtacgacttcgtgttcccggacggcctgtccaggtacaccgccggtaccaccgtactggcgaaggacggcaatacctatgcgtgcaagccgttcccgtacagcggcttctgcaagcagtggaacgccggttccaaccagttcgagcccggcgtcggctccagctggaaggacgcctggattcgccggtaa

SEQ ID NO: 1791 - DNA, 1500 bp, Pseudomonas sp.
atgaaccattccactcgccccctggcagcgcgcatgctgccgctggcagccgctctcggcctggctgcactcggtgcccagcaggcttccgcccacggctacgtcgatagcccgaaatcccgtgcctacatgtgcgccgcgtccggtggcagcctgaacaaggactgcggctccgcagcctgggaaccgcaaagcatcgagtactcgccgagcgtcggccaccactacaagggccgctactgcgcggacgatttcaccaaatgcggcccggccgacggcaccatcccctctggcggcatcaagggtttcgccaagctgaacgagcagtcggcgacccgctggcagaagaccaccatcaagccgggcatcaacgacttcacctggcgctataccgccggccatgccacggcctactaccagttctacatcaccaagaaggactggaacccgaaccagccgctgacccgcgagtccttcgagtccaagcccctgctgcacgagaacgccaatggcgcgcggccgtcgtccggcacccgcaccacgcacaaggtgaacatcccatccgaccgcagcggctaccacgtggttttggccacctggaagatcggtgacaccgcggccaccttctaccaggccatcgacgtcaacatcgataacaagggcgcgccgccgagcgaatggaccaccatcggcgccgtccagccggaagccctgagcatcggcgacaaggtgacgacccgcgtcttcaccaaggccggcgagcaggccaaccgccagaccctgctgcgcatcgacaacgcccagcaggcccaggccaatacctggccctacctgctggcgcagaaggccaaccaggccaacgccggctacctgatgggccagctgaacgccgacggcaaagtggtaccgaactacggcaccaacaacatctacaccaaggccggcagtgacgtggtccgcgtggagatccagaaggaacagccgagcattccggccgcgctcagcctctccagcctcaaggacagctacaccctgaagaacggctccgccgagctgcacttcaacgccatcgcccagggcggcaagtacaccatcgacgcgaccgtgttcaacgccaagggcgagagcatcgcctaccagcaaggcgaggccggcaacaacatgccgcacttcagcctgccgctgaagaacgtccaggccggtgaatacgacctggtggtgctggccaagccggagaagggcgagctgctgcagaagacccaccacttcaccctcaaggatgaaagcggcaatggcggcggtaacgccaagtacgactacgtcttccccgatggcgtgaagagctaccgtgccggcgtccgcgtcctggccaaggacggcaacatctacgagtgcaagccgttcccctacggcagctactgcccgcagtggagcaccggcgccaaccacttcgagcccggcgtaggccagttctggtcgcaggcctggatccgcaagtaa

SEQ ID NO: 1792 - DNA, 339 bp, Pseudoxanthomonas sp.
atgcgcaagaacgcttccatcctcgccgccaccctcgccgccgtgctgttctccggcgccgccatggcccaggacaacgatccgtccaagaagccggccgccgatgccgattccaaccagccggtgaccgatacctggatcaccaccaaggtgaagtccagcctgctggccgacagcgacgtgtccggcaccaagatcgaggtcgacaccgtcgacggcgtggtcttcctgaccggcaacgtcgacagccaggcccaggtcaacgaggccaagcgcatcgcctcggaaatcgacggcgtcggcaaggtcgacaccagccgcctgaaggtcggcaagtaa

SEQ ID NO: 1793 - DNA, 684 bp, unknown
  environmental sample
atgtcgatcgaatcgcaaaacggcgtatcccaccgtcgatcgagggccgcggtagggctcgcggcgtgtgcggttgccgcgctgtcgtcgggtgtggtcttcgcagggagcgcatcggcaacgccgacggcgttggcggacaagttcgcgagcactgtcaccgatgacggttggtcgttggatcttgccgccacgaaactgtcggcgaacccggtgccgaatctggcgacgacggcgttcactcgtgaggggttcgtgtcggcgaaggtgaccggcacgatcggtggtgcgggtgattcggcggtgaagaccggttatgtcgagcaggggttgcagattggctgccagatcgatgtttcctccggacttggcttggggcttggtttttcgctcggtccgtctgtcggtgtgagtatttcgggtgtcccgtcggcgaacgtgggtgtgaatgcgtcggtgaatccgagtattcagtcgacgattgcgccgggcacgatcacgacgattccgttggggaagaaggatctcgagtcgtcgaaggcgtcgatcacggcagagaacgtgcacgtgaaggttgatgcgtgcatggggccggtgacgattcgctcgtatgcacaactctcggtgtcgacggcgacgtcggacaacacgttgttcgtgtactccgatcccacctggctctga

SEQ ID NO: 1794 - DNA, 684 bp, Rhodococcus sp.
atggcaaccgaattgaaagcacgaacatctcgccgtcgatcgagggccgcggtagggctcgcggcgtgtgcggttgccgcgctgtcgtctggtgtggtcttcgcagggagcgcatcggcaacgccgacggcgttgtcggacaaattcgcgagcacggtcaccgatgacggctggtcgttggatcttgccgccacgaaactgtcggcgaacccggtgccgaatctggcgacgacggcgttcacccgtgaggggttcgtgtcggcgaaggtgaccggcacgatcggtggtgcgggcgattcggcggtgaagaccggttatgtcgagcagggattgcagatcggctgccagatcgatgtttcctccggacttggcttggggcttggtttttcgctcggcccttctgtcggtgtgagtatttcgggtgtcccgtcggcgaacgtgggtgtgaatgcgtcggtgaatccgagtattcagtcgacgattgcgccgggcacgatcacgacgattccgttggggaagaaggatctcgagtcgtcgaaggcgtcgatcacggcagagaacgtgcacgtgaaggttgatgcgtgcatggggccggtgacgatccgctcgtatgcacaactctcggtgtcgacggcgacgtcggataacacgttgttcgtgtactccgatccgacctggctctag

SEQ ID NO: 1795 - DNA, 684 bp, Rhodococcus sp.
atggcaaccgaattgaaagcacgaacatctcgccgtcgatcgagggccgcggtagggctcgcggcgtgtgcggttgccgcgctgtcgtcgggtgtggtcttcgcagggagcgcatcggcaacgccgatggcgttggcggacaagttcgcgagcactgtcaccgatgacggttggtcgttggatcttgtcgccacgaaactgtcggcgaacccggtgccgaatctggcgacgacggcgttcactcgtgaggggttcgtgtcggcgaaggtgaccggcacgatcggtggtgcgggcgattcggcggtgaagaccggttatgtcgagcaggggttgcagatcggctgccagatcgatgtttcctccggacttggcttggggctcggtttttcgctcggcccgtctgtcggtgtgagtatttcgggtgtcccgtcggcgaacgtgggtgtgaatgcgtcggtgaatccgagtattcagtcgacgattgcgccgggcacgatcacgacgattccgttggggaagaaggatctcgagtcgtcgaaggcgtcgatcacggcagagaacgtgcacgtgaaggttgatgcgtgcatggggccggtgacgatccgctcgtacgcacaactctcggtgtcgacggcgacgtccgacaacacgttgttcgtgtactccgatcccacctggctctga

SEQ ID NO: 1796 - DNA, 699 bp, unknown
  environmental sample
atggccaccagcacacccgagaccacccgcgcattgacgggaaagcgccgaatcggcaagacgatgggtgcttgtgctgcggtttcgtcggcattgatggcaggctctgttgcctttgccggcggcgcgtcggcgaccccgacggcgctgccggacaagttcgcgagcacggtcaccgacgacggatggaccctcgacctggcagctaccaaactttcggcgaacccggtcccgaacctggcgacaacagcgttcacccgcgaggggttcgtgtcggcgaaggtcaccggcaccatctccggggccggcaattctgcggtgaagacgggctacgtcgagcagggattgcagatcggttgccaaatcgatgtgtcctccggcctcggcgtgggacttggtttttccctcggcccgtccgtcggggtcagcatttcgggggttccgtcggcgaacgtcggcgtgaacgcctcggtgaacccgagcatccagaccacgatcgcaccgggcacgatcaccacgatcccgctcggcaagaaggacctcgaggctgcgaaggcatcgatcacggcggagaacgtgcacgtcaaggtcgatgcgtgcatgggcccggtcacgatccgttcgtacgcgcagttcgctgtgtcgacggcgacgtcggataacagtgtgtttgtgtactccgatcccacctggctctga

SEQ ID NO: 1797 - DNA, 699 bp, unknown
  environmental sample
atggccaccaacaccgccgaaaccgtccgcacgttgagaggaaaacgccgcatcggaaaagccgtgggcacatgtgctgcggtgtcgtcggtattgatggcgagcgcactcgcgtttgccggtactgcgtcggcgaccccgacggcactgccggacaagtttgcaagcacggtcaccgatgacggctggaccctcgatctcgctgctaccaaactttcggcgaacccggttccgaatctggccacgacggcgttcacccgtgagggtttcgtgtcggcgaaggtcaccggcaccatctccggtgcgggcgatacggccgtcaagaccggatatatcgagcaggggttgcagatcggttgccaaatcgacgtgtcctccggactcggcctgggactcggattttccctcggcccgtcagtgggggtgtccatctccggggttccgtcggcgaacatcggcgtgaacgcctcggtgaacccgagcatccagacgacgattgcaccgggcacgatcacaacgatcccgctcgggaagaaggatctcgaagccgcgaaggcgtcgatcacggcggagaacgtgcacgtcaaggtcgatgcgtgcatgggtccggtcacgatccgctcctacgcacagtttgccgtctcgacggcgacgtcggacaacagtgtgttcgtgtactccgatccgacttggctctga

SEQ ID NO: 1798 - DNA, 693 bp, Bacillus sp.
atgaaacagattattgcgatgggcggcggaggtttttcaatggaaccagatcatctggttcttgatcaatttatcattaatcagtcaaagcagccctcacctcgcatttgttttttgccaacggcaagcggggatgcggagaactatgttcagcggttttaccatgcttttcaaaagtttgattgtgatccgtctcatttgtctttatttaagccgccgacaacagatttagcctcctttattatggagaaagatgtgatttatgtcggcgggggaaatacaagaaatttgctggtgctgtggaaggagtggggactggatcacatattgaaaaaagcttgggagaacgggattattttagcgggattaagtgcaggtgcgatctgctggtttgaagaaggtgtgacggattctgccggaccgctgaccggtttgaaaagcttgggttttttgcaaggcagtttttgtcctcattatgatggagaaaaggatcggagacctacatatcatcacatgatatcagagaaagcgttgagcagcggttatgcggcggatgatggagcagctcttcattttattgatgatcagttttttcaggctgtaagttcaagatctgatgcaaatgcgtatcaggtggtgcttcatgaaaatgaaatctctgaaatagcattgccgattacatatttgtcttga

SEQ ID NO: 1799 - DNA, 693 bp, Bacillus sp.
atgaagcagattattgcgatggggggcgggggtttttcgatggagccggataatttgtccctcgatcaatatatcctcaatcaatcaaaacgagagcagcctcgtatttgttttttgccgacggcgagcggagattcccaaaactatattcagcggttttatcatgcatttcaaacactggattgtgtgccgtctcatttatctttgtttaagccgccatcaacagatttagcttcttttgttatggaaatggacgtgatttatgttggcgggggaaatacgcggaatttacttgtgttatggaaagagtgggggctggaccatattctcagggaagcatggaagaacggtgtggtcctagctggattaagtgccggtgcgatctgctggtttgaagaaggggtgacagattcagccggaccgctgacaggtttgaaaagtttaggttttttgcaagggagcttttgtccccattatgacggggaaaaggatcggagaccggcataccaccagttgatatctaacaagttcttatgcagtggctatgcagcggatgatggggctgctctccatttcataaatgatcagctgtttcaaaccgtgagttcaagagcgggtgcaaaggcatatcgggtgataatgggggaacatgaagtatctgaaatcccgttgccggtcaaatatttgggatga

SEQ ID NO: 1800 - DNA, 696 bp, Bacillus sp.
atgatgaagcagattattgcgatggggggcgggggtttttcgatggagccggataatttgtccctcgatcaatatatcctcaatcaatcaaaacgagagcagcctcgtatttgttttttgccgacggcgagcggagattcccaaaactatattcagcggttttatcatgcatttcaaacactggattgtgtgccgtctcatttatctttgtttaagccgccaccatcagatttagcttcttttgttatggaaatggacgtgatttatgttggcgggggaaatacgcggaatttacttgtgttatggaaagagtgggggcttgaccagattctcagggaagcatggaagaacggtgtggttttagctggattaagtgccggtgcgatctgctggtttgaagaaggggtgacagattcagccggaccgctgacaagtttgaaaagtttaggttttttgcaagggagcttttgtccccattatgacggggaaaaggatcggagaccggcataccaccagctgatatctaacaagttcttatgcagtggctatgcagcggatgatggggctgctctccatttcataaatgatcagctgtttcagactgtgagttcaaggtcgggtgcaaaggcatatcgggtgatgatggctgaacatgaaatagctgaaatcccgttgccggtcaaatatttagggtga

SEQ ID NO: 1801 - DNA, 696 bp, Bacillus sp.
atgatgaagcagattattgcgatggggggcgggggtttttcgatggagccggataatttgtccctcgatcaatatatcctcaatcaatcaaaacgagagcagcctcgtatttgttttttgccgacggcgagcggagattcccaaaactatattcagcggttttatcatgcatttcaaacattggattgcgtgccgtctcatttatctttgtttaagccaccatcatcagatttagtttcttttgttatggaaatggacgtgatttatgttggcgggggaaatacgcggaatttacttgtgttatggaaagagtgggggctggaccatattctcagggaagcatggaagaacggtgtggttgtagctggaataagtgccggtgcgatctgctggtttgaagaaggggtgacagattcagccggaccgctgacaagtttgaaaagtttaggttttttgcaagggagcttttgtccccattatgacggggaaaaggatcggagaccggcataccaccagctgatatctaacaagttcttatgcagtggctatgcagcggatgatggggctgctctccatttcataaatgatcagctgtttcagactgtgagttcaaggtcgggtgcaaaggcatatcgggtgatgatggctgaacatgaaatagctgaaatcccgttgccggtcaaatatttagggtga

SEQ ID NO: 1802 - DNA, 702 bp, Bacillus sp.
atgaaacagattattgcgatgggaggcgggggtttttcgatggagccggaaaatttgtccctcgatcaatatatcctcaatcaatcggaacgggagtcacctcgtatttgttttttgccgaccgcgagtggagattcccaaaactatattcagcggtattatcatgcgtttcaaacaatggattgtgtgccgtctcatttatccttatttaagccgccgtcaacagatttaacttcttttattatggaaaaggacgtgatctatgttggcgggggaaatacgcgcaatatgcttgtgctatggaaggaatgggggctggactttattctcagagaggcatggaagaacggagtgattttagctggattaagtgcaggtgcgatatgctggtttgaagaaggtgtgacagattcggccgggccgctgacaagtatgaaaagtttaggttttttgcaagggagcttttgtcctcattatgacggggaaaaggatcggagaccggcataccaccagatgatagctaacgaattcttgtgcaatggctatgcggcggacgatggagcggctctccatttcataaatgatcagctgtttcagactgtgagttcaagatcggatgcaaaggcatatcgggtgatgagggatgaacatgggatatctgaaatctcgttgcctgtcacatatttgggttcaattagctga

SEQ ID NO: 1803 - DNA, 705 bp, Bacillus sp.
atgatgaaacagattattgcgatgggaggcgggggtttttcgatggagccggaaaatttgtccctcgatcaatatatcctcaatcaatcggaacgggagtcacctcgtatttgttttttgccgaccgcgagtggagattcccaaaactatattcagcggttttatcatgcgtttcaaacaatggattgtgtgccgtctcatttatccttatttaagccgccgtcaacagatttaacttcttttgttatggaaaaggacgtgatctatgttggcgggggaaatacgcgcaatatgcttgtgctgtggaaggaatgggggctggactttattctcagagaggcatggaagaacggagtgattttagctggattaagtgcaggtgcgatatgctggtttgaagaaggcgtgacagattcgaccgggccgctgacaagtatgaaaagtttaggttttttgcaagggagcttttgtcctcattatgacggggaaaaggatcggagaccggcataccacctgctgatagctaacgaatttttgtgcaatggctatgcggcggacgatggagcggctctccatttcataaatgatcagctgtttcagactgtgagttcaagatcggatgcaaaggcatatcgggtgatgagggatgaacatgggatatctgaaatcccgttgcccgtcacatatttggattcaattagctga

SEQ ID NO: 1804 - DNA, 696 bp, Bacillus sp.
gtgaaacaaattatagctatgggcggaggcggcttttcgatggagccggatcatctgctacttgatcaatatcttttggagcaaacgaaaaaatctgcaccgcgggtatgttttttgccgactgcgagcggtgattccgaaagctatattcagcggttttatcatgcatttcaaaagcttgagtgtatgccggaccacttatcgttgtttaaaccgccttcaacagatctggcttcatttatatgtgaacaggatattgtatacgtcggcggcggaaatacccgaaatttacttgtgctttggaaagaatggggattagatcatatattgcgtgaggcgtgggagagaggcgttattttatcaggattaagcgccggagccatttgctggtttaaagagggcgtgacggactcgatgaatggcccgttaacaggcctgaatggcttagggtttttacaagggagcttttgtcctcattatgatggagagaaggagaggagaccggcgtttcacaggcttatttcagaaaagtctttgagcgaaggctatgcagcggatgatggagcggccttgcactttataggaaatcaactgtttcaggttgtgagttcaagagctggcgcccaggcatatcgggtgacagtgcatgagaatgaaataactgaaatttcattgccggttcatgacttaagttga

SEQ ID NO: 1805 - DNA, 693 bp, Bacillus sp.
atgaaacagattattgcgatgggcggcggggggttttcgatggagccggaaaatttgtccctcgatcaatatatcatcaatcaatcagagcggaagtcgcctcgtatttgttttttaccgacggcgagtggtgactcccaaagctatgttcagcggttttatgatgcatttcaaacgcttgattgtgtgccgtctcatttatcgttgtttaagccgccgtcaacaaatttaacttcttttcttatggaaaaggacgtgatatatgtcggtgggggaaatacacggaatatgcttgtgttgtggaaggagtgggggctgaatcttattctcagggaagcatggaagaacggtgtggttttagctggattaagtgccggtgcgatctgctggtttgaagaaggggtgacagattcagccgggccgctgacaagtatgaaaagtttaggttttctgcaagggagcttttgtcctcattatgacggtgaaaaggatcggagaccgatataccatgagctgatatctaacgagtttttgtgcgatggctatgcggcggacgacggagcggctcttcatttcgtaaatgatcagcttgttcagaccgtaagttcaagaccgggtgcaaaggcatatcgggtgatgatgggtgaacatggaatatctgaaaccccgttgccggtcaaatctttgtgttga

SEQ ID NO: 1806 - DNA, 693 bp, Bacillus sp.
atgaaacagattattgcgatgggcggcgggggtttttcgatggaaccggacaatttgtctctcgatcaatatatcatcaatcaaacgaaacggaagtcacctcgcatttgttttttgccgacggcgagcggtgattcacaaaactatgtccagcggttttatcatgcatttcaaacaatggactgtgtaccgtctcatttatccttatgtaagccgctgtcaacagatatactttcttttgttatggaacaggacgtgatctatgttggcgggggaaatacgcggaatatgcttgtgctatggaaggagtgggggttggatcttattctcagagaggcgtggaagagcggtgtggttttagctggattaagtgccggtgcgatgtgctggtttgaagaaggggtgacggattcagccgggccgctgacaagtatgaaaagtttaggctttttgcatggaagcttttgtcctcattatgacagtgagaaggagcggcggccgatattccatcagctgatatgtaatggtttcttgggtgatggttatgcggcggatgatggagcggctctccattttataaatgatcagctgtttcagacagtgagctcaaggccgggtgcaaaggcatatcgggtgacggtggttgaacatgaaatctttgaaacccggctgccggtaaaatatctggggtga

SEQ ID NO: 1807 - DNA, 753 bp, Bacillus sp.
atgaagcagattattgcgatggggggcgggggtttttcgatggagccggataatttgtccctcgatcaatatatcctcaatcaatcaaaacgagagcagcctcgtatttgttttttgccgacggcgagcggagattcccaaaactatattcagcggttttatcatgcatttcaaacattggattgcgtgccgtctcatttatctttgtttaagccaccatcatcagatttagtttcttttgttatggaaatggacgtgatttatgttggcgggggaaatacgcggaatttacttgtgttatggaaagagtgggggctggaccatattctcagggaagcatggaagaacggtgtggttgtagctggaataagtgccggtgcgatctgctggtttgaagaaggggtgacagattcagccggaccgctgacaagtttgaaaagtttaggttttttgcaagggagcttttgtccccattatgacggggaaaaggatcggagaccggcataccaccagctgatatctaacaagttcttatgcagtggctatgcagcggatgatggggctgctctccatttcataaatgatcagctgtttcagactgtgagttcaaggtcgggtgcaaaggcatatcgggtgatgatggctgaacatgaaatagctgaaatcccgttgccggtcaaatattttagggtgaaattggctgaatattatctatattcctctttttttcagattgattttatgataagatga

SEQ ID NO: 1808 - DNA, 756 bp, Bacillus sp.
atgatgaagcagattattgcgatggcgggcggcggtttttcgatggagccggataatttgtccctcgatcaatatatcctcaatcaatcaaaacgagagcagcatcgtatttgttttttgccgacggcgagcggagattcccaaaactatattcagcggttttatcatgcatttcaaacattggattgcgtgccgtctcatttatctttgtttaagccaccatcatcagatttagtttcttttgttatggaaatggacgtgatttatgttggcgggggaaatacgcggaatttacttgtgttatggaaagagtgggggctggaccatattctcagggaagcatggaagaacggtgtggttgtagctggaataagtgccggtgcgatctgctggtttgaagaaggggtgacagattcagccggaccgctgacaagtttgaaaagtttaggttttttgcaagggagcttttgtccccattatgacggggaaaaggatcggagaccggcataccaccagctgatatctaacaagttcttatgcagtggctatgcagcggatgatggggctgctctccatttcataaatgatcagctgtttcagactgtgagttcaaggtcgggtgcaaaggcatatcgggtgatgatggctgaacatgaaatagctgaaatcccgttgccggtcaaatatgttagggtgaaattggctgaatattatctatattcctctttttttcagattgattttatgataagatga

SEQ ID NO: 1809 - DNA, 699 bp, Bacillus sp.
ttgaagcagattattgcaatgggcggcgggggcttttccatggagccggatcatcttgtgctggatcagtatattttagagcagtcggcgcggtcaaagccgaaaatttgttttttgccgacggcaagcggagattcggagaattatatcggcaggttttatcaggcctttcaaaagctgcggtgtgagccggatcacttgtcgctgtttaaaccgccgggttctgatctcagatcctttctcatgaagaaagatattatatatgtcggcggcggaaatacgcgcaatatgcttgtcttatggaaagagtgggggcttgaccttattcttcgtgaggcttgggaaaacggcatcatgttggcgggtctcagcgccggggcgatttgctggtatgaagaaggagtgacggattcagctggagatttgagagagttaagagctttaggatttttgcggggaagcttttgtccgcactatgacggagaagcggagcgccggccggtgtatcaccgtctgatttcagaaaagaaactcagggagggctatgccgctgatgacggcgctgcgcttcattataaagacggtcagctgttccgggctgtctcctcccgggaaaccgcaaagggttatcgggtttttaataccgaaaaaggcgttcgggaaacagagcttatgaccttaccgttatctgaattttga

SEQ ID NO: 1810 - DNA, 705 bp, Bacillus sp.
atgacattgaagcagattattgcaatgggcggcggggggttttccatggagcctgatcatcttgtgctggatcagtatattttagagcagtcggtgcggtcaaagccgaaagtttgttttttgccgacggcaagcggagattcggagaattatatcggcaggttttatcaggcctttcaaaagctgcggtgtgagccggatcacttatcgctgtttaaaccgccgggttctgatctcagatcctttctcatgaagaaagatattatatatgtcggaggcggaaatacgcgcaatatgcttgtcttatggaaagagtgggggcttgaccttattcttcgtgaggcttgggaaaacggcatcatgttggcgggtctcagcgccggggcgatttgctggtatgaagaagggttgacggattcagctggagatttgagagagttaagagctttaggatttttgccgggcagcttttgtccgtactatgacggagaagcggagcgccggccggtgtatcaccgtctgatttcagaaaagaaactcagggagggctacgccgctgatgacggcgctgcgcttcattataaagacggtcagctgttccgggctgtctcttcccgggaaaccgcaaagggttatcgggtttttaataccgaagaaggcgttcgggaaacagagcttatgactgtcccgttatctgaattttga

SEQ ID NO: 1811 - DNA, 1446 bp, Salinibacillus sp.
atgaaaaagaaattagcagcagggctgacagcatccgcgattgtcagcacaacactagcgattacacccgctgaagcagcaacgattaaagtcaaaagcggagattccttatggaagctggcgcaaaactacaacacaagtgtagcggccatcacatccgccaaccatctttcgactaccgtcctgtcaatcggccagacgcttaccatcccaggcagcaattccggcacttcatcatcttcttcaggctcaacagcaaagaagagcggaaattctgtttacacagtgaaaagcggcgattcactatggctgattgccaatgagtttaagatgtcggtacaggaactgaaaaagttaaacggattgagcagcgacatgattcgtgcagggcaaaaattaaaagtatccggaaaggtttcttcaaattccagttccggcacttcaagcagctctaaatcatctaaatcgagctcaagctcttcagcttcgactggcacttacaaagtgcagctaggtgattcgctttggaaaatcgcgaacaaagtcaatatgtccatcgctgaattaaaggtattgaacaatttaaaatcagataccatttatgtgaatcaagtgttaaaaacaaaatcagcgggttctaattcgtcatccaaaaacaattcatccaaatcgaatcaatcagcgtcagcaacaacgaagtacaccgtaaaaagcggagactcactttggaagatcgcaaacaaatataacctgactgtacagcaaatccgaaacagcaacaatctgaaatcagacgttctgtacgtcggacaagtgctgaagctgaccggcaaatcaagttccagcacatcaacaacaccgtcttcgtcaaattcaagctccggcacaacgacgactacatatacggtgaagagcggtgattccttatgggtgatcgctcaaaagttcaatgtgacagcccagcagatccgggagaaaaacaacttgaaaaacgatgtcttacaaatcggccagaagctcacgattacaggcaaagcttcatcttcaaattcaagttccggatcttcaggcagcacgatctcaacaagcgcgaagattaacaaaatgatcgcggccgctaaggatcaccttggtgttccatatcgctggggaggaacaacaccggccggatttgactgcagcggattcatttactatgcgctaaacaaagtgacttctgtgtccagattaacggcggctggctactggaacaccatgaaacctgtcagccagcctgcagtcggagactttgtcttcttttcgacatacaaagccggcccttctcatgtcgggatttacctcggaaacggggaattcattaatgccaacgactcaggggttgtcatttcaaatatgaacaactcatactggaaacagcgctacctcggagcaaagcgttatttctaa

SEQ ID NO: 1812 - DNA, 1446 bp, Salinibacillus sp.
atgaaaaagaaattagcagcagggctgacagcatccgcgattgtcagcacaacactagcgattacacccgctgaagcagcaacgattaaagtcaaaagcggagattccttatggaagctggcgcaaaactacaacacaagtgtagcggccatcacatccgccaaccatctttcgactaccgtcctgtcaatcggccagacgcttaccatcccaggcagcaattccggcacttcatcatcttcttcaggctcaacagcaaagaagagcggaaattctgtttacacagtgaaaagcggcgattcactatggctgattgccaatgagtttaagatgtcggtacaggaactgaaaaagttaaacggattgagcagcgacatgattcgtgcagggcaaaaattaaaagtatccggaaaggtttcttcaaattccagttccggcacttcaagcagctcaaaaccatctaaatcgagctcaagctcttcagcttcgactggcacttacaaagtgcagctaggtgattcgctttggaaaatcgcgaacaaagtcaatatgtccatcgctgaattaaaggtattgaacaatttaaaatcagataccatttatgtgaatcaagtgttaaaaacaaaatcagcgggttctaattcgtcatccaaaaacaattcatccaaatcgaatcaatcagcgtcagcaacaacgaagtacaccgtaaaaagcggagactcactttggaagatcgcaaacaaatataacctgactgtacagcaaatccgaaacagcaacaatctgaaatcagacgttctgtacgtcggacaagtgctaaagctgaccggcaaatcaagttccagcacatcaacaacaccgtcttcgtcaaattcaagctccggcacaacgacgactacatatacggtgaagagcggtgattccttatgggtgatcgctcaaaagttcaatgtgacagcccagcagatccgggagaaaaacaacttgaaaaacgatgtcttacaaatcggccagaagctcacgattacaggcaaagcttcatcttcaaattcaagttccggatcttcaggcagcacgatctcaacaagcgcgaagattaacaaaatgatcgcggccgctaaggagcaccttggtgttccatatcgctggggaggaacgacaccggccggatttgactgcagcggattcatttactatgcgctaaacaaagtgacatctgtgtccagattaacggcagccggctactggaacaccatgaaatctgtcagccagcctgcagtcggagactttgtcttcttttcgacatacaaagccggcccttctcatgtcgggatttacctcggaaacggggaattcattaatgccaacgactcaggggttgtcatttctaatatgaacaactcatactggaaacagcgctacctcggagcaaagcgttatttctaa

SEQ ID NO: 1813 - DNA, 1446 bp, Bacillus sp.
atgaaaaagaaattagcagcagggctgacagcatccgcgattgtcagcacaacactagcgattacacccgctgaagcagcaacgattaaagtcaaaagcggagattctttatggaagctggcgcaaaactacaacacaagtgtagcggccatcacatccgccaaccatctttcgactaccgtcctgtcaatcggccaaacgcttaccattccaggcagcaattccggcacttcatcttcttcttcaggctcaacagcaaagaagagcggaaattctgtttacacagtgaaaagcggcgattcactatggctgattgccaatgagtataagatgtcggtacaggaactgaaaaagttaaacggattgagcagcgacatgattcgtgcagggcaaaaattaaaagtatccggaaaggtttcttcaaattccagttccggcacttcaagcagctctaaatcatctaaatcgagctcaagctcttcagcttcgactggcacttacaaagtgcagctaggtgattcgctttggaaaatcgcgaacaaagtcaatatgtccatcgctgaattgaaggtattgaacaatttaaaatcagataccatttatgtgaatcaagtattaaaaacaaaatcagcgggttctaattcgtcatccaaagacaattcatccaaatcaaatcaatcagcatcagcaacaacgaagtacaccgtaaaaagcggagactcactttggaagatcgcaaacaaatataacctgactgtacagcaaatccgaaacagcaacaatctgaaatcagacgttctgtacgtcggacaagtgctgaagctgaccggcaaatcaacttccggcacatcaacaacaccgtcttcgtcaaattcaagctccggcacaacgacgactacatatacggtgaagagcggggattccttatgggtgatcgctcaaaagttcaatgtgacagcccagcagatccgggagaaaaacaacttgaaaaacgatgtcttacaaatcggccagaagctcacgattacaggcaaagcttcatcttcaaattcaagttccggatcttcaggcagcacgatctcaacaagcgcgaagattaacaaaatgatcgcggccgctaaggagcagcttggcgttccatatcgctggggaggaacgacaccggccggatttgactgcagcggattcatttactatgcgctaaacaaagtgacatctgtgtccagattaacggcggccggctactggaacaccatgaaatctgtcagccagcctgcagtcggagactttgtcttcttttcgacatacaaagccggcccttctcatgtcggaatttacctcggaaacggggaattcattaatgccaacgactcaggggttgtcatttcaaatatgaacaactcatactggaaacagcgctacctcggagcaaagcgttatttctaa

SEQ ID NO: 1814 - DNA, 1434 bp, Bacillus sp.
atgaaaaaaaaattagcagcagggctgacagcaaccgcgattgtcagctcaacattagcgattacacccgctgaagcagcaacgattaaagtcaaaagcggagattccttatggaagctggctcaaacctataacacaagtgtagcagccatttcatccgccaaccatctttcgacgaccgtcctgtcaattgggcagacgcttaccattccaggcagcaaatccgacacttcatcatcttcttcagggtcaaaaaagaagaacggaaatgctgtttacacagtgaaaaatggcgattcactatggctgattgccaatgagtataagatgtcggtacaagaactgaaaaagttaaacggtttgagcagcgatatgattcgtgcaggccagaaattaaaagtatccggaaaagtttcttcacattcaagttccggcacttcaagcagctccaaatcgagctcaagctcttcagctaagactggcacttacaaagtgcagcttggtgattcgctttggaaaatcgcaaacaaagtcaatatgtccatcgctgaattgaaggtactgaacaatttgaaatcagataccatttatgtgaatcaagtgttaaaaacaaaatcagcgggttctcattcgtcatccaaagacaattcatccaaatcgaatcaatcagcgtcagcaacaacgaagtacaccgtgaaaagcggagactcactttggaaaatcgcaaacaaatataacctgactgtacagcaaatccgaaacagcaacaatctgaaatcagacgttctgtacgttggacaagtgctaaagctgaccggcaaatcatcttccggcacatcaacatcaccgtcttcgtcaaattcaagctccggcaccacgacgactacatatacggtgaagagcggtgattccttatgggtgatcgctcaaaagttcaatgtgacagcccagcagattcgggagaaaaacaacttgaaaaccgatgttttacaaatcggccagaagctcacgattacaggcaaagcttcatccccttcttcgagttccggatcttcaggcagcaccatctcaaccagcgcgaagattaacaaaatgatcgcggccgctaaggagcagcttggcgttccatatcgctggggaggaacgacaccggccggatttgactgcagcggattcatttactatgcgctaaacaaagtcacatctgtgtccagattaacggcggccggctactggaataccatgaaatctgtcagccagcctgcagtcggagactttgtcttcttttcgacatacaaagccggtccttctcacgtcgggatttaccttggaaacggggaattcattaatgccaacgattccggggtcgtcatttcaaatatgaacaactcatactggaaacagcgctacctcggtgcaaagcgttatttctaa

SEQ ID NO: 1815 - DNA, 1440 bp, Bacillus sp.
atgaaaaagaaattagcagcagggctgacagcatctgcgattgtcagcacaactttagcagtggcaccagctgaggcagcaacgattaaggttaaaagcggagattctttatggaaactggcccaaaactacaatacaagtgtggcggctatcacatccgccaaccatctttcgactactgttctgtcgatcggccagacgcttaccattccaggcagcaattccagcacttcatctacttcaagctcaacaaccaagaagagcggaagttctgtttacacagtgaaaagcggagattcactttggctgatcgcaaatgagtataaaatgacggtgcaggaactgaaaaaattaaatggcctaagcagcgacatgattcgtgcggggcaaaaattaaaggtatccggtacggtttcctcaagctccagctctagtaccagtaaaaaaagcagttccaataagagctcaagctcttcatcttctaccggaacatataaggtgaagcttggagattcgctttggaaaattgcaaacaaagtcaatatgtccgtcgctgaattgaaggtcttgaacaacttaaaatcagacaccatttatgtgaatcaagtgttaaaaacaaaatctagcggttctaatacgtcttccaaagacacttcatctaattcgaaccaaacttcagcaacaacgaaatacactgtaaaaagcggagattcactttggaaaattgcaaacaactataacctgactgtacagcaaatccgaaacagcaacaatctgaaatcagacgtgctgtacgtcggacaagtgctgaagctgacaggcaaagcatcttcaggttcttcttcatcgtcatcttcgtcaaatgcaagctccggcacgacgacgactacatacacggtgaaaagcggcgattccttgtgggtgattgctcaaaagtttaatgtaacagctcagcagattcgggagaaaaacaatttaaaaacggatgtcttgcaggttggccaaaagctggtcattaccggaaaagcctcatcttcatcctctgcttcatccgggtcatcaagcactaccagctcttcaagcgcgaaaatcaacactatgattgccgccgctaaagagcagcttggggttccgtatcgctggggaggcacgacacccgccggatttgactgcagcggtttcatttactatgcactgaacaaagtcacatccgtatcaagattaacggcagccggatattggaacacaatgaaatctgtcagccagcctgctgtcggagacttcgttttctttacaacatataaagcaggcccttcccacgtcggaatttatcttggaaacggggagttcattaatgccaatgattccggagttgtcatttccagtatgaacaactcttactggaaacagcgctatctcggagcaaaacgatatttctaa

SEQ ID NO: 1816 - DNA, 1467 bp, Bacillus sp.
atgaaaaagaaattagcagcagggctgacagcatctgcgattgtcggcacaactttagtagtgacaccagctgaagcagcaacgattaaggtcaaaagcggagattctttatggaaactggcccaaacctataacacaagtgtggcggccctcacatccgccaatcatctttcgactactgttctgtcgatcggccagacgcttactattccaggcagcaaatccagcacttcttcatctacttcaagctcaacaaccaagaagagcggaagttctgtttacacagtgaaaagcggagattcactttggctgatcgcaaatgagtttaaaatgacggtgcaggaactgaaaaaattaaacggactaagcagcgatttaattcgtgctgggcagaaattaaaggtgtccggtactgtttcttcaagctctagttccagtaaaaaaagcaactctaataagagttcaagctccagttcaaaaagcagttctaataagagttcaagttcttcatcttctacgggaacatataaggtgcagcttggagattcactttggaaaattgcaaacaaagtcaatatgtccatcgctgaattgaaggtcttgaacaacttaaaatcagacaccatttacgtgaatcaggtgttgaaaacaaaatcaagcggctctgatacgtcttctaaagacaattcatccaaatcgaaccaaacttcagcaacaactaaatataccgttaaaagcggtgattcactttggaaaatcgcaaacaactataacctgactgtacagcaaatccgaaatatcaacaatctgaaatcagatgtgctttacgttggacaagtattgaagctgacaggtaaagcatcttcaggctcttcatcatcgtcgtcttcttcgtcaaatgcaagctccggcacgacgactacatacacggtgaaaagcggtgattccttatgggtgattgctcaaaaatttaatgtaacagctcagcagattcgtgagaaaaacaatttaaaaacggatgtcttgcaggttggccaaaagctggtcatttccggaaaagcttcatcatcgtcttcatccggttcttcaaacaccaccagctcaacgagtgcgaagattaacacaatgatttcggccgctaaagcgcagcttggggttccgtatcgctggggaggcacgacaccgtccgggtttgactgcagcggattcatttactatgtactgaacaaagtcacatccgtatctagattaacggcagcgggatattggaacacaatgaaatcagttagccagcctgctgtcggagatttcgttttcttttcaacatataaagccggcccttcccacgtcggaatttacctaggcaacggggaattcataaatgccaacgattccggagttgtcatttccaatatgaacaactcttactggaaacagcgctatctcggtgcaaaacgatatttctaa

SEQ ID NO: 1817 - DNA, 1467 bp, Bacillus sp.
atgaaaaagaaattagcagcagggctgacagcatctgcgattgtcggcacaactttagcagtaacaccagctgaagcagcaacgattaaggtcaaaagcggagattctttatggaaactggcccaaacctataacacaagtgtggcggccctcacatccgccaaccatctttcgactactgttctgtcgatcggccagacgcttaccattcctggcagcaattccggcacttcatctacttcaagctcaacaaccaagaagagcggaagttctgtttacactgtgaaaagcggcgattcactttggctgatcgcaaatgagtataaaatgacggtgcaggaactgaagaaattaaacggactaagcagcgatttgattcgtgcggggcagaaattaaaggtgtccggcacagtttcttcaagctctagttccagtacaaaaagcaactctaataagagctcaagctccagttcaaaaagcagttctaataagagctcaagttcttcatctgctacgggaacatataaggtgcagcttggagattcactttggaaaattgcaaacaaagtcaatatgtccatcgctgaattgaaggtcttgaacaacttaaaatcagacaccatttacgtgaatcaggtgttgaaaacaaaatcaagcggctctgatacgtcttccaaagacacttcatccaaaccgaaccaaaattcggcaacaacgaaatatactgtaaaaagcggtgattcactttggaaaatcgcaaacaactataacctgactgtacagcaaatccgaaatgtcaacaatctgaaatcagatgtgctttatgttggacaagtactgaagctgacaggtaaagcatcttcaggcacttcatcatcgtcgtcttcttcgtcaaatgcaagctcaggcacgacgactacatacacggtgataagcggtgattccttgtgggtgattgctcagaaatttaatgtaacagctcagcagatccgggagaaaaacaatttaaaaacggatgtcttgcaggttggccaaaagctggtcattaccggaaaagcatcatcatcgtcgtcttcatccggttcttcaaacaccaccatctcaacgagcgcgaagattaacacaatgattgccgccgctaaagagcagattggggttccgtatcgatggggaggcacgacaccgtccggatttgactgcagcggattcatttactatgtactgaacaaagtcacatccgtatctagattaacggcagctggatattggaacacaatgaagcccgtcagccagcctgctgtcggagatttcgttttctttacaacatataaagccggcccttcccacgttggagtttacctaggaaacggggaattcataaatgccaacgattccggagttgtcatttccaatatgaacaactcttactggaaacagcgctatctcggtgcaaaacgatatttctaa

SEQ ID NO: 1818 - DNA, 1497 bp, Bacillus sp.
atgaaaaagaaattagcagcagggctgacagcatctgcgattgtcggcacaactttagtagtgacaccagctgaagcagcaacgattaaggtcaaaagcggagattctttatggaaactggcccaaacctataacacaagtgtggcggccctcacatccgccaatcatctttcgactactgttctgtcgatcggccagacgcttactattccaggcagcaaatccagcacttcttcatctacttcaagctcaacaaccaagaagagcggaagttctgtttacacagtgaaaagcggagattcactttggctgatcgcaaatgagtttaaaatgacggtgcaggaactgaaaaaattaaacggactaagcagcgatttaattcgtgctgggcagaaattaaaggtgtccggtactgtttcttcaagttccagtacaaaaagcagttccaataagagttcaagctcaagttcaaaaagcagttccaataagagttcaagctcaagttcaaaaagcagttctaataagagttcaagttcttcatcttctacgggaacatataaggtgcagcttggagattcactttggaaaattgcaaacaaagtcaatatgtccatcgctgaattgaaggtcttgaacaacttaaaatcagacaccatttacgtgaatcaggtgttgaaaacaaaatcaagcggctctgatacgtcttctaaagacaattcatccaaatcgaaccaaacttcagcaacaactaaatataccgttaaaagcggtgattcactttggaaaatcgcaaacaactataacctgactgtacagcaaatccgaaatatcaacaatctgaaatcagatgtgctttacgttggacaagtattgaagctgacaggtaaagcatcttcaggctcttcatcatcgtcgtcttcttcgtcaaatgcaagctccggcacgacgactacatacacggtgaaaagcggtgattccttatgggtgattgcacaaaaatttaatgtaacagctcagcagattcgtgagaaaaacaatttaaaaacggatgtcttgcaggttggccaaaagctggtcatttccggaaaagcttcatcatcgtcttcatccggttcttcaaacaccaccagctcaacgagtgcgaagattaacacaatgatttcggccgctaaagcgcagcttggggttccgtatcgctggggaggcacgacaccgtccgggtttgactgcagcggattcatttattatgtactgaacaaagtcacatccgtatctagattaacggcagcgggatattggaacacaatgaaatcagttagccagcctgctgtcggagatttcgttttctttacaacatataaagccggcccttcccacgtcggaatttacctaggcaacggggaattcataaatgccaacgattccggagttgtcatttccaatatgaataactcttactggaaacagcgctatctcggtgcaaaacgatatttctaa

SEQ ID NO: 1819 - DNA, 1452 bp, Bacillus sp.
atgaaaaagaaattagcagcagggctgacagcatctgcgattgtcagtacaactttagcagtgacaccagctgatgcagcaacgattaaggtcaaaagcggagattctttatggaaactggcacaaacctataacacaagtgtggcggccctcacatccgccaaccatctgtcatctactgttctgtcgatcggccagacgctgaccattccgggcagcaattccggcacttcatctacttcaagctcaacaacgaagaagagcggaagttctgtttacacagtcaaaagcggcgattcgctttggctgatcgcaaatgagtttaaaatgacggtgcaggaactaaaaaaagtaaacggactaagcagcaacatgattcgtgcgggacagaaattaaaggtgtccggtacagtttcctcaagttccagctctagtccaagcactagttccagtaaaaaaagcagttccaataagagctcaagctcttcatcttctgccggaacctataaagtgcagcttggagattcactttggaaaattgcaaacaaggtcagtatgtctgtcgctgaattgaaggtcttgaacaacttaaaatcagacaccatttatgtgaatcaagtgttaaaaacaaaatcaactggttctgatacgtcttccaaagacactcaatctcattcggacaaaccttcaccaacaacgacatacaaggtgaaaagcggcgattcgctttggaaaattgcaaacagctataacctgaccgtacagcaaatccgaaacagcaacaatttgaaatcagacatgctgtacgtcggacaagtgctgaagctgacaggcaaagcatcttcaggctcttcttcatcatcgtcttcttcgtcaaatgcgagctctggcacgacgactacatatacggtgaaaagcggcgattccttgtgggtgattgctcaaaagtataatgtgacagctcagcagattcgggagaaaaacaatttaaaaacggatgtcttacggattggccaaaagctggtcattgccggaaaagctttatcttcaggctcttcttcatccggttctacaagcacgtccagctcacctagcgctaaaattaacaaaatgatcgcagccgctaaggagcagcttggagttccgtatcgctggggtggaacgactccgaacggatttgactgcagcggttttatgtactatgcactgaacaaagtcacatccgtatcaagactaacagccgccggatattggaacacaatgaaatcggtcagccagccagctgtcggtgacttcgttttctttacaacctataaagcaggcccttcccacgtcggaatttatcttggaaacgggcaattcattaatgccaatgattccggcgttgtgatttccaatatgaacaactcttactggaaacagcgctatctcggtgcaaaacgttatttctaa

SEQ ID NO: 1820 - DNA, 1279 bp, Bacillus sp.
atccgccaaccatctttcgacgaccgtcctgtcaattgggcagacgcttaccattccaggcagcaaatccgacacttcatcatcttcttcagggtcaaaaaagaagaacggaaatgctgtttacacagtgaaaaatggcgattcactatggctgattgccaatgagtataagatgtcggtacaagaactgaaaaagttaaacggtttgagcagcgatatgattcgtgcaggccagaaattaaaagtatccggaaaagtttcttcacattcaagttccggcacttcaagcagctccaaatcgagctcaagctcttcagctaagactggcacttacaaagtgcagcttggtgattcgctttggaaaatcgcaaacaaagtcaatatgtccatcgctgaattgaaggtactgaacaatttgaaatcagataccatttatgtgaatcaagtgttaaaaacaaaatcagcgggttctcattcgtcatccaaagacaattcatccaaatcgaatcaatcagcgtcagcaacaacgaagtacaccgtgaaaagcggagactcactttggaaaatcgcaaacaaatataacctgactgtacagcaaatccgaaacagcaacaatctgaaatcagacgttctgtacgttggacaagtgctaaagctgaccggcaaatcatcttccggcacatcaacatcaccgtcttcgtcaaattcaagctccggcaccacgacgactacatatacggtgaagagcggtgattccttatgggtgatcgctcaaaagttcaatgtgacagcccagcagattcgggagaaaaacaacttgaaaaccgatgttttacaaatcggccagaagctcacgattacaggcaaagcttcatccccttcttcgagttccggatcttcaggcagcaccatctcaaccagcgcgaagattaacaaaatgatcgcggccgctaaggagcagcttggcgttccatatcgctggggaggaacgacaccggccggatttgactgcagcggattcatttactatgcgctaaacaaagtcacatctgtgtccagattaacggcggccggctactggaataccatgaaatctgtcagccagcctgcagtcggagactttgtcttcttttcgacatacaaagccggtccttctcacgtcgggatttaccttggaaacggggaattcattaatgccaacgattccggggtcgtcatttcaaatatgaacaactcatactggaaacagcgctacctcggtgcaaagcgttatttctaa

SEQ ID NO: 1821 - DNA, 1410 bp, Bacillus sp.
atgaaaaagaaactagcggcagggttaacagcatccgcgatcgtaggcacaacctttgctgtaacaccggcagaggcacaaaccattaaggtaaaaagcggtgattctttatggaaacttgctcaaaactacaatacaaccattgacaaaattaagtctgcaaatcatctgaagagcacggtgctgtcgatcggacaaacactcgacattccaaacggaaaatcaagttcatctacctcttcatcatcagccaagagcggaaaatctgtgtacacagtcaaaaacggcgattcactttggctgattgcaagcgattttaaaatgtctgttcaggaacttaaaaaactaaacgggctcagcagcgatctcattcgtgcaggacaaaaattaaaggtttcaggaaccgtttccaattccaaatcaagcacaaacaaatcgtcccagagcaacaaaaaaacgtcagcttcaggcacttatacggttcagctcggcgattcactttggaaaatcgcaaacaaagtcaatatgtctatcggcgaattaaaggttttgaacaatttaaaatcagataccatttatgtgaagcaagtattaaaaataaaaggaacggcttctgataaaacaagttccaactcaaacagttcatcaaagacgaagccgtcatcatcaactaaatacatagtcaaaagcggagactctctctggaaaatcgccaatcagcataatgtctccgttcagcaaatcagaaacagcaacaatttaaaatcagatgtgctgcaagtcggacaagtattgcagctttcaggcacatcatcgaattcttcaacttcaccgtcgaagaataccggttcagggaagacaacggtttatactgtgaaaagcggcgactctctatgggtgatcgcgcaaaagtacaatgtgaccgcccagcagatccgcgataaaaacaatctaaaaacagatgtgctgcaagtcggccagaaattaacgatttcaggcacggcttccactccttctacatcttcgccttcaacaagcacaggctcaagaagcacgaagattaaccaaatgattgcggctgccaaacaacaattaggagtgccttaccgctggggcggcacaacgccttcaggttttgactgcagcggctttatctattatgcactaaataaagtcacttctgtctccaggttaacagcggccggttattggaatgtcatgaaatcggtcagccagcctgcagtcggcgactttgtctttttcacaacgtatgcagcgggcccttctcatgtcggcatttatctcggaaatggcgaatttattaatgccaacgattcaggcgtcgtcatctcaaagatgagcaattcctattggaaacagcgctacctcggagcaaaacgttatttataa

SEQ ID NO: 1822 - DNA, 1458 bp, Bacillus sp.
atgaaaaaaaaggtagcggtcggtttgactgcatctgcgatcgtcgggtctgcgttagctgtaacaccggcagaagcacaaacgattaaggttaaaagcggagattcattatggaagcttgcccaaaactacaatacaagcgtggatgccattacatcagccaatcatctaaaatccaccgttatttccatcgggcagacgctcaccatccctaacggcaaatcagattccggcagcaaaaagccatcttcaaagaacagcggcaagacgacaagtgtgtatacggtgaaaagcggagactcgctgtggctgatcgcgtctgattttaaaatgtccgtacaggaactgaaaaaactgaacggtctgacaagcgacttaatccgcgcaggacagaagctgcaagtgaaggggaaagtttcctcaagcaccgacaagacaaaaaccgtgccgggcagcagctcaaacagcagtaaaaatcagtcatcttcatcttccgggacatataaagtcaaactcggcgattcgctctggaagatcgcaaacagcgttcatatgtccattgcggaacttaaagtattaaacaacttaaaaacggatacgatttacgtaaaccaggttctgaaaataaaaggaacatctccttcgggaaacaagccgtcaaaagacaattcaaacaaaaatcaaaaccagacgcaaacatcatcttatacagtaaaaagcggagactcgctctggaagatcgcaaacgcatacaatatgacggttcagcaaatcagaagcatcaataaactgacgtcagacatgctgcgggtcggacaagtgctgaagctgacaaaaacgtcatcttccggctcttcgtcttcaccgtcatctccgaaccagtccggagatacagggaaaaccactacatataccgtcaaaagcggggattctttatgggtgatcgcccaaaaattcaatgtaaccgcccagcagatccgcgagaaaaacaatctgaaaacagatgtgcttcaaatcggacagaagctgacgattacaggacagcagtcaaacacgacaccgaatcagtccggcagcacaggcggcacaggttcaacaagcgcgaagattaatgtaatgatcgatgccgcaaaagctcagctgggtgtaccgtatgtatggggcgggacaacgccgagaggctttgactgcagcggttttatttattacgttcttaataaggtcacttccgtatccagactttcagccgcaggctactggaatacgatgacatcagtcagccagccggcggtcggtgactttgtctttttctcaacttataaagccggaccttctcacgtcggcatttatctcggaaacggacagtttattaatgccaacgattcgggtgtcgtcatctccagcatgaacaattcctattggaaacagcgctacctcggagcgaaacgattcttctga

SEQ ID NO: 1823 - DNA, 1455 bp, Bacillus sp.
atgaaaaaaaaggtagcggtcggtttgactgcatctgcgatcgtcgggtctgcgttagctgtaacaccggcagaagcacaaacgattaaggttaaaagcggagattcattatggaagcttgcccaaaactacaatacaagcgtggatgccattacatcagcgaatcatctaaaatccaccgttatttctatcgggcagacgctcaacattcctaacggcaaatcagattccggcagcaaaaagccatcttcaaagaacagcggcacgactaaaagtgtctatacagtgaaaagcggcgactcgctgtggctgatcgcatctgattttaaaatgtccgtacaggaactgaaaaaattgaacggtctgacaagcgacttaatccgcgccggacagaagctgcaagtgacggggaaagtttcctcaagcaccgatcagaaaaaaaccgctcctggcagcagctcaaacaacagcaaaaagcagtcatcatcttccgggacgtataaagtcaaactcggcgattcactatggaagatcgcaaacagcgtcaatatgaccattgcggaactcaaagtattaaacaacttaaaaacggatacgatctacgtaaaccaagtcctgaaaacaaaaggaacgtcttcttcgggaaacacgccgtcaaaggacaattcaaaccaaaataaaaaccagacgcaaacgtcctcctatacagtaaaaagcggagactcactctggaaaatcgcaaacgcatacaacatgacggttcagcaaatcagaagcatcaacaaactgacgtcagacatgcttcgggtcggacaagtgcttaagctgaccaaaacgtcatcttccggctcttcgtcttcaccgtcaactccgaaccagtccggagatacagggaaaaccactacatataccgtgaaaagcggggattctttatgggtgattgcccaaaagttcaatgtgaccgcccagcagatccgcgagaaaaacaatctgaaaacagatgttcttcaaatcggacaaaagctgacgattaccgggcagcagacaaacacaacaccgaatcagtccggcaacacaggcggcacaggttcaacaagcgcgaagattaatgtaatgatcgatgccgcaaaagctcagctgggcgtaccgtatgtatggggcgggacgacgccgagaggctttgactgcagcggtttcatttattacgttctcaataaggtcacttctgtatccagactttcagccgcaggctactggaatacgatgacatcagtcagccagccggcggtcggtgactttgtctttttctcaacttataaagccggaccttcccacgtcggtatttatctcgggaacggccagtttattaatgccaacgattcgggtgtcgttatttccagcatgaacaattcctattggaaacagcgttacctcggcgcaaaacgtttcttctga

SEQ ID NO: 1824 - DNA, 1929 bp, Salinibacillus sp.
atgaaacctgtcatttcgcttatcctttccaccgtcctttttctttcatgttttctcggcgtcagtcagacagctgaagcaaaaccccgcagctcagatgatgccaaacagatcgttgatcgtatgacgttagatgaaaaaattggccagatgctgatgccggatttcagaaactggaaaaaagaaggtgagtcttctccgcaagccttcacaaaaatgaatgaggaagtcgctggcctcatcaagaaatatcaattcggcggcgtcatactatttgcagaaaatgtaaaaacaactgagcaaacggtacggctgacagacgcatatcaaaaggccagccccaagattccgctcttactcagcattgatcaagaaggcgggatcgtgacgagattaggggagggcactaatttcccaggcaatatggcgcttggcgcaacaagaagcagaatcaatgcatatcagaccggcagcatgattggaaaagagctttctgtcttaggcatcaatacagatttcagcccagtcttggacattaataataaccctgataatcccgtgatcggtgtgagatcattcagttctgatcgtgaactgacagcacgactcggtttatattctatgaaaggtttgcaacggcaaaatattgcctctgctcttaaacatttcccgggacatggagacactgacgttgacagccattatggactgccgctcgtttctcataaccaggaacggcttcgtgaggttgaactctatccttttcaaaaagcgattgatgccggagcagatatggtgatgacagctcatgttcaattcccagcctttgacgacaccacatataaaagcaagtttgatggatcagatattatggttcccgctacactttcaaagaaagtaatgaccgggctgcttcgggaggaaatgggatttggcggtgtaatcgtcactgatgctctcaatatgaaagctatagcagatcatttcggtcaggaagaggcggtcgtcatggccataaaggccggtgttgatatcgcgctaatgcctgcctcagttacatcgttgaaagatgaacaaaaattggcaagcgtaattgactccttaaaagaagctgttaaaaatggagacattcccttacagcaaatcaacaaatcggtggaaagaatcatttccctgaaaataaagcgcggtatttaccccgctcattatgacagcagcatagataaaaaggtgaagaaagcgctcaaaacagtgggaagcaaacaccatacaaagacagagcaaaaaatcgctgaaaaggcagtgacagtattaaaaaatgatcagcataccttgccgttcaaacccaaaaaaggcagccgaattttaattgccgcaccttacgaggaacaaacagcatccattgaaaaaaccattcacgatttaatgcagcggaaaaaaatcaaatctgtttctcttaacaaaatgaactttgcagaaaaggtatttaatgctgagcatgaaaaacaagtaaaagaagctgattatattattacaggctcttacgttgtaaaaaatgaccctgtcgtcaacgacggtgtcatcgacgacaccgtaacagattcaagcaaatgggccaccgcttttccgagagctgtcatgaatgccgcactgcagcacaaaaagcagtttgtcttaatgagtctgcgcaatccatatgatgccgccaatttcgaagaagcaagagctttgattgccgtctatggttttaaagggtatgcaaacgggcgttatctccagccgaatattccggccggcgttaaagcaatcttcggacaatcaaagccaaagggcacgctgccagtcgacattccatccgtcacaaaaccgggagacatcctttatccatttggctatggagtaaacatcaaaacgggaaaaccgctttaa

SEQ ID NO: 1825 - DNA, 1929 bp, Bacillus sp.
atgaaacctgtcatttcgcttatcctttccaccgtcctttttctttcatgttttctcggtgtcagtcagacagctgaagcaaaaccccgcagctcagatgatgccaagcagatcgttgatcgtatgacgttagatgaaaaacttggccagatgctgatgccggatttcagaaactggaaaaaggaaggtgagtcttctccgcaagccttcacaaaaatgaatgaggaagtcgctggcctcatcaagaaatatcaattcggcggcgtcatactatttgcagaaaatgtaaaaacaactgaacaaacggtacggctgacagacgcatatcaaaaggccagccctaagattccgctcttactcagcattgatcaagaaggcgggatcgtgacgagattaggggagggcactaatttcccaggcaatatggcgcttggcgcaacaagaagcagaatcaatgcatatcagaccggcagcatgattggaaaagagctttctgtcttaggcatcaatacagatttcagcccagtcttggacattaataataaccctgataatcccgtgatcggtgtgagatcattcagttctgatcgtgaactgacagcacgactcggtttatattctatgaaaggtttgcaacggcaacatatcgcctctgctcttaaacatttcccgggacatggagacactgacgttgacagccattatggactgccgctcgtttctcataaccaggaacggcttcgtgaggttgaactctatccttttcaaaaagcgattgatgccggagcagatatggtgatgacagctcatgttcaattcccagcctttgatgacaccacatataaaagcaagcttgatggatcagatattatggttcccgctacactttcaaagaaagtaatgaccgggctgcttcgggaggaaatgggatttggcggtgtaatcgtcactgatgctctcaatatgaaagccatagcagatcatttcggtcaggaagaggcggtcgtcatggccataaaggccggtgttgatatcgcgttaatgcctgcctcagttacatctttaaaagatgaacaaaaattggcaagcgtgattaactccttaaaagaagctgttaaaaatggagacattcccttacagcaaatcaacaaatcggtggaaagaatcatttccctgaaaataaagcgcggtatttaccccgctcagcatgacagcaacatagataaaaaggtgaagaaagcactcaaaacagtgggaagcaaacaccatacgaagacagagcaaaaaatcgctgaaaaggcagtgacagtattaaaaaatgatcagcataccttgccgttcaaaccaaaaaaaggcagccgaatcttaattgccgcaccttacgaggaacaaacagcatccattgaaaaaaccattcacgatttagtggagcgaaaaaaaatcaaatctgtttctcttaacaaaatcaactttgcagaaaaggtatttaatgctgagcatgaaaaacaagtaaaagaagctgattatattattacaggctcttacgttgtaaaaaatgaccctgtcgtcaacgacggtgtcatcgacgacacggtaacagattcaagcaaatgggccaccgcttttccgagagctgtcatgaatgccgcactgcagcacaaaaagcaatttgtcttaatgagtctgcgcaatccatatgatgccgccaatttcgaagaagcaagtgctttgattgccgtctatggttttaaaggatatgcaaacgggcgttatcttcagccgaatattccggccggcgttaaagcgatcttcggacaatcaaagccaaagggcacgctgccagtcgacattccatccgtcacaaaaccgggagacatcctttatccatttggctatggagtaaacatcaaaatgggaaaaccgctttaa

SEQ ID NO: 1826 - DNA, 1929 bp, Bacillus sp.
atgaaacctgtcatttcgctgatcctttccaccgtcctttttctttcatgtgttctcggcgtcaatcagacagctaaagcgaaaccccgcggctcagctgacgccaaacagatcgttgatcatatgacgttagatgaaaaacttggccagatgctgatgccggatttcagaaactggcaaaaggaaggtgagtcttctccgaaagccttcacagaaatgaatgaggaagtcgctggcctcatcaagaaatatcaattcggcggcgtcatactatttgcagaaaatgtaaaaacaaccgagcaaacggtacggctgacagacgcatatcaaaaggctggccctaagattccgctcttactcagcattgatcaagaaggcgggatcgtgacgagattaggggagggcactcatttcccaggcaatatggcgcttggcgcaacaagaagcagaatcaatgcatatcagaccggcagcatgattggaaaagagctttctgtcttaggcatcaatacagatttcagcccagtcttagatattaataataaccctgataatcctgtgatcggtgtaagatcattcagttctgatcgtgaactgacagcacgacttggtctatattctatgaaaggtttgcaacggcaacatatcgcctctgctcttaaacatttcccgggacatggcgacactgacgttgacagccattatggactgccgctcgtttctcatagccaggaacggcttcgtgaggttgaactctatccttttcaaaaagcgattgatgcaggagcagacatggtgatgacagctcatgttcaattcccagcctttgacgacaccacatataaaagcaagcttgacggatcagatattatggttcccgctacactttcaaagaaagtaatgaccgggctgcttcgggaggaaatggggtttggcggtgtaatcgtcactgatgctctcaatatgaaagccatagcagatcatttcggccaggaagaggcggtcgtcatggccataaaggccggtgttgatattgcgttaatgcctgcctcagttacatctctgaaaaatgaacataaatttgcaagcataattggctccttaaaagaagctgtcgagaaaggggacattcccttacagcaaatcaacaaatcggtggaaagaatcatttccctgaaaataaaacgcggtatttaccccgctcagaatgacagcagtatagataaaaaggtgaagaaagcgctcaaaacagtgggaagcaaacaccatacgaagacagagcaaaaaattgctgaaaaggcagtgacagtattaaaaaatgatcagcataccttgccgttcaaacccaaaaaaggcagccgaatcttaattgccgcaccttacgaggaacaatcagcatccattgaaaaaaccattcacgatttaatgcagcgaaaaaaaatcaattctgtttctcttaacaaaatcaactttgcagaaaaggtatttaatgctgagtatgaaaaacaagtaaaagaagctgattatatcattacaggctcttacgttgtaaaaaatgaccctgtcgtcaacgacggtgtcatcgacgacacggtaacagattcaagcaaatgggccaccgcttttccgagagctgtcatgaatgccgcactgcagcacaaaaagcaatttgtcttaatgagtctgcggaatccatatgatgccgccaatttcgaagaagccagagccctgattgccgtctatggttttaaaggatatgcaaacggccgttatcttcagccgaatattccggccggggttaaagcgatcttcggacaatcaaagccaaagggcacgctgccagtcgacattccttccgtcacaaaaccaggagacatcctttatccatatggctatggagtaaacatcaaaacgggaaaaccgctttaa

SEQ ID NO: 1827 - DNA, 1929 bp, Bacillus sp.
atgaaacctgtatttccgcttatcctttcagccgttctctttttttcatgttttcttggcgccagtcagacaaaagctgcttcatccagcggctcagctgacgccaagcagattgtcaatcgcatgacgttagatgaaaaactcggccagatgctgatgcctgatttcagaaattggcaaaaggagggcgagtcttctccgcaagccttcacagaaatgaatgaggaagtcgcaggccttatcaagaagtatcaattcggcggcgtcatcctttttgcagaaaatgtaaaaacaacacagcaaactgtacagcttactgacgcttaccaaaaggcgagccccaaaattccgctcatgctgagtattgatcaggaaggcggtatcgtaacgagattaggggagggcactaatttcccagggaatatggcgctgggcgcagctagaagcagaatcaacgcctatcagaccggcaccattattggaaaggagctctctgccttaggcattaatacggatttcagccccgtcatggacattaataataatcctgataatccggtaatcggcgtacggtcattcagctctaatcgagaactgacagcacgactcggtttatatacgatgaaaggtttgcagcggcaagatatcgcctctgccctcaaacatttcccgggacatggagacacggacgttgacagccattacggactgccgctcgtttcccatagccaagaacggcttcgtgaggtcgagctctatccttttcaaagagcaattgatgccggtgctgatatggtgatgacagctcacgttcaatttcctgcctttgacgacaccacatacaaaagcaaactcgatggatcggacattttggtgcctgctacactctcgaaaaaagtgatgacaggtcttcttcgtcaggaaatgggctttaatggcgtcatcgttactgacgctctcaatatgaaagcaatcgcagatcatttcggacaggaagaggctgttgtcatggctataaaagccggtgtcgatattgcattaatgcctgcctcagttacttctctgaaagaagaacagaaatacgcacgtgttattcaagctttagaagaagccgtaaaaaacggagacattccggaacatcaaatcaacaaatcggttgaaagaatcatttccctgaaaataaaacgcggtatgtatccagctcgaaacgacgacagcataaaagaaaaaatagacaaagcccagaaaatcgtaggaagcaagcatcacctgaaagcggagaaaaaaatagctgaaaaagcagtgaccgtattaaaaaatgaacagcacaccttgccgttcaagcctaaaaaagacagccggatcttaattgtcgcgccttacgaagaacaaacggcttcgattgaacaaaccattcgcgatctcgtcaaacgaaagaaaatcaaacccgtgtccctcagcaaaatgaattttgccaaccaagtatttaatgccgagcatgaaaaacaagtaaaagaggctgattatatcataaccggctcctatgtcgtgaaaaatgaccctgtcgtcaacgacggtgtcatcgacgacaccatatcagattcaagcaaatgggccaccgtatttccgagagctgtgatgaaagccacactgcagcacaacaaaccatttgtcttaatgagcctgcgcaacccatatgatgccgccaattttgaagaagctaaggcactcattgctgtctatggctttaaaggatacgcgaatggccgttatcttcaaccaaatatccccgccggagttatggcgatattcggccaggtaaaacctaaaggcacacttccagttgacattccgtcagtcacgaaaccgggagacatcctttatccatatggctatggattaaatatcaaaacgggaaaaccactctaa

SEQ ID NO: 1828 - DNA, 1929 bp, Bacillus sp.
atgaaacctgtctttccgcttatcctttcagccgttctctttctttcatgttttctcggcaccagccaaacaaaagctgcttcatccagcaactcaattgataccaagcagcttgtcaatcgcatgacgttagatgaaaaactcggccagatgctaatgccggatttcagaaattggcaaaagaaaagcgagtcttctccgcaagcctttacagaaatgaatgaggaagtcgccggcctaattaagaagtatcaattcggcggcgttatcctttttgcagaaaatgtaaaaacaacaaaacaaactgtacagctgacagacgcttaccaaaaagcgagcccaaaaatcccgctcatcctgagtattgatcaggaaggcggcatcgtaacgagactaggggagggcactaatttcccagggaatatggcgctgggcgcagccagaagcagaatcaatgcctatcagaccggcaccattatcgggaaagagctttctgccttaggcattaatacagatttcagccctgtcgtggacattaataataatccggataatccggtaatcggcgtacggtcattcagctccaatcgagaactgacagcacgactaggtttatatacgatgaaagggctgcagcgccaggacatcgcctctgccctcaaacatttcccgggacatggagacacggacgttgacagccattacggactgccgctcgtttcccatagccaagaacgtcttcgtgaggtcgagctctatccttttcaaagagcaattgatgccggtgctgatatggtgatgacagcgcacgttcaatttcctgcctttgacgacaccacatacaaaagcaaactcgatggatcggacattctggttcctgccacactctcgaaaaaagtgatgacaggtcttcttcgtcaagaaatgggctttaatggcgtcattgttactgatgctctcaatatgaaagcaattgcggatcatttcggccaagaagaggctgtggtcatggctgtaaaagccggcgttgatattgcattaatgcctgcctcagttacttctttgaaagaagaacagaaattcgcacgtgtcattcaagctttgaaagaagccgtgaaaaacggagacattcctgaacatcaaatcaacaaatcagtcgaaagaatcatttccctgaaaataaaacgcggcatatatccagctcgaagcggcgacagcataaaagaaaaaatagctaaagcccagaaaatcgcaggaagcaagcgtcacttgaaagctgaaaaaaaaatagctgaaaaagcagtgaccgtattaaaaaatgaacagcacaccttgccgtttaagcctaaaaaagacagccgaatcttaattgtcgcgccttacgaagaacaaactgcttcgattgaacaaaccattcgcgatctcatcaagcgaaagaaaatcaaatccgtgtccctcagcaaagtcaattttgccaaccaagtatttaatgccgagcatgaaaaattagtaaaagaggctgactatatcattaccggctcctatgtcgtgaaaaacgatcctgccgtcaacgacggtgtcatcgacgacaccatatcagactcaagcaaatgggctaccgtatttccgagggctgtgatgaaagccgctctgcagcacaacaagccatttgtcttaatgagcctgcgaaacccatacgatgcagccaattttgaagaagctaaggcgcttattgctgtctatggctttaaaggatatgcaaatggccgttatcttcagcccaatattccggcaggcgttagggcgatattcggccaggcaaaacctaaaggcactcttccagtcgacattccatcagtcacaaagccgggagacattctttatccatatggctacggattaaatatcaaaacgggcaaaccgctttaa

SEQ ID NO: 1829 - DNA, 1929 bp, Bacillus sp.
atgaaacctgtctttccgcttatcctttcagccgttctttttctttcatgttttctcgtggctaaccagaaagaagccactgcatctaaaagttcaatcgatgccaatcagattgtcaatcgtatgtcattagatgaaaaactcggtcagatgctgatgcctgattttagaaattggcaaaagaaaggcgagtcctcaccgcaagcccttacggaaatgaatgaggaagtcgccagcctcgtcaagaaatatcaattcggaggcgtcattctttttgcagaaaatgtaaaaacaacaaaacaaacggtccagctgacagacgcttaccaaaaggcaagtcctaaaatcccgctcatgcttagtattgatcaggaaggcggcattgtaacgaggctaggggagggcactaatttcccagggaatatggcgctgggcgcagccagaagtagaatcaatgcgtatcagaccggcagcatcattggaaaagagctctcggccttaggcatcaatacagatttcagccctgtcgtagacattaacaataatcctgataatcctgtaatcggcgtacggtcattcagctccaatcgagaactgacatcacgactcggtttatacacgatgaaagggttgcagcggcaggatatcgcctctgccctcaaacatttcccgggacatggagacacggacgttgacagccattatggactgccgctcgtttcccatgatcaagaacggcttcgagaggtcgagctctatccttttcaaaaagcaattgatgccggtgctgatatggtgatgacagcccatgttcaattccctgcctttgacgacaccacatacaaaagcaaactcgatggatcggacattttggttccagctacactttcgaaaaaagtgatgacaggccttcttcgtcaggaaatgggctttaatggggtcatcgttaccgatgcgctcaatatgaaggcaatcgcagatcatttcggacaggaagaggctgtggtcatggccgtaaaagctggtgtcgatattgcattaatgccagcctcagttacttcattgaaagaagaacagaaattcgcacgtgttattcaagctttgaaagaagccgtgaaaaacggagacattcctgaacatcaaatcaacaaatcagttgaaagaatcatttccctgaaaataaaacgcggcatgtatccagcacggaacgacgacagtacaaaagaaaaaatagccaaagcccaaaaaatcgtaggaagcaagcagcacctgaaagcagagaaaaaaatagctgaaaaagcagtaactgtattaaaaaatgaacagcacactttgccgttcaagcccaaaaaaggcagccgaatcttaattgtggcaccttacgaagaacaaactgcttcaatcgaacaaaccattcgtgatctcgtcaatcgtaagaaaatcaaacccgtatctgtcgacaaaatgaattttgccaaccaagtatttaaggccgagcatgaaaaacaagtaaaagaggctgattatatcattaccggttcctatgtcgtcaaaaatgaccctgtcgtcaacgacggtgtcatcgacgacaccatatctgattcaagcaaatgggctaccgtgtttccgagagctgtcatgaaagccgcactgcagcacaataaaccttttgtcttaatgagtctgcgcaatccctatgatgccgccaattttgaagaagcaaaggcactgattgctgtctatggctttaaaggatacacaaatggccgttatcttcagcctaatattccggccggagtgatggcgatattcggccagacaaaacctaaaggcacacttccagttgacattccgtcagtcacgaaaccagggaacaccctttacccatttggctacggtttaaatatcaaaacgggaaatccgctttaa

SEQ ID NO: 1830 - DNA, 1929 bp, Bacillus sp.
atgagacctgtctttccgcttatcctttcagccgttctctttctttcatgctttttcggggccagacagacagaagcctctgcatccaaacgttcaatcgatgccaatcagattgtcaatcgtatgtcgttagatgaaaaactcggccagatgctgatgcctgattttagaaattggcaaaaggaaggcgagtcctctccgcaagcccttacagaaatgaatgatgaagtcgccagcctcgtcaagaaatatcaattcggaggcatcatcctttttgcagaaaatgtaaaaacaacaaaacaaactgtccaactgacagacgattaccaaaaggcaagtccaaaaatcccgctcatgctgagtattgatcaggaaggcggcattgtaacgcggttaggggagggcactaatttcccagggaatatggcactgggcgcagccagaagcagaatcaatgcgtatcagaccggcagcatcatcgggaaagagctctctgccttaggcatcaatacagatttcagccctgtcgtggacattaacaataatcctgataatcctgtaatcggcgtacggtcattcagctccaatcgagaactgacatcacgcctcggtctatatacgatgaaagggttgcagcggcaggatatcgcgtctgccctcaaacatttcccgggacatggagacacggacgttgacagccattatggactgccgctcgtttcccatggccaagaacggcttcgtgaggtcgagctttatccttttcaaaaagcaattgatgctggtgctgatatggtgatgacagcccatgttcaattccctgccttcgacgacaccacatacaaaagcaaactcgatggatcggacattctggttcctgctacactttcgcaaaaagtgatgacaggtcttcttcgtcaggaaatgggctttaatggggtcatcgttaccgatgcgctcaatatgaaggcaattgcagatcatttcggacaggaggaggctgtggtcatggccgtaaaagctggtgtcgatattgcattaatgccagcctcagtcacttcaatgaaagaagaacagaaattcgcacgtgtcattcaagctttgaaagaagccgtgaaaaacggggatattcctgaacaacaaatcaacaaatcagttgaaagaatcatttccctgaaaataaaacgcggcatgtatccagcacgaaacagcgacagtacaaaagaaaaaatagccaaagccaaaaaaatcgtaggaagccagcagcacctgaaagcagagaaaaaaatagctgaaaaagcagtaactgtattaaaaaatgaacagcacactttgccgttcaagcctaaaaaaggcagccgaatcttaattgtggcaccttacgaagaacaaactgcttcaatcgaacaaaccattcacgatctcatcaagcgaaagaaaatcaaacccgtatccctcagcaaaatgaactttgccaaccaagtatttaaggccgagcatgcaaaacaagtaaaaaaggctgattatatcataaccggctcctatgtcgtcaaaaatgaccctgtcgtcaacgacggtgtcatcgacgacacaatatcagattcaagcaaatgggccaccgtgtttccgagagctgtcatgaaagccgcactgcagcacaacaaaccatttgtcttaatgagcctgcgcaacccatatgatgccgccaatttcgaagaagcaaaggcactgattgcagtctatggctttaaaggatacgcaaatggccgttatcttcaacctaatattccggccggagtgatggcgattttcggccaggcaaaacctaaaggcacacttccagttaacatcccatcagtcacgaaaccagggaacaccctttacccatttggctacggattaaatatcaaaacgggaagaccgctttaa

SEQ ID NO: 1831 - DNA, 1929 bp, Bacillus sp.
atgagacctgtctttccgcttatcctttcagccgttctctttctttcatgctttttcggggccagacagacagaagcctctgcatccaaacgtgcaatcgatgccaatcagattgtcaatcgtatgtcgttagatgaaaaactcggccagatgctgatgcctgattttagaaattggcaaaaggaaggcgagtcctctccgcaagcccttacagaaatgaatgatgaagtcgccagcctcgtcaagaaatatcaattcggaggcatcatcctttttgcagaaaatgtaaaaacaacaaaacaaactgtccaactgacagacgattaccaaaaggcaagtccaaaaatcccgctcatgctgagtattgatcaggaaggcggcattgtaacgaggttaggggagggcactaatttcccagggaatatggcgctgggcgcagccagaagcagaatcaatgcgtatcagaccggcagcatcatcgggaaagagctctctgccttaggcatcaatacagatttcagccctgtcgtggacattaacaataatcctgataatcctgtaatcggcgtacggtcattcagctccaatcgagaactgacatcacgcctcggtctatatacgatgaaagggttgcagcggcaggatatcgcgtctgccctcaaacatttcccgggacatggagacacggacgttgacagccattatggactgccgctcgtttcccatggccaagaacggcttcgtgaggtcgagctttatccttttcaaaaagcaattgatgctggtgctgatatggtgatgacagcccatgttcaattccctgccttcgacgacaccacatacaaaagcaaactcgatggatcggacattctggttccagctacactttcgcaaaaagtgatgacaggtcttcttcgtcaggaaatgggctttaatggggtcatcgttaccgatgcgctcaatatgaaggcaattgcagatcatttcggacaggaggaggctgtggtcatggccgtaaaagctggtgtcgatattgcattaatgccagcctcagtcacttcaatgaaagaagaacagaaattcgcacgtgtcattcaagctttgaaagaagccgtgaaaaacggggatattcctgaacaacaaatcaacaaatcagttgaaagaatcatttccctgaaaataaaacgcggcatgtatccagcacgaaacagcgacagtacaaaagaaaaaatagccaaagccaaaaaaatcgtaggaagccagcagcacctgaaaacagagaaaaaaatagctgaaaaagcagtaactgtattaaaaaatgaacagcacactttgccgttcaagcctaaaaaaggcagccgaatcttaattgtggcaccttacgaagaacaaactgcttcaatcgaacaaaccattcacgatctcatcaagcgaaagaaaatcaaacccgtatctgtcgacaaaatgaattttgccaaccaagtatttaatgccgagcatgcaaaacaagtaaaaaaggctgattatatcataaccggctcctatgtcgtcaaaaatgaccctgtcgtcaacgacggtgtcatcgacgacacaatatcagattcaagcaaatgggccaccgtgtttccgagagctgtcatgaaagccgcactgcagcacaacaaaccatttgtcttaatgagcctgcgcaacccatatgatgccgccaatttcgaagaagcaaaggcactgattgcagtctatggctttaaaggatacgcaaatggccgttatcttcaacctaatattccggccggagtgatggcgattttcggccaggcaaaacctaaaggcacacttccagttaacatcccatcagtcacgaacccgggggacaccctttatccatatggctacggattaaatatcaaaacgggaagaccgctttaa

SEQ ID NO: 1832 - DNA, 1929 bp, Bacillus sp.
atgagacctgtctttccgcttatcctttcagccgttctctttctttcatgctttttcggggccagacagacagaagcctctgcatccaaacgtgcaatcgatgccaatcagattgtcaatcgtatgtcgttagatgaaaaactcggccagatgctgatgcctgattttagaaattggcaaaaggaaggcgagtcctctccgcaagcccttacagaaatgaatgatgaagtcgccagcctcgtcaagaaatatcaattcggaggcatcatcctttttgcagaaaatgtaaaaacaacaaaacaaactgtccaactgacagacgattaccaaaaggcaagtccaaaaatcccgctcatgctgagtattgatcaggaaggcggcattgtaacgcggttaggggagggcactaatttcccagggaatatggcactgggcgcagccagaagcagaatcaatgcgtatcagaccggcagcatcatcgggaaagagctctctgccttaggcatcaatacagatttcagccctgtcgtggacattaacaataatcctaataatcctgtaatcggcgtacggtcattcagctccaatcgagaactgacatcacgcctcggtttatacacgatgaaagggttgcagcggcaggatatcgcgtctgccctcaaacatttcccgggacatggagacacggacgttgacagccattatggactgccgctcgtttcccatggccaagaacggcttcgtgaggtcgagctttatccttttcaaaaagcaattgatgctggtgctgatatggtgatgacagcccatgttcagtttcccgcctttgatgacaccacttacaaaagcaaactcgatggatcggacattttggttccagctacactttcaaaaaaagtgatgacaggtcttcttcgtcaggaaatgggctttaatggtgtgatcgttaccgatgcactcaatatgaaggcaatcgcagatcatttcggacaggaagaggctgtggtcatggccgtaagagctggtgtcgatattgcattaatgccagcctcagtcacttcattgaaagaagaacagaaattcgcacgtgttattcaagctttgaaagaagccgtgaaaaacggggatattcctgaacaacaaatcaacaattcagttgaaagaatcatttccctgaaaataaaacgcggcatgtatccagcgcgaaacagcgacagtacaaaagaaaaaatagccaaagccaaaaaaatcgtaggaagcaagcagcacctgaaagcagagaaaaaaatagctgaaaaagcagtaactgtattaaaaaatgaacagcacactttgccattcaagcctaaaaaaggcagccgaatcttaattgtggcaccttacgaagaacaaactgcttcaatcgaacaaaccattcacgatctcatcaagcgaaagaaaatcaaacccgtatctgtcgacaaaatgaattttgccaaccaagtatttaaggccgagcatgcaaaacaagtaaaaaaggctgattatatcataaccggctcctatgtcgtcaaaaatgatcctgtcgtcaacgacggtgtcatcgacgacacaatatcagattcaagcaaatgggccaccgtgtttccgagagctgtcatgaaagccgcactgcagcacaacaaaccatttgtcttaatgagcctgcgcaacccctatgacgcagccaatttcgaagaaacaaaggcactgattgcagtctatggctttaaaggatacgcaaatggccgttatcttcaacctaatattccggccggagtgatggcgatattcggccaggcaaaacctaaaggcacacttccagttgacattccgtcagtcacgaaaccagggaacaccctttacccatttggctacggattaaatatcaaaacgggaagaccgctttaa

SEQ ID NO: 1833 - DNA, 1929 bp, Bacillus sp.
atgagacctgtctttccgcttatcctttcagccgttctctttctttcatgctttttcggggccagacagacagaagcctctgcatccaaacgtgcaatcgatgccaatcagattgtcaatcgtatgtcgttagatgaaaaactcggccagatgctgatgcctgattttagaaattggcaaaaggaaggcgagtcctctccgcaagcccttacagaaatgaatgatgaagtcgccagcctcgtcaagaaatatcaattcggaggcatcatcctttttgcagaaaatgtaaaaacaacaaaacaaactgtccaactgacagacgattaccaaaaggcaagtccaaaaatcccgctcatgctgagtattgatcaggaaggcggcattgtaacgaggttaggggagggcactaatttcccagggaatatggcgctgggcgcagccagaagcagaatcaatgcgtatcagaccggcagcatcatcgggaaagagctctctgccttaggcatcaatacagatttcagccctgtcgtggacattaacaataatcctaataatcctgtaatcggcgtacggtcattcagctccaatcgagaactgacatcacgcctcggtttatacacgatgaaagggttgcagcggcaggatatcgcatctgccctcaaacatttcccgggacatggagacacggacgttgacagccattatggactgccgctcgtttcccacggccaagaacggcttcgtgaggtcgagctttatcctttccaaaaagcaattgatgctggtgctgatatggtgatgacagcccatgttcagtttcccgcctttgatgacaccacttacaaaagcaaactcgatggatcggacattctggttccagctacactttcgcaaaaagtgatgacaggtcttcttcgtcaggaaatgggctttaatggagtcatcgttaccgatgcgctcaatatgaaggcaatcgcagatcatttcggacaggaagaggctgtggtcatggccgtaaaagctggtgtcgatattgcattaatgccagcctcagtcacttcaatgaaagaagaacagaaattcgcacgtgttattcaagctttgaaagaagccgtgaaaaacggggatattcctgaacaacaaatcaacaaatcagttgaaagaatcatttccctgaaaataaaacgcggcatgtatccagcacgaaacagcgacagtacaaaagaaaaaatagccaacgccaaaaaaatcgtaggaagcaagcggcacctgaaagcagagaaaaaaatagctgaaaaagcagtaactgtattaaaaaatgaacagcacactttgccgttcaagcctaaaaaaggcagccacatcttaattgtggcaccttacgaagaacaaactgcttcaatcgaacaaaccattcacgatctcatcaagcgaaagaaaatcaaacccgtatctgtcgacaaaatgaattttgccaaccaaatatttaatgccgagcatgcaaaacaagtaaaaaaggctgattatatcataaccggctcctatgtcgtcaaaaatgaccctgtcgtcaacgacggtgtcattgacgacacaatatcagattcaagcaaatgggccaccgtgtttccgagagctgtcatgaaagccgcactgcagcacaacaaaccatttgtcttaatgagcctgcgcaacccctatgacgcagccaatttcgaagaagcaaaggcactgattgcagtctatggctttaaaggatacgcaaatggccgttatcttcaacctaatattccggccggagtgatggcgatattcggccaggcaaaacctaaaggcacacttccagttgacattccgtcagtcacgaaaccagggaacaccctttacccatttggctacggattaaatatcaaaacgggaagaccgctttaa

SEQ ID NO: 1834 - DNA, 1929 bp, Bacillus sp.
atgaagtcgatcatttccattactctatcaaccgttttatgtctatcagcgtgtcttgtggcaagtccggcctcagctgcaaaaccttccaaggccacaacagctaaacagctgacggcacaaatgacattagatgaaaagctgggccagatgctgatgcctgatttcagaaactggcaaaaagaaggggcggcatctccttctgcactcactgaaatgaatgatgaagtcgccggtcttgttgagaaatatcaatttggcggagtcattctctttgcagaaaacgtaaaaacaaccgaacaaaccgttcgcctgacagatgcatttcaaaaagcgagtcccaatattccgctgttactcagtattgatcaagagggcgggatcgtgacaagactcggagagggaactaatttcccaggcaatatggctctcggtgcagcgagaagcagcaactatgcgtatcttacggggactgtgatcggcaaggagctctcagccttgggcattaacactaatttcggacctgttctggacattaacaacaaccccaataacccagtcatcggcgtaagatctttcagttcaaatcgagaggtaaccgcaaagcttgggatgtactcaatgaaaggcttacaaaaacaaaatgttgcttcagcggttaaacatttcccgggacatggagacacagatgttgatagccattacggattgccgctcgtctctcataacaaagagcgccttcgtgaggttgaactctatccttttcaaaaagcaataaatgctggtgcggatatggtgatgacagcacatgttcaatttcctgcctttgacgacacgacctataaaagcaagctggacggaagtgatatccttgttcccgcaacactttcacgtaaagtcatgacagggcttctccgtgaggaaatgggatttgacggcgtcatcgtcactgatgcactcaatatgaaagccattgcggatcatttcggccaggaagaagccgtcgtcatggcagtcaaggcgggcgtcgatatcgcattaatgcctgccgcagtcacttctctcaaaacagaaaaccgtttcgacagcgttcttcaagccttaaaaaaagcagttactcagggagacattcctttacagcaaattaaccaatcggttgaaagaatcatttccctgaaaataaaacgcggtatttaccccgctcagaacaaaggcagtatagataaaaaagttgcaaaagcccttaaaaccgtaggaaggaaacaacaccggaaagctgagaaacaaatagctgaaaaagcagtgacgattcttaaaaacgagcagcacacattgccatttaagcccaagaaaggaagctcaattttaatcgctgcaccttacgaagaacagacagaagccatcgcgcaaaccattaccgatcttgtccaacgaaagaaaatcaaacccgtttccctcagtaaactgaactttgagggccgcgtattcgatgctgaaactgagaaacaaatcaaagaggctgattatgtgattaccggctcttatgtcgtaaaaaatgatcctgtcatcaacgatggcgtcatcgacgacactgtgaccgattcaagcaaatgggcgacagtttttccgagagccgtcatgaagtcagcacagcaaaatcacaagaaatttgtactgatgagcctgcgtaatccatatgatgcggccaatttcgaagaagctcaggcccttattgccgtctacggcttcaaaggatatgccgaaggccgttatcttcagccgaatatcccagcaggcattgaagcgatcttcgggcagaccaaaccaaaaggcacactcccagttgacattccatctgtcaccagaccgggagacatattgtatccgtatggccatggggtaaacctcaaaaccggaaaaccgctgtaa

SEQ ID NO: 1835 - DNA, 1929 bp, Bacillus sp.
atgaagtcgatcatttccattactctatcaaccgttttatgtctatcagcgtgtcttgtggcaagtccggcctcagctgcaaaaccttccggggccacaacaactaaacagctgacggcacaaatgacattagatgaaaagctgggccagatgctgatgcctgatttcagaaactggcaaaaagaaggggcggcatctcctgctgcactcactgaaatgaatgatgaagtcgccggtcttgttgagaaatatcaatttggcggagtcattctctttgcagaaaacgtaaaaacaaccgaacaaaccgttcgcctgacagatgcatttcaaaaagcgagtccaaatattccgctgttactcagtattgatcaagagggcgggatcgtgacaagactcggagagggaactaatttcccaggcaatatggctctcggtgcagcgaggagcagcaactatgcgtatcttacggggacagtgatcggcaaggaactctcagccttgggcattaacactgatttcggacctgttctggacattaacaacaaccccaataacccagtcatcggcgtaagatctttcagttcaaatcgagaggtaaccgcaaagcttgggatgtattcaatgaaaggcttacaaaaacaaaatgttgcttcagcggttaaacatttcccgggacatggagacacagatgttgatagccattacggattgccgctcgtctctcataacaaagagcgccttcgtgaggttgaactctatccttttcaaaaagcaataaatgctggtgcggatatggtgatgacagcacatgttcaatttcctgcctttgacgacacgacctataaaagcaagctggacggaagtgatatccttgtccccgcaacactttcacgtaaagtcatgacagggcttctccgtgaagaaatgggatttgacggcgtcatcgtcactgatgcactcaatatgaaagccattgcggatcatttcggccaggaagaagccgtcgtcatggcagttaaggcgggcgtcgatatcgcattaatgcctgccgcagtcacttctctcaaaacagaaaaccgtttcgacagcgttcttcaagccttaaaaaaagcagttactcaaggagacattcctttacagcaaattaaccaatcggttgaaagaatcatttccctgaaaataaaacgcggtatttaccccgctcagaacaaaggcagtatagataaaaaagttgcaaaagccctcaaaaccgtaggaaggaaacaacaccggaaagctgagaaacaaatagctgaaaaagcagtgacgattcttaaaaacgagcagcacacattgccatttaaacctaaaaaaggaagctcaattttaatcgctgcaccttacaaagaacagacagaagccatcgcgcaaaccattaccgatcttgtccaacgaaaaaaaatcaaacccgtttccctcagtaaactgaactttgagggccgagtattcgatgctgaaactgagaaacaaatcaaagaggcggattatgtgattaccggctcttatgtcgtaaaaaatgatcctgtcatcaacgatggcgtcatcgacgacactgtgaccgattcaagcaaatgggcgacagtttttccgagagccgtcatgaagtcagcacagcaaaatcataagaaatttgtactgatgagcctgcgtaatccatatgatgcggccaattttgaagaagctcaggcccttattgccgtctacggcttcaaaggatatgccgacggccgttatcttcagccgaatatcccagcaggcattgaagcgatcttcgggcagactaaaccaaaaggcacactcccagttgacataccatctgtcaccagaccgggagacatattgtatccgtatggccatggggtaaacctcaaaaccggaaaaccgctgtaa

SEQ ID NO: 1836 - DNA, 1914 bp, Bacillus sp.
atgaaacttctcatctcagctgtattactgttgttcattgtattcggcacgcatcatgcatcaacaaaaccggacattccgtcacaggcggaacaagcggtatcccgtatgacattagatgaaaaattagggcagatgctcatgcctgatttccgaaattggcaaaaaaaggggcagtcatcacctaaggctcttacccaaatgaatgacgaagtcgcagggcttattcaaaagtaccggttcggcggcgttatcttatttgcagaaaatgtaaaagacactgagcaaacggtacgcctgacagatgcctttcaaaaggcgagccctgacattccgctattattaagcattgatcaggagggcggcatcgtaactagacttggtgagggcactcatttcccaggcaatatggcgctcggggctgctagaaaaacagcctacgcgtcccagaccggcgccattatcgggaaagaactgaaagcactgggcattaatacgaatttcgctcccgttctcgatatcaataataatcccggaaaccctgtcatcggcgtcaggtcgttcagttcagaccgtgatctgacagcttcactcggtcttgcctcaatgaaggctcagcaaaagcagaatgtcgctgccgccgtcaaacatttcccgggacacggcgacacggatgtcgacagccactacggtcttccgcttgtcacccacaatcaagaaaggctgcgtcagattgaactttatccgttccggcaggccattcagggcggagctgatatgatcatgacagcccatgtgcaatttcccgcttttgacgatacaacctataaaagcaagctggacggttcagacatcctcgtacccgccacactctcgaaaaaagtgatgactcatcttctccgtgacgaaatgggatttaacggcgtcatcgttacggatgcattaaatatgaaagccattgccgatcatttcggtcaggaagaggcggtcgtcatggcagtaaaagcaggagtcgatattgccctgatgccggcccaagtgacatcgctgcaaacggaaaaccgctttgcccgggttcattccgctttaaaaaaggcggtacaaaaaggggatattccgctgcagcaaattaacaaatcagcggaacgcatcatttccctgaaaataaaacgagggatatatcccgcaccgaaagagacaaatctgaaaaagaagattgcaaaagcaaagaaaaccgtcggcagcaaaaatcacctgaaagctgaaaaacaaatcgcggaaagatccgtcaccgtcttacaaaacaaaaaccgcacgctcccattcaaaccgaaaaagaacagccgcgttctcattgccgctccttatgaagatcaaacagcggcaatggaacaaaccattcggcagctcatcaagaagaaaaaaatccggccggtaaccatcagtaaaatgaacttcgccgagcgcacatttcatgatgaacacaaaaagctggtatccgacgcggattacgtgattacaggctcctatgtcgtaaaaaatgaccctgtcgtaaacgacggcgtgattgacgattccgtcacagatcccggcaagtggacgaccgcatttccgcgggccgtcatgaaagccgcacaatcgaaccaaaaaccctttgtgctgatgagcctgcgtaatccttacgacgccgcgaattttgaagaagctgaagcccttatcgcagtctacggctttaaaggatatacagacggacaattcctccagccaaacattccggcaggcattgaagcgatattcggacagacaacaccgcaaggcaggctgcccgctgacattccttcagtcacgcatccgggaacgacactgtatccttatggtttcggtatcaatctgaagaccggaaaaccgctttaa

SEQ ID NO: 1837 - DNA, 1914 bp, Bacillus sp.
atgaaacttgtcatctcagctgtattaatgttgttcattgttttcggcacgcatcatgcatcgacaaaaccggacattccgtcacaggcggaacaagcggtatcccgtatgacattagatgaaaaattagggcagatgctcatgcctgattttcgcaattggcaaaaaaaggggcagccatcacctgaggctcttacccaaatgaatgacgaagtcgcagggcttattcaaaagtaccggttcggcggcgttatcttatttgcagaaaatgtaaaaaacactgagcaaacggtacgcctgacagatgcctttcaaaaggcgagccctgatattccgctattattaagcattgatcaggagggcggcatcgtaactagacttggtgaaggcactcatttcccaggcaatatggcgctcggagccgctagaaaaacagcctacgcgtcccagaccggcgccattatcgggaaagaactgaaagcactgggcattaatacgaatttcgctcccgttctcgatatcaataataatcccggaaaccctgtcatcggcgtcaggtcgttcagttcagaccgagatctgacagcttcactcggccttgcctcaatgaaggctcagcaaaagcaggatgtcgctgccgccgtcaaacatttcccgggacacggcgacacggatgtcgacagccactacggccttccgcttgtcacccacaatcaagaaaggctgcgtcagattgaactttatccgttccggaaggccattcaggccggagctgatatgatcatgacagcccatgtgcaatttcccgcttttgacgatacaacctataaaagcaagctggacggttcagacatcctcgtacccgccacactctcgaaaaaagtgatgactcatcttctccgtgaggaaatgggatttaacggcgtcatcgttacggatgcattaaatatgaaagccattgccgatcatttcggccaggaagaggcggtcgtcatggcagtaaaagcaggagtcgatattgccctgatgccggcccaagtgacatcgttgcaaacggaaaaccgctttgcccgggttcattccgctttaaaaaaggcggtacaaaaaggggaaattccgcttcagcaaattaacaaatcggtgaaacgcatcatttccctgaaaataaaaagagggatatatcccgcaccgaaagagacaaatctgaaaaagaagattgcaaaagcaaagaaaaccgtcggcagcaaaaatcacctgaaagctgaaaaacaaatcgcggcaaggtccgtcaccgtcttacaaaacaaaaaccgcacgctcccattcaaaccgaaaaagaacagccgcgttctcattaccgctccttatgaagatcaaacagcgtcaatggaacaaaccattcggcagctcatcaagaagaaaaaaatccggccggtaaccatcagtaaaatgaacttcgccgagcgcacatttcatgatgagcacaaaaagctggtatccgacgcggattacgtgattacaggctcctatgtcgtgaaaaatgaccctgtcgtaaacgacggcgtgattgatgattccgtcacagatcccggcaagtggacgactgcatttccgcgggccgtcatgaaagccgcacaatcaaaccaaaaaccctttgtgctgatgagcctgcgtaatccatatgacgctgcgaactttgaagaagctgaagcccttatcgcagtctacggctttaaaggatatacagacggacaatttctccagccaaacattccggcaggcattgaagcgatattcggacagacaacaccgcaaggcaggctgcccgctgacattccttccgtcactcatccgggaacggcactctatccttatggtttcggtatcaatctgaagaccggaaaaccgctttaa

SEQ ID NO: 1838 - DNA, 1089 bp, Salinibacillus sp.
gtgttaaagaaacctatcatctgtttgttcatcttatttttatttgcgtctgccgttttgtctgagccgatccaagcacatactgtgttacctgttaatcctaaagcacagcagacaacaagagatgtgatgaattggctcgcccacctgccgaaccgttctgaaaacagagtcctttccggtgcgtttgggggttacagtcatgacaccttctccatggccgaagcagaaagaatccgaaactcagccggacaatcacctgccatttacggctgtgattacgctaggggatggcttgaaacctcaaacattgaagattctatagacgtaagctgcaacagtgatttaatttcgtattggaaaagcggagggattccgcagatcagtctgcatctagcgaatcctgcttatcagtcaggacactataaaacaccgattaccaacgatcagtataaaaaactgttagactcttctacaacagaggggaagcggctgaacgccatgctcagcaaaattgctgacgggcttcaagagctggaaaaccaaggcgtgcccgttctgttcaggccgctgcatgagatgaacggcgagtggttttggtgggggcttacgtcatataatcaaaaggatgatgaaagaatctacttatataaacagctctacatcaaaatctatcattatatgactgaagaaagaggattggatcatttattgtgggttttctctcccgacgctaatcgagattttaaaaccgatttttaccctggagcttcatacgtagatatagttgggttagatgcatactttcaagatccatattcgataagcggatacgaccagctgacagcacttaataaaccatttgcctttacagaagttggtccgcaaacagcaaacggcagctttgattacagtctgtttatgagtgcgataaaacaaaaatatcctaaaacgacttattttctggcatggaatgatgaatggagtccggctgtgaacaaaggcgcttcatctctctacaatgataactggacattaaataagggagaagtgtggaacggtaatacattaacacctatagttgaataa

SEQ ID NO: 1839 - DNA, 1089 bp, Bacillus sp.
gtgttaaagaaacctatcatctgtttgttcatcttatttttatttgcgcctgccgttttggctgagccgatccaagcacatactgtgtcacctgttaatcctaaagcacagcagacaacaaaagatctgatgaattggctcgctcacctgccgaatcgttctgaaaacagagtgctttccggtgcgtttggcggttacagtcatgacacattctccatggccgaagcagaaagaatccgaagctcagccggacaatcacctgccatttacggctgtgattacgcgaggggatggcttgaaacctcaaacattgaagattctatagacgtaagctgcaacagtgatttaatttcgtattggaaaagcggagggattccgcagatcagtctgcatctagcgaatcctgcttatcagtcaggacactataaaacaccgattaccaacgatcagtataaaaaactgttagactcttctacaacagaggggaagcggctgaacgccatgctcagcaaaattgctgacggacttcaagagctggaaaagcaaggcgtgcccgttctgttcaggccgctgcatgagatgaacggcgagtggttttggtggggccttacgtcatataatcaaaaggatgatgaaagaatctacttatataaacagctctacatcaaaatctatcattatatgactgacgaaagaggattggatcatttattgtgggtttactctcccgacgctaatcgagattttaaaacagatttttaccctggagcttcatacgtagatatagttgggttagatgcatactttcaagatccatattcgataagcggatacgaccagctgacagcacttaataaaccatttgccttcacagaagttggtccgcaaacagcaaacggcagctttgattacagcctgtttatgagtgcgataaaacaaaaataccctaaaaccacttattttctggcctggaatgatgaatggagcccggctgtgaacagaggcgcttctgctctctacaatgatagctggacattaaataagggagaagtatggaacggtgatacgctaacacctatagttgaataa

SEQ ID NO: 1840 - DNA, 1089 bp, Bacillus sp.
gtgttaaagaaacctatcatctgtttgttcatcttatttttatttgcgtctgccgttttggctgagccgatccaagcacatactgtgtcacctgttaatcctaaagcacagcagacaacaaaagatgtgatgaattggcttgcccacctgccgaatcgttctgaaaacagggtgctttccggtgcgtttggcggttacagtcatgacacattctctatggcagaagcagaaagaatccggaacgcatccggacaatcacctgccatttacggctgcgattacgcgaggggatggcttgaaacctcaaatattgaagattctatagacgtgagctgcaacagtgatttaatatcgtactggaaaagcggagggattccgcagatcagtctgcatctagcaaatcctgcttatcagtcaggacattttaaaacaccgattaccaacgatcagtataaaaaactgttagactctacaacaacagaggggaagcggctgaacgccatgctcagcaaaattgctgacggacttcaacagctggaaaaccaaggcgtgcccgttctgttcaggccgctgcatgagatgaacggcgagtggttttggtgggggctgacgtcatataatcaaaaggatgatgaaagaatcttcttatataaacagctctatatcaaaatctatcattatatgactgacgaaagaggattagatcatttattatgggtttactcccccgacgctaatcgagattttaaaacaaatttttacccgggagcttcatacgtagatatcgttgggttagatgcatactttcaagatccatattcgataagcggatacgaccagctgacagcgcttaataaaccatttgccttcacggaagttggtccgcaaacagcaaccggcagctttgattacagcctctttatgagtgcgataaaacagaaataccctaaaaccacttattatctggcctggaatgatgaatggagcccggctgtgaacaaaggtgcttccgctctctataatgatagctggacattaaataagggagaagtatggaatggtgatacattaacacctatagttgaataa

SEQ ID NO: 1841 - DNA, 1089 bp, Bacillus sp.
gtggttaagaaatatacgatctctttgctcattttatttttgcttgcgtctgctgttttagcaaaaccaattcaagcgcatactgtgtctcctgtaaatcctaatgcacagcagacaacaaaagcagtgatgaattggcttgctcatctgccgaaccgaacggaaaacagagttctttctggcgcgttcggaggttacagtcatgacacattttctatggctgaggctgatagaatccgaagcgccgccgggcaatcgcctgctatttacggctgtgattatgccagagggtggcttgaaacagcaaatattgaagattcaatagatgtaagctgcaacagcgatttaatttcgtattggaaaaatggcggaattccgcaaatcagtttgcacctggcgaaccctgcttttcagtcagggcattttaaaacaccgattacaaatgatcagtataaaaaaatactagactcttcaacagtagaagggaagcggctaaatgccatgctcagcaaaattgctgacggacttcaagagctgaagaaccaaggtgtgcctgttctgttcaggccgctgcatgaaatgaacggtgaatggttttggtggggacttacatcatataatcaaaaggataatgaaagaatctctctatataaacagctctacaagaaaatctatcattatatgaccgacacaagaggacttgatcatttgctttgggtttactcccccgacgccaatcgagatttcaaaaccgatttttaccctggtgcgtcttacgtggatattgtcggactagatgcgtatttccaagatgcctattcgataaatggatatgaccagctaacggcgcttaataaaccatttgcttttacagaagtgggcccgcaaacagcaaacggcagcttcgattacagcctgttcatcaatgcaataaaacaaaaatatcctaaaaccatttactttctcgcatggaatgatgaatggagcccagcagtaaacaaaggtgcttcagctttatatcatgacagctggacgctcaataagggagaaatatggaatggcgattctttaacgccaatcgttgaatga

SEQ ID NO: 1842 - DNA, 1089 bp, Bacillus sp.
ttgtttaagaaacatacgatctctttgctcattttatttttacttgcgtctgctgttttagcaaaaccaattgaagcgcatactgtgtcgcctgtgaatcctaatgcacagcagacaacaaaagcagtgatgaactggcttgcgcacctgccgaaccgaacggaaaacagagtcctttccggagcgttcggaggttacagtcatgacacattttctatggctgaggctgatagaatccgaagcgccaccgggcaatcgcctgctatttacggctgcgattatgccagaggatggcttgaaacagcaaatattgaagattcaatagatgtaagctgcaacagcgatttaatatcgtattggaaaaatggtggaatcccgcaaatcagcatgcacctggcgaatcctgcttttcagtcagggcattttaaaacaccgattacaaacgatcagtataaaaaaatactagattcttcaacagcagaagggaagcggctgaatgccatgctcagcaaaattgctgacggacttcaagagctggagaaccaaggtgtgcctgttttgttcaggccgctgcatgaaatgaacggtgaatggttttggtggggacttacatcatataaccaaaaggataatgaaagaatctctctatataaacagctctacaagaaaatctatcattatatgaccgacacaagaggacttgatcatttgctttgggtttactctcccgacgccaaccgagattttaaaactgatttttacccgggcgcgtcttacgtggatattgtcggattagatgcgtattttcaagatgcctactcgatcaatggatacgatcagctaacagcgcttaataaaccaattgcttttacagaagtcggcccgcaaacagcaaacggcagctttgattacagcctatttatcaatgcaataaaacaaagatatcctaaaaccatttactttctggcatggaatgatgaatggagcccagcagtaaacaagggtgcttcagttttatatcatgacagctggacactcaacaagggagaaatatggaatggtgattctttaacgccaatcgttgaatga

SEQ ID NO: 1843 - DNA, 1089 bp, Bacillus sp.
ttgtttaagaaacatacgatctctttgctcattatatttttacttgcgtctgctgttttagcaaaaccaattgaagcgcatactgtggcgcctgtgaatcctaatgcccagcagacaacaaaagcagtgatgaactggcttgcacacctgccgaaccgaacggaaaacagagtcctttccggagcgttcggaggttacagtcatgacacattttctatggctgaggctgatagaatccgaagcgccaccgggcaatcgcctgctatttacggctgcgattatgccagagggtggcttgaaacagctaaaattgaagattcaatagatgtaagctgcaacggtgatttaatttcgtattggaaaaatggcggaattccgcaaatcagtttgcacctggcgaaccctgcttttcagtcagggcattttaaaacaccgattacaaacgatcagtataaaaaaatactagattcttcaacagcagaaggaaagcggctaaatgccatgctcagcaaaattgctgacggacttcaagagctggagaaccaaggtgtgcctgttctgttcaggccactgcatgaaatgaacggcgaatggttttggtggggacttacatcatataaccaaaaggataatgaaagaatctctctatataaacagctctacaagaaaatctatcattatatgaccgacacaagaggacttgatcatttgatttgggtttactcacccgacgccaaccgagattttaaaactgatttttacccgggagcgtcttacgtggatattgtcggattagatgcgtattttcaagatgcctactcgatcaatggatacgatcagctaacagcgcttaataaaccatttgcttttacagaagtcggcccgcaaacagcaaacggcagcttcgattacagcctgttcatcaatgcaataaaacaaaaatatcctaaaaccatttactttctggcgtggaatgatgaatggagcccagctgtaaacaagggtgcttcagctttatatcatgacagctggacactcaataagggagaaatatggagtggcgattctttaacgccaatcgttgagtga

SEQ ID NO: 1844 - DNA, 1104 bp, Bacillus sp.
atgggggagttgcatttgtttaagaaacatacgatctctttgctcattatatttttacttgcgtctgctgttttagcaaaaccaattgaagcgcatactgtgtcgcctgtgaatcctaatgcccagcagacaacaaaaacagtgatgaactggcttgcgcacctgccgaaccgaacggaaaacagagtcctttccggagcgttcggaggttacagtcatgacacattttctatggctgaggctgatagaatccgaagcgccaccgggcaatcgcctgctatttatggctgcgattatgccagaggatggcttgaaacagcaaatattgaagattcaatagatgtaagctgcaacggcgatttaatgtcgtattggaaaaatggcggaattccgcaaatcagtttgcacctggcgaaccctgcttttcagtcagggcattttaaaacaccgattacaaatgatcagtataaaaaaatactagattcttcaacagtagaaggaaagcggctaaatgccatgctcagcaaaattgctgacggacttcaagagttggagaaccaaggtgtgcctgttctgttcaggccgctgcatgaaatgaacggtgaatggttttggtggggacttacatcatataatcaaaaggataatgaaagaatctctctatataaacagctctacaagaaaatctatcattatatgaccgacacaagaggacttgatcatttgatctgggtttactctcccgacgccaaccgagattttaaaactgatttttacccgggcgcgtcttacgtggatattgtcggattagatgcgtattttcaagatgcctactcgatcaatggatacgatcagctaacagcgcttaataaaccatttgcttttacagaagttggcccgcaaacagcaaacggcagcttcgattacagcctgttcatcaatgcaataaaacaaaaatatcctaaaaccatttacttcctcgcatggaatgatgaatggagcccagcagtaaacaagggtgcttcagctttatatcatgacagctggacactcaataagggagaaatatggaatggcgattctttaacgccaatcgttgaatga

SEQ ID NO: 1845 - DNA, 1104 bp, Bacillus sp.
atgggggagttgcatttgtttaagaaacatacgatctctttgctcattatatttttacttgcgtctgctgttttagcaaaaccaattgaagcgcatactgtgtcgcctgtgaatcctaatgcccagcagacaacaaaagcagtgatgaactggcttgcgcacctgccgaaccgaacggaaaacagagtcctttccggagcgttcggaggttacagtcatgacacattttctatggctgaggctgatagaatccgaagcgccaccgggcaatcgcctgctatttacggctgcgattatgccagagggtggcttgaaacagctaaaattgaagattcaatagatgtaagctgcaacggtgatttaatgtcgtattggaaaaatggcggaattccgcaaatcagtttgcacctggcgaaccctgcttttcagtcagggcattttaaaacaccgattacaaacgatcagtataaaaaaatactagattcttcaacagcagaaggaaaacggctaaatgccatgctcagcaaaattgctgacggacttcaagagctggagaaccaaggtgtgcctgttctgttcaggccgctgcatgaaatgaacggcgaatggttttggtggggacttacatcatataaccaaaaggataatgaaagaatctctctatataaacagctctacaagaaaatctatcattatatgaccgacacaagaggacttgatcatttgatttgggtttactctcccgacgccaaccgagattttaaaactgatttttacccgggcgcgtcttacgtggatattgtcggattagatgcgtattttcaagatgcctactcgatcaatggatacgatcagctaacagcgcttaataaaccatttgcttttacagaagtcggcccgcaaacagcaaacggcagcttcgattacagcctgttcatcaatgctgtaaaacaaaaatatcctaaaaccatttactttctggcatggaatgatgaatggagcccagctgtaaacaagggtgcttcggctttatatcatgacagctggacactcaataagggagaaatatggaacggcgattctttaacgccaatcgttgaatga

SEQ ID NO: 1846 - DNA, 1107 bp, Bacillus sp.
atgaatggggagttgcatttgtttaagaaacatacgatctctttgctcattatatttttacttacgtctgctgttttagcaaaaccaattgaagcgcatactgtgtcgcctgtgaatcctaatgcccagcagacaacaaaagcagtgatgaactggcttgcgcacctgccgaaccgaacggaaaacagagtcctttccggagcgttcggaggttacagtcatgacacattttctatggctgagactgatagaatccgaagcgccaccgggcaatcgcctgctatttacggctgcgattatgccagaggatggcttgaaacagcaaatattgaagattcaatagatgtaagctgcaacagcgatttaatgtcgtattggaaaaatggtggaatccctcaaatcagcttgcacctggcgaatcctgcttttcagtcagggcattttaaaacaccgattacaaacgatcagtataaaaaaatactagattcttcaacagcagaagggaagcggctgaatgccatgctcagcaaaattgctgacggacttcaagagctggagaaccaaggtgtgcctgttttgttcaggccgctgcatgaaatgaacggtgaatggttttggtggggactcacatcatataaccaaaaggataatgaaagaatctctttatataaacagctctacaagaaaatctatcattatatgaccgacacaagaggacttgatcatttgatttgggtttactctcccgacgccaaccgagattttaaaactgatttctacccgggcgcgtcttacgtggatattgtcggattagatgcgtattttcaagatgcctactcgatcaatggatatgatcagctaacagcgcttaataaaccatttgcttttacagaagtcggcccgcaaacagcaaacggcagctttgattacagcctatttatcaatgcaataaaacaaagatatcctaaaaccatttactttctggcatggaatgatgaatggagcccagctgtaaacaagggggcttcagctttatatcatgacagctggacactcaataaaggagaaatatggaatggcgattctttaacgccaatcgttgagtga

SEQ ID NO: 1847 - DNA, 1014 bp, Bacillus sp.
ttgtttaagaaacatacgatctctttgctcattttatttttacttgcgtctgctgttttagcaaaaccaattgaagcgcatactgtgtcgcctgtgaatcctaatgcacagcagacaacaaaagcagtgatgaactggcttgcgcacctgccgaaccgaacggaaaacagagtcctttccggagcgttcggaggttacagtcatgacactttttctatggctgaggctgatagaatccgaagcgccaccgggcaatcgcctgctatttacggctgcgattatgccagagggtggcttgaaacagctaaaattgaagattcaatagatgtaagctgcaacggtgatttaatttcgtattggaaaaatggcggaattccgcaaatcagtttgcacctggcgaaccctgcttttcagtcagggcattttaaaacaccgattacaaatgatcagtataaaaaaatactagattcttcaacagcagaaggaaagcggctaaatgccatgctcagcaaaattgctgacggacttcaagagctggagaaccaaggtgtgcctgttctgttcaggccgctgcatgaaatgaacggcgaatggttttggtggggacttacatcatataaccaaaaggataatgaaagaatctctctatataaacagctctacaagaaaatctatcattatatgaccgacacaagaggacttgatcatttgatttgggtttactctcccgacgccaaccgagattttaaaactgatttttacccgggcgcgtcttacgtggatattgtcggattagatgcgtattttcaagatgcctactcgatcaatggatacgatcagctaacagcgcttaataaaccatttgcttttacagaagtcggcccgcaaacagcaaacggtagcttcgattacagcctgttcatcaatgcaataaaacaaaaatatcctaaaaccatttactttctggcatggaatgatgaatggagcccagcagtaaacaagggtgcttcagct

SEQ ID NO: 1848 - DNA, 1005 bp, Bacillus sp.
gtgtcgcctgtgaatcctaatgcccagcagacaacaaaaacagtgatgaactggcttgcgcacctgccgaaccgaacggaaaacagagtcctttccggagcgttcggaggttacagtcatgacacattttctatggctgaggctgatagaatccgaagcgccaccgggcaatcgcctgctatttatggctgcgattatgccagaggatggcttgaaacagcaaatattgaagattcaatagatgtaagctgcaacagcgatttaatgtcgtattggaaaaatggtggaatccctcaaatcagcttgcacctggcgaatcctgcttttcagtcagggcattttaaaacaccgattacaaacgatcagtataaaaaaatactagattcttcaacagcagaagggaagcggctaaatgccatgctcagcaaaattgctgacggacttcaagagttggagaaccaaggtgtgcctgttctgttcaggccgctgcatgaaatgaacggtgaatggttttggtggggacttacatcatataaccaaaaggataatgaaagaatctctctatataaacagctctacaagaaaatctatcattatatgaccgacacaagaggacttgatcatttgatttgggtttactctcccgacgccaaccgagattttaaaactgatttttacccgggcgagtcttacgtggatattgtcggattagatgcgtattttcaagatgcctactcgatcaatggatacgatcagctaacagcgcttaataaaccttttgcttttacagaagtcggcccgcaaacagcaaacagcagctttgattacagcctatttatcaatgcaataaaacaaagatatcctaaaaccatttactttctggcatggaatgatgaatggagcccagctgtaaacaagggggcttcagctttatatcatgacagctggacactcaataaaggagaaatatggaatggcgattctttaacgccaatcgttgagtga

SEQ ID NO: 1849 - DNA, 1083 bp, Bacillus sp.
gtgaaaaaaaacatcgtttgttcaatcttcgcgctgctccttgcttttgccgtttcgcagccgagctatgcacacaccgtttctccggtgaacccgaatgcccagccgacgacgaaagcggtgatgaactggctcgcccacctgcccaatcggacggaaagccgggtgatgtccggggcgttcggaggatacagcctcgacacattttcaacggctgaagccgaccggatcaaacaggcaacaggacagctgccggccatatacggctgcgattatgcaagaggatggctggagccggaaaagatcgccgatacgattgactacagctgcaaccgtgatttgatcgcatactggaaaagcggaggcattccgcaaatcagcatgcacctcgcaaaccccgcgtttacttcgggtcattataaaactcagatttcaaacagccagtatgagagaattttagattcttccacgcccgaaggaaaacggcttgaagcgatgctgagcaaaatcgcggacggcctccaggagcttgaaaatgaaggcgtgcccgttctattcagaccccttcacgaaatgaacggcgaatggttctggtgggggctgacgcaatataatcaaaaagacagcgaaagaatctccttgtacaaacagctctatgtgaaaatctatgactatatgacaaaaacaagaggcctggatcatctcttgtgggtgtatgcgccggacgccaacagagactttaaaacagacttttatccgggcgcatcatatgtggacattgtcgggctagacgcttattttgatgacccgtacgacattgatggctacgaaaagctcacatcgctgaacaagccgtttgcctttacagaagtcggaccgcagacgacaaacggcggactggattacgcgcggtttatccatgccatcaaagaaaaatacccgaaaacgacgttcttcctggcgtggaacgatgagtggagcccggctgtgaataagggagcggacaccctctatcttcattcatggacgctgaataagggagagatatgggacggcgattctttgacgcctgtcgttgaataa

SEQ ID NO: 1850 - DNA, 1086 bp, Bacillus sp.
atcatgaaaagacatatcatcagttttgttatcgcttcattattcatattggctgcatcaccggccgcatccgctcatacggtttcaccggtgaatccgaatgcccagccaacaacgaaagcaactatgaactggctcgcacatctgccgaacagatcggaaaaccgggtgatgtcgggtgcattcggcggttacagtcttgatacgttttctatggctgaagccaatcaattaaaaaatacaacggggcagctgcctgcgatttacggatgtgattatgcaagagggtggcttgagccggcagatatcaccgataccgttgaccacagctgcaacagcgatttgatttcatactggaaaagcggcggcatccctcaaatcagcatgcatctggcaaacccggcgtttacttcaggccactacaaaacacagatttccaacagccagtatcaacacatattagattcatcaacggccgaaggaaagcgtcttgatgccatgttggagaagatcgcagatggtcttgaagaactgaaaaatgaaggtgtgcccgtccttttcagacctcttcacgaaatgaacggcgagtggttctggtgggggctgacagaatataatcaaaaagacagtgagaggatcgctttatacaaacagctttatcaaaaaatctatcactatatgacaaatgaaagaggattggacaaccttatatgggtgtatgcgcctgatgccaacagagattttaaagctgatttttatccgggatcttcctatgttgatattgttggattggatgcttactttgccgacgccgattctattcagggatatgaagagctgacatcgcttgataagccgtttgccttcacagaagtcggaccgcaggaaacgaacggcagctttgattacgcttcatttattaatgcaatcagacaaaagtatccgaaaaccgtttactttttggcctggaatgacggctggagccctgccgcaaacaagggcgcatcaagcctttacaacaacagctggacgctgaataaaggagaagtatgggacggcgattcattaacgcctgtcgttgaataa

SEQ ID NO: 1851 - DNA, 1095 bp, Bacillus sp.
atgtttaaaaaaactggtatttttatattactttcttttataatcatttcagctttttcacagacggcatctgcacatacagttaaccccgtaaatcctaatgctcagatgacaacaaaggagttgacgaattggctagctcatctgccaaaccgaactgagaatcgcatactgtcaggtgcattcggcggatatacaaatgcgacgttttctatgacagaagctaatcgaatcaaaaatgctattggccagtcacctgcagtatatgcttgtgattattcgagagggtggttggagtcaggaaatattactgatgcaattgattatagctgcaacagtgatttaatttcttattggaagagcggaggtatacctcagatcagtatgcatcttcctaacccagcgtttcaatctgggcattataaaactcaaatctcaaacagtcaatatcaaaaaatcttagattcatcaactactgagggcaagcgattggatgctattttgagcaaaattgcagatggtcttcaacagctaaaaaatgaaggtgttcctgttctattcagacctcttcatgaaatgaatggagaatggttttggtggggactaaccgaatataacaaaaaagacagccagcgcatctcactttacaaacaactttatcaaaaaatctatcattatatgactgatacaagaggtttggacaacctgatttgggtatatgcaccagacgctaacagggactttaagactgacttttaccctggctcttcatatgttgacattgttggattagacgcttatttctcagacccttattcaattaaaggttatgatgagttaacagctcttaataagccatttgctttcacagaagtcggtccgtcgacaacaaatggcatcgtggacagcctggattattcacagtttatcaatgcaattaaacaaaaatatcctaaaaccatttatttcttagcttgggatgatgagtggagtcctgtggctaataagggtgcgtctagcctttataatgatagttggacactcaataagggagaagtgtggcaaggaagttcacttacaccaatcgttgaataa

SEQ ID NO: 1852 - DNA, 1083 bp, Bacillus sp.
atgctcaaaaagttcgcagtctgtctgtctatcattttattactcatctcagccgcccgtccgatatcggctcacaccgtttaccctgtcaatcccaatgcccagcagacgacaaaagacgtcatgaactggctggcgcatttgcccaaccgttcagaaaacagggtcatgtccggtgcattcggcgggtacagcgatgtcaccttttcaatgacggaggaaaaccgcttgaaaaacgcgacgggacagtctcccgccatctacggctgtgattatgggagagggtggctggaaacatcggatatcaccgattctatcgactacagctgcaacagcagcctcatttcgtactggaaaagcggcggcctccctcaggtcagcctgcatctcgcaaatccggcctttccatcaggacactataaaacggccatttcaaacagccagtataaaaatatcctgaacccttcaactgttgaaggacggcggcttgaggccttgctcagcaaaatcgccgacggccttactcagctgaaaaatcaaggcgtcaccgttctgttcaggccgctgcatgagatgaacggtgaatggttctggtgggggctgacaggctacaaccaaaaagacactgagagaatctcgctgtacaaagagctttacaagaagatataccgctatatgacagagacaagaggattggataatcttttgtgggtgtattcgcctgatgccaacagagacttcaaaacagacttctacccaggctcatcttatgtggatattaccggactggatgcttacttcaccgacccgtatgcgatatcaggctatgatgaaatgctgtctctgaaaaaaccgtttgcctttgccgagaccggtccgtccggtaatatcggaagctttgattacgctgtttttatcaatgcgatcaggcaaaagtatcccgagacaacctactttttgacatgggatgaacaattaagcccggcagccaatcaaggcgcgcaaagcctttatcaaaacagctggacgctgaacaagggcgaaatgtggaatggcggaaccttgacgccgatcgcggaataa

SEQ ID NO: 1853 - DNA, 1083 bp, Bacillus sp.
atgctcaaaaagttagcagtctgcctgtctatcgttttattactcttaggagccgccagtccgatatcggctcacaccgtttatcccgtcaatccaaatgcccagcagacgacaaaagatatcatgaactggctggcgcacctgcccaaccgttcagaaaacagggtcatgtccggggcgttcggcgggtacagcgatgtcactttttcaatgacagaggaaaaccgcttgaaaaacgcgacgggacagtctcccgccatctacggctgtgactatgggagaggatggcttgaaacagcggatatcaccgattctatcgattacagctgcaacagcagcttaatctcatactggaaaagcggcggcctccctcaggtcagcctgcatctcgcaaatccggcttttccatccggaaactataaaacggccatctcaaacagccagtacaaaaacatcctggacccttcaactgttgaaggaaaacgccttgaggcgctgctcagcaaaatcgccgacggccttactcagctgaaaaatcaaggcgtcaccgttctgttcagaccgctgcatgaaatgaacggcgagtggttctggtgggggctgacaggctacaaccaaaaagacaatgaaagaatctcactgtacaaagagctttacaagaagatataccgctatatgacagagacaagaggattggataaccttttgtgggtgtattcgccggatgccaacagagactttaaaacagacttctacccaggctcatcttatgtggatattaccggtctggacgcttacttcactgatccgtatgcgatatcaggctatgatgaaatgctgtctctgaaaaaaccgtttgcctttgccgaaaccggtccgtccggcaatatcggaagctttgattatgctgcttttatcaatgcgatcaggcaaaagtatcccgagacaacgtactttttgacatgggatgaacaattaagtccggcggccaatcaaggcgcgcaaagcctttatcaaaacagctggacgctgaacaagggcgaaatatggaacggcgggtccttgacgccgattgcggaataa

SEQ ID NO: 1854 - DNA, 1083 bp, Bacillus sp.
atgctcaaaaagttagcagtctgcctgtctatcgttttattactcttaggagccgccagtccgatatcggctcacaccgtttatcccgtcaatccaaatgcccagcagacgacaacagatatcatgaactggctggcgcacctgcccaaccgttcagaaaacagggtcatgtccggggcgttcggcgggtacagcgatgtcactttttcaatgacagaggaaaaccgtttgaaaaacgcgacgggacagtctcccgccatctacggctgtgactatgggagaggatggcttgaaacagcggatatcaccgatactatcgattacagctgcaacagcagcttaatctcatactggaaaagcggcggcctccctcaggtcagcctgcatctcgcaaatccggcttttccatccggaaactataaaacggccatctcaaacagccagtacaaaaacatcctggacccttcaactgttgaaggaaaacgccttgaggcgctgctcagcaaaatcgccgacggccttactcagctgaaaaatcaaggcgtcaccgttctgttcagaccgctgcatgaaatgaacggcgagtggttctggtgggggctgacaggctacaaccaaaaagacaatgaaagaatctcgctgtacaaagagctttacaagaagatataccgctatatgacagagacaagaggattggataaccttttgtgggtgtattcgccggatgccaacagagactttaaaacagacttctacccaggctcatcttatgtggatattaccggtctggacgcttacttcactgatccgtatgcgatagcaggctatgatgaaatgctgtctctgaaaaaaccgtttgcctttgccgaaaccggtccgtccggcaatatcggaagctttgattatgatgcttttatcaatgcgatcaggcaaaagtatcccgagacaacgtactttttgacatgggatgaacaattaagtccggcggccaatcaaggcgcgcaaagcctttatcaaaacagctggacgctgaacaagggcgaaatatggaacggcgggtccttgacgccgatcgcggaataa

SEQ ID NO: 1855 - DNA, 1098 bp, Bacillus sp.
atgtttaaaaaaattagtatttttatattactttcttcaataatcatttcagctttttcacagacggcatctgctcatacagtcaaccctgtgaatcctaatgctcaggcgacaacgaaagagttgatgaattggctagctcatctaccaaaccgatctgaaaatcgcatactgtcaggtgcattcggcggattcacaaatgcttcgttttccatgaaagaagccaaccgaattaagaatgctacaggccagttacccgcaatttatggttgtgactattccagtggatggttggagaagccctatatttctgatattactgagacgatcgactatagttgcaacagtgacttaatctcatattggaaaagtggtggaataccacagattagcttacatctagctaatcctgcatccagtacttttgggaaaaatgcttcccatatttcaaacagtgagtatgaaaaaatcttagactcatcaactacagagggtaagcgattagaggctgttctgagcaaagttgcagatggccttgatcagttaaaaaatgaaggtgtacctgttctattcagacctcttcatgaaatgaatggagaatggttttggtggggactaaccgaatataacaaaaaagacagccagcgcatctcactttacaaacaactttatcaaaaaatctatcattatatgactgatacaagaggtttggacaacctgatttgggtatatgcaccagacgctaacagagactttaagatagatttttatcctggctcatcatatgttgacattgtgggattagatgcatatttctcagatgcttattcgattaaaggatatgacgagttaacggctctggataagccatttgcttttacagaagttggtccgcaaacaaaaaatggcagcctggattattcacaatttatcaatgcagttaaacaaaaatatcctaaaaccatctatttcttagcttgggatgaggattggagccctgtggctaatcaaggtgcctctaatctctataatgacagttggacactgaataagggcgaagtgtggagtggtagttcacttacaccaatagttgaataa

SEQ ID NO: 1856 - DNA, 1044 bp, Paenibacillus sp.
ttggggattctgttaatcgcttcgactttctcacagacagcatctgcacatacggtgaatcctaatggacaagccacaaccaaggaagtgatgaactggctcgctaatctgtcatcggaaaatcgcgtagtgtcaggagcattcggcgggtacacaaatgcgtcattttctatgaccgaagctaatcgaattgaaaatgcaacaggacagtcccctgccgtgtatggctgtgattattcaagaggatggatggagacttctaatattgccgattcgatcgattatagttgtaacaccgattcaatctctcattggaagaacggaggtatacctcagatcagtatgcatctggctaaccctgcgtttaactctggaaattataaaaccccaatctcaaacagtcagtatgaaagaatcctagactcatcaactgaagagggccagcgattagacgctatgttaagcaaaattgccgatggccttcagcagttagaagatgaaggtgttcctgttcttttcagacctcttcacgaaatgaatggagaatggttctggtggggactcaccgactataaccaagaggatagcgaacgtatcactttatatcaacagctttataaaaaagtctatcattatatgaccgatacaagaggattggacaacctgatatgggtatacgcaccagacgccaaccgaaactttaagacagacttttaccctggatcttcatatgttgatattgttggattagacgcttatttctcagatccttattcgattcaaggatatgacgagttaacagctcttgataagccttttgctttcacagaagtcggtccgcaggcaaccaatggtagtatggattattctttatttatcaatgccatcaaagaaaaatatccgaaaaccatttatttcttagcttgggatgagggatggagccccgcagctaataaaggtgcctacaatctttataatgatggttggacactgaataagggggaaatgtgggaaggcagttcacttgcatcatttgctgaataa

SEQ ID NO: 1857 - DNA, 630 bp, Bacillus sp.
atgacgacaaaatttactgcgctagctgtttttcttctttgtttcatgcctgcttcgaaaattgaacatacacaagcttcactactgaacacaaagaagacaaaacatgaagaagctaagctgcttacccatataaatcatgacacagacacatctttctcttcactgtctgctgatgaggacaagaaaaaaataaagccgatcaagctatcagcgaacactgaaaagaaagaaaaagaacaatcagagaaagcgaatgagaagaaagaaacttattctgagtctgaaaaagaattgctttcccgactcgttcacgcagaggcgaagggcgaatcctatgaaggcaaggtcgctgttgcaagcgttgtgctgaacaggacggataagaagggctttcccgatacaatcagaggggttatttatcagaaaaatgcctttgaacctgtcgcaaacggaagcattaatcaagagccagacaaagaatcaattgaggctgttgaagaagcgatgtcatctaaggacagagaaacagaagcccttttcttttataacccgaaaacggcgtcagatgactggattcgctcaaggaaaatcattgaaaaaatcggcaggcatgtctttgccatataa

SEQ ID NO: 1858 - DNA, 630 bp, Bacillus sp.
atgacgacaaaattgactgctctagctgtttttcttctttgtttcatgcctgcttcgaaaattgaacatacacaagcttcactactgaacacaaagaagacaaaccatgaagaagctaagctgcttacccatataaatcatgacacagacatatctttctcttcactgtctgctgatgaggacaagaaaaaaataaagccgatcaagctttcagcgaacactgaaaagaaagaagaagaacaatcagagaaaacgaatgagaagaaagaaacttactctcagtctgaaaaagaattgctttcccgactcgttcacgcagaagcgaagggcgaatcctatgaaggcaaggtcgctgttgcaagcgtcgtgctaaataggacggataagaagggctttcccgatacaatcagaggggttatttatcagaaaaatgcctttgaacctgtcgcaaacggaagcattaatcaagagcctgacaaagaatcaattgaggctgttgaagaagcgatgtcatctaaggacagagaaacagaagcccttttcttctataacccgaaaacggcgtcagatgactggattcgctcaaggaaaatcattgaaaaaatcggcaggcatgtctttgccatataa

SEQ ID NO: 1859 - DNA, 630 bp, Bacillus sp.
atgacgacaaaatttactgctctggctgtttttcttctttgtttcatgcctgcttcgaaaattgaacatacacaagcttcactactgagcacaaagaagactaaacatgaagaagctaagctgcttacacatataaatcaagatacagacacatctttctcttcactgtctgctgataaggacaagaaaaaaataaaaccgatcaagctatcagcgaacactgaaaagaaagaagaagaaaaaccaaagaaaacgaatgataaggaagaaacatattcacagtctgaaaaagaattgctttcccgtcttgttcacgcagaggctaagggagaatcctatgaaggaaaggtcgctgttgcaagcgttgtgctgaacaggacggagaaaaaaggttttcctgatacaataagaggggttatttatcagaaaaacgcttttgaaccggtcgcaaacggaagcattaatcaaaagcctgataaagaatcaattgctgctgccgaagaagcgctgtcttcaaaaaatagagaaacagatgctatattcttttataatccgaaaacagcgtcggatgattggattcgctcaagaaaaatcgtagaaagaatcggcgggcacgtttttgccatctaa

SEQ ID NO: 1860 - DNA, 630 bp, Bacillus sp.
atgacgacaaaatttactgctctggctgtttttcttctttgtttcatgcctgcttcgaaaattgaacatacacaagcttcactactgagcacaaagaagactaaacatgaagaagctaagctgcttacacatataaatcaagatacagacacatctttctcttcactgtctgctgataaggacaagaaaaaaataaaaccgatcaagctatcagcgaacactgaaaagaaagaagaagaaaaaccaaagaaaacgaatgataaggaagaaacatattcacagtctgaaaaagaattgctttcccgtcttgttcacgcagaggctaagggagaatcctatgaaggaaaggtcgctgttgcaagcgttgtgctgaacaggacggagaaaaaaggttttcctaatacaataagaggggttatttatcagaaaaacgcttttgaaccggtcgcgaacggaagcattaatcaaaagcctgataaagaatcaattgctgctgccgaagaagcgctgtcttcaaaaaatagagaaacagatgccatattcttttataatccgaaaacagcgtcggatgattggattcgctcaagaaaaatcgtagaaagaatcggcgggcacgtttttgccatctaa

SEQ ID NO: 1861 - DNA, 630 bp, Bacillus sp.
atgacgacgaaattcactgctctggctgtttttcttctttgtttcatgcctgcagcaaaaattgaacatacacaagcttcactactgagcacaaagaagacaaaacatgaagaagcgaaatggcttacacatatagatcaagacagagacgaatctttcccttcactgtctgctgataaggaccagaaaaaaataaagccgatcaagctatcagcacacactgaaaagaaagagaaagacaagccggccaaaacaactgaaaagaaagaaacatatacacagtctgaaaaagatctgctgtcccgtctcgttcacgcagaggctaagggagaatcctataaaggcaaggtcgccgtagcaagcgttgtgctgaacagaacggagaaaaaaggttttcctgatacaattagaggggttatttatcagaaaaacgcctttgaaccggttgcaaacggaagcattaatcaaaagcctgataaagaatcgattgctgctgctgaagaagcgctgtcctcaaaaaatagagaaacagatgccatatttttttataatccgaaaacagcgtcagatgattggattcgttcaaggaaaatcatagaaaaaatcggcaggcacgtttttgccatctaa

SEQ ID NO: 1862 - DNA, 630 bp, Bacillus sp.
atgacgacgaaattcactgctctggctgtttttcttctttgtttcatgcctgcagcaaaaattgaacatacacaagcttcactactgagcacaaagaagacaaaacatgaagaagcgaaatggcttacacatatagatagagacagagatgaatctttcccttcactgtctgctgataaggaccagaaaaaaataaagccgattaagctatcagcacacactgaaaagaaagagaaagacaagccagccaaagccactgaaaagaaagagacatatacacaatctgaaaaagaattgctgtcccgtctcgttcacgcagaggctaagggagaatcctatgaaggcaaggtcgctgtagcaagcgttgtgctgaacaggacagaggaaaaaggttttcctgataccataagaggggttatttatcagaaaaacgcctttgagccggtctcgaacggaagcattaaccaaaagcctgataaagaatcgattgctgctgccgaagaagcgctgtcttcaaaaaatagggaaacagacgccatattcttttataatccgaaaacagcgtcagatgattggattcgttcaagaaaaatcgtagaaaaaatcggcaggcacgtttttgccatctaa

SEQ ID NO: 1863 - DNA, 627 bp, Bacillus sp.
atgacaacgaaattcactgctctggctgtttttcttctttgtttcatgcctgcagccaaaattgagcatacacaagcttcactactgagcgcaaagaagacaaaacatgaagaagcgaaatggcttacacatatagatcgaaatacgaatgaatctttcccttcactgtctgctgataaggacaagaaaataaaaccgattaagctatcagcacacactgaaaagaaagagaaagataaaccggacaaaacaaatgatgagaaagaaacatatacacagtctgaaaaagagttgctgtcccgtctcgttcacgcagaggccaaaggagaatcatataaaggcaaggtcgctgtagcaagcgttgtactgaacagaacggagaaaaaaggttttcctgatacgattagaggagttatctatcagaaaaacgcctttgaaccggtcgcaaacggcagcattaatcaaaagcctgacaaagaatcgattgaagctgccgaagaagcactgtcctcaaaaaatagagaaacagatgccatcttcttttataatccgaaaacagcgtcagataattggattcgttcaagaaaaatcgtcgaaaaaatcggcagacacgtttttgccgtttaa

SEQ ID NO: 1864 - DNA, 627 bp, Bacillus sp.
atgacaacgaaattcactgctctggctgtttttcttctttgtttcatgcctgcagccaaaattgagcatacacaagcttcactactgagcgcaaagaagacaaaacatgaagaagcgaaatggcttacacatatagatcgaaatacgaatgaatctttcccttcactgtctgctgataaagacaaggaaataaaaccgattaagctatcagcacacactgaaaagaaagagaaagataaaccggacaaaacaaatgatgagaaagaaacatatacacagtctgaaaaagagttgctgtcccgtctcgttcacgcagaggccaaaggagaatcatataaaggcaaggtcgctgtagcaagcgttgtactgaacaggacggagaaaaaaggttttcctgatacgataagaggagttatttatcagaaaaacgcctttgaaccggtcgcaaacgggagcattaaccaaaagcctgataaagaatcgattgaagctgccgaagaagcgctgtccaaaaaaaatagagaaacagatgccatattcttttataatccgaaaacagcgtcagataattggattcgttcaagaaaaatcgtagaaaaaatcggcagacacgtttttgccgtctaa

SEQ ID NO: 1865 - DNA, 630 bp, Bacillus sp.
atgacgacaaaattcactgctctggctgtttttcttctttgtttcatgcctgcggcaaaaattgaacatacacatgcttcactcatgagcacaaagaagataaaacatgaagaagcgaaatggctttcacatatagaacgaggtacagacggatctttcccttcactgtctgctgataaggagaagaaaaaaataaagccgatcaagctatcagcacacactgaaaagaaagaaaaagacaagccagccaaaacaactgaaaagaaagaaacatatacacagtctgaaaaagatctgctgtctcgtctcattcacgcagaagctaagggagaatcctataaaggcaaggtcgctgtagcaagcgttgtgctgaacagaacggaacaaaaagggtttcctgataccattagaggggttatttatcagaaaaacgcctttgaaccagtcgcaaacggaagcattaagcaaaaacctgataaagaatcgattgctgctgctgaagaagcgctgtcctcacaaaatagagaaacagatgccatattcttttataatccaaaaacagcgtcggatgattggattcgttcaagaaaaatcatagaaaaaatcggcgggcacatttttgccatctaa

SEQ ID NO: 1866 - DNA, 654 bp, Bacillus sp.
atgacaacgaaattcactgctctggctgtttttcttctttgtttcatgcctgcagcaaaaattgaacatacacatgcttcactaatgagcacaaagaagacaaaacatgaagaagcgaaatggcttacacatatagatcaagacagagacgaattattcccttcactgtctgctgataagaaccagaataaaataaagccgatcaagctatcagcacacaatgaaaagaaagagaaagagaaagagcaagagaaagacaaagacaagccggccaaaacaaccgaaaagaaagaaacatatacacagtctgaaaaagatctgctgtcccgtctcgttcacgcagaggctaagggagaatcctataaaggcaaggtcgccgtagcaagcgttgtgctgaacagaacggaaagaaaaggttttcctgatactataagaggggttatttatcagaaaaacgcctttgaaccggtcgcaaacggaagcattaatcaaaagcctgataaagaatcgattgctgctgccgaagaagcgctgtcctcaaaaagtagagaaacagatgccatattcttttataatccgaaaacagcgtcagatgattggattcgttcaagaaaaatcatagaaaaaatcggcaggcacgtttttgccatctaa

SEQ ID NO: 1867 - DNA, 645 bp, Bacillus sp.
atgacaacaaaatttgctgccttggctgtttttcttctatgttttatgcctgcaactaaaattgagcatgcacaagcttcacttatgctgacaaagaagacgaagcctgaagctaagcaattgcttacacatataaataacgatgaagaagaatctttcccgtcactgtctgatgataaggataagaaaaaagtaaagccgatcaagctatcagcacgcactgaaaagaaagaaaaaccaaattcaaacgagacatcatctcatcctaaagagaaagaagaaagaaaatattcccagtcggaaaaagaactgctttcccgcctcgttcatgctgaggcgaaaggtgaatcctacaaaggcaaggtcgctgtggccagcgtagtgctgaaccggacggaggagcgcggcttccctgacacaataagaggcgtcatttatcaaaaaaatgcttttgaaccggtggcaaacggaagcatcaatcaaaaggctgacaaagactcaattgaagcagcggaagaggtattgtcagataagaacagagaaacagaagccatcttcttttataatccaaagacggcatcagacgattggattcgttcaagaaaagtaattgaaagaatcggcaagcacgtttttgccatgtaa

SEQ ID NO: 1868 - DNA, 1008 bp, Salinibacillus sp.
atgaatgcaaaaagatggatcgcattagtgatcgcccttggaatttttggcgtgtccatcatcgtcagtatctcaatgagtttctttgaaagtgtcaagggtgctcaaacagaccttacgtcactgacagatgaatcccaggaagtgacgcttgaaaacggaagcctttccagcaaaattgccgttttggaggtcagcggcaccattcaggataatggtgattcaagcagtctgctcggttcagacggatataaccaccgaacattcttaaaaaatcttgagcaggcaaaagaggatgatgcggttaaagggatcgtactcaaggtaaactctccgggaggcggagtgtatgaaagtgccgaaatacataaaaaactggaagaagtaaaaaaagcaacaaaaaaaccaatctatgtgtcaatgggatcgatggcagcttccggaggttattatatctcaacagctgccgataaaatttttgcgacaccggaaaccctgacaggatctcttggggttatcatggagagcgtgaattactcaaagctggctgataagctcggcatctcttttgagaccattaaaagcggggctcacaaggatattatgtctccttcccgtgagatgacaaaagaagaaaaaaatattatgcaatctatggttgataactcctatgaaggctttgtcgatgtcatttcagaaggccgcggcatatcgaaagcggaagtaaagaaaatcgcggacggacgcgtgtatgacgggcggcaggcgaaaaaactgaatcttgtggatgaaatcggattttatgatgatacaattgcggccatgaaaaaagatcataaaaacttgaaaaacgcttctgtcgtctcttacgaggaaagcttcggattaggctctctgtttaccatgggagcgaacaaaatgtttaaaagtgaaattgattttctgaatatgagagaagttctttcacaatccggttcgccgagaatgatgtatctctatgcgaagtag

SEQ ID NO: 1869 - DNA, 1008 bp, Bacillus sp.
atgaatgcaaaaagatggatcgcattagtgatcgcccttggaatttttggcgtgtccatcatcgtcagtatctcaatgagtttctttgaaagtgttaagggtgctcaaacagaccttacgtcactgacagatgaatcccaggaagtgacgcttgaaaacggaagcctttccagcaaaatcgctgttttggaggtcagcggcaccattcaggataatggtgattcaagcagtctgctcggttcagaagggtataaccaccgaacattcttgaaaaaccttgagcaggcaaaagaagatggtgcggttaaagggatcgtactcaaggtaaactctccgggaggcggagtgtatgaaagtgccgaaatacataaaaaactggaagaagtaaaaaaagaaacaaaaaaaccaatctatgtgtcaatgggatcgatggcagcttccggcgggtattatatctcaacagctgcggataaaatttttgcgacaccggaaaccctgacaggatctcttggggttatcatggaaagcgtgaattactcaaagctggctgataagctcggcatctcttttgagaccattaaaagcggggctcacaaggatattatgtctccttcccgtgagatgacaaaagaagaaaaaaatatcatgcaatctatggttgataactcttatgaaggctttgtcgatgtcatttcagaaggccgcggcctatcgaaaacacaggtaaagaaaattgcggacggacgcgtgtatgacgggcggcaggcgaaaaaactgaaccttgtggatgaacttggattttatgatgatacaattgcggccatgaaaaaggaccataaaaacttgaaaaacgcttctgtcgtctcttacgaggaaagcttcggattaggctctctgttttccatgggagcgaacaagatgtttaaaagtgaaattgattttctgaatatgagagaagttctttcacaatccggttcgccgagaatgatgtatctctatgcgaagtag

SEQ ID NO: 1870 - DNA, 1008 bp, Bacillus sp.
atgaatgcaaaaagatggatcgcattagtgatagctctggggattttcggcgtgtctattatcgtcagcatctctatgagtttctttgaaagcgtcaaaggcgctcaaacggatcttacatcattgacggatgaatcgcaggaaaagacgctggaaaacggcagtctctcaagtaaaattgccgtattagaggtcagcggcaccatccaggataatggggattcaagcagtctgcttggtgcagacggatataaccacagaacgttcttaaaaaaccttgagcgcgcaaaagatgacaagacggtcaaaggtatcgttctgaaggtgaattctccgggcggcggagtatatgaaagtgctgaaatacataagaagctggaagaaatcaagaaagaaacaaaaaaaccgatttatgtgtcgatgggatcgatggcggcatccggcggctattacatctcaacggcggctgataagatttttgcgacaccggaaaccctgaccgggtcactcggcgtcattatggaaagcgtcaattattcaaagcttgccgataagctcggcatttcttttgaaacaattaagagcggggctcacaaggacattatgtctccttctcgtgagatgacgaaagaagaaaaaaacatcatgcaatcgatggttgataattcgtatgagggctttgttgatgttatttcaaaaggccgcggcatttcgaaagcagaggtaaagaaaattgcggacggccgcgtgtatgacgggcgtcaggcgaaaaaactgaatctcgttgatgagcttggtttttatgatgacactatttcggcgatgaaaaaggatcacaaggatttgaaaaacgcctctgtcatttcttatgaggaaagcttcggattaggctcattgttttccatgggcgcgaacaaaatgtttaaaagtgaaattgattttttaaatatgagagaaatgctttcgcaatccggttcgccgagaatgatgtatctctatgcgaagtag

SEQ ID NO: 1871 - DNA, 1008 bp, Bacillus sp.
atgaatgcaaaaagatggattgcattagtgattgctctggggattttcggcgtgtctattatcgtcagcatctctatgagtttctttgaaagcgtcaaaggcgctcaaacggatctcacatcactgacagatgaatcgcaggaaaagacgctggaaaacggcagtctctcaagtaaaattgccgtattagaggtcagcggcaccattcaggataatggggactcaagcagtctgcttggtgcagacggatataaccacagaacgttcttaaaaaaccttgagcgcgcaaaagatgacaagacggtcaaaggtatcgttctgaaggtgaattctccgggtggcggagtgtatgaaagtgctgaaatacataagaaactggaagaaatcaagaaagaaacgaaaaaaccgatttacgtgtcaatgggttcgatggcagcatcaggaggctattacatctcaacagcggctgataagatttttgcgacaccggaaaccctgaccgggtcactcggcgtcattatggaaagcgtcaattattcaaagcttgccgacaagcttggcatttcttttgaaacgattaagagcggggcccataaggacattatgtctccttcccgtgagatgacgaaagaagaaaaaaacatcatgcaatcgatggttgataattcgtatgaaggctttgttgatgtcatttcaaaagggcgcagcatgccgaaagcagaggtaaagaaaattgcggacggccgcgtgtatgacggacggcaggcgaaaaaactgaacctcgttgatgagcttggtttttatgacgataccattacggccatgaaaaaggatcacaaggatttgaaaaacgcctctgtcatttcttatgaggaaagcttcggattaggctcactgttttccatgggcgcgaacaaaatgtttaaaagtgagattgattttttgaatatgagagaaattctatcgcaatccggttcgccgaggatgatgtatctctatgcgaagtag

SEQ ID NO: 1872 - DNA, 1008 bp, Bacillus sp.
atgaatgcaaaaagatggattgcattagtgattgctctggggattttcggcgtgtctattatcgtcagcatctctatgagtttctttgaaagcgtcaaaggcgctcaaacggatctcacatcactgacggatgaatcgcaggaaaaaacgctggaaaacggcagtctctcaagtaaaattgccgtattagaggtcagcggcaccattcaggataatggggactcaagcagtctgcttggtgcagacggatataaccacagaatgttcttaaaaaaccttgagcgcgcaaaagatgacaagacggtcaaaggtatcgttctgaaggtgaattctccgggtggcggagtgtatgaaagtgctgaaatacataagaaactggaagaaatcaagaaagaaacgaaaaaaccgatttacgtgtcaatgggttcgatggcagcatccggaggctattacatctctacagcggctgataagatttttgcgacaccggaaaccctgacagggtcactcggcgtcattatggaaagcgtcaattattcaaagcttgccgataagcttggcatttcttttgaaacgattaagagtggggcccataaggacattatgtctccttcccgtgagatgacgaaagaagaaaaaaacatcatgcaatcgatggttgataattcgtatgaaggctttgttgatgtcatttcaaaagggcgcggcatgccgaaagcagaggtaaagaaaattgcggacggccgcgtgtatgacggacggcaggcgaaaaaactgaacctcgttgatgagcttggtttttatgacgataccgttacggccatgaaaaaggatcacaaggatttgaaaaacgcctctgtcatttcttatgaggaaagcttcggattaggttcactgttttccatgggcgcgaacaaaatgtttaaaagtgaaattgattttttgaatatgagagaaattctatcgcaatacggttcgccgagaatgatgtatctctatgcgaagtag

SEQ ID NO: 1873 - DNA, 1005 bp, Bacillus sp.
atgaatgcaaaacgatggattgcattggtgattgcgcttgggattttcggcgtttcattaattgcgagtcttacaatcgctttctttgaaaatttcagcggcaacacggatattacgtcactgaacgatgaatcacaagaagtcacgctggaagatggaaacctctccagtaaaatcgctgtactcgaagtcagcggaacgattcaagacaatggggattcaagcagtctgctcggttcagacggctataatcacagaacgttcttgaaaaaccttgaacaggccaaagaagacaagaccgttaaaggaattgttctgaaagtgaactctcccggcggcggcgtctacgaaagtgccgaaatacataaaaagcttgaagagattaaaaaagaaacaaagaaaccgatctatgtatcaatgggttcaatggcagcttccggggggtattatatctcagcggacgcagataagatttacgcatcaccggaaacgattaccggttctctcggagttattatggaaagtgttaactattcgaagctggccgatgagctcggcatcaaatttgaaacgattaaaagcggtgctcacaaggacatcatgtctgccactcgtgacatgacagatgaagaaaagaaaatcatgcaatctatggttgataattcttacgaaggttttgtagatgtcatttcgaaggggagaaacatgtctgaagcggaagtgaaaaaaatcgccgacggacgtgtttatgatggcaaacaagcgaagaaattgaatctcgttgatgagcttggcttttatgatgatacgattgctgcaatgaaaaaagatcataaaaatctgaaagacgcatctgttgtcacctatgaggaaagcttcggcttaggttctctcttttcgatgggggcgaacaaaatgtttaagagcgaaattgattttctgaatatgaaggaattaatttcacaatccagctcgccgagaatgatgtatctctatgcgaagtag

SEQ ID NO: 1874 - DNA, 1005 bp, Bacillus sp.
atgaatgcaaaacgatggattgcattggtgattgcgcttgggattttcggcgtttcattaattgcgagtcttacaatcgctttctttgaaaatttcagcggcaacacggatattacgtcgctgaacgatgaatcacaagaagtcacgctggaagacggaaacctctccagtaaaatcgctgtactcgaagtcagcggaacgattcaagacaatggggattcaagcagtctgctcggttcagacggctataatcacagaacgttcttgaaaaaccttgaacaggccaaagatgacaagaccgttaaaggaattgttctgaaagtgaactctcccggcggcggcgtctacgaaagtgccgaaatacataaaaagcttgaagagattaaaaaagaaacaaagaaaccgatctatgtatcaatgggttcaatggcagcttccggggggtattatatctcagcggacgcagataagatttacgcatcaccggaaacgatcaccggttctctcggagttattatggaaagtgttaactattcgaagctggccgatgagctcggcatcaaatttgaaacaattaaaagcggtgctcacaaggacatcatgtctgccactcgtgacatgacagatgaagaaaagaaaatcatgcaatctatggttgataattcttacgaaggttttgtagatgtcatttcgaaggggagaaacatgtctgaagcggaagtgaaaaaaatcgccgacggacgtgtttatgatggcaaacaagcgaagaaattgaatctcgttgatgagcttggcttttatgatgatacgattgctgcaatgaaaaaagatcatacaaatctgaaagacgcatctgttgtcacctatgaggaaagcttcggcttaggttctctcttttcgatgggggcgaacaaaatgtttaagagcgaaattgactttctgaatatgaaggaattaatttcacaatccagctcgccgagaatgatgtatctctatgcgaagtag

SEQ ID NO: 1875 - DNA, 1008 bp, Bacillus sp.
atgaatgcaaaaagatggattgcgctcgtcatcgcgctcggcattttcggcgtatcagtcattgcaagtgtgaccgtcggggtgctgaagaatatcggagatacagggtctgactttgcatcactgacagatgacacagaggaagtgacgctggataagggcagccccggcagtaaaatcgccgtgcttgaagtggacggcacgattgaggataacggcgggtccgctggcctgctcagctcaggcgggtatgatcacagattatttttaaaacaggttgagcgtgcgaaagaagacaaaagcgtcaaaggaattgtgctgaaaatcaattcccctggcggaggcgtgtacgaaagcgcggaaatacataaaaaactggaagaactaaagaaagaaaccaagaaaccgatttatgtatccatgggctccatggcggcatcgggaggctactatatttcaacggccgccgataaaatctatgcttcaccggaaacgctcacgggttcactgggcgtcatcatggaaagcgtcaattattccaagctcgccgatgaactcggcatcaagtttgaaaccattaaaagcggcgcgcataaagacatcatgtccccgacccgcgacatgacgaaggaagaaagaaagatcatgcagacaatggtcaacgattcttatgaaggatttgtcaatgtcatttcaaaaggccggcacatgtcaaaagcggatgtgaaaaaaattgccgacggccgtgtttacgacggcagacaagcgaaaaaaatcggcctcgttgatgagctcggtttttacgatgatacgatcagcgcgatgaaaaaggaccataaaaatatgaaaaacgcttcagtcatcacatacgaggaaggattcggattaggctcgctcttttccatgagcgcagcgaaaatgtttaaaagcgaaattgattttctgaatatgaaagaactcatttcgcaatccggttcgccgcggatgatgtatctctatgcaaagtag

SEQ ID NO: 1876 - DNA, 1008 bp, Bacillus sp.
atgaatgcaaaaagatggattgcgctcgtcatcgcgctcggcattttcggcgtatcagtcattgcaagtgtgaccgtcggggtgctgaagaatatcggagatacagggtctgactttgcatcactgacagatgacacagaggaagtgacgctggataagggcagccccggcagtaaaatcgccgtgcttgaagtggacggcacgattgaggataacggcgggtccgctggcctgctcagctcaggcggatatgatcacagatcatttttaaaacaggttgagcgtgcgaaagaagacaaaagcgtcaaaggaattgtgctgaaaatcaattcccctggcggaggcgtgtacgaaagcgcggaaatacataaaaaactggaagaactaaagaaagaaacgaagaaaccgatttatgtatccatgggctccatggcggcatcgggaggctactatatttcaacggccgccgataaaatctatgcttcaccggaaacgctcacgggttcactgggcgtcatcatggaaagcgtcaattattccaagctcgccgatgaactcggcatcaagtttgaaaccattaaaagcggcgcgcataaagacattatgtccccgacccgcgacatgacgaaggaagaaagaaagatcatgcagacaatggtcaacgattcttatgaaggatttgtcaatgtcatttcaaaaggccggcacatgtcaaaatccgacgtgaaaaaaattgccgacggccgtgtctacgacggcagacaagcgaaaaaaatcggcctcgttgatgagctcggtttttacgatgatacgatcagtgcgatgaaaaaggaccataaaaatatgaaaaacgcttcagtcatcacatacgaggaaggattcggattaggctcgctcttttccatgagcgcagcgaaaatgtttaaaagcgaagttgattttctgaatatgaaagaactcatttcgcaatccggttcgccgcggatgatgtatctctatgcaaagtag

SEQ ID NO: 1877 - DNA, 1008 bp, Bacillus sp.
atgaatcccaaacgatgggtagcgctcgtgattgcattggccatttttggctgctctctgatcatgagccttgttttagcggtgtttgaaaatttcggagaggacagtaagatgcagcttggactaagcgacggacaggaagaaacggtattggaacatgggagcggttcaagcaaaatcgccgtccttgaagttgacggaacaattgccgacaacggcgatggcggaagcctgctcggttctgacggatacaatcacagatcatttttgaaaatgctcgaaagggccaaagatgattccgcagtaaaaggaattgtattgcgcgtgaattctccgggaggcggagtatacgaaagcgctgaaatacataagaaactcgaagaaatcaaaaaagaaacgaaaaagccgatttatgtttcaatggggtcaatggcggcatctggaggctactatatttcaacggttgccgacaaaattttcgcggcgccggatacgctgacaggttctctcggggtcattatggaaagcatgaattacggcaagcttgctgaaaaattgggcctgaaaactgaaacaattaaaagtggtgaatataaagacattatgtccccgacgcgcggcatgacgaaaaaggaacgggagatcatgcaggccatggtcgatgattcctacgaaggcttcgttgacgttatttcagaagggcgccatatgtccaaagccgatgtcaagaaaatcgctgatggacgggtgtatgacgggcgccaggctaaaaaaatccatttggttgatgaactcggctactacgaagatacggtaaaagcgttgaaaaaagaccataaaaatttggatggtgcatctgtagtcacctataaagaatcaacaggcctgtcgtctttcctttcaatgagcgcaaacaaaatatttaagagcgaagcggactttttgaatattaaggaagcaatttcacaatccggcgcaccaagattgatgtatctttacgccaaatag

SEQ ID NO: 1878 - DNA, 1008 bp, Bacillus sp.
atgaatcctaaaagatggatcgcgcttgtaatcgcattggggattttcgggttttctgcggttataagtcttgtgctgtctgtatttgacagctttggcgaggacggcaagatgcagtttggactcaatgacacacaggaggaaacggtgcttgaacaaggcagctcatcaagcaaaatcgccgtgcttgaagtgaatggaacaatcgccgataatgggggtgcttcaagcctgctcgggtctgatgggtataatcacagagcattcttaaaaacgcttgaaaaagcaaaggatgattccgcggtaaaagggattattttgcgcgtcaattctccgggaggcggagtatacgaaagcgctgagatacataagaagcttgaagaaatcaaaaaggaaacgaaaaagccgatctacgtttccatggggtctatggctgcatcaggcggctattatatttcaacggcagccgataaaatttacgcagcccccgatacgctcacaggctctctcggggttattatggaaagcctgaactacagcggacttgcggaaaaactcggactgaaaaccgaaacgattaaaagcggagaatttaaagacatcatgtctccgactcgcgacatgacgaaaaaagaacgggaaatcatgcagggcatggtcgatgatgcatacgaaggatttgtagatgtcatcgctgacggacgccatatgtcggaaagcgatgtgaagaaaatcgccgacggccgtgtttacgacggacgccaggcgaagaagatcaatctcgttgatgaactcggctactatgaagatgtggtgaaagcgatgaaaaaagaccataaaagcatggcgggcgcatccgttgtcagctataaagaatcaacaggcctctcatcgcttttatctatgagcgccaacaaaatctttaaaagcgaagtggacttcttaaacattaaagaagcgatttcgcaagcaggcgcaccgagagcgatgtatttatacgctaaatag

SEQ ID NO: 1879 - DNA, 1008 bp, Bacillus sp.
atgaatgcgaaaagatggatcgcacttgtcatcgcgctgggcgtttttgcgttatctgcggtggtgagccttttgctagcagtatttgacacgatggggaatgacggaaagatgcagtttggccttaatgacacccaggaagaaacggtgcttgaagaaggaaacagctcaagaaaaatcgccgtgcttgaagtgaacggaacgatttccgacaatggcggcgcttctggcttgttcagctctgaaggctataaccacagatcgtttttgcaaatgcttgaaaaagcaaaagacgactctgctgtaaagggcattattctgcgcgtcaattctccgggtggcggagtatacgaaagcgccgaaatacataagaagcttgaagagatcaaaaaagatacgaaaaaaccgatttacgtatcaatgggctcgatggctgcatctggaggctattacatttcaacgcctgccgacaaaatctttgcagcgccggacacgctgacgggttcactaggggtcatcatggaaagccttaactacagcaagcttgcagaaaagcttggattgaaaacggaaacgatcaaaagcggtgagtttaaagacatcatgtcaccgacgcgcgatatgacgaaaaaagaaagagaaatcatgcagtcaatggtcgatgacgcgtacgaaggatttgtcgatgttatagccgacggacgcagcatgtccgaaaatgacgtgaaaaaaattgccgacggacgcgtttatgacggccgccaggcgaaacagaaccatctcattgatgagctcggctactatgaggatgcggtcaaagcgatgaaaaaagaccacaaaaaccttgccggagcgtctgttgtcagctatgaagaatcggccggccttgcgtcgctcttttcgatgactgcaaataagatgtttaaaagcgaagccgatttcttaaacattaaagaagcaatttctcaatccggcgcaccgagactcatgtatttatacgctaaatag

SEQ ID NO: 1880 - DNA, 1002 bp, Bacillus sp.
atgaatgcgaaaagatgggtagcgctaattattgcacttggtgttttcggattttcaattgtgattagtgtcacgatggccttgttcgatagcttcaatgacaataaaatgagctatcaattcggggatgaaatagaagagaaggtactagagaatggcagcggtgcaggcaagattgctgttcttgagattaatggaaccattcaagataatggcggtgcatcgagcctattaggcggagaaggttatgatcatcgtgcattcctcaaggaactagataaggcgaaagaggatgcttctgtaaaaggtgtacttctgcgcgtaaactctcctggcggcggtgtctatgaaagtgctgaaatacataaaaaattagaagaagtgaaaaaagcgaagaagccgatttacgtatctatgggttcaatggcagcttctggcggctactacgtgtcaactccagcgaagaaaatctttgcttcacctgaaacattaacagggtcgttaggggtcatcatgcaaagcttgaattattctaagctcgcagataatctgggtattaaatatgaaacgattaagagcgggaaattcaaagatatcatgtctccaaaccgtgatatgacaaaagatgagcgcaacatcatgcaaagcatggtcgataactcttatgaaggatttgtcaaagtaatctcggaaggacgcggcatgtcaaaacaggaagtcaagaaaattgccgacggccgggtatatgacgggacacaggcaaaatcgaacggattagtcgatgagcttgggtattatgaagatgcattaaaagcgatgaagaaaaatgaaaaaggcttaaaaggagcaacagtggtcagctattctcaaagctttggctggaactctctcttcaacatgagtgcaagcaagctctttaaaagcgaaattgattttctgaatttaaaagaaacactggctggctcaaatgggtctaaaccgatgtatctctattcaaaataa

SEQ ID NO: 1881 - DNA, 1002 bp, Bacillus sp.
atgaatgcgaaaagatgggtagcactaattattgcacttggtgttttcggattttcaattgtaattagtgtcacgatggccttgttcgatagcttcaatgacaataaaatgagctatcaattcggggatgaaatagaagagaaggtactagagaatggcagcggtgcaggcaagattgctgttcttgagattaatggaaccattcaagataatggcggcgcatcgagcctattaggcggagaaggttatgatcatcgtgcattcctcaaagaactagataaagcgaaagaggatgcttctgtaaaaggtgtacttctgcgcgtaaactctcctggcggcggtgtctatgaaagtgctgaaatacataaaaaattagaagaagtgaaaaaagcgaagaagccgatttacgtatctatgggatccatggcagcttcaggcggctactacgtgtcaactccagcgaagaaaatctttgcttcacctgaaacattaacaggatcgttaggtgtcatcatgcaaagcttgaattattcaaagctcgcagataatctgggtattaaatatgaaacgattaagagcgggaaattcaaagatatcatgtctccaaaccgtgatatgacaaaagatgagcgcaacatcatgcaaagcatggtcgacaactcttatgaaggatttgtcaaagtgatctctgaaggacgcggcatgtcaaaacaggaagtcaagaaaatcgctgacggccgggtatatgacgggacacaggcaaaatcgaacggattagtcgatgagcttgggtattatgaagatgcattaaaagtgatgaagaaaaatgaaaaaggcttaaaaggagcaacagtggtcagctattctcaaagctttggctggaactctcttttcaacatgagtgcaagcaagctctttaaaagcgaaattgattttctgaatttaaaagaaacactggctggctcaaatgggtctaaaccgatgtatctctattcaaaataa

SEQ ID NO: 1882 - DNA, 1623 bp, Salinibacillus sp.
ttgcgtacactgttcaaaacatctctgttcatggccggcttatgcacggcggctcaatgtgtttttgcatcaaatgcctcagcagatcaaagcatcaaatacgaccatacgtatcaaaccccttcatacatcatcgaaaaatcacagccatcatggcagccagctcaaaacctaacgcagaaagaagcgctattttcatatctggacaagcaacaaacccattttaagctcaaaggaaacgcgaacagccattttcgcatttcaaaaacaattaaggattcaaagacaaaacaaacattttttaaattagaggaagtgtataaagggattcctgtttacggttttggacaggcggtcgcgatgaaggaaaacaaacaagtgaaaagtttcttcgggaaggtgcacccgcaaataaatgacatatctgtcacaccgtctgtatctaagaaaaaagccatacatacagcgcgccgtgcgcttgaggcctccattggaaaaatcgagtatgttgacggagaaccgaaagccgaattatatatttatccgcacgaaggcgcatatgatcttgcctaccttgtgagactttcgacgtctgaacctgaacctggatattggcattatttcatcaatgccaaaagcggaaaggtcattgatactttcaatgccattcatgaagcagccggtacagggatcggcgtatcaggcgaagaaaaaagctttgaagtaactgaacagaatgggcgttattatttggctgacgaaacaaggggaaaagggataaatacttttgacgcaaagaacctgaacgaaaccttgtttacccttttgtctcaattgatcgggtatacaggcagtgaagtggtcagcggcacgtccgtatttcatgatccggcggctgtagatgcccatgcaaacgcacaaaccgtttacgactattacagccgcacgttcggccgccattcttttgatcaaaacggagcgagaattacgtctaccgtacatgtgggaacacagtggaacaatgcggcgtggaacggtgtgcagatggtgtacggggatggtgacggcgctaggtttaagccgctgtccggatcgctcgacattgtggcgcatgaaatgacacacgcggtcacccagtattccgccggccttttatatcagggagaacccggcgcgctaaacgaatccatttctgacattatggcggcgatgacagaccgggatgactgggaaatcggcgaggatgtatatacgccgtatgtacgaggggatgctttacgttcgttagaggacccttccaagcaggggaatccggatcattattcaaaccggtatacgggcacagaggattacggcggggtgcacatcaattcgtcgatccacaataaagcggcatatcttctcgcagaaggcggcgtgcaccatgatgtgcgggttgaaggggtcgggcgtgaagcttgtgagcaaatttattaccgggctttgacatattatgtaacgccttcttcagacttcagcatgatgaagcaagcggctatcgaagccgccaatgatttatacggtgaagactcaaagcaatcagcttctgtcgaaaaggcatatgacgcagtcggaattcaataa

SEQ ID NO: 1883 - DNA, 1623 bp, Bacillus sp.
ttgcctacactgttcaagacatctctattcatggccggcttatgcacggcggctcaatgtgtttttgcatcaaatgcctcagcagatcaaagcatcaaatacgaccatacgtatcaaaccccttcatacatcatcgaaaaatcacagccatcatggcagccagctcaaaacctaacgcagaaagaagcgctattttcatatctggacaagcaccaaacgcattttaagctcaaaggaaatgcaaacagccattttcgcatttcgaaaaccataaaggatccaaagacagaacaaacatttttaaaattagaggaagtgtataaaggaattcctgtttacggctttggacaggcggtcgcgatgaaggaaaacaaacaagtgaaaagtttcttcgggaaggtgcacccgcaactaaatgacatatctgtcacaccgtctgtatccaagaaaaaagctatacatacagcgcgccgtgcgcttgaggcatctattggaaaaatcgagtatgttgacggggaaccgaaagccgaattatatatttatccgcacgaaggcgcatatgatcttgcctaccttgtaagactttcgacgtctgaacctgagcctggatattggcattatttcattcatgccaaaagcggaaaggtcattgattctttcaatgccattcatgaagcagcaggtacaggaattggcgtatcaggcgaagaaaaaagctttgaagtaactgaacagaatgggcgttattatttggctgatgaaacaaggggaaaagggataaatacttttgacgcaaagaacctgaacgaaaccttatttacccttttgtctcaattgatcgggtatacaggcaaagaagtggtcagcggcacgtccgtatttaaagacccggcggctgtagatgcccatgcaaacgcgcaaacggtttacgactattacagccgcacgtttggccgccattccttcgatcaaaacggagcaagaattacgtctaccgtacatgtgggaaaacagtggaacaatgcggcgtggaacggtgtgcagatggtgtacggggatggtgacggcgcaaagtttaagccgctttccggatcgctcgacattgtggcgcatgaaatgacacacgcggtcacccagtattccgccggccttttatatcagggagaacccggcgcgttaaacgaatccatttctgatattatggcggcgatgacagaccgggatgactgggaaatcggcgaggatgtatatacgccggatgtacgcggggatgctttacgttcgttagcggatccttccaagcaggggaatccggatcattattcaaaccgttatacaggcacagaggattacggcggggtgcatatcaattcgtcgatccacaataaagcggcatatcttctcgcggaaggcggcgtgcaccatgatgtgcgggtagaggggatcggacgtgaagcttgtgagcaaatttattatcgggctttgacatattacgtcacgccttcttcagacttcagcatgatgaggcaagcggcaatcgaagctgccaaggatttatacggtgaaggctcgaagcaatcagcttctgtcgaaaaggcatatgacgcagtcggaatccaataa

SEQ ID NO: 1884 - DNA, 1593 bp, Bacillus sp.
atggccggcttatgcacggcggctcaatgtgtttttgcatcaaatgcctcagcagatcaaagcatcaaatacgaccatacgtatcaaaccccttcatacatcatcgaaaaatcacagccatcatggcagccagctcaaaacctaacgcagaaagaagcgctattttcatatctggacaagcaccaaacgcattttaagctcaaaggaaatgcaaacagccattttcgcatttcgaaaaccataaaggatccaaagacagaacaaacatttttaaaattagaggaagtgtataaaggaattcctgtttacggctttggacaggcggtcgcgatgaaggaaaacaaacaagtgaaaagtttcttcgggaaggtgcacccgcaactaaatgacatatctgtcacaccgtctgtatccaagaaaaaagctatacatacagcgcgccgtgcgcttgaggcatctattggaaaaatcgagtatgttgacggggaaccgaaagccgaattatatatttatccgcacgaaggcgcatatgatcttgcctaccttgtaagactttcgacgtctgaacctgagcctggatattggcattatttcattcatgccaaaagcggaaaggtcattgattctttcaatgccattcatgaagcagcaggtacaggaattggcgtatcaggcgaagaaaaaagctttgaagtaactgaacagaatgggcgttattatttggctgatgaaacaaggggaaaagggataaatacttttgacgcaaagaacctgaacgaaaccttatttacccttttgtctcaattgatcgggtatacaggcaaagaagtggtcagcggcacgtccgtatttaaagacccggcggctgtagatgcccatgcaaacgcgcaaacggtttacgactattacagccgcacgtttggccgccattccttcgatcaaaacggagcaagaattacgtctaccgtacatgtgggaaaacagtggaacaatgcggcgtggaacggtgtgcagatggtgtacggggatggtgacggcgcaaagtttaagccgctttccggatcgctcgacattgtggcgcatgaaatgacacacgcggtcacccagtattccgccggccttttatatcagggagaacccggcgcgttaaacgaatccatttctgatattatggcggcgatgacagaccgggatgactgggaaatcggcgaggatgtatatacgccggatgtacgcggggatgctttacgttcgttagcggatccttccaagcaggggaatccggatcattattcaaaccgttatacaggcacagaggattacggcggggtgcatatcaattcgtcgatccacaataaagcggcatatcttctcgcggaaggcggcgtgcaccatgatgtgcgggtagaggggatcggacgtgaagcttgtgagcaaatttattatcgggctttgacatattacgtcacgccttcttcagacttcagcatgatgaggcaagcggcaatcgaagctgccaaggatttatacggtgaaggctcgaagcaatcagcttctgtcgaaaaggcatatgacgcagtcggaatccaataa

SEQ ID NO: 1885 - DNA, 1593 bp, Bacillus sp.
atggccggcttatgcacggcggctcaatgtgtttttgcatcaaatgcctcagcagatcaaagcatcaaatacgaccatacgtatcaaacccctttatacatcatcgaaaaatcacagccatcatggcagccagctcaaaacctaacgcagaaagaagcgctattttcatatctggacaagcaccaaacgcattttaagctcaaaggaaatgcgagcagccattttcgcatttcgaaaaccacaaaggatccaaagacaaaacaaacgttttttaaattagaggaagtgtataaaggaattcctgtttatggctttggacaggcggtggcgatgaaggaaaacaaacaagtgaaaagtttcttcgggaaggtgcacccgcaactaaatgacatatctgtcacaccgtctgtatccaagaaaaaagccatacatacagcgcgccgtacgcttgaggcatctattggaaaaatcgagtatgttgacggggaaccgaaagccgtattatttatttatccgcacgaaggtgcatatgatcttgcctaccttgtaagactttcgacgtctgaacctgagcctggatattggcattatttcattcatgccaaaagcggaaaggtcattgattctttcaatgccattcatgaagcagccggtacaggaatcggcgtatcaggcgaagaaaaaagctttgaagtaactgaacagaatgggcgttattatttggctgatgaaacaaggggaaaagggataaatacttttgacgcaaagaacctgaacgaaaccttatttacccttttgtctcaattgatcgggtatacaggcaaagaagtggtcagcggcacgtccgtatttaaagacccggcggctgtagatgcccatgcaaacgcgcaaacggtttacgactattacagcagcacgtttggccgccattccttcgatcaaaacggagcaagaattacgtctaccgtacatgtgggaaaacagtggaataatgcggcgtggaacggtgtgcagatggtatacggggatggtgacggcgcaaagtttaagccgctttccggatcgctcgacattgtggcgcatgaaatgacacacgcggtcacccagtattctgccggccttttatatcagggagaacccggcgcgttaaacgaatccatttctgatattatggcggcgatgacagaccgggatgactgggaaatcggcgaggatgtatatacgccggatatacgtggggatgctttacgttcgttagcggacccttccaagcaggggaatccggatcattattcaaaccgttatacaggcacagaggattacggcggggtgcatatcaattcgtcgatccacaataaagcggcatatcttctcgcggaaggcggcgtgcaccatgatgtgcgggtagaggggatcgggcgtgaagcttgtgagcaaatttattatcgggctttgacatattacgtcacgccttcttcagacttcagcatgatgaggcaagcggcaatcgaagctgccaaggatttatacggtgaagactcgaagcaatcagcttctgccgaaaaggcatatgacgcagtcggaatccaataa

SEQ ID NO: 1886 - DNA, 1617 bp, Bacillus sp.
ttgcgcaacctgaccaagacatctctattactggccggcttatgcacggcggcccaaatggtttttgtaacacatgcctcagctgatcaaagcatcaaatacgaccatacgtatcaaaccccttcatacatcatcgaaaagtcatcgcagaagccggtacaaaacacaacccagaaagaatcgctattttcctatcttgacaagcatcaaacgcagtttaagctcaaagggaatgcgaacagtcattttcgcatttcgaaaaccataaaggatccaaaaacaaaacaaacgttttttaaattaacggaggtttacaaaggaattccgatttacggctttgaacaagcggtcgcgatgaaggaaaacaaacaagtgaaaagtttctttggaaaggtgcatccgcaaatcaaggacgtctccatcacaccgtctatttctgagaaaaaagcaatacatacagcaaggcgtgagctcgaggcttccattggaaaaatcgaatatcttgatggggaaccaaaaggcgaattatatatctatccacacgacggtgaatatgatctcgcctaccttgtgagactctcgacatctgaacctgatcctggctattggcattatttcatcgatgccaaaaacggaaaggtcattgagtcctttaatgccattcatgaagcggcaggtacaggaatcggcgtatcaggtgatgaaaaaagctttgacgtcacagaacaaaatgggcgcttttatttggctgacgaaacaaggggaaaagggatcaatacatttgacgcgaagaacctgaacgaaaccttgtttacgcttttgtctcaactaatcgggtatacgggcaaagaaatagtcagcggcacgtccgtatttaatgaacctgcggctgtagacgcacacgcaaatgcgcaagccgtttacgattattacagcaagacatttggccgtgattcttttgatcaaaacggagcaaggattacgtctaccgtgcatgtcggcaaacaatggaacaatgctgcgtggaacggtgtccagatggtatacggggatggagacggttcgaaatttaagccgctgtctggatcgctcgacattgtcgcgcatgaaatcacacacgcagtcacacagtattccgccggtcttttatatcaaggagaacccggtgcattaaatgagtccatttctgacattatgggcgcgatggctgaccgtgatgattgggagatcggcgaagatgtctatactcctggtattgcaggagattcattgcggtcattggaggacccatctaagcagggaaatccagatcattactcgaaccgctacacaggaacagaggattatggcggagtccatatcaattcgtccattcacaataaagcagcttatcttcttgcagaaggaggcgtgcaccacggtgtacaggttgaagggattgggcgtgaagcaagtgaacaaatttactatcgggctttaacatattatgtaacggcatctacagatttcagcatgatgaagcaagcggcgattgaagctgccaatgatttatacggtgaaggctcgaagcaatcagcttcagtcgaaaaggcgtatgaggctgtcggaattctatga

SEQ ID NO: 1887 - DNA, 1617 bp, Bacillus sp.
ttgcgcaacctgaccaagacatctctattactggccggcttatgcacggcggcccaaatggtttttgtaacacatgcctcagctgatcaaagcatcaaatacgaccatacgtatcaaaccccttcatacatcatcgaaaagtcaccgcagaagccggtacaaaacacaacccagaaagaatcgctattttcctatcttgacaagcatcaaacgcagtttaagctcaaagggaatgcgaacagccattttcgtgtttcgaaaaccataaaggatccaaagacaaaacaaacgttttttaaattaacggaggtttacaaaggaattccgatttacggctttgaacaagcggtcgcgatgaaggaaaacaaacaagtgaaaagtttctttggaaaggtgcatccgcaaatcaaggacgtctccatcacaccgtctatttctgagaaaaaagcaatacatgcagcaaggcgtgagctcgaggcttccattggaaaaatcgaatatcttgatggggaaccaaaaggcgaattatatatctatccacacgacggtgaatatgatctcgcctaccttgtgagactctcgacatctgaacctgagcctggctattggcattatttcatcgatgccaaaaacggaaaggtcattgagtcctttaatgccattcatgaaacggcaggtacaggaatcggcgtatcaggtgatgaaaaaagctttgacgtcagagaacaaaatgggcgcttttatttggctgacgaaacaaggggaaaagggatcaatacatttgatgcgaagaacctgaacgaaaccttgtttacgcttttgtctcaactgatcgggtatacgggcaaagaaatagtcagcagcacgtccgtatttaatgaacctgcggctgtagacgcacacgcaaatgcgcaagccgtttacgattattacagcaagacatttggccgtgattcttttgatcaaaacggagcaaggattacgtctaccgtgcatgtcggcaaacaatggaacaatgctgcgtggaacggtgtccagatggtatacggggatggagacggttcgaaatttaagccgctgtctggatcgctcgacattgtcgcgcatgaaatcacacacgcagtcacacagtattccgccggtcttttatatcaaggagaacccggtgcattaaatgagtccatttctgacattatgggcgcgatggctgaccgtgatgattgggagatcggcgaagatgtctatactcctggtattgcaggagattcattgcggtcattggaggacccatctaagcagggaaatccagatcattactcgaaccgctacacaggaacagaggattatggcggagtccatatcaattcgtccattcacaataaagcagcttatcttcttgcagaaggaggcgtgcaccacggtgtacaggttgaagggattgggcgtgaagcaagtgaacaaatttactatcgggctttaacatattatgtaacggcatctacagatttcagcatgatgaagcaagcggcgattgaagctgccaatgatttatacggtgaaggctcaaagcaatcagtttcagtcgaaaaggcgtatgaggctgtcggcattctatga

SEQ ID NO: 1888 - DNA, 1617 bp, Bacillus sp.
ttgcgcaaactgactaagacttctctattactggccggcttatgcacggcgacccaaatggtttttgtaacacatgcctcagctgatcaaagcatcaaatacgaccatacgtatcaaaccccttcatacatcatcgaaaagccatcacagaagccggtacaaaacacaacccagaaagaatcgttattttcctatcttgataagcatcaatcgcattttaagctcaaagggaatgcgaacagccattttcgtgtttcgaaaaccataaaggatccaaaaacaaaacaaacgttttttaaattaacggaggtttacaaaggaattccgatttacggctttgaacaagcggtcgcgatgaaggataacaaacaagtgacaagtttctttggaaaggtgcacccgcaaatcaaggacgtctctgtcacaccgtctatttctgagaaaaaagcaatacgtacagcacagcgtgagctcgaggctgccattggggaaatcaaatatcttgatggggaaccaaagggcgaattatatatctatccacacgacggtgaatatgatcttgcctaccttgtgagactctcgacatctgaacctgagcctggctattggcattatgtcatcgatgccaaaaacggaaaggtcatcaagtcttttaatgccattcatgaagcggcaggtacaggaatcggcgtgtcaggcgatgaaaaaagctttgacgtcacagaacagaatgggcgcttttatttggccgacgaaacaaggggaaaagggatcaatacgtttgacgcggagaacctgaacgaaaccttgtttacgcttttgtctcaactgatcggatatacgggcaaagaaatagtcagtggcacttccgtatttaatgaacctgcggctgtagacgcgcatgcaaatgcgcaagccgtttacgattattacagcaagacatttggccgtgattcttttgatcaaaacggagcaaggattacgtctaccgtgcatgtcggcaaacaatggaacaatgcagcgtggaacggcgtccagatggtgtacggtgatggagacggttcaaaatttaagccgctgtccggatcgctcgacattgtcgcgcatgaaattacacacgcagtcacacagtattccgccggcctattatatcaaggagaacccggtgcattaaatgagtccatttccgatattatgggcgcaatggctgaccgtgatgattgggaaatcggcgaggatgtctatactccggatattgcaggagattcattgcggtcgttagaggacccatctaagcagggaaatccagatcattactcgaaccgctacacaggaacagaggattatggcggagtccatatcaattcgtccatccacaataaagcagcttaccttctggcagaaggaggcgtgcaccacaatgtgcaggttgaagggatagggcgtgaagcatgtgaacaaatttactatcgggctttaacatattatgtaacggcatctacagatttcagcatgatgaagcaagcggcgattgaagccgccaatgatttatatggtgaaggatcgaagcaatcagcttcagtcgaaaaagcgtatgaggctgtcggcattttataa

SEQ ID NO: 1889 - DNA, 1560 bp, Bacillus sp.
atggtttttgtaacacatgcctcagctgatcaaagcatcaaatacgaccatacgtatcaaaccccttcatacatcatcgaaaagtcaccgcagaagccggtacaaaacacaacccagaaagaatcgctattttcctatcttgacaagcatcaaacgcagtttaagctcaaagggaatgcgaacagccattttcgcatttcgaaaaccataaaggatccaaagacaaaacaaacgttttttaaattaacggaggtttacaaaggaattccgatttacggctttgaacaagcggtcgcgatgaaggaaaacaaacaagtgaaaagtttctttggaaaggtgcacccgcaaatcaaggacgtctccgtcacaccgtctatttctgagcaaaaagcaatacatacagcgaggcgtgagctcgaggcttccattggaaaaatcgattatcttgatggggaaccaaaaggcgaattatatatctatccacacgacggtgaatatgatctcgcctaccttgtgagactctcgacatctgaacctgagcctggctattggcattatttcatcgatgccaaaaacggaaaagtcattgagttctttaatgccattcatgaagcggcaggcacaggaatcggcgtgtcaggtgatgaaaaaagctttgacgtcacagaacaaaatgggcgcttttatttggctgacgaaacaaggggaaaagggatcaatacgtttgacgcgaagaacctgaaccaaaccttgtttacgcttttgtctcaactgatcgggtatacgggcaaagaaatagtcagcggcacgtccgtatttaatgaacctgcggctgtggacgcacacgcaaatgcgcaagccgtttacgattattacagcaagacatttggccgtgattcttttgatcaaaacggagcaaggattacgtctaccgtgcatgtcggcaaacaatggaacaatgctgcgtggaacggtgtccagatggtatacggtgatggagacggttcgaaatttaagccgctgtctggatcgctcgacattgtcgcgcatgaaatcacacacgcagtcacacagtattccgccggtcttttatatcaaggagaacccggtgcattaaacgagtccatttctgacattatgggcgcgatggctgaccgtgatgattgggagatcggcgaagatgtctatactcctgatattgcaggagattcattgcggtcattggaggacccatctaagcagggaaatccagatcattactcgaaccgctacacaggaacagaggattatggcggagtccatatcaattcgtccattcacaataaagcagcttatcttcttgcagaaggaggcgtgcaccacgatgtacaggttgaagggattgggcgtgaagcaagtgaacaaatttactatcgggctttaacatattatgtaacggcatctacagatttcagcatgatgaagcaagcggcgattgaagctgccaatgatttatacggtgaaggctcgaagcaatcagcttcagtcgaaaaggcgtatgaggctgtcggcattctatga

SEQ ID NO: 1890 - DNA, 1560 bp, Bacillus sp.
atggtttttgtaacacatgcctcagctgaagaaagcatcgaatacgaccatacgtatcaaaccccttcatacatcatcgaaaagtcaccgcagaagccggtacaaaacacaacccagaaagaatcgctattttcctatcttgacaagcatcaaacgcagtttaagctcaaagggaatgcgaacagccattttcgcgtttcgaaaaccataaaggatccaaagacaaaacaaacgttttttaaattaacggaggtttacaaaggaattccgatttacggctttgaacaagcggtcgcgatgaaggaaaacaaacaagtgaaaagtttctttggaaaggtgcatccgcaaatcaaggacgtctccgtcacaccgtctatttctgagaaaaaagcaatacatacagcaaggcgtgagctcgaggcttccattggaaaaatcgaatatcttgatggggaaccaaaaggcgaattatatatctatccacacgacggtgaatatgatctcgcctaccttgtgagactctcgacatctgaacctgagcctggctattggcattatttcatcgatgccaaaaacggaaaggtcatcgagtcctttaatgccattcatgaagcggcaggtacaggaatcggcgtgtcaggtgatgaaaaaagctttgacgtcacagaacaaaatgggcgcttttatttggctgacgaaacaaggggaaaagggatcaatacatttgacgcgaagaacctgaacgaaaccttgtttacgcttttgtctcaactgatcgggtatacgggcaaagaaatagtcagcggcacgtccgtatttaatgaacctgcggctgtagacgcacacgcaaatgcgcaagccgtttacgattattacagcaagacatttggccgtgattcttttgatcaaaacggagcaaggattacgtctaccgtgcatgtcggcaaacaatggaacaatgctgcgtggaacggtgtccagatggtatacggggatggagacggttcgaaatttaagccgctgtctggatcgctcgacattgtcgcgcatgaaatcacacacgcagtcacacagtattccgccggtcttttatatcaaggagaacccggtgcattaaatgagtccatttctgacattatgggcgcgatggctgaccgtgatgattgggagatcggcgaagatgtctatactcctggtattgcaggagattcattgcggtcattggaggacccatctaagcagggaaatccagatcattactcgaaccgctacacaggaacagaggattatggcggagtccatatcaattcgtccattcacaataaagcagcttatcttcttgcagaaggaggcgtgcaccacggtgtacaggttgaagggattgggcgtgaagcaagtgaacaaatttactatcgggctttaacatattatgtaacggcatctacagatttcagcatgatgaagcaagcggcgattgaagctgccaatgatttatacggtgaaggctcgaagcaatcagcttcagtcgaaaaggcgtatgaggctgtcggcattctatga

SEQ ID NO: 1891 - DNA, 1560 bp, Bacillus sp.
atggtttttgtaacacatgcctcagctgaagaaagcatcgaatacgaccatacgtatcaaaccccttcatacatcatcgaaaagtcaccgcagaagccggtacaaaacacaacccagaaagaatcgctattttcctatcttgacaagcatcaaacgcagtttaagctcaaagggaatgcgaacagccattttcgcgtttcgaaaaccataaaggatccaaagacaaaacaaacgttttttaaattaacggaggtttacaaaggaattccgatttacggctttgaacaagcggtcgcgatgaaggaaaacaaacaagtgaaaagtttctttggaaaggtgcatccgcaaatcaaggacgtctccgtcacaccgtctatttctgagaaaaaagcaatacatacagcaaggcgtgagctcgaggcttccattggaaaaatcgaatatcttgatggggaaccaaaaggcgaattatatatctatccacacgacggtgaatatgatctcgcctaccttgtgagactctcgacatctgaacctgatcctggctattggcattatttcatcgatgccaaaaacggaaaggtcattgagtcctttaatgccattcatgaagcggcaggtacaggaatcggcgtatcaggtgatgaaaaaagctttgacgtcacagaacaaaatgggcgcttttatttggctgacgaaacaaggggaaaagggatcaatacatttgacgcgaagaacctgaacgaaaccttgtttacgcttttgtctcaactaatcgggtatacgggcaaagaaatagtcagcggcacgtccgtatttaatgaacctgcggctgtagacgcacacgcaaatgcgcaagccgtttacgattattacagcaagacatttggccgtgattcttttgatcaaaacggagcaaggattacgtctaccgtgcatgtcggcaaacaatggaacaatgctgcgtggaacggtgtccagatggtatacggggatggagacggttcgaaatttaagccgctgtctggatcgctcgacattgtcgcgcatgaaatcacacacgcagtcacacagtattccgccggtcttttatatcaaggagaacccggtgcattaaatgagtccatttctgacattatgggcgcgatggctgaccgtgatgattgggagatcggcgaagatgtctatactcctggtattgcaggagattcattgcggtcattggaggacccatctaagcagggaaatccagatcattactcgaaccgctacacaggaacagaggattatggcggagtccatatcaattcgtccattcacaataaagcagcttatcttcttgcagaaggaggcgtgcaccacggtgtacaggttgaagggattgggcgtgaagcaagtgaacaaatttactatcgggctttaacatattatgtaacggcatctacagatttcagcatgatgaagctagcggcgattgaagctgccaatgatttatacggtgaaggctcggagcaatcagcttcagtcgaaaaggcgtatgaggctgtcggcattctatga

SEQ ID NO: 1892 - DNA, 1560 bp, Bacillus sp.
atggtttttgtaacacatgcctcagctgatcaaagcatcaaatacgaccatacgtatcaaaccccttcatacatcatcgaaaagccatcacagaagccggtacaaaacacaactcagaaagaatcgttattttcctatcttgataagcatcaatcgcattttaagctcaaagggaatgcgaacagccattttcgtatttcgaaaaccataaaggattcaaaaacaaaacaaacgttttttaaattaacggaggtttacaaaggaattccgatttacggctttgaacaagtggtcgcgatgaaggataacaaacaagtgacaagtttctttggaaaggtgcacccgcaaatcaaggacgtctctgtcacaccgtctatttctgagaaaaaagcaatacgtacggcgcagcgtgagctcgaggctgccattgggaaaatcaaatatcttgatggggaaccaaagggcgaattatatatctatccacacgacgggaaattcgatcttgcctaccttgtgagactctcgacatctgaacctgagcctggctattggcattatgtcattgatgccaaaaacggaaaggtcatcgaatcctttaatgccattcatgaagcggcaggtacaggaatcggcgtgtcaggcgatgaaaaaagctttgacgtcacagtacaggatgggcgcttttatttggccgacgaaacaaggggaaaagggatcaatacgtttgacgcggagaacctgaacgaaaccttgtttacgcttttgtctcaactgatcggatatacgggcaaagaaatagtcagtggcacttccgtatttaatgaacctgcggctgtagacgcgcatgcaaatgcgcaagccgtttacgattattacagcaagacatttggccgtgattcttttgatcaaaacggagcaaggattacgtctactgtgcatgtcggcaaacaatggaacaatgcagcgtggaacggcgtccagatggtgtacggtgatggagacggttcaaaatttaagccgctgtccggatcgctcgacattgtcgcgcatgaaattacacacgcagtcacacagtattccgccggcctattatatcaaggagaacccggtgcattaaatgagtccatttccgatattatgggcgcaatggctgaccgtgatgattgggaaatcggcgaggatgtctatactccggatattgcaggagattcattgcggtcgttagaggacccatctaagcagggaaatccagatcattactcgaaccgctacacaggaacagaggattatggcggagtccatatcaattcgtccatccacaataaagcagcttaccttctggcagaaggaggcgtgcaccacaatgtgcaggttgaagggatagggcgtgaagcatgtgaacaaatttactatcgggctttaacatattatgtaacggcatctacagattttagcatgatgaagcaagcggcgattgaagccgccaatgatttatacggtgaaggatcgaagcaatcagcttcagtcgaaaaagcgtatgaggctgtcggcattttataa

SEQ ID NO: 1893 - DNA, 1149 bp, Bacillus sp.
atgcgcatttttaaaaaagctgtattaatagtcatcatttcttttctatttgcaaatgtaaatgtgaacacagcacatgcagctataaatgtcagtgcgaagagcgccattgtcattgacggcacatcaggaagagtgttatttgccaaggacgagcatgaaaaaaggcggattgccagtattacaaagatcatgaccgctgttctcgccattgaatccggaaaaatggaagaaaccgtgactgtttctgcaaatgcggtcagaacagagggctcggccatttatttaaccgaagggcaaaaagtaaaattaaaggatcttgtgtatggcctgatgctgagatccgggaacgatgctgctgttgcgattgctgagtatgtcgggggaagcctcgatggatttgtctatatgatgaaccaaaaagcagaacaaatcggtatggagaatacccgttttcaaaacccgcacggattggacgaccatgaaaatcactactcaacagcttatgacatggctgttttaacgaaatacgccatgaagctcaaagactatcaaaccatctccggcacaaaaatatacaaagcagaaacaatggaaagcgtatggaaaaacaaaaataaattgctgacgatgctgtatccatacagcacaggggggaaaacaggctataccaagcttgcaaaacgcacactggtttcaaccgcttcaaaggacggcgtagatctgatagccgttaccattaatgaccccgacgattgggatgatcatatgaatatgtttaactatgtatttgatcattatcaaacatatttaatcgcaaagaaaggagatattccgaagctcaaaggtacattttatgagtctaaagctttcatcaaacgggacatcacctatttgcttaccgaagaagaaaaagaagatgtcaaaatcaacactaccctgctcaaaccaaaaaaagcctgggaaaaggatgtctcaaaaattccggatattgtaggacatatgaaagtcatgttcaacgatgaaatcatcgcaaaagtgccgatctattacgaaaacgaacgaaatcaaaaaccgaaaaaaaagttttttgaaacgtttcaatccatttttctgaatgcggctggcggggcaaaatggtcaatataa

SEQ ID NO: 1894 - DNA, 1149 bp, Bacillus sp.
atgcgcatttttaaaaaagctgtattaatagtcattatttcttttctatttgcaaatgtaaatgtgaacacagcccatgcagctataaatgtcagtgcgaagagcgcgattgtcattgacggcacatcaggaagagtgttatttgccaaggacgagcatgaaaaaaggcgaattgccagtattacaaagatcatgaccgctgttctcgccattgaatcaggaaaaatggaagaaaccgtgactgtgtctgcaaatgcggtcagaacagagggctcggccatttatttaaccgaagggcaaaaagtaaaattaaaggatcttgtgtatggcctgatgctgagatccgggaacgatgctgctgttgcgatcgctgagtatgtcgggggaagcctcgatggatttgtctatatgatgaaccaaaaagcagagcaaatcggtatggagaatacccgttttcaaaacccgcacggattggacgaccatgaaaatcattactcatcagcttatgacatggctattttaacgaaatacgccatgaagctcaaagactatcaaaccatctccggcacaaaagtatacaaagcagaaacaatggaaagcgtgtggaaaaacaaaaataaattgctgacgatgctgtatccatacagtacaggggggaaaacaggctataccaagcttgcaaaacgcacactggtttcaaccgcttcaaaggacggcgttgatctgatagccgtgaccattaatgaccctgacgattgggatgatcatatgaatatgtttaactatgtatttgagcattatcaaacatatttaatcgcaaaaaaaggagacattccgaagctcaaaggtacattttatgagtccaaagctttcatcaaacgagacatcacctatttgcttaccgaagaagaaaaagaagatgtcaaaattaacactacgctgctcaaaccgaaaaaagcctgggaaaaggatgcttcaaaaattccggatattgtaggacatatgaaagtcatgttcaacgatgaaaccattgcaaaagtgccgatctattacgaaaacgaacgaaatcaaaaaccgaaaaaaaagttttttgaaacatttaaatcaatttttctgaatgcggctggcggggcaaaatggtcaatataa

SEQ ID NO: 1895 - DNA, 1149 bp, Bacillus sp.
atgcgcattttcaaaaaagcagtcttcatggtcatgattttttttctatttgcaaatgtaaatgtgaacacagcacatgcggctatagatgttagtgcaaaaagcgcgatagtaattgatggagattcaggcagagtgttatttgccaaggatgagcatgaaaaaaggcggattgcaagcatcacaaaaatcatgacggccgttctcgccattgaatccggcaaaatggaggaaactgtgacggtttcggcaaatgctgtcagaacagaaggctctgccatttatttaacagaagggcaaaaagtgaaattaaaagatcttgtgtatggcctgatgctgagatcaggaaacgacgccgctgttgcgattgccgagcatgtcgggggaagcctcgatggatttgtttatatgatgaatcaaaaagccgagcagcttggtatggagaatacccgttttcaaaatccgcacggattggacgaccatgaaaaccattattcaacagcctatgacatggccatcttaacaaaatacgctatgaagttgaaagactatcaaaaaatttcaggcacaaaaatatacaaagcagaaacgatggaaagtgtctggaaaaacaaaaataaactgctgaccatgctttatcgatacagcacaggaggaaaaacaggctatacaaaacttgcaaaacggacactggtctcaacagcctcaaaggacggcattgacctgatcgccgttaccataaatgaccctgacgattgggatgatcatatgaatatgtttaactatgtgtttgatcattataaaacctatttaatcgcgaaaaaaggggacattccaaagctgaaaggcacattttatgaatctaaggcttttatcaaacgtgacatcacctttttgctaaccgaagaagaaaaagaagatgtcgaaattagaaccacgctgcttaagccgaaaaaagcatgggagaaagatgcatcaaaaattcccgacatcgtaggacacatgaagatcatgttcaacgatgaaaccatcgcaaaagtgccgatctattatgaaaatgaacgacatcaaaaaccgaaaaaacaattttttgaaacgtttaaatccatctttctgaatgcggctggcggggcaaaatggtcaatataa

SEQ ID NO: 1896 - DNA, 1149 bp, Bacillus sp.
atgcgcattttcaaaaaagcagtattcatggtcatgatttcttttcttattgcaaatgtaaatgtgaacacagcacatgctgctatagatgtcagtgcaaaaagcgcgatcgttattgacggagcgtcaggcagagtgttatttgccaaggatgagcatgaaaaaaggcggattgcaagcatcacaaaaatcatgacggccgttctcgccatcgaatccggcaaaatggatgaaacggtgacagtgtccgcaaatgctgtcagaacagaaggctctgccatttatttaacagaggggcaaaaagtgaaattaaaagatcttgtgtatggcctgatgctgagatcgggaaacgacgccgctgtcgcaattgctgaacatgtcggtggaagcctcgatggatttgtttatatgatgaatcaaaaagctgagcagcttggcatggagaatacccgttttcaaaacccgcacggattggacgaccatgaaaatcattattcaacagcttatgacatggccattttaaccaaatacgctatgaagctgaaagactatcaaaagatttctggcacgaaaatatacaaagcagaaacgatggaaagcgtctggaaaaacaaaaataaactgctgaccatgctttatcgatacagcacaggaggaaaaacaggctatacaaaacttgcaaaacggacactggtctcaacagcttcaaaggacggcattgacctgatagccgtcaccataaatgaccctaacgattgggatgatcatatgaagatgtttaactatgtgtttgatcattatcaaacctatttaatcgcgaaaaaaggggacattccaaagctgaaaggcacattttatgaatcgaaggcttttatcaaacgtgacatcacctatttgctaaccgaagaggaaaaaggagatgtcaacattaaaaccacgctccttaagccgaaaaaaacatgggaaaaagacgcctcaaaaattcccgacatcgtagggcatatgaagatcatgttcaacgatgaaacgatcgcaaaagtgccgatctattatgaaaatgaacgacatcaaaaaccgaaaaaacaattttttgaaacgtttaaatcaatctttctgaatgcggctggcggggcaaaatggtcaatataa

SEQ ID NO: 1897 - DNA, 1149 bp, Bacillus sp.
atgcgcattttcaaaaaagcagtattcgtgattatgatttcttttctgattgcaactgtaaatgtgaatacagcacatgcagctatagatgtcagtgcaaaaagcgcgatcattatcgacggagcgtcaggcagagtgttatttgccaaggatgagcatcaaaaaaggcgtattgccagcatcacaaaaattatgaccgccgtcctcgctatcgaatccggcaaaatggatcaaacggtgacggtttcggcaaatgctgtcagaacagaaggttccgccatttatttaacagaaggtcaaaaagtgaaattaaaagatcttgtgtatggcctgatgctaagatcaggaaacgacgccgctgtcgcgattgctgagcatgtcggtgggagcctcgatgggtttgtttatatgatgaatcaaaaagccgagcagcttggtatggagaacacccgttttcaaaacccgcacggcttggacgaccatgaaaatcattattcaacagcctatgacatggccattttaactaaatatgctatgaaactgaaagactatcaaaagatttcaggcacaaaaatatacaaagcggaaacgatggaaagcgtatggaaaaataaaaataaactgctgaccatgctttatccatacagtacaggagggaaaacaggctatacaaaacttgcaaaacggacactggtttcaacggcttcaaaggatggcattaacctgatagccgtcaccattaatgaccctgatgattgggatgaccatatgaaaatgtttaattatgtgtttgatcattatcaaacctatttaattgcaaaaaaaggggacattccaaagctgaaagacacattttatgaatcgaaggcttttatcaaacgagatatcacctatttgctgaacgaagaggaaaaagaagatgtgaaaattaataccacgctgctcaagccaaaaaaagcatgggaaaaagacgcctcaaaaattcctgacatcgtagggcacatggagatcatgttcaacaatgaaaccatcgcaaaagtgccgatctattatgaaaatgaacgtcatcaaaaaccgaagaaacaattttttgaaacgtttaagtcaatctttctgaatgcggcaggcggagcaaaatggtcaatataa

SEQ ID NO: 1898 - DNA, 1149 bp, Bacillus sp.
atgcgcattttcaaaaaagcagtattcgtgatcatgatttcttttcttattgcaaccgtaaatgtgaatacagcacatgctgctatagatgtcagtgcaaaaagcgcgatcattattgacggtgcgtcaggcagagtgttatatgccaaggatgagcatcaaaaaaggcggatcgcgagcatcacaaaaattatgaccgccgtcctcgccatcgaatccggcaaaatggatcaaacggtgacggtttcggcaaatgctgtcagaacagaaggctccgccatttatttaacagaaggtcaaaaagtgaagctaaaagatcttgtgtatggcctgatgctaagatcaggaaacgatgccgctgtcgcgattgctgagcatgtcggtgggagcctcgatgggtttgtttatatgatgaatcaaaaagccgagcagcttggtatgaaaaacacccgttttcaaaacccgcacggattggacgaccatgaaaatcattattcaacagcctatgacatggccattttaactaagtatgctatgaagctgaaagactatcaaaagatttcaggcacaaaaatatacaaagcggaaacgatggaaagcgtatggaaaaacaaaaataaactgctgaccatgctatatccgtacagcacaggaggaaaaacaggctatacaaaacttgcaaaacggacactggtctctacggcttcaaaggacggcattaacctgatagccgtcaccattaatgaccctaatgattgggatgaccatatgaagatgtttaactatgtgtttgagcattatcaaacctatttaattgcaaaaaaaggggatattccaaagctgaaaggcacattttatgaatcgaaggcttttatcaaacgtgatatcacctatttgctgactgaagaggaaaaagaagatgtgaaaattaataccacactgctcaagccgaaaaaagcatgggaaaaagatgcctcgaaaatccctgacatcgtagggcacatggagatcatgttcaacgatgcaaccatcgcaaaagtgccgatctattatgaaaatgagcggcatcaaaaaccgaagaaacaattttttgaaacgtttaaatcaatctttctgaatgcggcaggcggagcaaaatggtcaatataa

SEQ ID NO: 1899 - DNA, 1149 bp, Bacillus sp.
atgcgcattttcaaaaaagcagtattcgtgatcatgatttcttttctaattgcaaccgtaaatgtgaatacagcacatgctgctatagatgtcagtgcaaaaagcgcgatcattattgacggtgcgtcaggcagagtgttatatgccaaggatgagcatcaaaaaaggcggatcgcgagcatcacaaaaattatgaccgccgtcctcgccatcgaatccggcaaaatggatcaaacggtgacggtttcggcaaatgctgtcagaacagaaggctccgccatttatttaacagaaggtcaaaaagtgaagctgaaagatcttgtgtatggcctgatgctaagatcaggaaacgacgccgctgtcgcgattgctgagcatgtcggtgggagcctcgatgggtttgtttatatgatgaatcaaaaagccgagcagcttggtatgaaaaacacccgttttcaaaacccgcacggattggacgaccatgaaaatcattattcaacagcctatgacatggccattttaactaagtatgctatgaagctgaaagactatcaaaagatttcaggcacaaaaatatacaaagcggaaacgatggaaagcgtatggaaaaacaaaaataaactgctgaccatgctatatccgtacagcacaggaggaaaaacaggctatacaaaacttgcaaaacggacactggtctctacggcttcaaaggacgacattgacctgatagccgtcaccattaatgaccctaatgattgggatgaccatatgaagatgtttaactatgtgtttgagcattatcaaacctatttaattgcaaaaaaaggggatattccaaagctgaaaggcacattttatgaatcgaaggcttttatcaaacgtgatatcacctatttgctgagtgaagaggaaaaagaagatgtgaaaattaataccacactgctcaagccgaaaaaagcatgggaaaaagatgcctcgaaaatccctgacatcgtagggcacatggagatcatgttcaacaatgcaaccatcgcaaaagtgccgatctattatgaaaatgagcggcatcaaaaaccgaagaaacaattttttgaaacgtttaaatcaatctttctgaatgcggcaggcggagcaaaatggtcaatataa

SEQ ID NO: 1900 - DNA, 1152 bp, Bacillus sp.
atgcgctttctgaaaaaagctgccgtaatcattctggtcactgcttttctactcacctttattaaagagcataaagcatatgcagcaataaatgtcagcgcaaaaagcgctattgtcattgacggagcgtcaggcagagtgttatttgctaaagacgagcacgaaaaacggcgaattgcgagcataacaaagatcatgacggccgttctcgccatagaatcaggaaaaatggaagagactgtgacagtgtcggcaaacgcggtcagaacggaaggttcagccatctatttaaaagaaggacaaaaggtaaagctgaaagatcttgtatatgggctgatgctgcgttcaggcaatgatgcggctgcggccattgccgaacatgtcggaggaagcctaggcggatttgtgtatatgatgaaccaaaaagctgagcagatcggcatggaaaatacacgttttcaaaaccctcacggactcgatgaccatgagaatcattactcaacagcctatgatatggcgattttaaccaaatacgccatgaagctgaaagactatcaaaccatttcaggtactaaagtgtataaagcggaaacgatggaaagtgtatggaagaataaaaacaagcttctgacaggactttaccaatacagcacaggcggtaaaacaggctatacgaagcttgcgaagcggacgctggtctcgaccgcatcaaaagatggcacagacttaattgcagtcactattaatgaccctaacgattgggatgatcatatgaatatgtttgagtatgtatttaatcattataaaacctacattgtcgcaaaaaaaggagacattccaaagctcaaagaaaccttttatggcagccgcgcttttataaaacgagatgttacttatttactcaatgaagctgaaaaagacgaagtgaaaattaatacaaccctgctcaagccgaaaaaagcatggaaaaaggatcgctcagccattcctgatgttgtcggacaaatgacggtcaccgttaatgacgaaaccatagtgaaattgccgatctattatgaaaatgaacggaataaaaaaccgaaaaaacgcttctttgaaaccttcaaagcaattttctcgaatgcggctggcgggtcagaatggtcaatttaa

SEQ ID NO: 1901 - DNA, 1152 bp, Bacillus sp.
atgcgctttctcaaaaaagctgccgtatttcttttgacttttgttattcttttttccattacagacggcaatacggcacatgcccaaatacatgtcagcgcaaaaagcgcgattataatcgacggagcatctggcagggtgttattcgccaaggatgaacatcataagcggcggattgcaagcattacgaaaatcatgacggcggtgctggcgattgaatcagggaagatggaagagaccgtgacggtttccccgaatgccgtaaaaacggaaggctcagccatttatcttcagccgggacaaaaagtgaagctgaaagatctcgtatacgggcttatgctgagatcaggaaatgacgccgctgcagcaatagctgaatatgtcggcggaagccttgacggttttgtatttatgatgaacaaaaaagccgagcaaatcgggatggaaaatacaaaatttcaaaatccgcacggactggacgaccatgaaaatttatattcaacggcgtatgacatggcgcttttgactaaatacgcgatgaaaatcaaggaataccggaccgtttcaggcacaaaagtgtataaggcggaaacgatggaccgggtatggaaaaataaaaacaagcttctcacagggctctaccgttacagcacaggcggaaaaacaggttacacaaaaatcgcgaaacggacgctcgtctcgacggcctcaaaagacggtacggatctcatcgcggtcaccataaatgatccggatgattgggatgatcatatgaatatgtttaattatgtctttgatcactataaaacctatgtcgtcgccaaaaaaggcggcattccgaagctgaaaaagacgttttacggaaagcgcgcttttattgcccgggatgtaaaatatttgttaaaagaggatgaaatcgacgatgtaaaaatccgcacaaccttaataaaaccgaaaaaagcctggaaaaaggacgcctctctcattcctgatgtcgtcggccgaatgactgttatgcatgatgggaaagtgatcgccaggatccccgtctattatgaaaacgagcgccataaaaaaccgaaaaagcatttcattgagacgtttacgagcctgtttatgagcgcggcgggcggttcgtcatggtcaatttaa

SEQ ID NO: 1902 - DNA, 1152 bp, Bacillus sp.
atgcgctttctcaaaaaagctgccgtatttcttttgacttttgttattcttttttccattacagacggcaatacggcacatgcccaaatacatgtcagcgcaaaaagcgcgattataatcgacggagcatctggcagggtgttattcgccaaggatgaacatcataagcggcggattgcaagcattacgaaaatcatgacggcggtgctggcgattgaatcagggaagatggaagagaccgtgacggtttccccgaatgccgtaaaaacggaaggctcagccatttatcttcagccgggacaaaaagtaaagctgaaagatctcgtatacgggcttatgctgagatcaggaaatgacgccgctgcggcaatagctgaatatgtcggcggaagccttgacggttttgtatttatgatgaacaaaaaagccgagcaaatcgggatggaaaatacaaaatttcaaaatccgcacgggctggacgaccatgaaaatttatattcaacggcgtttgacatggcgcttttgactaaatacgcgatgaaaatcaaggaataccggaccgtttcaggcacaaaagtgtataaggcggaaacgatggaccgggtatggaaaaataaaaacaagcttctgaccgggctctaccgttacagcacaggcggaaaaacaggttacacaaaaatcgcgaaacggacgctcgtctcgacggcctcaaaagacggaacggatctcatcgcggtcaccataaatgatccggatgattgggatgatcatatgaatatgtttaattatgtctttgagcactataaaacctatgtcgtcgctaaaaaaggcggcatcccgaagctgaaaaagacgttttacggaaagcgcgcttttattgcccgggatgtcaaatatttgttaaaagaggatgaaatcgacgatgtaaaaatccgcacaaccttaataaaaccgaaaaaagcctggaaaaaggacgcctctctcattcctgatgtcgtcggccggatgactgttatgcatgatgggaaagtgatcgccaggatccccgtctattatgaaaatgagcgccataaaaaaccgaaaaagcatttcattgagacgtttacgagcctgtttatgagcgcggcgggcggttcgtcatggtcaatttaa

SEQ ID NO: 1903 - DNA, 1155 bp, Bacillus sp.
atgcgcttttttctaaaacaagcggcagcagccatcatgatatgctctcttttatgctcttcatacgaaaccgctcaagcacagccctcccttcatatcagcgcaaaaagcgcgattgtcatggacgggcaatccggacgggttttgtttgcaaaggatgagcatgaaaaacggcgcattgcaagcattacgaagattatgacagccattttggccgtggaatcgggcaaattggatgagacggtcacggtcagcgacagagcggtcaggacagagggatcatcgatctatttaacaagcgggcaaaaggtgaagctgaaggaccttgtttacggtttgatgctgagatcgggaaatgatgcagccgttgcgattgccgaacatgtgggcggaagcctggaaggctttgtctacatgatgaatcaaaaagcggccgagctcggcatggaaaacaccctgttccgcaatccgcacggacttgatgaccaccctgatcactattcctcggcctatgatatggcgcttttaacaaaatatgcgatgacaaatgaaacgtacaaaaaaatcgccggaacgaaacgctataaagcagaaacgatgcaaggcatctggagaaataaaaacaagcttttaacagggctttacaaatacagtacaggcgggaagacgggatatacaaagcttgcaaagcgtacgctcgtctccacttcatcgaaagacggaaccgatttgatcgccgtcacaatcaatgcccctgacgactggaatgatcatatgaacatgttcaactatgtattcggccactacaaaacatatatcatcgccaaaaaaggcgagattccgaaattaaaagactctttttacggaaataaagcttttattaaacgggatgtcacatatcttttaaacgaagaggaaaaagaagatgtgaaggttgatatcgagcttcttgaaccgaaaaaatcatggcgtaaaaacaaaaaagaaatcccggacatcatcggagaaatgaacgtcatgttcgacggaaaaacgattgcaagcgtaccgatctattatgaaaacgagcgaaacaaaaaaccgaaaaaatcgtttttcgagacctttcaatccgtattccaaaaagcggcgggcggttcatcatggtcaatataa

SEQ ID NO: 1904 - DNA, 1155 bp, Bacillus sp.
atgcgcttttttctaaaacaggctgcagcagccatcatcatatgctctcttttatgctcttcataccaaatcgctgaagcacagccttcccttcatgtcagcgcaagaagcgcgattgtcatggacgggcaatccggacgggtattgtttgcgaaggatgagcatgaaaaacggcgcattgcaagcattacgaagattatgacagccattttggccgtggaatcgggcaaattggatgagacagtcacggtcagcgacagggcggtcaaaacggagggatcatcaatctatttgacaagcgggcaaaaggtgaagctgaaggaccttgtttacggtttgatgctgagatcgggaaatgacgcagctgttgcgattgctgagcatgtgggcggaagcctggaagggtttgtctacatgatgaatcaaaaagcggccgacctcggcatggaaaacaccctgttccgcaatccgcacggactcgatgatcaccctgaccactattcctcggcctatgatatggcgcttttgacgaaatatgcgatgacaaacgaaacgtaccaaaaaatcgccggaacgaagcgctataaggcagaaacgatgcaaggcatctggagaaataaaaacaagcttttaacagggctttacgaatacagtacaggcgggaagacgggatataccaagctggcgaagcgcacgctggtctccacttcatcgaaagacggaactgatttgatcgccgtcaccatcaatgcccctgacgactggaatgatcatatgaacatgttcaactatgtatacggccactacaaaacatatatcatcgccaaaaaaggcgaggttccgaaattaaaagactctttttacgggaataaagcttttattaaacgggatgtcacatatttgttaaacgaagatgaaaaagaagacgtgaaggttgacatcgagcttcttaaaccgaaaaaatcgtggcgtaaaaacaaaaaagaaatcccggacatcatcggggaaatgaacgtcatgttcaacggaaaaacgattgcaagtgtaccgatctattatgaaaacgaacgcaacaaaaagccgaaaaaatcgtttttcgagacctttcaatccgtattccaaaaagcggcaggcggttcatcatggtcaatataa

SEQ ID NO: 1905 - DNA, 1155 bp, Bacillus sp.
atgcgcttttttctaaaacaggctgcagcagccatcatcatatgctctcttttatgctcttcataccaaatcgctgaagcacagccttcccttcatgtcagcgcaagaagtgcgattgtcatggacgggcaatccggacgggtattgtttgcgaaggatgagcatgaaaaacggcgcattgcaagcattacgaagattatgacagccattttggccgtggaatcgggcaaattggatgagacagtcacggtcagcgacagggcggtcaaaacggagggatcatcaatctatttgacaagcgggcaaaaggtgaagctcaaggaccttgtttacggtttgatgctgagatcgggaaatgacgcagccgttgcgattgctgagcatgtgggcggaagcctggaagggtttgtctacatgatgaatcaaaaagcggccgaccttggcatggaaaacaccctgttccgcaatccgcacggactcgatgatcaccctgaccactattcctcggcctatgatatggcgcttttgacgaaatatgcgatgacaaacgaaacgtaccaaaaaatcgccggaacgaagcgctataaggcagaaacgatgcaaggcatctggagaaataaaaacaagcttttaacagggctttacgaatacagtacaggcggaaagacgggatataccaagctggcgaagcgcacgctcgtctccacttcatcgaaagacggaaccgatttgatcgccgtcaccatcaacgcccctgacgactggaatgatcatatgaacatgttcaactatgtatacggccactacaaaacatatatcatcgccaaaaaaggcgaggttccgaaattaaaagactctttttacgggaataaagcttttattaaacgggatgtcacatatctgttaaacgaagatgaaacagaagacgtgaaggttgacatcgagcttcttaaaccgaaaaaatcgtggcgtaaaaacaaaaaagaaatcccggacatcatcggagaaatgaacgtcatattcgacggaaaaacgattgcaagcgtaccgatctattatgaaaacgaacgtaacaaaaagccgaaaaaatcgtttttcgagacctttcaatccgtattccaaaaagcggcaggcggttcatcatggtcaatataa

SEQ ID NO: 1906 - DNA, 1152 bp, Bacillus sp.
atgcgctttctaaaacgaactgcagcagcggccattcttttttttctttttttctcttcttttcaaatcgctgaagcagaggcttccattcatgtcagcgcaaaaagcgcaattgtcatagacggtcaatccggcagggttttatttgccaaggatgaacatgaaaagcggcgcattgcaagcatcacgaagatcatgacggccattttggcgatcgagtcgggaaaattggaggataccgtgacagtctcagacagggctgcaggtacggaaggttcttccatatatttgacgagcggacaaaaagttaagctaaaagaccttgtatacggtctcatgctgagatcgggaaatgacgccgccgtggcgattgccgaacacgtcggcggcagtcttgaaggctttgtgtatatgatgaatcaaaaagcggccgatctcgggatggaaaacaccgtgtttcgcaatccccacggtcttgatgatcatgccggccattattcaaccgcatatgacatggcgcttttgacaaaatatgcgatgacaaatcagacataccgaaaaatcgccggaacaaagcattacaaagcggaaacgatgcagggaatctggagaaacaaaaacaagcttttaacaggcttgtaccgctacagcacagggggcaagacggggtacacaaagcttgcaaagcgcacgctcgtatccacttcctctaaagacggcacagatctgatcgcggtcacgatcaacgctcctgatgattggaatgatcatatcaatatgttcagctattgttacgatcattataaaacgtatgttgttgccaaaaaaggagaaattcacaggctgcgggattcgttttatggaagcaaagtttttattaaacgcgatgtcaagtatctcttaagcgatgaggaaaaagacgaggtgaagatcgacttagaacttctcgagccgaagaaatcttggcggaaaaacgaaaaagcgattccggacatcattggcaggatgaaggtgaaactggacggaaaaacgattgccgacctgcctgtgtactatgaaaatgaacggaacaaaaagccgaaaaaatcgttccttgatacctttcaatctgtttttaaaaaagcggcgggcggtccatcatggtcaatataa

SEQ ID NO: 1907 - DNA, 981 bp, Bacillus sp.
gtgaaagttgtgttatctgcccttcttctccttttgtttgcatttgaaccttttgcgtctggaaaagagctttcagatccggtgctttctaaacggatggaattatatcataaagtcgaagctgtgacgcagattccttggtatgcgctagccgctgttgatcaatacgaggagaatgtgcggagcaacagaaaggatctgcctgacaaaacgggaatcatcagcatctatgtaccggatgaaatctggagcggaccagaaaacccgaatccgaaagacgatgcaccgttaagcataaaagtgtttgacggaatcggaatggacggtgacggcgatgggaaagccgaggtcagcaatgacgaagacattttgtatacattcgcacaatatctgctgtcgcacggcacagatgaggaaaatatccgcatcgggctctggaattactaccgccgtgatcaaacagtgggaatcatatccgagttcatgaagctgtttaaggcatacggtcatattgatttgggcgagcatgcgtttccgcttccaatcagaacggattacagctatcggagcacatggggggacgcccgcggctttggaggaaggcggattcatgaaggaacggatatctttgcccattatggccttcctgtgaaatccacctgttacggcgtcattgaaatgaaaggctggaaccgctttggaggatggagaatcggcatcagagatattaacaatacgtatcattatttcgcccacctcaatgggtttgcgaaaggcattaaaccagggcagatcgttgagcccggccaagtgatcgggtcagtcggcagctcaggatacggcccgcctggcacagccggaaaatttccgccgcacctgcactatggcatgtataaggataatggaaaaacggaatggtcgtttgatccttatcctcatttgagagcgtgggagcgctatgagtacaagaaaaagaaatga

SEQ ID NO: 1908 - DNA, 981 bp, Bacillus sp.
gtgaaagttttgttatccgctcttcttctccttttgtttgcgtttgagccttatgcgtctggaaaagagctttcagatccagtgctgtcgaaacggatggaattatatcataaaatcgaggctgtgacgcagattccctggtacgctctcgccgcagtagatcaatacgaggaaaatgtgcggagcaaccgaaaagatctgcctgacaaggctggaatcatcagcatctatataccggatgaagtctggagcgggcctgaaaacccgaatccgaaggacgatgcgccgttaagcattaaagtgtttgacggtatcggcatggatggtgatggagacgggaaagccgaggtcagcaatgatgaagatattttgtatacgttcagccaatacttgctttcgtatggcacagacgaagacaacattcgcatcggactttggaattattaccggcgtgatcagacagtggggatcatatctgaattcatgaagctgtttaaagcctacggccatattgatttaggcgagcatgcgtttccgcttccgatcagaaccgattacagctatcgcagcacatggggagatgcacgcggcttcgggggaaggcgcattcatgaaggcacggatatctttgcccattacggccttcctgtcaaatccacctgctacggcgtagttgaaatgaagggctggaaccgcttcggaggatggagaatcggcattagagacatcaacaatacgtatcattattttgcccatctcaatgggtttgccaaagggattaaaacaggacaaatcgttgagcccggccaagtgatcggttccgtcggcagctccggatacggaccgccgggaaccgctgggaagttcccgccgcatcttcactacgggatgtacaaagataacgggaaaaccgaatggtcgtttgatccatacccgcatttgagggcgtgggagcggtatgaatataaaaaaaagaaataa

SEQ ID NO: 1909 - DNA, 981 bp, Bacillus sp.
gtgaaagttttgttatccgctcttcttctccttttgtttgcatttgagccttctgcgtctggaaaaaagctttcagatccagtgctgtcgaaacggatggaattatatcataaaatcgaagctgtgacgcagatcccttggtatgcgctcgcggctgttgatcaatacgaagaaaacgtgcggagcaaccggaaagatctgcctgacaaggcgggaatcatcagcatctatatacccgatgatatctggagcgggcctgaaaacccgaatccgaaagatgatgcgccgttaagcattaaagtgtttgacggaatcggaatggatggcgatggagacgggaaagccgaggtcagcaacgatgaagatatcttgtatacgttcagccaatacttactgtcgtatggcacagatgaagacaacatccggatcgggctttggaattattatcggcgtgatcagacagtggggattatatctgaattcatgaagctgtttaaagcctacggccatattgatctgggcgagcatgcattcccgcttccgatcagaaccgattacagctaccgaagcacgtggggagatgcccgcggcttcggtggaaggcggattcatgaaggtacggatatctttgcccattacggccttcctgtcaaatccacatgttacggcgtagttgaaatgaagggctggaaccgcttcggaggatggagaatcggcatcagggacattaacaatacgtatcattattttgcccatctcaatgggtttgccaaagggattaaaacaggacaaatcgttgagcctggccaagtgatcggatcagtcggcagctccggatacggcccgccgggaaccgccgggaagttcccgccgcatctgcactatggcatgtacaaagataacggaagaaccgaatggtcatttgatccatacccgcatttgagggcgtgggagcgatatgaataccaaaaaaagaagtaa

SEQ ID NO: 1910 - DNA, 981 bp, Bacillus sp.
gtgaaagttttgttatccgctcttcttctccttttgtttgcatttgagccttctgcgtctggaaaaaagctttcagatccagtgctgtcgaaacggatggaattatatcataaaatcgaagctgtgacgcagatcccttggtatgcgctcgccgctattgatcaatacgaagaaaacgtgcggagcaaccggaaagatctgcctgacaaggcgggaatcatcagcatctatatacccgatgacatctggagcgggcctgaaaacccgaatccgaaagatgatgcgccgttaagcattaaagtgtttgacggaatcggaatggatggcgatggagacgggaaagccgaggtcagcaacgatgaagatatcttgtatacgttcagccaatacttactgtcgtatggcacagatgaagacaacatccgcatcgggctttggaattattaccggcgtgatcagacagtggggattatatctgaattcatgaagctgtttaaagcctacggccatattgatctgggcgagcattcattcccgcttccgatcagaaccgattacagctaccgaagcacatggggagatgcccgcggcttcggaggaaggcggattcatgaaggtacggatatctttgcccattacggcctgcctgtcaaatccacatgttacggggtagttgaaatgaagggctggaaccgcttcggaggatggagaatcggcatcagggacattaacaatacgtatcattattttgcccatctcaatgggtttgccaaagggattaaaacaggacaaatcgttgagcctggccaagtgatcggatcagtcggcagctccggatacggcccgccgggaaccgccgggaagttcccgccgcatctgcactatggcatgtacaaagataacggaagaaccgaatggtcatttgatccatacccgcatttgagggcgtgggagcgatatgaataccaaaaaaagaagtaa

SEQ ID NO: 1911 - DNA, 999 bp, Bacillus sp.
atgaaaggagattattttgtgaaagttttgttatccgctcttcttctccttttgtttgcatttgagccttctgcgtctggaaaaaagctttcagatccagtgctgtcgaaacggatggaattatatcataaaatcgaagctgtgacgcagatcccttggtatgcgctcgccgctgttgatcaatacgaagaaaacgtgcggagcaaccggaaagatctgcctgacaaggcgggaatcatcagcatctatatacccgatgacatctggagcgggcctgaaaacccgaatccgaaagacgatgcgccgttaagcattaaagtgtttgacggaatcggaatggatggcgatggagacgggaaagccgaggtcagcaacgatgaagatatcttgtatacgttcagccaatacttactgtcgtatggcacagatgaagacaacatccggatcgggctttggaattattaccggcgtgatcagacagtggggattatatctgaattcatgaagctgtttaaagcctacggccatattgatctgggcgagcatgcattcccgcttccgatcagaaccgattacagctaccgaagcacgtggggagatgcccgcggctttggtggaaggcggattcatgaaggtacggatatctttgcccattacggccttcctgtcaaatccacatgttacggcgtagttgaaatgaagggctggaaccgcttcggaggatggagaatcggcatcagggacattaacaatacgtatcattattttgcccatctcaatgggtttgccaaagggattaaaacaggacaaatcgttgagcccggccaagtgatcggatcagtcggcagctccggatacggcccgccgggaaccgccgggaagttcccgccgcatctgcactatggcatgtacaaagataacggaagaaccgaatggtcatttgatccatacccgcatttgagggcgtgggagcgatatgaataccaaaaaaagaagtaa

SEQ ID NO: 1912 - DNA, 999 bp, Bacillus sp.
atgaaaggagattattttgtgaaagttttgttatccgctcttcttctccttttgtttgcatttgagccttctgcgtctggaaaaaaacttccagatccagtgctgtcgaaacggatggaattatatcataaaatcgaagctgtgacgcagatcccttggtatgcgctcgccgctgttgatcaatacgaagaaaacgtgcggagcaaccggaaagatctgcctgaaaaggcgggaatcatcagcatctatatacccgatgatatctggagcgggcctgaaaacccgaatccgaaagacgatgcgccgttaagcattaaagtgtttgacggaatcggaatggatggcgatggagacgggaaagccgaggtcagcaacgatgaagatatcttgtatacgttcagccaatacttactgtcgtatggcacagatgaagacaacatccggatcgggctttggaattattaccggcgtgatcagacagtggggattatatctgaattcatgaagctgtttaaagcctacggccatattgatctgggcgagcatgcattcccgcttccgatcagaaccgattacagctaccgaagcacgtggggagatgcccgcggcttcggtggaaggcggattcatgaaggtacggatatctttgcccattatggccttcctgtcaaatccacatgttacggcgtagttgaaatgaagggctggaaccgcttcggaggatggagaatcggcatcagggacattaacaatacgtatcattattttgcccatctcaatgggtttgccaaagggattaaaacaggacaaatcgttgagcctggccaagtgatcggatcagtcggcagctccggatacggcccgccgggaaccgccgggaagttcccgccgcatttgcactatggcatgtacaaagataacggaagaaccgaatggtcatttgatccatacccgcatttgagggcgtgggagcgatatgaataccaaaaaaagaagtaa

SEQ ID NO: 1913 - DNA, 951 bp, Bacillus sp.
gtgaaagttttgttatccgctcttcttctccttttgtttgcatttgagccttctgcgtctggaaaaaagctttcagatccagtgctgtcgaaacggatggaattatatcataaaatcgaagctgtgacgcagatcccttggtatgcgctcgccgctattgatcaatacgaagaaaacgtgcggagcaaccggaaagatctgcctgaaaaggcgggaatcatcagcatctatatacccgatgatatctggagcgggcctgaaaacccgaatccgaaagacgatgcgccgttaagcattaaagtgtttgacggaatcggaatggatggcgatggagacgggaaagccgaggtcagcaacgatgaagatatcttgtatacgttcagccaatacttactgtcgtatggcacagatgaagacaacatccggatcgggctttggaattattaccggcgtgatcagacagtggggattatatctgaattcatgaagctgtttaaagcctacggccatattgatctgggcgagcatgcattcccgcttccgatcagaaccgattacagctaccgaagcacgtggggagatgcccgcggctttggtggaaggcggattcatgaaggtacggatatctttgcccattacggccttcctgtcaaatccacatgttacggcgtagttgaaatgaagggctggaaccgcttcggaggatggagaatcggcatcagggacattaacaatacgtatcattattttgcccatctcaatgggtttgccaaagggattaaaacaggacaaatcgttgagcctggccaagtgatcggatcagtcggcagctccggatacggcccgccgggaaccgccgggaagttcccgccgcatctgcactatggcatgtacaaagataacggaagaaccgaatggtcatttgatccatacccgcatttgagggcgtgg

SEQ ID NO: 1914 - DNA, 981 bp, Bacillus sp.
gtgaaaattgtgttatccgctcttcttctccttttgtttgcattcgagcctagcatttcgggcaaagaaaagccggattccgtactctctgcacgcatggaattataccgcaaggcggaagcggtcacgcaaatcccttggtacgcgcttgccgccgttgatcaatatgaagaaaatgtgcgcagcaaccgaaacgatttgcccgaaaaatcaggaatcatcagtatctatattccggatgacatatggagcggacctgaaaatcctaaccctaaggatgatgccccgctaagtataaaagtgtttgacgggatcggcatggatggggatggcgacggcaaagccgaggtcagcaatgatgaggatatcttgtatacattcgcccaatacttgctgtcatacggaacggacgtggacaatatccgcatcggactatggaatttttatcatcgtgatcagactgtcggaattattacagagtttatgaaactgtttaaggcttacggtcatattgatctcggtgagcatgcctttcctctgcctgtcagaacagattatagctatcggagcacatggggagatgcccgcggttttggaggcaggcgcatccatgaaggaacggatctgttcgcccattacgggatgccggtccggtctacctgctacggggtgattgaaatgaaaggctggaaccgcttcggaggatggagaattggaatcagagatgtgaataatacgtatcattactttgcccaccttaacggctttgccaaaggaatcaaaaccggtcagattgtcgaaccggggcaagtgatcggttctgtcggcagctcaggctacggcccgcccggaacagccgggaaattccctccgcatctgcattacggtatgtacaaagataacggcagaaccgaatggtcgtttgatccatacccgcatttaagagcatgggaacgttttgaaatacgaaaaaagaagtag

SEQ ID NO: 1915 - DNA, 1050 bp, Bacillus sp.
atgattactgacatttttaagccgggttgccgcaaactatgtgtattcaatatgaaaggagattattttgtgaaagttttgttatccgctcttcttctccttttgtttgcatttgagccttctgcgtctggaaaaaaactttcagatccagtgctgtcgaaacggatggaattatatcataaaatcgaagctgtgacgcagatcccttggtatgcgctcgccgctgttgatcaatacgaagaaaacgtgcggagcaaccggaaagatctgcctgaaaaggcgggaatcatcagcatctatatacccgatgatatctggagcgggcctgaaaacccgaatccgaaagacgatgcgccgttaagcattaaagtgtttgacggaatcggaatggatggcgatggagacgggaaagccgaggtcagcaacgatgaagatatcttgtatacgttcagccaatacttactgtcgtatggcacagatgaagacaacatccggatcgggctttggaattattaccggcgtgatcagacagtggggattatatctgaattcatgaagctgtttaaagcctacggccatattgatctgggcgagcatgcattcccgcttccgatcagaaccgattacagctaccgaagcacgtggggagatgcccgcggcttcggtggaaggcggattcatgaaggtacggatatctttgcccattacggccttcctgtcaaatccacatgttacggcgtagttgaaatgaagggctggaaccgcttcggaggatggagaatcggcatcagggacattaacaatacgtatcattattttgcccatctcaatgggtttgccaaagggattaaaacaggacaaatcgttgagcctggccaagtgatcggatcagtcggcagctccggatacggcccgccgggaaccgccgggaagttcccgccgcatctgcactatggcatgtacaaagataacggaagaaccgaatggtcatttgatccatacccgcatttgagggcgtgggagcgatatgaataccaaaaaaagaagtaa

SEQ ID NO: 1916 - DNA, 978 bp, Bacillus sp.
gtgaaagttctgttatctgctcttctccttttatcagttttctgtccggctgcaagcgggaaagaacaatcggctcctgtttacggtgaacggatgcagttgtaccgcaaagccgaagcagtcacgcagattccttggtatgtgcttgcggcagttgatcaatatgaagaaaatgtccgctcaaaccgaaaggatctgccggaaaaagcgggaatcatcagcatttatattccggatcatttgtggagcggccctgaaaatccaaatcctaaggacgatgcgcctctcagcattaaagtatttgacgggatcggcctggacggcgacggcgacggaaaagccgaggtaagcaatgatgaggatatcctttatacatttgctcagtatttagcgggattcggaaccgatcttgaccatatccgcatcggtctctggaattattaccgccgcgatcagacggtcggcattatcaccgaattcatgaaactgtttaaaacgttcggccgccttgatctcggagagcacgcttttccgcttcccgtgaagacggattacagctaccgcagcacatggggcgccgcacggggtttcggcgggcgccggattcacgaaggaacggatctgttcgctcattacgggctccccgtcagatcgacctgctacggtattgttgaaatgaagggctggaaccgtttcggcggctggagaatcggcatcagggatatcaataacacgtatcactacttcgctcacctgaacggctttgcaaaaggtgtgcataaaggccagatcgtcaaacccggagaggtgatcggctctgtcggcagttccgggtacggaccgccgggcaccgcgggaaaattcccgccgcatcttcactacgggatgtataaagataacggcagatcggaatggtcttttgatccgtatccccatttaagggcatgggaacgaaaagaaatccgcaggaaaaagtaa

SEQ ID NO: 1917 - DNA, 978 bp, Bacillus sp.
gtgaaagttctgttatctgctcttctccttttatcatttttctgtccggctgcaagcgggaaagaacaatcggctcctgtttacggtgaacggatgcagttgtaccgcaaagccgaagcagtcacgcagattccttggtatgtgcttgcggcggttgatcaatatgaagaaaatgtccgctcgaaccgaaaggatctgccggaaaaagcgggaatcatcagcatttatattccggatcatttgtggagcgggcctgaaaatccaaatcctaaggacgaggcgcccctcagcattaaagtatttgacgggatcggcctggacggcgacggcgacggaaaagccgaggtcagcaatgatgaggatattctttatacatttgcacagtatttagcgggattcggaacggatcttgaccatatccgcatcggcctctggaattattaccgccgtgatcagacggtcggcattatcaccgaattcatgacactgtttaaaacgttcggccgccttgatctcggagagcacgcttttccgcttcccgtgaagacggattacagctaccgcagcacatggggcgccgcgcggggtttcggcggtcgccggattcacgaaggaacggatctgttcgcccattacgggctccccgtcagatcgacctgctacggtattgttgaaatgaagggctggaaccgtttcggcggctggagaatcggcatcagggatatcaataacacgtatcactacttcgctcacctgaacggctttgcaaaaggtgtgcataaaggccagatcgtcaaacccggagaggtgatcggctctgtcggcagttccggatacggaccgccgggcaccgcgggaaaatttccgccgcatcttcactacgggatgtataaagataacggcagatcggaatggtcttttgacccgtatccccatttaagggcgtgggagcgaaaagaaatccgcaggaaaaagtaa

SEQ ID NO: 1918 - DNA, 978 bp, Bacillus sp.
gtgaaagttctgttatctgctcttctccttttttcagttttctgtccggctgcaagcgggaaagaacaatcggctcttgtttacggcgaacggatgcagttgtaccgcaaagccgaagcagtcacgcagattccttggtatgtgcttgcggcggttgatcaatatgaagaaaatgtccgctcgaaccgaaaggatctgccggaaaaagcgggaatcatcagcatttatattccggatcatttgtggagcggccctgaaaatccaaatcctaaggacgatgcgcctctcagcattaaagtatttgacgggatcggcctggacggcgacggcgacggaaaagccgaggtaagcaatgatgaggatatcctttatacatttgctcagtatttagcgggattcggaaccgatcttgaccatatccgcatcggtctctggaattattaccgccgtgatcagacggtcggcattatcaccgaattcatgacactgtttaaaacgttcggccgccttgatctcggagagcacgcttttccgcttcccgtgaagacggattacagctaccgcagcacatggggcgccgcacggggtttcggcgggcgccggattcacgaaggaacggatctgttcgctcattacgggctccccgtcagatcgacctgctacggtattgttgaaatgaagggctggaaccgtttcggcggctggagaatcggcatcagggatatcaataacacgtatcactacttcgctcacctgaacggctttgcaaaaggtgtgcataaaggccagatcgtcaaacccggagaggtgatcggctctgtcggcagttccgggtacggaccgccgggcaccgcgggaaaatttccgccgcatcttcactacgggatgtataaagataacggcagatcggaatggtcttttgatccgtatccccatttaagggcatgggagcgaaaagaaatccgcaggaaaaagtaa

SEQ ID NO: 1919 - DNA, 1008 bp, Bacillus sp.
gtgtattcaatcctgaaaggagatcatgttgtgaaagttctgttatctgcccttctccttttatcagttttctgtccggctgcaagcgggaaagaacaatcggctcctgtttacggcgaacggatgcagttgtaccgcaaagccgaagcagtcacgcagattccttggtatgtgcttgcggcggttgatcaatatgaagaaaatgtccgctcgaaccgaaaggatctgccggaaaaagcgggaatcatcagcatttatattccggatcatttgtggagcggccctgaaaatccaaatcctaaggacgatgcgcctctcagcattaaagtatttgacgggatcggccttgacggcgacggcgacggaaaagccgaggtcagcaatgatgaggatatcctttatacatttgcacagtatttagcgggattcggaacggatcttgaccatatccgcatcggcctctggaattattaccgccgtgatcagacggtcggcattatcaccgaattcatgacactgtttaaaacgttcggccgccttgatctcggagagcacgcctttccgcttcccgtgaagacggattacagctaccgcagcacgtggggcgccgcccggggtttcggcgggcgccggattcacgaaggaacggatctgttcgccaattacgggctccccgtcagatcgacctgctacggtattgttgaaatgaaaggctggaaccgtttcggaggctggagaatcggcatcagggatatcaataacacgtatcactacttcgctcacctgaacggctttgcaaaaggtatgcataaaggccggatcgtcaaacccggagaggtgatcgggtctgtcggaagctccggatacggaccgccgggcaccgcaggaaaatttccgccgcatcttcactacgggatgtataaagataacggcagatcggaatggtcctttgacccgtatccccatttaagggcatgggaacgaaaagaaatccgcaggaaaaagtaa

SEQ ID NO: 1920 - DNA, 981 bp, Bacillus sp.
gtgaaagttgtattatccgttctcatcctccttttgttcagctcgcagcccgcggctttcgggcaggaaaagaaagagccggatctgcagacgagaatggcgctttatcataaaacagaggcggccacacatattccctggtatgtttttgcagcagtcgatcaatatgaaatcaacatccgcaaaaaccgaagagacctgccaaagcaaaaaggctacaccggaatctatattccgcaaagcgtttggagcgggccggaaaatccgaatcctaacgatacatctccgctcagcatcaaagtgtttgacggaatcggaatggatggaaacggagacggacgggctgaatctgatcaggatgaagatgtcctttatacgttcggccaatacttgctgacatatggaagagatatcgataacatccgcatcggattgtgggaattttatgaaagggatcagacggtcggaattatttcaggatttatgagacttttccaaacctatggccacatcgatttgggaaaacacgcttttcccctgccggtcaaatctgattacagctacagaagcacgtggggagacgcccgcggattcgggggaagacgtatacatgagggaactgacttgtttgcccacttcggcctgcccgtacgatccacatgctatgggattattgaaatgaaaggctggaaccgcttcggcggatggagaatcggcatcagagatatcaataatacgtaccactactttgcccatctcaacgggttcacgaaaggattgaaagtcggacagatcgttgaaccgggacaggtcatcgggtcggtcggcaatacgggatacgggccgcccgggacagccggaaaattccctccccaccttcactatgggatgtataaagataatggaagaaccgaatggtcttttgatccgtatcctcacttgagggcctgggaacgaaaggaaatcagaaagaaaaaataa

SEQ ID NO: 1921 - DNA, 981 bp, Bacillus sp.
gtgaaagctgtattatccgttctcatcctccttttgctcatcttgcagccgtgcgctcttgcaaaggagaaaaaagagcccgatctgcaaaagagaatggccctttatcataagacagaagccgcaacccatattccttggtatgttttcgcggcagtcgaccaatacgaaatcaatatccgcaaaaaccgcaaagacttgccgaagcaaaaagggcacaccgggatatatattccgcaaagcgtgtggagcggacctgaaaaccccaatcctaaagatacatcgccgctcagcatcaaggtttttgacggaattggaatggacggaaacggagacggactcgcagaaccggatcaggatgaagacgtcctttatacgtttggacaatacttgttgacatacggaagggacattgaaaatatccgcatcggtctgtgggagttttacgaaagggatcagacggtcggcatcatatcaggctttatcaggctttttcaaaaatacggccacattgatttgggcaagcacgcctttccccttcccgtaagatcagattacagctatagaagcacatggggagatgcccgcggattcgggggcagacgcattcacgaagggacggatttgttcgcccattacggcctccccgtccggtcgacatgctacggcattgtggaaatgaaaggctggaaccgtttcggcggatggcggatcggaatcagagacatcaacaatacgtaccattatttcgctcatttgaacggtttcacaaaaggcttgaaagtgggagaaatcgtcgagcccggccaggtgatcggctcagttggagcgacgggatacgggccgccgggaacatcgggaaaattcccgccccaccttcactacggcatgtataaagacaatggaagaacagagtggtcttttgacccttatcctcatttaaaggcatgggaacggaaggaacttcgaaagaaaaaataa

SEQ ID NO: 1922 - DNA, 993 bp, Bacillus sp.
gtgaaagctgtattatccgttctcatcctccttttgctcatcttgcagccgtgcgctcttgcaaaggagaaaaaagagcccgatctgcaaaagagaatggccctttatcataagacagaagccgcaacccatattccttggtatgttttcgcggcagtcgaccaatacgaaatcaatatccgcaaaaaccgcaaagacttgccgaagcaaaaagggcacaccgggatatatattccgcaaagcgtgtggagcggacctgaaaaccccaatcctaaagatacatcgccgctcagcatcaaggtttttgacggaattggaatggacggaaacggagacggactcgcagaaccggatcaggatgaagacgtcctttatacgtttggacaatacttgttgacatacggaagggacattgaaaatatccgcatcggtctgtgggagttttacgaaagggatcagacggtcggcatcatatcaggctttatcaggctttttcaaaaatacggccacattgatttgggcaagcacgcctttccccttcccgtaagatcagattacagctatagaagcacatggggagatgcccgcggattcgggggcagacgcattcacgaagggacggatttgttcgcccattacggcctccccgtccggtcgacatgctacggcattgtggaaatgaaaggctggaaccgtttcggcggatggcggatcggaatcagagacatcaacaatacgtaccattatttcgctcatttgaacggtttcacaaaaggcttgaaagtgggagaaatcgtcgagcccggccaggtgatcggctcagttggagcgacgggatacgggccgccgggaacatcgggaaaattcccgccccaccttcactacggcatgtataaagacaatggaagaacagagtggtcttttgacccttatcctcatttaaaggcatgggaacggaaggaacttcggaaggaacttcgaaagaaaaaataa

SEQ ID NO: 1923 - DNA, 981 bp, Bacillus sp.
gtgaaagtggttttagccatcatgattgctctttcaatgctccctttacctgttcatgcaaaagggacgggcaagcagccagatgaattgaagcaaagaatggccctatatgaaaaagtctccatcacaactcaggttccatggtatgtacttgctgcagttgatcagtatgaacacaatattcgaaaaagcagaagagatttaccgaaacaaaaaggcgtcattggcatctacattccccgggaaatgtggattggaccagaaaacccgaataaacaggatacctctcctttaagcattaaagtgtttgatggaattggtcttgatgggaatggggatggcaaagcaagcagcgatgacgatgaggatgtattattcacttttgcacaatacttgcttcactacggcagcaatattgatcaattaaaaattggcttatgggactattatggacgtgatcaaaccgttggaatcatttcatcttttatgaagctatataagcactacggccatcttgatcttggaaagcatgcttttcctcttccggttggagctgactacagctaccgaagtacatggggagatgcgagagggtttggaggaaggagaattcatgagggaaccgatttatttgcccattatggacttcccgttcgtgcgacatcgtatggcgtgattgaaatgaaaggctggaaccgctttggcggctggcggataggcattcgagatattcataatcattatcattactttgctcacttaaatggctttgcgaaaggactcaagacaggtcaaattgttgaacctggccaggtgattggatctgtcggaagctccggttacggtcctccaggcaccgcaggaaagtttccgccgcatcttcactatggcatgtacaaagacaacggcagaacggaatggtcatttgatccatatcctcatttgagggcgtgggaaagagctgaacggaaacgaaagtaa

SEQ ID NO: 1924 - DNA, 981 bp, Bacillus sp.
gtgaaattggttttagcgatcatcatcgctctttcaatgattcccgcaccagtccatgcacaaggggcaaacaaacagcctgatgaattaaaacagcgaatggcactgtatgaaaagatcgccatcaccacacaggttccgtggtatgtacttgctgcggttgatcagtatgaacacaatatacgcaaaagcagaagagatttaccaaaacaaacaggtgtgattggcatctacattccccgggaaatgtggataggaccagaaaatccaaataagcaagatacctcaccattaagcattaaagtgttcgacggtattgggcttgatggaaatggggatggaaaagcggaaatcgataacgatgaagatgtcctgttcacgtttgctcaatacttgcttcattacggcagcagcatcgaccaattaaaaatcgcgctgtgggattattacggacgtgatctaaccgttggaatcatttcatcttttatgaagctctatcagcattacggccatcttgaccttggaaagcatgcgtttcctcttccggttggagctgactacagctacaggagtacatggggtgatgcgagaggctttggaggcagaagaattcatgagggcactgatctttttgctcattacggtcttcctgttcgtgcgacatcgtacggcgtgattgaaatgaaaggctggaatcgctttggcggctggcggatcggcattcgagatattcataatcattatcattattttgcccacttaaatggctttgcaaaaggactcaaagctgggcagattgtagaacctggtcaagtcatcggatcagtcggaagctccggttacggtccacctggcacagcaggaaaattcccgccacacctccattacggcatgtataaagacaatggacgaactgaatggtcgtttgatccttatcctcatttaagggcatgggaaagagccgagcggaaacgtcattaa

SEQ ID NO: 1925 - DNA, 1008 bp, Bacillus sp.
atgcttgatgaaaggagatggacgtttgtgaaagtggttttagccatcatgatcgctctttcaatgcttcctttacctgttcatgcacagggggaaggcaagcagccagatgtactgaagcagcgaatggcactttacgaaaaagtcgccatcacgacacaagttccatggtatgtacttgctgcggttgatcagtatgagcacaatattcgaaaaagcagaagagatttaccgaaacaaaaaggcgtcattggcatctacattccccgggaaatgtggatcggccctgaaaacccgaataagcaggatacctctcctttaagcattaaagtgtttgatggaattggacttgatggaaacggggatggaaaagcgaacagcgatgacgatgaggatgtattattcacgtttgctcaatacttgcttcattacggcaacagcattgatcaattaaaaattgctttatgggactattatggacgagatcaaaccgttggaatcatttcatcttttatgaagctatatcagcactatggccatcttgacctcggaaagcacgctttccctcttccagtcggagctgactacagctaccggagtacatggggagatgcaagaggatttggaggcagaagaattcatgagggtacggatttatttgcccattatggacttcccgttcgtgcgacatcgtatggtgtgattgaaatgaaaggctggaaccgctttggcggctggcggattgggattcgagatattcataaccattatcattacttcgctcatttaaatggctttgcaaaaggactcaaaacaggtcaaattgttgaacccggacaggtcattggatctgtcggaagctccggttatggccccccaggcacagcaggaaaatttccgccgcatcttcactatggcatgtataaagacaacggcagaactgaatggtcttttgatccataccctcatttaagggcgtgggaaagagctgagcgaaaacgacattaa

SEQ ID NO: 1926 - DNA, 1008 bp, Bacillus sp.
atgcttgatgaaaggagatggacgtttgtgaaagtggttttagccatcatgatcgctctttcaatgctccctttacctgttcatgcacaaggggaaggcaagcagccagatgtactaaagcagcgaatggcactatacgaaaaagtcgccatcacgacacaagttccatggtatgtacttgctgcggttgatcagtatgagcacaatattcgaaaaagcagaagagatttaccgaaacaaaaaggcgtcattggcatctacattccccgggaaatgtggatcggccctgaaaacccgaataagcaggatacctctcctttaagcattaaagtgtttgatggaattggacttgatggaaacggggatggaaaagcaagcagcgatgacgatgaggatgtattattcacgtttgctcaatacttgcttcattacggcaacagcattgatcaattaaaaattgctttatgggactattatggacgagatcaaaccgttggaatcatttcatcttttatgaagctatatcagcactatggtcatcttgacctcggtaagcacgctttccctcttccagtcggagctgactacagctaccggagtacatggggagatgcaagaggatttggaggcagaagaattcatgagggtacggatttatttgcccattatggacttcccgttcgtgcgacatcgtatggtgtgattgaaatgaaaggctggaaccgctttggcggctggcggattgggattcgagatattcataaccattatcattacttcgctcatttaaatggctttgcaaaaggactcaaagcaggtcaaattgttgaacccggacaggtcattggatctgtcggaagctccggttatggccctccaggcacagcaggaaaatttccgccgcatcttcactatggcatgtataaagacaatggcagaactgaatggtcttttgatccataccctcatttaagggcgtgggaaagagctgagcggaaacgacattaa

SEQ ID NO: 1927 - DNA, 2643 bp, Salinibacillus sp.
atgaaaaagagattaatcgcaccgatgctcctgtccgccgcgtcccttgccttttttaccataaccggctctgcacaggctgcagcgtatacggactactcgatttataaggtggagccggcaaaaacattcagcacagaaagccaagcctctcaggccgccgccaaattggaaaaagacacaggctgggatgcctcctatcaggcttcaggcacaacagcaacctaccaaattaccgctacaggcatacatagcgaagcacaagctaaaaccgtgctgagcggactgacaaaacagacagctattacaggcacatccagtccagtcggcagcaaacagccgtatatgaccatcacatccggcgcaatatcaagtgaaaaacaggccaacaccctgctggccaagcttaagcaggaaacaggggtatccggcgctgtgaagatgtccggcacagcccagttttacatgaacgtggttacctcggaaatagcagaagagacgaaggtcaaggagcttatccaaggcctgacaaagaaaacggggataaaaagcacgtaccagcctgttacacatgaagtgtctgtaacaagcattcaatcaggcgatattatcggggacagcaaggctgcccaagtcaaaaacgcattccaaaaagaatcaggactgaaggcatcattaaaagaaacagcgaaaggccaagcttattacacgtttacaacagcctctatatcaggtgaagcaaacgccaagactttgttacagcagctgaaacaaagtaccggaattacgggaagctacaagtcaatcaatcaaaaaacaacagcagacgtatacaatgtccaatcggcttatttcaaagggctgaatacagtgaaggatgccatcagccaaatcaagaaaaacactggggtgtccggatattatcaaaaggtcggcaaaagcacatcatatacggtaaacatgaagaatttgacaaaacagcagcttcaaaaggtcgacgcattcttcaaaaagaaaaaatggcattacacgtcatctgccgtgaaaaaaacggcaacgtcatctgcctatcaaattacgactgcacagattttaggtgagcagcaggccaacaaagctgcggccttcttcacacagaaaaaagtaaaggcaacgaaaaaagcgactggaaaaaaaaccgaaaaccaatatcagctcatttctgaagaaacaacagaccaagcaaaagttacaaaaggtttgaacgttttaaagaaaaataagctaagtgctgcagcaaaaacagtaaaaaaacaaactgccaacacgtttaaaattacaactgaatctctgctggaagcggctaaagtcaatgaagccatcacgttctttaaatcgaatcagatttcagccgcaatcaaaaaaacgggtcagacagcaggaagtaaatatcgaatcaccactgaggcgatcattagccaaaaggacatcgatcgtgtacttgcttttttcaaaaaaaataacgcctctggcacagccgcgaaaacaggcgcgacagcatatacacaatacaaaatcctgacatctcagctcagcagcaaaacagcattgaacaatggactgaactattttaaagctcagcagttaagcgcgaactacacgaccaaaagcaacacgctttataaaattagccttaacgagcaattcacaggcaatagcgcagcttcagcggcatcagcgaagctgaaacaattatatggatggacatcatccactgtaaaaataaagaacggtccgcaaatcatgaaaacgaattataatctctcgcttcgtgatatggttcaaaaacaaatgaaagtcagcccgcaaaccgacggtgcagcttacgtatcactcacgtatatcaatacagcaacctcaacggttacagctgatgtactcaacatccggtcaacgccggcagtcagtccgacgaacgtcatcggccaattaaaaaaaggcgataaagtgaaaatcatcggccagacaaacgggtgggctaaaatcaatatggggtggagaaatgctagcagcgatgaagtaggacaatacgttgacccgaacaacttttccaaggacagcaaatactacttccaatttcttaagctgtcacagacagccggcctcagcgttgccgaagtcaatcagaaagtgcttgcgggcaaaggcatactgacagggaaagcaaaggcatttatcgatgccgcaactaagtacagcatcaacgagctatatttaatctcacacgctctccttgaaacaggcaacggaacatccggtttggccaatggtttaacctataacggaagaaccgtttataacatgtacggaatcggcgcatacgatagcaacccgaactactacggcgccaaatacgcatacgagcaaggctggttcacaccagaagctgccattatcgggggcgccaagttcataggctcatcctacattcataacacagcctacaatcaagacacgctatacaagatgagatggtcagccacagctgcacaccaatacgcaacagatatcggctgggcgtacaaacaagtaaaccgcatgtacagcctgtattcattactggatgggtacacactgtattatgatgttccggagtatcaataa

SEQ ID NO: 1928 - DNA, 2643 bp, Bacillus sp.
atgaaaaagagattaatcgcaccgatgcttctgtccgccgcgtcccttgccttttttaccataaccggctctgcacaggctgcagcgtatacggactactcgatttataaggtggagccggcaaaaacattcagtacagaaagccaagcctctcaggccgccgccaaattggaaaaagacacaggctgggatgcctcctatcaggcttcaggcacaacagcaacctaccaaattaccgctacaggcatacatagcgaagcacaagctaaaaccgtgctgagcggactgacaaaacagacagccattacaggcacatccagtccagtcggcagcaaacagccgtatatgaccatcacgtccggcgcaataccaagtgaaaaacaggccaacaccctgctgtccaagcttaagcaggaaacaggggtatccggcgctgtgaagatgtccggcacagcccagttttacatgaacgtggttacctcggaaatagcagatgagatgaaggtaaaggagcttatccaaggcctgacaaagaaaacggggataaaaagcacgtaccagcccgttactcatgaagtgtctgtaacaagcattcaatcaggtgctattatcggagacagcaaggctgcccaagtcaaaaacacattccaaaaagaatcaggtctgaaggcatcattaaaagaaacagcgaaaggccaagcctattacacgtttacaacagcctctatatcaggtgaagcaaacgccaagactttgttacagcagctgaaacaaagcaccggaattacgggaagctacaagtcaatcaatcaaaaaactacagcagacgtatacaatgtccaatcggcttatttcaaagggctgaatacagtgaaggatgccatcagccaaatcaagaaaaacactggggtgtccggatattatcaaaaggtcggcaaaagcacatcatatacggtaaacatgaagaatttgacaaaacagcagcttcaaaaggtcgacgcatttttcaaaaagaaaaaatggcattacacgtcatctgccgtgagaaaaacggcaacatcatctgcctatcaaattacgactgcacagattttaggtaagcagcaggccaacaaagctgcaaatttcttcacacagaaaaaagtaaaggcaacgaaaaaagcgactggaaaaaaagccgaaaaccaatatcagctcatttctgaagaaacaacagaccaagcaaaagttacaaaaggtttgaacgttttaaagaagtataagctaagtgctgcagcaaaaacagtaaaaaaacaaactgccaacacgtttaaaattacaactgaatctctgctggatgcggcaaaagtcaatgaagccatcacgttctttaaatcgaatcagatttcagccgcaagcaaaaaaacgggtcagacagcaggaagtaaatatcaaatcaccactgaggcgatcatcagccaagaggacatcgatcgtgtacttgcttttttcaaaaaaaataacgtctctggcacagccgcgaaaacaggcgcaacagcatatacacaatacaaaatcctgacatctcagctcagcagcaaaacagcattgaacaatggactgaaatattttaaagctcagcagttaagcgcgaactacacgaccaaaagcaacacgctttataaaattagccttaacgagcaattcacaggcaatagcgcagcttcagcggcatcagcgaagctgaaacaattatatggatggacatcatccactgtaaaaataaaaaacggtccgcaaatcatgaaaacgaattataatctctcgcttcgtgatatggttcaaaaacaaatgaaagtcagcccgcaaaccgacggtgcagcttacgtatccctcgcgtatatcaatacagcaacctctacggttacagctgatgtactaaacatccggtcaacgccggcagtcagtccgacgaacgtcatcggccaattaaaaaaaggcgataaagtgaaaatcatcggccagacaaacggctgggccaaaatcaatatggggtggagaaacgccagcagtgatgaagtaggacaatacgttgacccaaacaacttttccatggacagcaaatactacttccaatttcttaagctgtcacagacagccggcctcagcgttgccgaggtcaatcagaaagtgcttacgggcaaaggcattctgacaggaaaagcaaaggcatttatcgatgctgctactaagtacaacatcaacgagctatacttaatctcacacgctctccttgaaacaggaaacggaacatccgatttggccaatggtttaacctataacggaagaaccgtttataacatgtacggaatcggcgcatacgatagcaacccgaactactacggcgccaaatacgcatacgagcaaggctggttcacaccagaagccgccattatcggcggcgccaagttcataggctcatcctacattcataacacagcctacaatcaagacacgctatacaagatgagatggtcagccacagctgcacaccaatatgcaacagatatcggctgggcgtacaaacaagtaaaccgcatgtacagcctgtattcattactggatggatacacactgtattatgatgttccggaatatcaataa

SEQ ID NO: 1929 - DNA, 2643 bp, Bacillus sp.
atgaaaaagagattaattgcaccgatgcttctgtccgccgcgtcccttgccttttttaccataaccggctcagcacaggctgcagcgtatacggactactcgatttataaggtggagccgggaaaaacattcagtacagaaagccaagcctctcaggctgccgccaaactggaaaaagacacaggctgggatgcctcttatcaggcttcaggcacaacagcaacttaccagattaccgctacaggcatacatagcgaagcagaagctaaaactttgctgagcggactgacaaagcagacagccattacaggcacatccagtccagtcggcagcaaacagccgtatatgaccgtcacgtccagcgcaatatcaagtgaaaaacaggcaaacattctgctggccaagcttaagcaggaaacaggtgtcaccggcgctgtgaagatgtccggcacagcccagttttacatgaacgtggttacctcggaaatagcagatgagaaaaaggtcaaggagcttatccaaggcctgtcaaagaaaacggggataaaaagcacgtaccagcctgtcacacatgaagtatctgtgacaagcattcaatctggcgctatgatcggagacagcaaggctgcgcaagttaaaaatgcattccaaaaagaatcgggactgaaggcatcgttaaaagaaacagtgaaaggccaagcctattacacgtttacaacagcccctatatcaggcgaagcaaatgcaaagactttgttacagcagctgaaacaaagcaccggaattacgggaagctacaagtcaattaatcaaaaaacaacagcagacgtatacaatgtccaatcggcttatttcaaagggctgaatacagtgaaggacgccgtcagccaaatcaagaaaaacactggggtgtccggatattatcaaaaggttggcaaaagcacatcatatactgtaaacatgaagaatttgacgaagcagcagcttcaaaaggtcaatgcattcttcaaaaagaaaaaatggcattacacatcatctgccgtgaaaaaaacgacaacgtcatctgcctatcaaattacaactgcacagattttaggtgagcagaaggccaacaaagctgcggccttctttacacagaaaaaagtaaaggcaacgaaaaaagcgactggaaaaacaaccgaaaaccaatatcagctcatttctgaagaaacaacagaccaaacaaaagttacaaaaggtttgaacgttttaaagaaaaataagctgagtgctacagcaaaaacagtaaaaaaacaaattgctaacacatttaaaattacaactgaatctctgctggaagcggcaaaagtcaatgaagccataacgttttttaaatcgaatcagatttcagccgcaagcaaaaaaacgggtcaaacaacaggaagtaaatatcaaatcaccactgaggcgatcatcaacaaagaggacatcgatcgtgtacttgcttttctcaaaaaaaataacgcctctggcacggccgcgaaaacaggcgctacagcatatacacaatacaaaatcctgacatctcagcttagcagcaaaacagcattgaacaatggactgaactattttaaagctcaacagttgagcgcgaactacacaaccaaaagcaacacgctttataaaattagccttaatgagcaattcacaggcaatagtgcagccttagcggcatcagcgaagctgaagcaattatatggatggacatcatccattgtaaaaatcaaaaacggtccgcaaatcatgaaaacgaattataatctatcgcttcgtgatatggttcaaaaacaaatgaaagtcagcccgcaaaccgacggtgcagcttacgtatcactcacatatatcaatactgcaacctcaacggtcacagctgatgtccttaacatccggtcaacaccggcagtcagtccgacgaacgtcatcggccaattaaaaaaaggtgataaagtgagaatcatcggccagacaaacggctgggctaaaatcaatatggggtggagaaacgctagcagtgatgaagtaggacaatacgttgacccaaacaacttttccatggacagcaaatactacttccaatttcttaagctgtcacagacagccggcctcagcgttgccgaggtcaatcagaaagtgcttgcgggcaaaggcatcctgacagggaaagcaaaggcatttatcgatgccgcaaataagtacagcatcaacgagctatatttaatctcacacgctctccttgaaacaggcaacggaacgtccgtactggccaatggtttaacctataacggaaaaaccgtttataacatgtacggaatcggcgcatacgatagcaacccgaactactacggcgccaaatacgcatacgagcaaggctggttcactccagaagccgccattatcgggggcgccaaattcataggcacatcctacattcataacacagcctacaatcaagatacgctatacaagatgagatggtcagccacagctgcacaccaatacgcaacagacatcggctgggcatacaaacaagtaaaccgcatgtacagcctgtattcattgctggatggatacacgctgtattatgatgttccggagtatcaataa

SEQ ID NO: 1930 - DNA, 2643 bp, Bacillus sp.
atgaaaaagagattaatcgcacctatgcttctgtccgccgcgtcccttgccttttttgccatatccggttctgcacaggctgcagcgtatacggactactcgatatataaggtagagccggctaaaacgttcagtacagaaagccaagcctcgcaggctgttgccaaactggaaaaagacaccggctgggatgcttcctatcaggcttcaagcacaacaacgacctaccaaatttccgctgcaggcatacaaagcgaagcagaagcgaaagcaatactgagtgggctcaacaaacagacagcgattacaggcacgtcaagtcctgtcggtagcaaacagccgtatgtcaccatcacctcaggtgccatttccggagaaaaacaggcaaacactttgctgaccaagcttaaacaggagacgggagtggctggcgctgtaaaagcttcaggaacagctcagtcttatgtgaacgtcacgacatcagaaatcgctgatgagacaaaagtcaaggcgcttatacagagcctggctaagcaaacagggattaaaagctcatatcagccaatcacacacacggtttctgtcacagccattcagtcaggcacaatcgtgggagacagcaaagctgagcagatcaaaagcgcattccaaaaggaatcagggctgaaggcatcattaaaagcaacggtgaaaggacaagcctattatacttttacaacagccgccattttaggtgaagcgaatgccaaaaacctattaaatcagctgaaacagagcactggtattacaggaagctacaagtcaatcaatcaaaaagcaactgctgagtcatacaatgtccaatcagcttatttcaaagggctgaatacagtgaaggacgccatcagccaaatcaagaaaaacaccggtgtatccggcagttatcaaaaggttggcaaaagcacatcatataccgtgaatatgaagggtttaacaaaacagcagctgcaaaaagtagacactttctttaaaaagaaaaagtggcattacacgtcatccagcgtcaaaaaaacgacaacgtctgcagcctatcaaattacgacggcaaagattttaggagagcagcaagcaaacaaagccgcagccttctttgctcagaaaaaagtaaaggcaacgaaaacagcagctggaacaacagcagaaaatcaatatcagctcatctcagaagaaacatcagatcaagcaaaagttacaaagggcttgaacgtattaaagaaaaatcagctcagtgcatctgcaaaatcagtcaaaaaacaattagctaacacgtttaaaataacaactgaatctctgcttgatacaacgaaagtcaatcaggcacttacgtttttcaaatcgaatcacatatcagcagcaagccagaaaaccggtcagacagcagcgagcagctataaaatcatgactgaagccatcatcagccaaaaagatattgaccgcgttttagcatttttcaaacaaaacaatgccgccggcacaacagcaaaaacaggcgaaacggcatatacacaatacaaaatcgtgacagctcagctcagcagcaaaacagcattgaacaacgggttaacctatctaaaagcgcaaagtgtaagcccgagctacacaaccaaaaccaatacgctttataaagtcagcctaaacgaacagttcacaggcaatgacgcagctgctgcggcatcatcgaagctaaaacaattatacgggtgggcatcatctatcgtgaaaatcaaaaacggcccgcaaatcatgaaaacaaattacaatctctcgcttcgtgatatggtccaaaaacaaatgacagtaagcccgcaaacagacggggcggcttacgtatcgctcacttatattaatacagcaacttcaaccgttacggctgatgtattaaatattcggtctacaccggcagtcagcccgacgaacgtgatcgaccaatttaaaaagggcgataaggtgaaaatcatcggccagacaaacggctgggccaaaatcaatttgggctggcgaaacgcaagcagtgatgaagtggttcaatacgtggatccgaataacttttccagagacagcaaatactacttccaatttctcaaactgtcacagacagccggcctcagtgtcactgaagtcaatcagaaagtgcttgccagcaaaggcatcctgacagggaaagcaaaggcgtttatagatgccgccaataaatacggcatcaacgagctgtatttaatctcacacgctctccttgaaacaggtaacggaacatccgatttagccaatggcttaacttataacggaaaaaccgtatataacatgtacggaattggcgcatacgacagcaacccgaattactacggcgccaaatatgcgtacgagcaaggctggttcacaccagaagcggccattatcggcggagcaaaattcataggctcatcgtatatacacaacacagcctacaatcaggacacactgtacaaaatgagatggtcagccacagcaacacaccaatatgcaacagacatcggctgggcgtacaaacaagtaaaccgcatgtacagcctgtattcattgctggacggttatacgctttactttgatgttccggaatatcaataa

SEQ ID NO: 1931 - DNA, 2643 bp, Bacillus sp.
atgaaaaagagattaatcgcacctatgcttctgtccgccgcgtcccttgccttttttgccataaccggttctgcacaggctgcagcgtatacggactactcgatatatgaggtagagccgtcaaaaacgttcagctcagaaagccaagcctcgcaggctgtcgccaaactggaaaaggacaccggatgggacgcttcctaccaagcttcaggaacaacaacgacttaccaaatttccgctgcaggcatacaaagcgaagccgaagcgaaagcaatcctgagcggacttaccaaacagacagcgattacaggcacgtcaagtcctgtcggcagcaaacagccgtatgtcactatcacctcaggtgccatttccggagataaacaggcaaacacaatcctggccaagctaaaacaggagacgggagtgggtggcgctgtaaaagcgtccggaacagctcagtcttatgtaaacgtcacgacaccagaaatcgctgatgagacaaaagtcaaagcgcttatccagggcttggttaagcaaacggggattaaaagcacgtatcagcccatcacacacacgatgtctgtcacaaccattcagtcaagcacaatcgtgggagacagcaaagctgaacagatcaaaaacgctttccaaaaggaaactggcctgaaggcatcattaaaagcaacggtgaaaggacaagccttctatacgttcacaacagccgccatttcaggtgaagcgaatgccaaaaatctagtaaaccagctgaaacagagcacaggtattacaggaagctacaagtcaatcaatcaaaaaaacactgttgaatcatacaatgtccaatcagcttatttcaaagggctgaatacagtgaaggacgccatcagccaaatcaagaaaaacaccggcgtatccggcagttatcaaaaggttggaaaaagcaattcatataccgtgaatatgaagggattaacgaaacagcagctgcaaaaggtagacactttctttaaaaagaaaaagtggcattacacgccatcaagcgtcaaaaaaacgacaacgtttacagcctatcaaatgacgacagcaaagattttaggcgagcagcaagcaaacaaagccgcagccttctttacccagaaaaaagtaaaggcaacgaaaacagcagctggaacatcagcagaaaaccaataccagctcatctcagaagaaacatcagatcaagcaaaagtcacaaagggcttgaatgtattaaagaaaaatcagctaagtgcatctgcaaaatcagtcaaaaaacaaatagctaacacatttaaaataacaactgaatctctgcttgatacagtgaaagtcaatcaggcactcacattttttcaatcgaatcacatatcagcagcaagccagaaaaccggtcagaccgcagcaagcagctataaaatcgtgactgaggccatcatcagccaagaagatattgaccgcgttttagcgttttttaaacaaaacaatgccgccggcacaacggcaaaaacaggcgaaacggcatatacacaatataaaatcgtgacagcccagctaagcagtaaaaccacattgaacaatggattaacctatctaaaagcgcaaagtttaagcccaagctacacaacgaaaagcaatacgctttatcaaatcagcttaaacgaacagttcacaggcaatgacgcagcttcagccgcatcagcgaagctaaagcaattatacggatggacatcatctattgtgaaaatcaaaaacggcccgcaaatcatgaaaaccaattacaatctctcgctacgtgatatggtccaaaaacaaatgacagtcagcccgcagacagatggggcggcttacgtatcgctcacttatattaatacagcaacgtcaacggttacggctgatgttttaaatatccggtcaacgccggcagtcagcccgacaaacgtaatcggccaatttaaaaaaggcgataaggtaaaaatcatcggccagacaaacggctgggccaaaattaatttaggctggcgaaacgcaagcagtgatgaagtggttcaatacgtgaacccgaataacttttccagagacagcaaatactacttccaatttctcaagctgtcacagaccgccggattaaacgctgctgaagtcaatcagaaagtgcttactggcaaaggcatcctgacaggaaaagcaaaggcatttatcgatgccgccaataaatacggcatcaacgagctgtatttaatctcacacgctctccttgaaacaggcaacggaacatccgatttagccaatggcttaacctataacggaaaaaccgtatataacatgtacggaattggcgcctacgacagcaatccgaattactacggcgctaaatacgcgtacgagcaaagctggttcacaccagaagcggccattatcggcggggccaagttcatcggctcatcgtatattcacaacacagcctacaatcaggacacactgtacaaaatgagatggtcacccacagcgacacaccaatacgcaacagacatcggctgggcgtacaagcaagtaaaccgcatgtatagcctgtattcattgctggatggttatacgctttactttgatgttccggaatatcaataa

SEQ ID NO: 1932 - DNA, 2643 bp, Bacillus sp.
atgaaaaagagattaatcgcacctatgcttctatccgccgcgtcccttgccttttttgccatgtctggttccgcccaggccgccgcgtataccgactactccatatataaggtagagccgtcgaatacgttcagtacagaaagccaagcctcacaagctgtcgccaaactggaaaaagatactggctgggatgcatcctatcaggcttcaggcacaacaacgacctaccaaatttccgcctcaggcattcatagcgactcagaagcgaaagcaatactgagcggactcaccaaacagacatcgattaccggaaagtcaagtcctgtcggaagcaaacagccatatgtcaccatctcgtcaggtgccatttccggagaaaaacaggccaacacaatcctggcaaagctgaagcaggagacgggagtagctggcgctgtaaaagcgtacggagcacctcagccctatatgaatgtcatgacatcagacattgctgatgagacaaaagtcaaggcgcttatccagagcctggctaagcaaacggggattaaaagctcgtatcagcccatcacacactcggtgtctgtcacaaccatccagtcaggcacaatcgtcggagacagcagagcagcgcagatcaaaagcgcctttcaaaaggaatcggggctgcaggcatcattaaaggaaacggtgaaaggacatgcctattatacgtttacaactgccgccatttcaggtgaagcgaatgccaaaactctattgcagcagctgaaacaaagcactggcatcacaggcagctacaagtcaatcaatcaaaaaacaaccgttgagtcatacaatgtccaatcagcttatttcaaaggcctgaatacagtaaaggacgccatcagccagatcaagaaaaacaccggcgtatccggcagttaccaacaggttggaaaaagcacatcatataccgtgaatatgaaggggataacaaaacagcagctccaaaaagtagatactttctttaaaaagaaaaaatggcattatacgtcatccagcgtcaaaaaaacaacaacgtctgcggcttaccaaatcacgacagcaaagatcttaggcgagcagcaagcgaacaaagcagcagccttctttgctcagaaaaaagtaaaagccacaaaaacaacagctggaactacagcagaaaatcaatatcaactcatctcagaagaaacatcagaccaatcaaaagtcacaaagggattgaacatattaaagcaaaatcagctgagtgcttctgcgaaatcagtcaaaaaacaaatagctgacacattcaaaatcacaactgaatctctgcttgatcaaacgaaagtcaatcaggcactcacgtttttcaagtcgaatcatatatcagcagcaagccagaaaaccggccagtcggcagcaagcagctatcaaatcacaactgaagccatcatcagccaagaagacattgaccgcgttttagcattttttaaacaaaacaatacctccggcacaacggcaaaaacaagcgaaacggcatatacacaatacaaaatcgtgacagcccagctcagcagcaaaactgcattaaacaatgggttaacctatcttaaatcgcaaggtttaactccgagctacacaacgaaaagcaatacgctttataaaatcagcgtaaacgaacagttcacaggcaatgatacagctgctgcggcatcatcgaagctaaaacaattatacggatgggcatcatctatcgtgaaagtcaaaaacggcccgcaaatcatgaaaacaaattacaatctctcgcttcgtgatatggtccaaaaacaaatgacagtaagtccgcaaacagacggggcggcttacgtatcgctcacgtacattaatacagcaacatcaaccgttacggctgatgcactaaatatccggtcaacgccggaagtcagcccgacgaacgtgatcggccaatttaaaaaaggcgataaggtaaaaatcatcggccagacaaacggctgggccaaaattaatttaggctggcgaaacgcaagcagtgatgaagtggttcaatacgtggacccgaataacttttccagagacagcaaatactacttccaatttctcaagctatcacagacggccggattaaacgctactgaagtcaatcagaaagtgcttgcgggtaaaggcatcctgacagggaaagcaaaagcatttatcgatgccgccaatcaatacggcatcaacgagctgtacttaatctcacacgctctccttgaaacaggcaatggaacatctgatttagccaatggcttaacctataacggaaaaaccgtatataacatgtacggaattggcgcctacgacagcaacccgaattactacggcgctaaatacgcgtacgagcaaggctggttcacaccagaagcggccattatcggcggagccaaattcataggctcatcgtatattcacaacacagcctacaatcaggacacactgtacaaaatgagatggtcagctacagcgacacaccaatacgcaacagacatcggctgggcgtacaaacaagtaaaccgcatgtacagcctgtactcattgctggacggttacacactttactttgatgttccggaatatcaataa

SEQ ID NO: 1933 - DNA, 2619 bp, Bacillus sp.
atgcttctatccgccgcgtcccttgccttttttgccatatctggttctgcccaggcagccgcgtataccgactactcactatatcaagtagagccgtcgaatacgttcagtacagaaagccaagcctcacaagctgtcgccaaactggaaaaagatactggctgggatgcatcctatcaggcttcaggcacaacaacgacctaccaaatttccgcctcaggcattcatagcgaatcagaagcgaaagcaatactgagcggactcgccaaacagacatcgattacaggaacgtcaagtcctgttggaagcaaacagccatatgtcaccatctcgtcaggtgccatctccggagaaaaacaggccaacactgtcctagcaaagctgaaacaggagacgggagtggctggcgctgtaaaagcttacggagcagctcagccctatatgaacgtcatgacatcagacattgctgatgagacaaaagtcaaggcgcttatccagaacctggccaagcaaacggggattaaaagctcgtatcagcccatcacacacacggtgtctgtcacaaccattcgttctggcacaatcgtgggagacagcagagcagcgcagatcaaaaaagccttccaaaaggaatcggggctgaaggcatcattaaaggaaacagtgaaaggacaagcctattatacgttcacaactgctgccatttcaggtgaagcgaatgccaagactctattgcagcagctgaaacagagcactggcatcacaggcagctacaagtccatcaatcaaaaaacaaccgttgagtcatacaatgtccaatcagcttatttcaaaggcctgaatacagtaaaggacgccatcagccagatcaagaaaaacaccggtgtatccggcagttatcaacaggttggaaaaagcacatcatataccgtgaatatgaaggggataacaaaacagcagctccaaaaagtagatactttctttaaaaagaaaaaatggcattatacgtcatccagcgtcaaaaaaacaacaacgtctgcggcttaccaaatcacgacagccaagatgttaggcgagcagcaagcaaacaaagcagcagccttctttgctcagaaaaaagtaaaagccacaaaaacagcagctggatcaacagcagaaaatcaatatcagctcatctcagaagaaacatcagatcaagcaaaagtcacaaagggtttgaacatattaaagaaaaatcagctgagtgcttctgcgaaatccgtcaaaaaacaaatagctgacacgtttaaaatcacaaccgaatctctgtttgaccaaacgaaagtcaatcaggcactcacgtttttcaaatcgaatcatatatcagcagcaagccagaaaaccggtcagacagctgcgagcagctatcaaatcacaactgaagctatcatcagccaagaagagattgaccgcgttttaacatttttcaaacaaaatcatatcgcagtcacaacatcaaaaacaggccagacagcatatacacaatacaaaatcgtgacaacacagctcagcagcaaaacagcattgaataatgggttaacctatcttaaatcgaaaagtgtaacccctagctatacaacgaaaagcaatacgctttataaaatcagcgtaaatgagcagttcacaggcaatgatacagctgctgcggcatcaacgaagctaaaacaattatacggatggacatcatctatcgtgaagatcaaaaacggtccgcaaatcatgaaaacaaattacaatctctcgcttcgtgatatggtccaaaaacaaatgacagtaagtccgcaaacagacggagcggcttacgtatcgctcacgtacattaatacagcaacatcaaccgttacggctgacgtactaaatatccggtcaacgccggaagtcagcccgacaaacgtgatcggccaatttaaaaaaggcgataaagtgaaaatcatcggacagataaacggctgggctaagatcaatttgggctggcgaaacgcaagcagtgatgaagtagttcaatacgtggatccaaataactttaccagagacagcaaatactacttccaatttctcaagctgtcacagacagcgggcctcagcgttactgaggtcaatcagaaagtgcttgcgggtaaaggcatcctgacagggagagcaaaggcatttatcgatgccgccaatcaatatagcatcaacgaactgtatttaatctcacacgctcttctggaaacaggaaacgggacatccgccttagccaatggattaacctataacggaaaaaaagtatacaacatgtatggaattggagcatacgacagcaatccgaattactacggagccaaatatgcgtacgagcagggctggttcacaccagaagcggccattatcggcggagctaaattcataggctcatcgtatatccacaacacagcttacaatcaggacacactgtacaaaatgagatggtcagctacagcgacacatcaatacgcaacagacatcggctgggcgtacaaacaagtaaaccgcatgtacagcctgtattcattgctggacggctatacactttactttgatgttccggaatatcgataa

SEQ ID NO: 1934 - DNA, 2643 bp, Bacillus sp.
atgaaaaagagtttaattgcacctatgcttctgtccgccgcgtcccttgtctttttttccatatccggttctgcccgggctgcagcttatacggactattcgatatatgagatagagccgtcaaaaacgttcagtacagaaagcaaagcctcgcaggctgtcgccaaactggaaaaggacactggctgggatgcttcctatcaggcttcaggtacaacaaggacctaccaaatttccgctgcaggtatacacagcgaatcagaagcaaaaacaatactgagcggactcaccaaacagacagcgattacaggcacgacaagccctgtcggaagcaaacagccctatgtcaccatcacgtcaggtgccatttccggagaaaaacaggcaaacaacttgctggccaagcttaaacaggagacgggagtggctggcgctgtaaaagcttccggagcagctcaaccctatgtaaacgtcatgacatcagagatcgctgatgagacaaaagccaaggcgcttattcagagtatggctaagcaaacggggattaaaagctcgtatcagcccatcacccacacggtgtccgtcacaacgattcagtcaggcacaattgtgggaaacagcaaagcagagcagatcaaaagcgcatttcaaaaggaatcagggctgcaggcatcattaaaggagacggtgaaaggacaagcctattatacgttcactacagccgccatttcacgtgaagcgaatgccaaaaatctattaaatcagctgaaacagagcaccggtatcacaggaagctacaggtcaatcaaacaaaaaacaactgctgagtcatacaatgtccaatcagcctatttcaaaggactgaatacagtgaaggacgccatcagccaaatcaagaaaaacaccggcgtttcaggcagttatcaacagattggcaaaagctcatcctatacagtgagtatgaaggggttaacgaaacagaagctgcaaaagatagacactttctttaaaaagaaaaaatggcattacacgtcatccagcgtcaaaaaaacgaccgcgtctacagcctatcaaataacgacagcacagattttaggggagcggcaatcaaacaaagccgcagccttcttttctcagaaaaaagtaaaggcaacgaagaaagcaactggaacaacagcagaaaaccaatatcagctcatctcggaagaaacatcagatcaagcaaaagtgacaaagggcttgaacatgttaaagaaaaatcagctgagtgcagctgcgaaaacagtaaataaacaaatgcctaacacgtttaaaatatcaactgaatctctgcttgatacagcgaaagtcaatcaagcacttacattctttcaatcaaatcacatatctgcaacaagccagaaaaccggccagaccacagcgagcagctatcaaatcataactggagcaatcattagccaagaagatattgaccgcgttctagcgttttttaaacaaaacaatgcagccggcaccacagcaaaaacaggcgagacggcatatacacaatacaaaatcgtaacagcccagctcagcagcaaaacagcattgaacaatgggttaacctatcttaaaacgcaaagtttaatcccaagttatacaacgaaaagcaatacgctttataaaatcagcataaatgatcagttcacaggcaataatgcggctgctgcggcatcaacaaagctaaaacaattatacggatggacatcatctatcgtgaaaatcaaaaatggcccgcaaatcatgaaaacaaattacaatctctcgctgcgtgatttggtccaaaaacaaatgacagttagcccgcaaacagacggtgccgcttacatatcactcaattacattaatacagcaacttcaaccgttacggctgacgcactgaatatccggtcaacgccggcagtcatcccgacaaacgtaattggtcaatttaaaaaaggcgataaggtgaaaatgatcagccagacaaacggctgggccaaaatcaatttaggctggcgaaacgcaagcagtgacgaagtggttcaatatgtagatccgaataatttttccagagacagcaaatactacttccaatttctcaagctgtcacagacagccggcctcagcatgactgaagtcaatcagaaagtgcttgcgggtaaaggcattctgacagggaaagcaaaggcatttatcgatgccgccaaacaatacggcatcaacgagctgtatttaatctcacacgctcttcttgaaacaggcaacggaacatccgatttagccaatggtttaacctataacggaaaaaaagtatataacatgtacggaattggcgcttacgacagcaacccgaatgaatacggcgcgaaatatgcctatgagcagggctggttcacaccagaggctgctattatcggcggtgccaaattcataggctcatcgtatatccacaacacggcttacaatcaggacacactgtacaaaatgagatggtcagccacagcgacacaccaatacgcaacagacatcgggtgggcgtacaaacaagtgaaccgcatgtatagcctgtattcattgctggacggttataccctttactttgatgttccggaatatcaataa

SEQ ID NO: 1935 - DNA, 2643 bp, Bacillus sp.
atgaaaaagaaattttttgcatctatgtcattgtccgccgctgcccttgtcttttttacgatagcaagctctgctcaagcagcctatatcgacaactcgatttataagattgagccggctaagcactttgcatccgagagcgaggcatcacaagccgtaagtaagctgaaaaaggacaccggctggcaggctttttacaaagcttccggaagcagttccgcagcctaccaaatctcagcttctggaataaacagcgaagccgccgctaaatctgcgttggggcagctcacaaaacagacaggcatcacaggcacatacagcccggcaggcagcaaacagccatatgtcaccatcacttcgggcgcaatagctggcgagcagccggcaaacagcttgctggccaagctgaaaaaagaaacaggaataacaggagcagtaaaggcaacaggagtaaaacaaaactatataaatgtcgttacttcagaaatagaaggcgagacaaaggtcaaaggtattgcccaaggcctagcgaaagagacgggcgtcaaaagcacataccagccagttaaaaatgaaaaatccttgacacgaatccaatctggcatcattcaaggagacggcaaagcagcacaaatgaaaaccgcgttccaaaaagagaccggtctgacggcttcattaaaagaaacatcaaaaggcgagatttattataccttgaccacagctgacttctccggagaaagcaatgcgaaaaatcttgttaagcagcttgaacaaagtacggggatcaaaggaagctacaaggcgatcagccagaaaaaaaccgtttccgcctataacgtccaatcaggctactttaaagggctgagcacagtgaaaaacgcgatcagtcaaattaagaaaaacacgggagtaagcgggatctatcaaaaagttggaaaaagcacatcgtataccgtgaatatgaaaggcatctcaaaacaagaattacaaaaagttcaggcattctttaagaaaaaaaagtggcgctatacctctgcatcagccaaaacaacaacgtcagctacagtctatcaaattacgactgcaccggttttaggcgagcagcttgccaataaaggcactgccttcttcacacagaaaaaagtaaaaacaagcagaaaatcaaccgggaagaaaactgaaaaccaataccggcttgtatcggaagaaacatcagatcaagggaaaatcaccaaggggctgagctttttaaagaaaaacaatctcagcgccacaacacaaatcatcaaaaaacaaacgaacagtcaattcaaaataacgacagagtctttacttgatacaacgaaaatcaatcagacattggcttattttaaagggaaaagcatccccgccagcagccaaaaaacgggaaaaaccacaaacagccaataccaaatcactacggccgaattgctcaatcaacaagacattgatcgcgtgctcgcctttttcaaacaaaacaaagcatccggttcaaaaacaccaacgggtaagacagcttatacgcagtataaaattgtcactgcgcaactcagcgacaaaacgacattgaataaagggctgaattattttaagacaaacaagatctcagcaagctatacgagcaaaagcaatccgctttacgagatcacaattactcaacaattcacaggaaatgacactgcctctgcggcagccgcaaaattgaagaaattgtacggctggacatcttccattgtgaaaatcaaaaacggcccgcaaatcatgaaaacaaattacaacgtctcgcttcgtgatatggtacaaaaacaaatgacggtaagcccacaaacagacggagccgcatacgtgtcactcgcctatatcaacacagccgcccaaacggtcacggcagatgtattaaatatccgatcaacaccggcggtcagtccgaccaatgtgatcggccaattcacaaaaggcgatagagtcaaaatcatcagccaggcaaacggctgggctaaaatcaacatgaattggagaaacgcaagcagtgacgaagtggaacaatacgttaatcccgacaacttctcattagacagcaaatactattttcagttcttaaagctgtcgcaaacagccggactgacagcgtcagaggttaaccaaaaggtgctttacaacaaagggatccttgcggggaaaggccaatccttcatagacgcagccaacaaatacggcattaatgagctttacctgatctcacacgctctcctggaaacaggcaatggtacttctaatctggcaacaggaacaacctataacggaaaaaccgtgtacaacatgtacggaatcggcgcctatgacagcaacccgttatactacggagcaaaatatgcctacgaacaaggctggtttacaccgcaggcagcgatcataggaggtgcaaaatttataggctcatcctatattcacaacacagcctaccagcaggacaccctctataaaatgagatggtcgccgactgcttctcaccaatacgccaccgatatcggctgggcctacaaacaggtgaaccgcatgtacagcctgtatacattgctggatggatatacgctttattatgatgttccggtttataagtaa

SEQ ID NO: 1936 - DNA, 2643 bp, Bacillus sp.
atgagaaagagattttttgcatctacgtcattgtccgccgctgcccttgtcttttttacgatagcaagctctgctcaagcagcctatatcgacaactcgatttataagattgagccggctcagcaatttgcatccgagagcgaggcatcacaagccgtaagtaagctgaaaaaggacaccggctggcaggctttttacaaagcttccggaagcagttccgcagcctaccaaatctcagcttctggaataaacagcgaagccgccgctaaatctgcgctggggcagctcacaaaacagacaggcatcacaggcacatacagcccggcaggcagcaaacagccgtatgtcaccatcacttcgggcgcaatagctggcgaacagccggcaaacagcttgctggccaagctgaaaaaagaaacaggaataacaggagcagtaaaggcaacaggagtaaaacaaaactatataaatgtcgttacttcagaaatagaaggcgagacaaaggtcaaaggtattgcccaaggccttgcgaaagaaacgggcgtcaaaagcacataccagccagttaaaaatgaaaaatccttgacacgaatccaatctggcatcattcaaggagacggcaaagcagcacaaatgaaaaccgcgttccaaaaagagagcggtctgacggcttcattaaaagaaacatcaaaaggtgagatttattataccttgaccacagctgacttctccggagaaagcaatgcgaaaaatcttgttaagcagcttgaacaaagtacggggatcaaaggaagctacaaggcgatcagccagaaaaaaaccgtttccgcctataacgtccaatcaggctactttaaagggctgagcacagtgaaaaacgcgatcagtcaaattaagaaaaacacgggagtaagcggaacctatcaaagagttggaaaaagcacatcgtataccgtgaatatgaaaggcatctcaaaacaagaattacaaaaagttcaggcattctttaagaaaaaaaagtggcgatatacctctgcatcagccaaaacaacaacgtcagctacagtctatcaaattacgactgcaccggttttaggcgagcagcttgccaataaaggcactgccttcttcacacagaaaaaagtaaaaacaagcagaaaatcaaccgggaagaaaactgaaaaccaataccggcttgtatcggaagaaacatctgatcaagggaaaatcaccaaggggctgagctttttaaagaaaaacaatctcagcgccacaacacaaatcatcaaaaaacaaacgaacagtcaattcaaaataacgacagagtctttacttgatacaacgaaaatcaatcagacattggcttattttaaagggaaaagcatccccgcgagcagccaaaaaacgggaaaaaccacaaacagccaataccaaatcactacggccgaattgctcaatcaacatgacattgatcgcgtgctcgcctttttcaaacaaaacaaagcatccggttcaaaaacaccaacgggtaagaaagcttatacgcagtataaaattgtcactgcgcaactcagcgacaaaacgacattgaataaagggctgaattattttaagacaaacaagatctcagcaagctatacgagcaaaagcaatccgctttacgagatcagcattactcaacaattcacaggaaatgacactgcctctgcggcagccgcaaaattgaagaaattgtacggctggacatcttctattgtgaaaatcaaaaacggcccgcaaatcatgaaaacaaattacaacgtctcgcttcgtgatatggtacaaaaacaaatgacggtaagccctcaaacagacggagccgcatacgtgtcactcgcctatatcaacacagccgcccaaacggtcacggcagatgtattaaatatccgatcaacaccggcggtcagtccgaccaatgtgatcggccaattcacaaaaggcgatagagtcaaaatcatcagccaggcaaacggctgggctaaaatcaacatgaattggagaaacgcaagcagtgacgaagtagagcaatacgttaatcccgacaacttctcattagacagcaaatactattttcagttcttaaagctgtcgcaaacagccggactgacagcgtcagaggttaaccaaaaggtgctttacaacaaagggatccttgcggggaaaggccagtccttcatagacgcagccaacaaatacggcattaatgagctttacctgatttcacacgctcttctggaaacaggcaatggtacatctaacctggcaacaggaacaacctataacggaaaaaccgtgtacaacatgtacggaatcggcgcctatgacagcaacccgttatactacggagcgaaatatgcctacgaacaaggctggtttacaccgcaggcagcgatcataggtggtgcaaaattcataggctcatcctatattcacaacacagcctaccagcaggacaccctctataaaatgagatggtcgccgactgcttctcaccaatacgccaccgatatcggctgggcctacaaacaggtgaaccgtatgtacagcctgtatacattgctggatggatatacgctttattatgatgttccggtttataagtaa

SEQ ID NO: 1937 - DNA, 753 bp, Serratia sp.
atgaaaatccgtacttctttgattgcactgagcattactgctttattgagcggctgtcaaaaccttaataccgataccctactacaatccggcgcccaggcctaccaggcggcgacgctgagcgatagcgacgtcaaggcactcagtgataaatcctgcgcagagatggatagccaggagcaaattgcgccagcaagcagcgactataccaagcgcctgaacaagattgccgcagcgttgggggataacatcaacggtacccctgcaaactacaaggtttacgtgaccaaagacgtcaatgcctgggcgatggctaacggctgtatccgcgtctacagcggcctgatggacatgatggatgataacgaagtcgaaggcgtactgggccatgaaatgggccacgttgcgctgggccacactcgtaaagccatgcaggtcgcttatgggaccgtggcattacgtaccgcagcatcttcagctggcggcgtagcagcctcactgtctcagtcgcagttggccgatctgggcgaaaaactggtcaatgcccagttctcacaaaaacaggaaagtgaagcggatgattactcgttcgatctgctgaaaaaacgcggcatcaatcctgcaggcctggccaccagtttcgataaactggcgaaattagacggtggtcatgaaagcagcatgtttgacagccacccaacttccgaagcccgtgccaagcacattcgcgatcgcatcgccgccggtaagtaa

SEQ ID NO: 1938 - DNA, 753 bp, Serratia sp.
atgaaaatccgtacttctttgattgcactgagccttactgctttattgagcggctgtcaaaaccttaataccgataccctactacaatccggtgcccaggcctaccaggcggcgacgctgagcgatagcgacgtcaaggcactcagtgataaatcctgcgcagagatggatagccaggagcaaatcgcgccagcaagcagcgaatataccaagcgcctgaacaagatcgccgcagcgttgggggataatatcaacggtacccctgcaaactacaaggtttacgtgaccaaagacgtcaacgcctgggcgatggcaaacggctgcatccgcgtctacagcggcctgatggacatgatggatgataacgaagtcgaaggcgtactgggccatgaaatgggccacgttgcgctgggccacactcgtaaagccatgcaggtcgcttatgggacagttgcattacgtaccgcagcatcttcagctggcggtgtagcagcctcattgtctcagtcgcagttggccgatctgggcgaaaaactggtcaatgcccagttctctcagaaacaggaaagcgaagcggatgattactcgttcgatctgctgaaaaaacgcggcatcaatcctgctggcctggctaccagtttcgataaactggcgaaattagacggtggtcatgaaagcagcatgtttgacagccatccaacttccgaagcccgtgccaagcacattcgcgatcgcatcgctgccggtaagtaa

SEQ ID NO: 1939 - DNA, 753 bp, Serratia sp.
atgaaaatccgtaccaccttgattgcattaagtattacggctctgttgagcggctgtcagaacctcaacaccgataccctactgcaatctggcgcccaggcataccaagcggccacgctgagcgataacgacgtcaaggccctgagtgataaatcctgtgcagaagtggatagccaggaacaaatcgcaccggcaagcagcgactataccaaacgtctgaacaaaattgccgcggcactgggtgataatatcaacggaacccctgcaaactacaaggtctacctgaccaaagatgtcaacgcctgggcgatggccaacggctgcatccgcgtatacagcggcctgatggacatgatggacgataacgaagtcgaaggcgtgctgggccatgaaatgggccacgtggcgttgggccacacgcgtaaagccatgcaggttgcctacggcaccgtagcggtacgtaccgcagcagcttcggctggcggcgtagcggcttcactgtcccagtcacagttggccgatctgggtgaaaaactggttaatgcccagttctcacagaaacaggaaagcgatgcggacgattattcgttcgagctgctgaaaaaacgcggtatcaatccagcgggcctggccaccagtttcgataaactggcgaaattggacgcgggccgcgaaagcagcatgtttgacagccacccaacttctgaagcccgtgccaagcacattcgcgatcgtatcgcggcagggaagtaa

SEQ ID NO: 1940 - DNA, 753 bp, Serratia sp.
atgaagatacgtatttctttaatcgcattgagtattactgcgctattaagcggttgccaaaacctgaataccaataccttgatgcaatccggcgctcaagccttccaggccgcgacactgagcgacaacgacgtgatagcactgagtgataaatcttgtgccgagatggacagtaaagcgcaaatcgccccggcaaacagcgactatgccaagcgcttgaacaaaatcgccgctgcattaggggataacatcaacggcacgccagctaactacaaagtttacatgaccaacgacgtgaatgcctgggccatggccaatggctgtatccgcgtttacagcggtctgatggatatgatgaccgacaacgaagtggaaggcgtactggggcatgaaatgggccacgtcgcgctgggtcatactcgcaagaagctacaggtcgcttacggaactgtcgccctgcgcactgcggcctcttcagcaggcggagtagtgggttccctctcccagtcacagttggctgacttgggcgaaaaactggttaatgcacagttttcacaaaaacaggaaagcgaagcagatgattactcatttgatttgctgaaaaaacgcggaattgacccgaatggtcttgtcaccagtttcgaaaaactggccaaaatggaaggcgggcgcaagagcagtatgtttgatgaccacccggcttccgaagcccgcgcacaacatattcgtgaccgtatcgccgccggtaaataa

SEQ ID NO: 1941 - DNA, 753 bp, Serratia sp.
atgaagatccgtacctctttgattgcattaagcattgccactttggcaagcggctgtcaaaacctgaataccgataccctgatgcagtctggcgcacaggcgtttcaggcggcgacgttgagcaataacgacgtaaaaaccctgagtgataaatcctgcgcggagatggacagcaaggcacaaatcgcgccggctgacagtacctatgccaagcgtctgaacaaaatcgccgcggcgctgggtgataatatcaacggcacaccggccaactacaaggtttacgtcactaaagacgtgaatgcttgggcgatggccaacggctgtatccgcgtttacagcggcttgatggacatgatgaccgataatgaagtggaaggcgtactgggccatgaaatgggccacgtggcgctgggccatactcgcaaggcgatgcaggtggcttacggcaccgtggcgttgcgtaccgcagcggcctcaaccggcggcatcatcggctcgttgtcacagtcacaactggcggacatgggcgagaaactggtgaatgcccagttctcgcagaaacaggaaagcgaagcggatgactactcgttcgacctgctgaaacaacgcggtatcgatccgaacggtctggtcaccagctttgaaaaactggcgaaaatggaagccggccgtcaaagcagcatgttcgacgaccacccggcctcggaagcgcgcgcgcagcacattcgcgaccgcatcgcagcaggcaagtaa

SEQ ID NO: 1942 - DNA, 753 bp, Serratia sp.
atgaagatccgtacctctttgattgcattaagcattgccactttggtaagcggctgtcaaaacctgaacaccgataccctgatgcagtctggcgcgcaggcgtttcaggccgcgacgctgagcaataacgacgtaaaaatcctgagtgataaatcctgcgcagagatggacagcaaggcacaaatcgcgccggccgacagtacttatgccaaacgcctgaacaaaatcgcggcggcgctgggggataatatcaacggcacgccggccaactacaaggtttacgtcacaaaagacgtgaatgcctgggcgatggccaacggctgtatccgcgtttacagcgggctgatggacatgatgaccgacaatgaagtggaaggcgtgctgggccacgaaatgggccacgtggcgctgggccatacccgcaaagccatgcaggtcgcttacggcaccgtagcattgcgcaccgcagcggcctcgaccggcggcatcataggttcgctgtcgcagtcacagttggcggatatgggcgagaagctggttaacgcgcagttctcccaaaaacaggaaagtgaagccgatgactattcgttcgatctgctgaaacaacgcggcatcgacccgaacggcctggtcagcagctttgaaaagctggctaaaatggaggccggtcgtcagagcagcatgttcgacgatcaccccgcctccgaagcgcgcgcacagcatattcgcgagcgcatcgcagcaggcaagtaa

SEQ ID NO: 1943 - DNA, 753 bp, Serratia sp.
atgaaaattcgtacttctttgattgcattaagtattaccactctgctgagtggttgtcagaaccttaacaccgatactctgatgcaatctggggcgcaggcataccaagcagccacgctgagtgacgcggacgtcaaagccttaagtgataagtcctgtgcagagatggacagccagtcacaaatcgcgccagcaaacagcacttacacacagcggttaaataaaatcgccgctgcactgggtgataatatcaacggtactaccgcgaactacaaggtctacctgacaaaagacgtgaatgcctgggcgatggccaacggctgtattcgcgtttacagcggcctgatggatctgatgaatgacaacgaagtcgaaggcgtgctggggcacgaaataggccacgttgcattgggccactcccgcaaagccatgcaggtggcttacagcaccgttgcagtgcgcaccgctgctgcttcggctggcggtatcgtaggttcactgtctgagtctcagttggccgatctgggcgaaaaactggttaatgcccagttctctcagaagcaggaaaccgaagccgatgattattcgttcgatctgctgaaaaagcgcggtatcgatccaaacggcttggtgaccagcttcgagaagttggcgcagatggaaggcagccgcaagagcagcatgtttgacggccacccaccgtcagaagcccgcgcgcagcatatccgtgagcgcatcgccgcaggtaagtaa

SEQ ID NO: 1944 - DNA, 753 bp, Yersinia sp.
atgaaaattcgtacctcaatgattgcattaagccttacggcactgcttagcggctgccagaatatgagtgctgatggcttgatgcaatcgggcgcacaagcgtttcaggccgcaaccctgagcgatgctgatgtcaaaacgctcagtgataaatcttgcgtagaaatggatcagaaggctcaaatagcgccggcagatagcacctatgcaaaacgtctggccaaaatctcagccgcattgggtgataacatcaatggtacgccagctaactataaggtttatgtcactaaagacgtgaacgcctgggcgatggcaaatggctgtattcgtgtttacagcggtctgatggacatgatgaccgacaatgaagtcgaaggcgtgctcggccatgaaatgggccatgtggcgttaggtcatacccgtaaagcgatgcaagtagcctacggcaccaccgccctgcgcactgccgcagcctctgctggcggcgttaccagccagttgtctcagtctcagttggctgatatcggtgagaaactggttaatgcgcaattctcacaaaagcaagaaagcgaagccgatgattactcatttgatttgctgaaaaaacgcggtatcgatccaaatggtttggtcaccagctttgagaagctggcaacgatggaggctggccgctccagcagcatgtttgatgatcatccatcatcacaagcgcgcgccgatcatatccgtcaacgtatcgctgccgggaagtaa

SEQ ID NO: 1945 - DNA, 753 bp, Yersinia sp.
atgaaaattcgtacatcaatgattgcactgagccttacagtatttcttagcggctgccaaaatatgaataccgatggcttgatgcagtccggtgctcaggcctttcaggctgcaaccctgagtgatgctgatgtcaaaaacctcagtgagaaatcatgtgcggaaatggatcaaaaagcccaaatcgcctccgctaatagcgattatggtaaacgtctggctaaaatctcggccgcattgggtgataacatcaatggtaccccagcaaactataaggtttacgtcactaaagatgtgaatgcctgggcgatggcaaatggctgtatccgtgtttacagcggccttatggatatgatgaccgacaatgaagtggaaggcgtactcggccatgaaatgggccatgtggcattagggcatacccgcaaagccatgcaagtggcctacggtacaacagcgctgcgcactgcggctgcctctgctggtggtattgccgggcaactgtcgcagtctcaattggccgatattggcgagaaactggtgagtgcccaattctcacaaaaacaagagagtgaagcagatgattactcattcgatctgctgaaaaagcgcggcatcgatccaaacggtttagtcaccagcttcgaaaaattggcgactatggaggcaggccgtactagcagcatgtttgacgatcacccatcctcacaggcgcgcgccgaccatatccgccagcgtattgccgccgaaaaataa

SEQ ID NO: 1946 - DNA, 753 bp, Pantoea sp.
atgaaactctccctctcacttactgctcttactctcaccgctgcgctttccggctgcgcaaaccttaataccgatgcactgatgcaatccggcgctcaggcttatcaggccgccacgctgagcgacgcgcaggtcaaagagctgagcgttacatcctgtgcacagatggacagtgaagcgcaaattgcgccagcaagtagcgtctacgcgcagcgtctggataaaattgccaaagcgctgggcgataacatcaacggcacgcccgccaactataaggtctatgtgaccaaagacgtcaacgcctgggcgatggctaacggctgtatccgcgtctacagcggtctgatggacatcatgacggataatgaagtggaaggcgtcctggggcatgaaatgggtcacgttgcgctgggccacacgcgtaaagcgatgcaggttgcctacggcaccaccgcggcacgtaccgccgttggctcagtcggtggtgttgccgcctcgctgtcgcagtcgcagctggcggatatgggtgagaaactggttaacgcccagttctcccagacccaggaaagccaggcggatgattattcgttcgacctgctgaaaaaacggggcatcagtccgcagggactggtcaccagctttgaaaaactggcgaagctggaagggagccaccagagcagcatgtttgactcacacccctcttctgaatcacgagcgcagcatattaaagaacgcattgctgccggtaagtaa

SEQ ID NO: 1947 - DNA, 753 bp, Yersinia sp.
atgaaaattcgtacctcaatgattgtactgagccttacggcattgctgagcggctgccagaatatgaataccgatggcttgatgcagtccggcgctcaagcatttcaggccgcaaccctgagtgatgccgatgtaaaaaacttcagcgaacaatcttgtgcagaaatggatcagaaagcccagatagcttccgctgatagcgattacggtaagcgcctagcaaaaatctcagctgcattgggtgataatatcaatggtacgccagccaactataaggtttacgtcactaaagatgtcaatgcctgggcgatggctaatggctgcatccgtgtgtacagcggcttgatggatatgatgacagacaatgaagtggaggcggtacttggccatgaaatgggccatgtggcgttaggacatactcgtaaagccatgcaggtcgcctatggtacaaccgccctgcgcactgctgccgcctctgcgggagggattgccggtcaactatcgcagtctcaattggccgatattggtcagaaactagtgaacgcccagttctcccagaaacaagaaagcgaagccgatgattactcattcgaattactgaaaaaacagggtatcgatcctaacggcttagtcaccagtttcgaaaaactggccactatggaggctggccgcaccagcagcatgtttgatgaccacccatcctcacaagcccgagctgaccatattcgccaacgtattgccagcggtcagtaa

SEQ ID NO: 1948 - DNA, 753 bp, Pectobacterium sp.
atggctattcgttcttctgtactggcgctgtgtatagcaaccttgctgactggctgccagaacttaaacaccaataccttaatgcaatccggcgcacaggcgtttcaggcagcaacgctcagcgatgctgatgttaaagcactcagcaatcagtcctgtgagcaaatggataaagaagcaaagattgcccctgccgacagcaaatacacacagcgcctgaataaaattgcagatgcactgggtcatgacatcaacggtacaccagccaactataaggtttatctgacaaaagatgtcaacgcctgggcaatggctaacggctgcatccgcgtatacagcggcctgatggatatgatgaatgacaacgaagtggaaggcgttctcggccacgaaattggccacgttgcgctgggccacacgcgtaaagctatgcaggttgcctatgcggcgacggctgcacgtactgccattggctctgcgggtggcgtagcggcgtccctgtcacagtctcaactcgccgatctgggagaaaaactggttaattcccaattctctcaaactcaggaaacgcaggcagatgactattccttcgatctgctgaagaaacgtggcgtcaagctggaaggtctggcaagcagctttgaaaaactggccaaacttgatgccggtcgtgagagcagcatgttcgattcccatccttcatcggaagggcgcgccaaacacattcgtgagcgtatcgctgccgagaaataa

SEQ ID NO: 1949 - DNA, 753 bp, Pectobacterium sp.
atggctattcgttcttctgtactggcgctgtgtgtagcaaccttgctgactggctgccagaatttaaacaccaataccttaatgcaatctggcgcacaggcgtttcaggcggcaacgctcagcgatgctgatgttaaatcactcagcaatcagtcctgtgagcaaatggataaagaagcaaagattgcccctgccgacagcaagtacacacagcgcctgaataaaattgcagatgcgctgggtcatgacatcaacggtacaccagccaactataaggtttatctgacaaaagacgttaacgcctgggcaatggctaacggttgcatccgcgtctacagcggcctgatggatatgatgaatgacaacgaagtggaaggtgttctcggccacgaaattggccacgttgcgctgggccacacgcgtaaagccatgcaggttgcctatgcggcgactgcggcacgtactgccattggctctgcgggtggtgtagcggcgtccctgtcacagtctcaactcgccgatctgggagaaaaactggttaattcccaattctctcaaactcaggaaacgcaggcagatgactattccttcgatctgctgaagaaacgtggcgtcaaactggaaggtctggcaagcagctttgaaaaactggccaaacttgatgccggtcgtgagagtagcatgttcgattcccatccttcatcagaagggcgcgccaaacacattcgtgagcgtatcgctgccgagaaataa

SEQ ID NO: 1950 - DNA, 753 bp, Erwinia sp.
atgaagaaacgtatcacttgtatcgcgctggcgctgactggcttactttccggctgtcaaaattttgacagcaatgccctgatgcagtctggcagccaggcctggcaggccgctacccttagcgatgcgcaggttaaagagttgagcgacaagtcctgccagcagatggatagcgaggcacaaattgcccctgacagcagcccctatgcacaacgcctgaaaaaaatctccgcagcgctcggggataacatcaacggcaccccggccaactataaagtttatctgactaaggacgtcaacgcatgggcgatggcgaacggctgcatccgcgtatatagcggcctgatggatttgatgagcgataacgaagttgaaggtgtgctgggccacgaaatgggccacgttgcgctgggtcactcacgtaaagccatgcagctggcctgggctaccactgccgtgcgcagcgctgccgcctccgttggcggggttaccgcttcgctgtcgcagtcacagctgggcgatctgggtgagaagctggtaaacgctcagttctcacagggccaggaatcccaggctgatgactactctttcgacctgctgaaaaaacgcaatatcaatccacaggggctggtcaccagctttgataaactggcgaagctggaaggcacccacgccagcagcatgtttgactcgcacccgtcctcacaggcgcgtgctgaccatattaagcagcgtatcgccgctggcaagtaa

SEQ ID NO: 1951 - DNA, 756 bp, unknown
  environmental sample
atgaaaatcaaaaaaatggtattagcgcttggactaacgacgctgctgagtggctgtcagggtttagacaataatgcgctgatgcagtcgggcgcgcaggcgtatcaggcttataccctcagcgacgatcaggtaaaacagctgagcgataaatcctgtgagcagatggacaaagataatcagattgcgcctgctaacagtgattatcagcagcgtctgaacaagatcgccgcggcgctgggcgataacatcaacggcgtaccggctaactacaaggtttatcagactaaagatgtcaacgcctgggcgatggcaaacggctgtattcgtgtttacagcggtctgatggatatgatgactgacaatgaagtggaaggcgtgctgggtcatgagatgggtcacgtcgcgttaggtcatacgcgcaaggcgatgcagctggcgtatgccacaaccgcggcccgcaccgcagccgcctcggttggcggcgtgattggttcactgtcgcagtcgcagctgggtgaaatgggtgaaaaactggtgaatgcgcagttctcccagacgcaggaatcacaggcggatgactactcctacgacctgatgaagaagcgcaatatcgatccaatgggcctggccaccagctttgaaaagctggcgaagatggaacagggacgtcagagttcgatgtttgactcgcatcccgcctctgaagcgcgcgcagcgcatattcgtgagcgaattgctgccgacggcaagtaa

SEQ ID NO: 1952 - DNA, 753 bp, Pantoea sp.
atgaaaatgagagctaccattgttgctctgggaatggcttcgttgctgagcggctgcgaaggatttgataacaacgcgctgctgcaatccggtgcgcaggcttatcaggcctacgcgctgaacgatgcacaggtgaaagagttaagcgatcaatcctgtgcgcagatggataaagacaatcaggttgcacccgccaacagtgaatatcagcaacgcctgaacaaaatcgcggcggcgctcggcgataacatcaacggcgtgcctgccaactacaaggtgtatcagactaaagacgtcaacgcctgggcgatggccaacggttgtattcgcgtctacagcggcttgatggacatgatgaccgacaacgaagtcgaaggtgtgcttggccatgagatgggccacgtcgcactgggccatacgcgtaaagcgatgcaggtggcgctgactactaccgcaacgcgcaccgctgcggcttccgtcggcggcgtgatcggttcgctatcacaatcgcaattgggtgaaatgggtgaaaaactggtgaatgcacagttctcacaaacccaggaaacacaagccgatgattactcgtttgatctgatgaaaaagcgcggtattgatccgatgggattagcgaccagttttgagaagctggcgaaactggaacagggacgccagagttcgatgtttgattcgcacccggactcggaagcgcgcgcccagcatattcgtgagcgcattgccgctgggaagtaa

SEQ ID NO: 1953 - DNA, 756 bp, Pantoea sp.
atgaaaatgacccaactcgccgccactctcggcgttaccctgctgctagccggctgccagaatttcgacagcaatgcgctgatgcagtccggtgcgcaggcttttcaggccgtcacgctcaacgatcagcaggtgaaaaccctgagcgatcagtcgtgccagaaaatggacagcgaaaataaggtagcggatgccaacgatccgtatcagcaacgactgaataaaattgctgccgcgctgggcgacaacatcaacggcacgcccgctaactacaaggtttatctgaccaaagacgtcaacgcctgggcgatggccaacggctgtatccgtgtttatagcggcctgatggatttaatgtccgacaatgaagtgaccgcggtagtgggtcatgagatgggtcacgttgcgctgggccatacgcgcaaagcgatgcaggttgcgtacggcaccacggcggcgcgcaccgcggcggcttcagcgggcggcattgcggccacgctttcgcagtcacagctgggtgaaatgggtgaaaagctggtgaatgcccagttctcccagagccaggaatcacaggcggatgattactcgttcgatctgctgaaaaaacgcggcatcagtcaggaaggtttagtgaccagctttgagaagctggcaaaactcgaaggcgcgcagcagagcagcagcatgtttgactcgcatccgtcatccagcgcccgcgctgagcacattcgtcagcgtatcgccgcaggcaaataa

SEQ ID NO: 1954 - DNA, 759 bp, Buttiauxella sp.
atgaaattgcgcccaattttactgagcctgagcgttgctgccctattgagcggctgccagaatatggactctaacggcctgctggcttccggtgcagaagcctttcaggcgtacacattaagtgatgcgcaagttaaagagctgagtgacaaatcctgtgctgaactcgacagcaaagcgagcatcgcgcccgcgagcagcgagtatgcgcaacgcctgagcaaaatatccgccgccctgggcgataacatcaatggcatgccggtgaactataaggtttatgtcaccaaagacgtgaacgccttcgcgatggcaaacggctgtatccgcgtttacagcggcctgatggatatgatgaacgataacgaagtcgaagcggttatcggccacgaaatgggtcacgtcgcgctcggccacgtgaagaaagggatgcaggtcgctctggggaccaacgcagcgcgtgttgcagcggcctctgctggcggtgtgattggcagtttgtcgcagtcacaactcggcgatttgggcgagaaactggtgaatgcgcagttctcccagcgccaggagtctgaagctgatgactattcatatgatttgttgagaaaacgcgggattaacccaatcggcctggcgaccagttttgagaagctggctaaagaggaagaaggccgccaaagctcaatgcttgacgaccaccctgcttccgccgaacgtgcgcaacatattcgcgaccgtatggctgcggatggattgaagtaa

SEQ ID NO: 1955 - DNA, 759 bp, Salmonella sp.
atgaaaattcgcgctttactgcttgctttgggcatggcgacggtgctgaccggctgccagaatatggactctaatggactgctttcttcgggcgctgaagcttttcaggcctatacgttaagcgatgcgcaggtaaaagcgttgagcgatcaatcctgtcaagagctcgacagcaaagcgaaaatcgcgccggcgagcagcgaatacgctaaacgactggcaaaaattgccgccgcgctgggggataacattaacggccagccggtgaactataaggtttacgagacgaaagacgtcaacgcgtttgccatggcgaacggttgtattcgcgtctacagcggactaatggatatgatgaccgacaacgaagttgaagccgtgatcggccatgaaatgggccatgtcgcgctgggtcatgtaaagaaagggatgcaggtcgcgctgggcactaacgcagtgcgcgtcgcggcggcatcggcaggaggcgttgtcggcagcctgtcgcaatcacagcttggcgatcttggcgaaaaactggtgaactcgcagttctcccagcgtcaggagtccgaagcggatgattattcttacgatctgttgcgcaaacgcggtatcagtccggcaggactcgccaccagctttgagaaactggcaaaactggaagcgggtcgtcaaagctcgatgttcgacgatcacccggcgtccgccgcacgcgcacagcatgtgcgcgatcgtatgagcgcggacgggatcaaataa

SEQ ID NO: 1956 - DNA, 750 bp, Proteus sp.
atgaaaattaaattacttgctacagtgatggtatcagcagcactactctctggttgtaaaaacctcaatacagatatgttgaccaaatcaggaacccaacttttccaagcagcgacattaagcgacgatgatatcaaagcgctaacaaatgatgcttgtaaagagatggatgcgcaaaataaagttgcacctgcaaatagcacctacactaaacgtttaaataatattgctaaagcgttaggtaatgaagttaatggtacacctgtaaactacaaagtttacatgaccaaagatgtcaatgcatgggcaatggctaacggctgtgtgcgtgtttatagtggcttaatggacatgatgacagataacgaagttgaaggcgttttaggtcatgagatgggtcacgtagctttaggtcatactcgtaaagccattcaagttgctcacgcaacagttgcagcacgtacagcagcagcatccgctggtggtgtagcggcacaattaagcagctcgcaattagctgaaatgggagaaaaactggttaatgctcaattctctcaacaccaagaatcagaagcggataacttctcttatgatctactgaaaaaacgtggggtcagcaccgcaggtttagtcacaggttttgagaaattagctaaattaggtggcggtgattcaagtatgtttgattctcacccaccatcaaaagagcgtgcagataatatccgtaatcgcattgctgcagataaataa

SEQ ID NO: 1957 - DNA, 759 bp, Enterobacter.2 sp.
atgaaaatgcgtgcaatagtgctggccctgggtacaacgctcctgttgagcggctgtcagaatatggattctaacggtctgatgacgtcaggcgcagaggcctttcaggcctattccctgagcgatgcgcaggtgaaagcgctgagcgaccaggcctgtaaagatatggacggaaaagccacgcttgcgccggctaacagtacctacacgcagcgtctgaataagattgcgtccgcgctgggcgacaacatcaacggccagccggtgaactacaaggtgtacatggcgaaagacgtgaacgccttcgcgatggcgaacggctgtatccgcgtctatagcgggctgatggacatgatgaccgacaacgaagtggaagcggtcatcggccatgaaatgggccacgttgccctgggccacgtgaagaaagggatgcaggttgccctgggcaccaatgccatccgcgcggcggcggcctcagcgggcggtatcgttggtagcctgtcgcagtcacagcttggcgacgtgggtgaaaagctggttaactctcagttctcacagcgtcaggagtccgaggcggatgactactcctacgatctgttgcgcaaacgcggcattaatccatcaggtttagccaccagcttcgaaaaactggccaagctggaagcgggacgccaaagctccatgtttgacgatcaccctgcctcagaagaacgcgcgcagcatattcgcgaccgtatggccgcagacggaattaaataa

SEQ ID NO: 1958 - DNA, 759 bp, unknown
  environmental sample
atgaaaatgcgtgcaatagtgctggccctgggtacaacgctcctgctgagcggctgtcagaatatggattctaacggcctgatgtcctcaggcgcagaagcctttcaggcctactccctgagcgacgcacaggttaaagcgctgagcgaccaggcctgtaaagatatggacggaaaagccacgcttgccccggccaatagtacctacacgcagcgtctgaataagatagcctccgcgctgggtgataacattaacggccagccggtgaactataaggtgtacatggccaaagatgtaaacgccttcgcgatggcgaacggctgcatccgcgtttacagcgggctgatggatatgatgaccgacaacgaagttgaagcggttatcggccatgaaatgggccacgttgcacttggccacgtgaagaaaggcatgcaggttgcgttaggcactaacgccatccgcgccgcggcggcgtctacgggcggtatcgtcggcagcctgtcacagtcgcagcttggcgatgtgggtgaaaaactggttaactctcagttctcgcagcgtcaggaatccgaagcggatgactactcctacgttctgttgcgcaaacgcggcattaatccatcaggtttagccaccagcttcgaaaaactggccaaactggaagccggtcgccagagctctatgtttgatgaccacccggcgtcagaagagcgcgcacagcatattcgcgaccgtatggccgcagacggaattaaataa

SEQ ID NO: 1959 - DNA, 759 bp, Citrobacter sp.
atgaagattcgcgcgttactgcttgctatgggcatggcgacggtgttgaccggctgccagaatatgaattccaatggactgctctcctcaggggccgaggcttttcaggcctacagtctgagcgacacgcaggttatcgcgttaagcaaccaggcctgtacggaaatggatggtaaagcgactatcgcgccagccggcagcgagtacgcgaagcgcctgaacaaaatcgccacggcgctcggcgataacatcaacggacaagcggtcaactacaaggtctacatggcgaaagacgtgaatgccttcgcgatggcgaacggctgtattcgtgtctatagcggcctgatggacatgatgacggacaacgaagtcgaagcagtgattggccatgaaatgggtcacgttgcgctcggacacgtgaagaaaggtatgcaggtggcgctgggcactaacgccgttcgtgcagccgcagcctcagcgggtgggatcgtcggcagcctgtcgcaatcacagctcggcgatctgggggaaaaactggtgaactcgcagttctcccagcgtcaggaagcggaagcggacgactactcgtacgatttgttgcgcaaacgcggtatcagcccggcgggtcttgccaccagcttcgaaaaactggcgaaactggaagaaggtcgtcaaagctcaatgtttgacgatcacccggcctccgcagaacgtgcgcaacatattcgcgatcgtatgaaagcagacgggattaagtaa

SEQ ID NO: 1960 - DNA, 2664 bp, Serratia sp.
atgaacaagtttaagatgagtgctctcgccgccctgacggctaccgttgggctctttggcagcgtaggttctgccatggccaaccagcaggtggttgatcaactcagccagttgcaggtcaatctgaagatgttggacaaccgtgccgctgaacacggcgtggactgtgccaagctgggtgccgactgggcgtcctgccataaggtgctgatcaccttgaccaacggcaatcaggaaatcaaagataaagattgggcgatctatttccacagcccgcgccagacgctgaaagtcgataacgaccagttcaaaatcacccacattaccggcgatctgtataagctggaaccgacagacaaattcactagcttcccggccaatcaggcggtggaaatcccgattatcgctgaatactggcagctgttccgcaccgacttcctaccgcgttggtatgccacttccggcgatgctcagccgaagatcctgtcgaataccgataccgatgatattaaccagtttgttgccccattcactggcgatcagtggaagcgtaccaaggatgacaacaacattctgatggtcccggaaagccgcttcaccaagaaccaggatctgaaagtgttgccgatggcatcgctgcgtgggcaaatcatcccaaccccgatggaagttaaagtccatgcgaaggatattgacctgagcaaaggcgtggcgctggatttgagtgcgttgaccaagccagcggcggatgcggcggccgagcgttttgccctgctgggcattgagagccaggcgagcggttatccgatcaagacggatatcaagccagcggcattcaaaggcgatcaggccgttccaggtgcctaccaactgaagatcggcgagaaaggtgccgaaattgtcggtttcgatcagactggggtgttctatggcctgcaatccatcctgtcgctaatcccttcggatggcagcaagaagattgcgacactggatgccaaagatgcaccgcgcttccaataccgcggcatcttcctggacgtggcgcgtaacttccaccacaaagacgccgtattgcgcctgctggatcaaatggcagcctacaagctgaacaaattccacttccacctgacggatgacgaaggttggcgcattgagatccctggcctgccagagttgaccgaagtgggcggccagcgttgtcatgacctgagcgagaccacctgcctgatgccacaatacggctctggccctgcaccgcacggtggcttcttctcccgtcaggactatatcgacatcgttaaatatgctcaggcgcgccagattgaagtgatccctgagatcgacatgccggcacacgcccgtgcggcgattatttccatggaagctcgttacaagaaactgcttgccgaagggaaagagaaagaggccaaccagttccgcctggtggatccgaccgatacctccaataccacctcggtgcagtacttcaaccgtcagagctatctgaacccatgcctggattcctccaagaacttcgtggacaaagtgattggtgaagtggcccagatgcacaaagaggccggtcagccactgaaaacctggcactttggtggggacgaagcgaagaacatccgtctgggcgccggctataccgacgtgaaaaacccggaagcgggcaagggcatcctcgatctgagcaaagaagacaagccgtgggccaagtcgcaggtttgtcaggccatcatcaaagatggcaaagtggaagatatggaacacttgccaagctacttcggtctggaagtcagccagttggtgaaagcgcacggcattgacagaatgcaggcgtggcaggacggcctgaaagatgccaaagactcgaaggccttcgcgaccaagcatgtggcggtgaacttctgggataccctgtactggggtggtttcgactcggctaacgactgggcgaacaagggttatgacgtggtgatctctaacccggactacgtctatatggacttcccgtatgaagtcagcccggacgaacacggttattactggggcacccgcttcagcgacgagcagaagatcttcagctttgcgccgaacaacctgccgcagaacgccgaaacctcggttgaccgtgatggtaaccacttcaccgccaagagcgacaaaccgtggccgggcgcatatggtctttccgcccaactgtggagcgaagtggtgcgtaccgatcagcagatggaatacatgatttacccacgtgccgtgtcgcttgcagaacgtgcatggcaccgcgccagctgggagcaggattacaaagctggccgtgagtataaaggtggtgaaacccatcaggtcgataccaaaactctggatcaggactggctgcgctttgccaacctgatcgggcagcgtgaactggccaagatggataaagcgggcgtgagctatcgcctgccggtcccaggggcacgtatcatcggtggcaagttggaggcgaatattgctctgccgggcctgggaattgaatattccaccgacggcggcaaacagtggcagcgttatgacgataaagcgcgccctgcggtggcgggtgaggtgcaaatccgtgcaatcagcccggatggcaaacgcttcagccgtgccgagccagtgaaagcgtaa

SEQ ID NO: 1961 - DNA, 2664 bp, Serratia sp.
atgaacaagtttaagatgagtgctctcgccgccctgacggctaccgttgggctattgggcagcgtaggttctgccatggccaaccagcaggtggttgatcaactcagccagttgcaggtcaatctgaagatgctggacaaccgcgccgccgagcacggcgtggactgtgccaagctgggtgccgactgggcatcctgccacaaggtgttgatcaccctgaccaacggcagccaggaaatcaaagacaaagactgggcgatctatttccacagcccgcgccaaacgctgaaggtcgataacgaccagttcaagatcacccacctgaccggcgatctgtataagctggaaccgacggacaaattcaccagcttcccagccaatcaggcggtggaaattccgattatcgcggaatactggcagctgttccgcaccgacttcctaccgcgctggtatgccacatccggcgatgcccagccgaagatcctgtcgaataccgataccgaagatgttaaccagtttgtggccccgtttaccggtgaccagtggaagcgtaccaaggatgacaacaacatcctgatggtgccggaaagccgcttcaccaagaatcaggatctgaaagtgttgccagcggcgacgctgcgtggccagattatcccaacgccgatggaggttaaagtccactctcaggacgttgatctgagcaagggcgtggcactggaactgagcgccttgaccaaacctgcggccgatgcggcagccgagcgttttgctctgttggggattaaaaaccaggctggtggttatccgatcaagacggatatcaaacctgctgcatttaaaggcgatctggccgttccgggagcctatcagctgaagattggtgagaaaggggccgagatcgttggtttcgatcagaccggggtgttctatggtctgcaatctatcctgtcgctgatcccatcggatggcagcatgaagatcgccacgctggatgctaaagatgcaccgcgcttccagtatcgcggcattttcctcgacgtggcacgtaacttccaccataaagacgccgtattgcgcctgctggatcagatggcagcgtacaagctgaacaaattccacttccacctgaccgatgacgaaggctggcgcatcgagatccctggcttgccagagttgaccgaagtgggtggccagcgttgccatgacctgagtgaaaccacctgcctgatgccgcaatacggctctggcccggcaccgcacggcggcttcttctcccgtcaggactatatcgatatcgtcaaatatgctcaggctcgccagattgaagtgatccctgagatcgacatgcctgcgcacgcccgcgcggcgatcgtttccatggaagcgcgttacaagaagctgcttgccgaaggaaaagagaaagaagccaatcaattccgcctggtggatccgaccgatacctccaataccacctcggtacagtatttcaaccgtcagagctacctgaacccatgcctggactcatccaagaactttgtggataaagtgattggcgaagtggctcagatgcacaaagaagccggtcagccgctgcaaacctggcactttggtggcgacgaggcgaaaaacatccgtctgggcgctggctataccgacgtgaaaaacccggaagccggcaagggcatcctcgatctgagcaaagaagacaagccctgggccaagtcgcaggtttgtcaggccttcatcaaagacggcaaagtggccgatatggaacacttgccaagctacttcggtctggaagtcagccaactggtgaaagcgcacggcattgacagaatgcaggcgtggcagaatggcctgaaagatgccaaagactcacaggccttcgcgaccaagcatgtggccgtgaacttctgggataccctgtactggggcggctttgactcggctaacgactgggctaacaaaggctatgacgtagtgatctccaacccggattacgtctatatggacttcccttatgaagtcagcccggatgagcacggctattactggggcacccgcttcagcgatgagcagaagatcttcagcttcgcaccgaacaacctgccgcagaacgccgaaacctcggtggatcgcgacggtaaccacttcaccgccaagagcgataaaccatggccgggcgcttatggtctttccgcccaactgtggagtgaagtcgtgcgtaccgatcagcagatggaatacatgatttatccacgcgctatatcggtagcagagcgtgcatggcaccgtgcgagctgggagcaggactataaagctggtcgtgagtacaaaggtggcgaaacccatcaggttgataccaaaaccctggatcaggactggctgcgctttgccaacctgattgggcaacgcgagctggccaagatggataaagcgggcgtgagctatcgcctgccggtgccaggggcgcgcatcgtgggtggcaagctggaggcgaatatttcgctgccgggcctgggcattgaatactctaccgatggtggcaaacagtggcagcgttatgacgataaagcgcgccctgcggtggctggcgatgtgcaaatccgtgcgattagcccggatggcaaacgcttcagccgcgccgagccggtgagggcataa

SEQ ID NO: 1962 - DNA, 2664 bp, Serratia sp.
atgaacaagtttaagatgagtgctctcgccgccctgacggcaaccgtcgggctatttggcagcgcaggttccgccatggccaaccagcaggttgttgaccagctcagtcagttgaaagtcaatctgaagatgcaggacaatcgtgccggtgagcacggggtggattgcgccaaactgggcgctgattgggcttcctgccacaaagtgctgatcaccttgaccaatggcggtcaggaaatcaaagacaaagactgggcgatctatttccatagcccacgccaaacgctgaaagtggataacgaccagttcaaaatcactcacctgaccggcgatttgtataaactggaaccaactgacaaattcaccagcttcccggccaatcaagcggtggagatcccgattatcgcggaatattggcagttgttccgcactgacttccttccgcgctggtatgccacttcaggcgacgccaagcctaagatcctggcgaataccgataccgaagatgtgaaccagtttgttgctcctttcaccggcgaccagtggaagcgcaccaaggatgacaataacgttctgatggtgccggaaagccgcttcgccaagaaccaggagttgaaagtattgccgatggctacgctgcgcggccagatcatcccaaccccgatggatgttaaaatccaccagcaggatgttgatctgagcaaaggcgtggccttggaattgagtgccttgaccaagccagcggcggatgcggcagccaagcgttttgagctgctgggcgtagagaacaaggccgatggttacccaatcaagacggatattcaacctggcgcatttaaaggcgatctggccgtgccgggcgcctaccaactgaagattggcgagaaaggcgcggtgatcaccggtttcgatcaggccggggtgttctatggtctgcaatccattctgtcgctgatcccgaccgacggcagcaagaagattgctacgctggatgctaaagatgcgccgcgcttccaataccgcggcattttcctggacgtggcgcgtaacttccaccacaaagacgccgtcttgcgcctactggatcagatggccgcgtacaagctgaataaattccacttccacctgacggatgacgaaggttggcgcattgagatcccagggctgccggaattgaccgaagtcggcggccagcgttgccatgatctgagcgaaaccacctgcctgttgccgcagtacggctctggcccgcaaccacacggtggtttcttctcccgccaggattatatcgatatcgttaaatatgcccaggctcgccagattgaggtgatcccagagatcgacatgcctgcgcatgcccgcgccgcgattatttccatggaggcccgttacaagaagctgcatgccgaaggtaaagaaaaagaagccaatgaattccgcctggtggatccaaccgatacctccaatactacctcggtacagtacttcaaccgccaaagctacttgaacccgtgcctggattcctccaagagctttgtggataaagtgatcggtgaaattgcccagatgcacaaagaggcggggcagccgctgcaaacctggcactttggtggcgacgaggcgaagaacattcgtctgggcgcgggctataccgacgtgaaaaaaccagagcctggcaagggcattcttgatctgagcaaagaagacaagccatgggccaagtctcaggtttgtcaggcgatgatcaaagacggcaaagtggaagacatggaacacttgccaagctatttcggtctggaggtcagccaactggtgaaagcgcacggcattgacaaaatgcaggcgtggcaggatggcctgaaagatgccaaagactcgcaagccttcgcgaccaagaatgttgcggtgaacttctgggataccttgtactggggcggcttcgactcggctaacgactgggctaacaaaggctatcaggtggtgatctccaacccggattatgtctatatggacttcccctatgaagtcagcccagacgaacatggttactactggggcactcgcttcagcgatgagcagaagatcttcagctttgcgccgaacaacctgccgcaaaatgccgaaacctcggttgaccgtgacggtaaccactttaccgccaagagcgacaaaccatggccgggcgcttatggtctctccgctcaattgtggagcgaaatcgtgcgtaccgatcagcaaatggaatacatgatttatccacgcgcgttgtcggtagcagaacgcgcatggcaccgtgcgagctgggagcaggattacaaagctggccgtgagtataaaggcggcgaaactcatcaggtcgatacccaaaccctggataaagactggctgcgctttgctaacctgattgggcaacgtgaattggccaaactggacaaagctggcgtgagctatcgcctgccggtaccaggagcacgcatcatcggcggcaaactggaagcgaacatttcgctgccgggcttggggattgaatactctaccgacggtgggaaacagtggcaacgttacgacgataaagcgcgtcctgccgtggcgggagacgttcaaatccgtgcgatcagcccggatggcaagcgtttcagccgtgccgagcctgttaaggcgtaa

SEQ ID NO: 1963 - DNA, 2664 bp, Serratia sp.
atgaacaagtttaagatgagtgctctcgcagccctgacggccactgttgggttattcggtggagtaggctcggcgatggctaaccaacagattgttgaccaacttagccagttgaatgtgaagctacagatgcaggacaaccgtgcagccgatcatggtgttgactgcgccaagctgggtgctgattgggcatcttgtaataaagtgttgattaccctgaccaacagtgggcaggaaatcaaaggccaggattgggcgatttattttcacagcccgcgtcagacgctaaaagtcgataacgaacaattcaagattacccatatcactggcgatctgtacaagctggaaccgactgataaattcaccagttttccagccaatcaggccgtggaaattccgatcattgctgaatactggcaggtgttccacagtgacttcctgccacgctggtatgccacctcgggcgatgcaaagcctaagatcctggcgaataccgataccgaagatgtgaaccagtttgttgccccattcactggcgaccagtggaaacgcaccaaggatgacaataatattctgatggtgccagaaagccgctttatcaagaatcaggatctgaaagtgctgccaacggcagccttgcgtggccagatcgtaccaaccccaatggaagttaaagttcatcaacatgatgttgatttgagcaaaggcgtggcgttagaactcagcgcattagccaagcctgcggcggacgcggcggccaagcgttttgaactgttgggtgttgccaatcaggctggcggttatccgatcaaaacggatattcaaccaggtgcctttaagggggatctggcggtatcaggtgcgtatcaattgaaggttggtgagaaaggcgcgctggttaccggtttcgatcaggcgggggttttctacggcctacaatccattctgtcgctgattccttccgatggcagcaagaaaatcgctacgctggatgccacagacgcaccgcgtttccaataccgtgggatgttcttggacgtggcgcgtaacttccatcagaaagatgcggtgttgcgcctgctggatcagatggcggcttacaaactgaataaattccatttccatctgacggatgatgaaggttggcgcattgaaatccccggtctgccagagctgaccgaagtgggaggccaacgttgccatgacctgagtgaaaccacctgcctgttaccgcaatacggttcaggcccagagccgcacggtggcttcttctcgcgtcaggattacattgatatcgtcaaatatgctcaggcacgccagatcgaagtgatccctgaaatcgacatgcctgcccatgctcgcgcggcgatagtgtcgatggaagcccgttacaaaaagctgcatgccgcaggtaaagagaaagaggccaatgaattccgccttgtagatccgacggatacatcgaataccacctcggtacaatatttcgaccgccaaagttatctgaacccgtgcctggattcgtctaaaaactttgttgataaagtgattggtgaagtggcccagatgcataaagaagccggtcagccactgaaaacctggcactttggtggggatgaagccaaaaacatccgcctgggtgctggctataccgatgtgaaaaaaccggaagcaggcaagggcatccttgatctgagcaaagaagataaaccatgggccaagtctcaggtttgtcaggcgatcattaaagacggcaaagtggaagatatggaacacttgccaagctactttggtcttgaagtcagccagctggtgaaagcccacggtattgacagaatgcaggcgtggcaggatggcctgaaagatgccaaagattccaaagcgtttgctaccaagaacgttgcggtgaacttctgggatactctgtactggggcggcttcgactccgtgaatgactgggcgaacaagggttatgacgtcgttatttccaacccggattatgtctatatggacttcccctatgaggtgaccccgaaagaacatggttactactggggcactcgtttcagtgatgaacagaagatcttcagtttcgcgccggataacctgccacaaaacgctgaaacctcggtggatcgtgatggcaaccactttgctgccaagagcgacaaaccatggccgggtgcttatggtctttcagcccaactgtggagcgaagtggtgcgaaccgaccagcaaatggaatatatgatttacccacgtgcgctgtctgtggctgaacgtgcatggcatcgcgcaagttgggagcaggactacaaagcgggccgtgagtacaaaggaggcgaaacccatcacgtcgataccaaggcgctggaaaaagattggcagcgtttcgccaacctgatcgggcaacgtgaactggctaagctggataaaggtggggtgagttaccgtctgccagtaccaggagcccgtgttgttgatggtaagctggaagccaacatcgccttgccgggcctgggtattgaatactctgttgatggcggcaagcagtggcagcgttacaacgataacgcacgtcctgccgttgcgggtgatgtgcaaatccgcgcgatcagcccagatggcaagcgtttcagccgtgccgagccggtaaaagcctaa

SEQ ID NO: 1964 - DNA, 2658 bp, Serratia sp.
atgaacaaatttaaattgaacgcgcttgctgccctgacggcgaccgttggattgtttggcggcgtggggaacgcaatggccgatcaacagctggtggatcaactgagccagttaaaactgaatttaaagatggtggacaaccgcgcggccgacaacggcctggactgtggcaagctgggtgccgactgggcggcctgcaataaagtcgtgatcagcctgaccaacgataatcaggacattaaaggccaagactgggcgatttattttcacagtgcccgccagaccatgagagtggataacgaccagtttagggtctctcatttgaccggtgatctgtacaaactggagccgaccgataaatttaccggctttccggccggtaaaacggtggaaattccgattattgcggaatactggcagctgtttaaaaccgacttcgtgccgcgctggtacgcgacctccggcgatgccaagccaaaagttctggttaataccgataccgaagatctgaatcagttcgttgcgccctttactggcgaccagtggaagcgcaccaaggatgacaacaatatcctgatgacgccggcctcccgtttcactaaaaacgccgaactgaaaaccttaccggcagcgtcgctgcgtggccaaatcgtaccgacgccgctggaagtgaaagtgcacccgcaggatgtggatctgagcaaaggcgtggcgcttgaactgagcgcattgagcaagcctgctgccgaggcggcggctgaacgctttgcgctgctgggggtgaccaacaatgcgggcggttatccaatcaaaaccgatatccagccgggtaaatttaaaggtgagctggcggtgccgggcgcttatgagctgaagattggcaacaaggaagcgcgggtcatcggcttcgatcaggccggggtgttctatggcctgcagtctattttgtcgcttgtcccgacagacggcagcgccaatattgccacgctggacgctaaagatgcgccacgcttccagtatcgcggcattttcctcgacgtagcgcgcaacttccaccagaaggatgcggtgctgcgtttgctcgatcagatggcggcttacaaactcaataaattccacttccacctgagcgatgacgaaggctggcgcattgagatcccgggcctgccggagttgatcgaagtagggggacaacgttgtcacgacctgagcgaaaccacctgcctgctgccgcaatacggccaggggcccgacgtgtatggcgggttcttctcgcgtcaggattacatcgacattatcaaatacgcccaggcgcgccagattgaggtgatcccggaaatcgatatgccggcgcatgcccgtgcggcggtggtttcgatggaggcgcgctacaaaaagctgcatgccgccgggaaagagaaagaggccgacgagttccgtttggtggacccgaccgatacctcaaataccacctcggtacagtattttaaccgtcagagctacctgaatccgtgcctggattcatccaagcgctttgtcgacaaggtaatcggcgagattgcccagatgcacaaagaggccgggcagccgctgcgcacctggcactttggcggcgatgaggcgaaaaacattcgcttgggcgcgggctataccaatctgaccaagccggaggcgggcaaaggcattatcgatcagagcaaggaagacaaaccttgggcgagatctcaggtgtgccaagcgatgattaaagaaggcaaagtggccgatatggagcacctgccaagctacttcgggctggaagtcagccaacaggtgaaggcgcacggcattgacagaatgcaggcctggcaggatggccttaaagatgcgaaagacgccaaggcattcgctacccaacgcgttggggtgaacttctgggataccctgtattggggcggtttcgatagcgcgaacgattgggcgaacaaaggttacgaagttatcctttccaacccggattacgtctacatggacttcccgtatgaggtgaacccggacgaacgcggctactactgggggactcgcttcagcgacgaacggaaaatgttcagcttcgcgccgaacaacctgccgcagaacgccgaaacctcggttgaccgcgacggcaatcactttaccgccaagagcgacaagccgtggccgggcgcttacggcatctccgcgcagatgtggagtgaaacccaacgcaccgatccgcaaatggaatacatgattttccctcgctcactgtcggtggccgaacgcgcatggcaccgcgccggttgggaacaggattaccgggcgggacgtgagtataaaggcggggaaacccattttgtcgacggcaagcaattggatcgggactggctgcgttttgccaatatcctggggcagcgcgagttggcgaaactggacaagggcggggtgagctatcgcttgccggttccgggcgcccgcgtggtgggcggcaagctggaagccaatatctcgctgccgggcttgggcattgagtattccatcgatggcggcaaacattggcagcgttatgacggcaaagccaaacctgcggtagccggcgacgtgcagattcgggcggtaagcccggatggcaagcgttatagccgtgcagagaaagtgtaa

SEQ ID NO: 1965 - DNA, 2658 bp, Serratia sp.
atgaacaaatttaaattgaacgcgcttgctgccctgacggcgaccgttggattgtttggcggcgtggggaacgcaatggccgatcaacagctggtggatcaactgagccagttaaaactgaatttaaagatggtggacaaccgcgcggccgacagcggcctggactgtggcaagctgggtgccgactgggcggcctgcaataaagtcgtgatcagcctgaccaacgataatcaggacattaaaggccaagactgggcgatttattttcacagtgcccgccagaccatgagagtggataacgatcagtttagggtctctcatttgaccggtgatctgtacaaactggagccgaccgataaatttaccgggttcccggccggtaaaacggtggaaattccgattattgcggaatactggcagctgtttaaaaccgacttcgtgccgcgctggtacgcgacttccggcgatgccaagccaaaagttctggttaataccgataccgaagatctgaatcagttcgttgcgccctttaccggcgaccagtggaagcgcaccaaggatgacaacaatatcctgatgacgccggcctcccgtttcactaaaaacgccgagctgaaaaccttaccggcagcgtcgctgcgtggccaaatcgtgccgacgccgctggaagtgaaagtgcacccgcaggatgtggatctgagcaaaggcgtggcgcttgaactgagcgcattgagcaagcctgctgccgaggcggcggctgaacgctttgcgctgctgggggtgaccaacaatgcgggcggttatccaatcaaaaccgatatccagccgggtaaatttaaaggtgagctggcggtgccgggcgcttatgagctgaagattggcaacaaggaagcgcgggtcatcggcttcgatcaggccggggtgttctatggcctgcagtctattttgtcgcttgtcccgacagacggcagcgccaatattgccacgctggacgctaaagatgcgccacgcttccagtatcgcggcattttcctcgacgtagcgcgcaacttccaccagaaggatgcggtgctgcgtttgctcgatcagatggcggcttacaaactcaataaattccacttccacctgagcgatgacgaaggctggcgcattgagatcccgggcctgccggagttgatcgaagtagggggacaacgttgtcacgacctgagcgaaaccacctgcctgctgccgcaatacggccaggggcccgacgtgtatggcgggttcttctcgcgtcaggattacatcgacattatcaaatacgcccaggcgcgccagattgaggtgatcccggaaatcgatatgccggcgcatgcccgtgcggcggtggtttcgatggaggcgcgctacaaaaagctgcatgccgccgggaaagagaaagaggccgacgagttccgtttggtggacccgaccgatacctcaaataccacctcggtacagtattttaaccgtcagagctacctgaatccgtgcctggattcatccaagcgctttgtcgacaaggtaatcggcgagattgcccagatgcacaaagaggccgggcagccgctgcgcacctggcactttggcggcgatgaggcgaaaaacattcgcttgggcgcgggctataccaatctgaccaagccggaggcgggcaaaggcattatcgatcagagcaaggaagacaaaccttgggcgagatctcaggtgtgccaagcgatgattaaagaaggcaacgtggccgatatggagcacctgccaagctacttcgggctggaagtcagccaacaggtgaaggcgcacggcattgacagaatgcaggcctggcaggatggccttaaagatgcgaaagacgccaaggcattcgctacccaacgcgttggggtgaacttctgggataccctgtattggggcggtttcgatagcgcgaacgattgggcgaacaaaggttacgaagttatcctttccaacccggattacgtctacatggacttcccgtatgaggtgaacccggacgaacgcggctactactgggggactcgcttcagcgacgaacggaaaatgttcagcttcgcgccgaacaacctgccgcagaacgccgaaacctcggttgaccgcgacggcaatcactttaccgccaagagcgacaagccgtggccgggcgcttacggcatctccgcgcagatgtggagtgaaacccaacgcaccgatccgcaaatggaatacatgattttccctcgctcactgtcggtggccgaacgcgcatggcaccgcgccggttgggaacaggattaccgggcgggacgtgagtataaaggcggggaaacccattttgtcgacggcaagcaattggatcgggactggctgcgttttgccaatatcctggggcagcgcgagttggcgaaactggacaagggcggggtgagctatcgcttgccggttccgggcgcccgcgtggtgggcggcaagctggaagccaatatctcgctgccgggcttgggcattgagtattccatcgatggcggcaaacattggcagcgttatgacggcaaagccaaacctgcggtagccggcgacgtgcagattcgggcggtaagcccggatggcaagcgttatagccgtgcagagaaagtgtaa

SEQ ID NO: 1966 - DNA, 2658 bp, Serratia sp.
atgaacgcattcaaactgagcgcactggccgccttgacggcaacgatgggattcttgggcggcatggggagcgccatggccgatcaacagctggtggatcagctgagccaactgaagctgaacgtgaaaatgctggataaccgcgccggggaaaacggcgtggattgcgcggcgctgggcgcagactgggcctcatgcaaccgggtgttgttcaccctgagcaacgacgggcaggcgatcgacggcaaagactggatcatttatttccacagcccgcgccagactctgcgggtagacaacgatcagttcaagatcgctcacctcaccggcgatctgtacaagctggagccgaccgccaaattcagcggtttcccggccggtaaggcggtggaaatcccggtggtcgccgaatactggcagctgttcagaaacgacttcctgccccgctggtatgccacgtccggcgacgccaagccgaaaatgctggcgaataccgacaccgaaaatctggatcagtttgtggcgccgtttaccggcgatcagtggaagcgcaccaaggacgacaaaaatattctgatgacgccggcttcgcgttttgtcagcaacgccgatctgcagacgctgcccgccggcgcgctgcgcggccagatcgtgccgacgccgatgcaggtgaaagtgcacgcgcaggacgccgatctgcgcaaaggggtatcgccggatctgagtgcgttggtcaagccggcggcggatgtcgtcaaccagcgcttcgcgctgctgggcgtgccggttcaggccaacggttacccgatcaagaccgacatccagccgggcaagtttaaaggcgcgatggcggtgccgggcgcttatgagctgaagatcggcaagaaagaggcgcgggtgatcggcttcgatcaggccggggtgttctacgggttgcagtctatcctgtcgttagtgccgaccgacggcagcggcaagatcgccacgctcgacgccagcgatgcgccgcgcttccagtatcgcggcattttcctcgacgtggcgcgtaacttccataagaaggatgcggtgctgcgcctgctggatcagatggcggcttacaagctcaacaaattccacttccacctgagcgatgacgaaggttggcgtatcgaaattcccggcttgcctgagttgacggaagtcggcggccagcgctgccacgatctgagcgaaaccacctgcctgctgccgcagtacggccaggggccggatgtctacggcggtttcttcactcgtcaggactacatcgacatcatcaaatacgcccaggcgcgccagattgaggtgatcccggagatcgacatgccggcgcacgcccgcgcggcggtggtctcgatggaagcgcgctacaagaaactgcatgccgccggcaaagagcaggaggccaacgaattccgtctggtggatccgaccgatacctccaataccacctccgtgcagttctttaaccgtcagagttacctgaacccgtgcctggattcctcccagcgctttgtcgacaaggtgattggcgagattgcccagatgcataaagaagccggccagccgattaagacctggcactttggcggcgacgaagcgaaaaacatccgcctgggcgccggctacaccgacaaggcgaaaccggaaccgggtaaaggcatcattgaccagagcaatgaagacaagccgtgggccaagtctcaggtgtgccaggtgatgatcaaagagggcaaagtggccgacatggagcacctgccgagctacttcggccaagaggtcagcaagctggtgaaggcgcacggcatcgacagaatgcaggcctggcaagacggcctgaaagacgccgagagttcgaaggcgttcgccacttcgcgcgtgggggtcaacttctgggacaccctgtactggggcggtttcgacagcgtcaacgactgggccaataaagggtatgaagtggtggtctccaacccggactacgtctatatggacttcccttacgaggtgaacccggacgagcgcggttactactggggaacccgcttcagcgacgagcgcaaggtgttcagcttcgcgccggacaacatgccgcagaacgcggaaacctcggttgaccgagacggcaaccacttcaacgccaagagtgacaagccgtggccgggggcatatggactttccgctcagctgtggagcgaaacccagcgcaccgacccgcagatggaatacatgatcttcccacgcgcgctgtcggtggcggagcgcgcctggcatcgcgccggttgggagcaggactatcgcgctggccgcgaatacaaaggcggggaaacccactttgtcgataccaagacgctggagaaagattggctgcgcttcgccaatattctgggccagcgtgaactggccaagctggacaaaggaggcgtggcttatcgtctgccggtgccgggcgctcgcgtggcgggcggcaagctggaggcgaatatcgcgctgccggggttgggcatcgagtactccaccgacggcggtaagcagtggcagcgctatgatgccaaggctaaacctgcggtttccggcgaagtacaggtgcgctcggtcagcccggacggcaaacgctacagccgcgccgagaaggtctaa

SEQ ID NO: 1967 - DNA, 2658 bp, Serratia sp.
atgaacgcattcaaactgagcgcgcttgccgccttgacggcaacgatgggattcctgggcggcatgggaaacgccatggccgatcaacagctggtggatcaactgagccagctgaagctgaacgtgaaaatgctggataaccgcgccggcgaaaacggcgtggattgcgcggcgctgggcgccgactgggcctcttgcaaccgggtgttgttcaccctcagcaacgacggccaggctatcgacggcaaggactgggtcatctatttccacagcccgcgccagaccctgcgggtggataacgatcagttcaagatagcccacctcaccggcgatctgtacaagctggagccgaccgccaaattcagcggtttccctgccggcaaggcggtggaaatcccggtggtcgccgaatattggcagctgtttagaaatgacttcctgccgcgctggtatgccacgtccggcgacgccaaaccgaaaatgctggcgaataccgacaccgaaaacctggaccagttcgtggcgccgttcaccggcgatcagtggaagcgcaccaaagacgacaaaaacattctgatgacgccggcttcgcgctttgtcagcaatgccgagctgcagacgctgcccgccggcgcgctgcgcggccagatcgtgccgacgccgatgcaggtgaaggtccacgcgcaggacgccgatctgcgcaaaggggtctcgccggatctgagcacgctggtcaagccggcggcggacgtcgtcaaccagcgctttgcgctgctgggcgtgccggttcaggccaacggctatccgatcaagaccgatatccagccgggcaagtttaaaggcgcgatggcggtgccgggcgcctatgagctgaagatcggcaaaaaagaggcgcgggtgatcggcttcgatcaggccggggtattctatgggttgcagtcgatcctgtcgttagtgccgaccgacggtagcggcaagattgctacattggacgccagcgacgcgccgcgcttccagtatcgcggcattttcctcgacgtggcgcgcaacttccataagaaggatgcggtgttgcgtctgctggatcagatggcggcctacaagctcaacaaattccacttccacctgagtgatgatgaaggttggcgtatcgagatccccggtttgcctgagctgacggaagtcggcggccagcgctgccacgatctgagcgaaaccacctgcctgctgccgcagtacggccaggggccggatgtctacggcggtttcttcagccgtcaggactatatcgacatcatcaaatacgcccaggcgcgccagattgaagtgatccctgagatcgacatgccggcgcacgcccgcgccgcggtggtgtcgatggaggcgcgctataaaaagctgcatgccgccggaaaagagcaggaggccaacgaattccgcctggtggatccgactgatacctccaataccacctccgtgcagttctttaaccgtcagagttacctgaacccgtgcctggattcttcccagcgctttgtcgacaaggtgatcggcgagatcgcccagatgcataaagaagccgggcagccgatcaaaacctggcacttcggcggcgacgaggcgaaaaacatccgcctgggcgccggctataccgacaaggcgaaaccggagccgggtaaaggcgtcatcgaccagagcaacgaagacaagccgtgggccaagtcgcaggtttgccagacgatgatcaaagaaggcaaggtggccgacatggagcacttaccgagctacttcggccaggaggtcagcaagctggtgaaggcgcacggcatcgacagaatgcaggcctggcaggacggcctgaaagacgccgagagcgcgaagtcgttcgccacctcgcgcgtgggcgtcaacttctgggataccttgtactggggcggtttcgacagcgtcaacgattgggccaataaagggtatgaagtggtggtctccaacccggactacgtctacatggacttcccttacgaggtgaacccggacgagcgcggttactactggggcacccgcttcagcgacgagcgcaaggtgttcagcttcgcgccggacaacatgccgcagaacgcggaaacctcggtcgatcgcgacggcaaccacttcaacgccaagagcgacaagccgtggccgggagcctacgggttgtccgctcagctgtggagcgaaacccagcgcaccgatccgcagatggaatacatgatcttcccgcgcgcgctgtcggtggccgaacgcgcctggcaccgcgccggttgggagcaggactatcgcgccggccgcgaatacaaaggcggggagacccactttgtcgacaccaaggcgctggagaaagactggctgcgcttcgccaatatcctgggccagcgtgaactggccaagctggacaaaggcggcgtcgcttatcgtctgccggtgcccggcgcacgcgtagcgggcggcaagctggaggcgaatatcgcgctgccgggattgggcatcgagtattccaccgacggcggcaagcagtggcagcgttatgacgccaaggccaagccggcggtatcgggtgaggtgcaggtgcgttcggtcagtccggacggtaaacgttacagccgcgccgagaaggtctaa

SEQ ID NO: 1968 - DNA, 2664 bp, Serratia sp.
atgaataaatttaaactgagtgccctggccgtattggcggcgaccgccggcatgttcggcgcggccggcagcgccatggcggatcagccgctggtggagcgcctcagccagctgaagctgaatatcaaaatgctggataaccgcgccgccgacagcggcgtggactgcgccaggctgggtgccgactgggcggcctgcaacaaggtgctgatcacgctggccaacggcggccaggcgattaccgccaaagactgggccatctatttccacagcccgcgtcagacgctggaggtgggcaataagcagttccgcatcactcacctgaccggcgatctgtataagctggagccgaccgcggcgttccggggcttcccggccaaccaggcggtggaaattcccattgtggcggagtactggcagctgtttaagaccgatttcctgccgcgctggtatgccaccgctggcgacgctaaaccgcaggtgctggtcaataccgatactgaagatctggaccggtttgtggcgccgttcggcgacgaccagtggaagcgcaccaaagacgataacaacgtgctgatgacgccggcctcgcgctttacgcgcaacgcggatgtgcagacgttgccggccgcctcgctgcgcggccagattatcccgacgccgatgtcggtacagatccatgcgcaggatatcgatcttggcaacggcgtggcgctgaacctcgacgcgctggagccggcgtcagcggaggtggtgcgcgagcgctttaagcagcttggcgtcgcaagtgtggcgacgggctatccgatcgtcaccgagatcagaccggcatcgtttagcggcgagatagcgcaatccggcgcctataaactgacgctgagcgagaaggaagcgcggattaccggctttgaccagagcggggtgttctacggtctgcagtccattttgtcgctgattccgctgaatggcgagaagaagattgccgcgctggaggcgagcgacgcgccgcgctttgcctaccgcgggctgttcctcgacgtggcgcgcaatttccaccataaggacgccgtgctgcgcctgctggatcagatggcggcctataagctgaataaattccatttccacctgaccgatgatgagggctggcgtattgaaatccctggcctgccggagttgacggacgtcggtgcgcagcgctgccatgacctgagcgaaaccacctgtctgctgccgcagtacggtcaggggccgggtgtctacggcggtttcttctcgcgccaggattacatcgacattctcaagtatgcgcaggcgcgacatattgaggtgatcccggaaatcgacatgccggcgcacgcccgcgcggcggtagtttccatggaggcgcgctaccagaaactgatggcgcagggcaagcagcaggaggcggaggcgtaccggctggtcgacccgaccgatacctcgaacaccacctcggtacagttcttcaaccgccagagctacctgaacccgtgcctggactcctccacccgctttgtcgacaaagtgatgggggaactggtcaaaatgcatcaggaggcggggcagccgatcggcacctggcactttggcggcgatgaggcgaaaaacatccgtctgggggccggttacaccgacgtgaagaaacctgaggcgggcaaggggatgctcgatctgagcaaggaagataagccatgggcgaagtcgcaggcctgccagcggctgatcgacagcggtaaagtggcggatatggaacatctgccgagctactttggccaggaggtcagcaagctggtgaaggcgcacggtatcgatcggatgcaggcctggcaggatggcctgaaagatgccaaggacgccaaagcgttcgccacctcgcgcgtgggcgtcaacttctgggataccctgtactggggcggctttgactcggtgaacgactgggccaacaagggttatgaagtggtggtctccaacccggactatgtctatttggacttcccgtatgaagtgaatccgaacgacagcggctattactggggcacccgcttcagcgacgagcgcaagatcttcagctttgccccggacaatatgccgcaaaacgccgaaacctcggttgaccgcgacggcaacgcgttcagcgccaaaagcgacaagccgtggccgggggcgcacggtctgtccgcccagctgtggagcgaggtggtacgaaccgatccgcagatggagtatatgatcttcccacgtgcgctgtcggtggccgagcgcgcctggcaccgcgccgactgggaactggactatcaggcgggccgcgagtacaaggggggggaaacccgctttgtcgacggcaaaaagctggcgcaggagtggcaggtttttgccaatatcctggggcagcgtgagctggccaagctggatgcgggtggcatcagttaccgtctgccggtgccgggcgcgcgcatagtcggcggcaggctggaagccaatattgcgctgccgggcctgaccatcgagtattcgaccgacggcggccagcgctggcagcgttatgatgacgccgccagaccggcggtgcagggcgaggtgcaggtgcgttcggcaagcccggacggcaagcgcttcagccgtgcggagccggtaacggcctaa

SEQ ID NO: 1969 - DNA, 2664 bp, Serratia sp.
atgaacaaatttaaactgagtgccctggccgtactggcggcgaccgccggcatgttcggcgcggccggcagcgccatggcggatcagccgctggtggagcgcctcagccagctgaagctgaatatcaaaatgttggataaccgcgccgccgacagcggcgtggactgcgccagactgggcgccgactgggcggcctgcaacaaggtgctgatcacgctggccaacgacggccaggcgattaccgccaaagactgggccatctatttccacagcccgcgtcagacgctggaagtgggcaataagcagttccgcatcactcacctgaccggcgatctgtataagctggagccgaccgcagcgttccggggcttcccggccaaccaggcggtggaaattcccattgtggcggagtactggcagctgtttaagaccgatttcctgccgcgctggtatgccaccgccggtgatgccaaaccgcaggtgctggtcaataccgatagcgaagatctggatcggtttgtggcgccgtttggcgacgaccagtggaagcgcaccaaagacgataacaacgtgctgatgacgccggcctcgcgctttacgcgcaacgcggatgtgcagacgttgccggccgcttcactgcgcggccagattatcccgacgccgatgtcggtacagatccatgcgcaggatatcgatcttggcaacggcgtggcgctgaacctcgacgcgctggatcaggcgtcagcggaggtggtgcgcgagcgctttaagcagcttggcgtcgcgagtgcggcgacgggctacccgatcgtcaccgagatcagaccggcatcgtttagcggcgagatggcgcaatccggcgcctataaattgacgctgggcgagaaggaagcgcggattaccggctttgaccagagcggggtgttctacggtctgcagtccattttgtcgctgattccgctgaatggcgagaagaagattgccgcgctggaggcgagcgacgcgccgcgctttgcctaccgcgggctgttcctcgacgtggcgcgcaatttccaccataaggacgccgtgctgcgcctgctggatcagatggcggcctataagctgaataaattccatttccacctgaccgatgatgagggctggcgtattgaaatccccggcctgccggagttgacggacgtcggtgcgcagcgctgccatgacctgagcgaaaccacctgtctgctgccgcagtacggtcaggggccggatgtctacggcggtttcttctcgcgtcaggattacatcgacattctcaagtatgcgcaggcgcgacatattgaggtgatcccggaaatcgacatgccggcgcacgcccgcgcggcggtggtttccatggaggcgcgctaccagaaactgatggcgcagggcaagcagcaggaggcggaggcgtaccggctggtcgacccgaccgatacctcgaacaccacctcggtacagttctttaaccgtcagagctacctgaacccgtgcctggactcctccacccgctttgtcgacaaagtgatgggggaactggtcaaaatgcatcaggaggcggggcagccgatcggcacctggcactttggtggcgatgaggcgaaaaacatccgtctgggggccggctacaccgacgtgaagaaaccggaggcgggcaaggggatgctcgatctgagcaaggaagataagccatgggcgaagtcgcaggcctgccagcggctgatcgacagcggtaaagtggcggatatggaacatctgccgagctacttcggccaggaggtcagcaagctggtgaaggcgcacggtatcgatcggatgcaggcctggcaggatggcctgaaagacgccaaggacgccaaagcgttcgccacttcgcgtgtgggcgtcaacttctgggataccctgtactggggcggttttgactcggtgaacgactgggccaacaagggttatgaagtggtggtctccaacccggactatgtctatctggacttcccgtatgaagtgaacccgaacgacagcggctattactggggcacccgcttcagcgacgagcgcaagattttcagctttgctccggacaatatgccgcagaatgccgaaacctcggtcgaccgtgacggcaacgcgttcagcgccaagagcgacaagccgtggccgggggcgcacggtctgtccgcccagctgtggagcgaggtggtgcgaaccgatccgcagatggagtatatgatcttcccacgtgcgctgtcggtggccgagcgcgcctggcaccgcgccgactgggagctggactatcaggcgggccgcgagtacaagggtggggaaacccgctttgtcgacggcaaaaagctggcgcaggagtggcaggtttttgccaatatcctggggcagcgtgaactggccaagctggatgcgggcggtatccgctatcgcctgccggtgccgggcgcacgcattgacggcggcaggctggaggccaatattgcactgccgggcctgaccatcgagtattcgaccgacggcggtcagagctggcagcgctatgatgacgccgccagaccggcggtgcagggcgaggtgcaggtgcgttcggcaagcccggacggcaagcgcttcagccgcgcggagccggtaacggcctaa

SEQ ID NO: 1970 - DNA, 2682 bp, Yersinia sp.
atgaataaattcaaactaagtgctttggctgcgttaacagcaacttttggtttgatgggggcggcgcaagccagccccgccgaccaacaggttgtcgaccaactaagccagcttaaggttaatttcaaaataaaagataaccgagccgcagataatggaacggattgtgccgcgttgggagctgactgggcctcttgtaacaaaacactgattactctgaccaacgccggggatgagattcagggtaaagattgggcgctgtatttccataatgtgcgtcaggtgctggcggtgggtaacgatcagttcaaaattacccatttgaccggcgatctgcataaaatcgagccaaccgataagttcagcggttttccggccaataaagcagtggaaatcccgatcacaggtgaatactggcagctattcgaaaccgactttatgccgcgctggtacgccacttctggcgatgtgcagccaaaagttctggctagtactgacaccgaagatatcgatcaattcctgacgcgcttcactggggatcaatggaagcgtaccaaggacgataataacgttctgatgacgcctgaatcccgttttgttaagaacgaaagtctgaaaaccctgccggcagaaagcctgcgtgggcagattattccaacgccgatgagcgtcaaagttcataacgctgatgtcgatctgagcaaaggcgtggcgctggagttgagtgctttaccaaaacctgcggcagacgcagcgcagaaacgctttgaaatgctgggtgtgaatgttaatgcggcgggctacccgataacgactatgattcagccgagtgattttaaaggcgatctggccgttgctggtgcttatgaactgaagattggcgagcagggcgcgcaggtaattggtttcgatcaaaccggcgtgttttacggtttacagtcaatcctgtcgctgattccgtccgatggcagtaagaaaattgctactctggatgccaaagatgcaccgcgctttgaatatcgcgcgctgttccttgatgtcggccgtaactttaaaaccaaggatgcggtactgcgtttgttggaccaaatgtccgcttacaagctaaacaaattccacttccatcttagcgatgatgaaggctggcgcatagaaattccgggcttaccggagctgaccgaagtgggaagcaagcgttgccacgatctcagcgaaaatgcctgtttattgccacagttaggttcaggcccggatagcaataatctgggaagcgggcactttagccgtcaggattacatcgatatcctgaaatatgccaaagcgcgccagattgaagtgattcccgaaatcgatatgccggctcacgcccgtgctgcggtcgtttcgatggaagctcgctataacaatctgatgaagcagggtaaagaagcagaagccaatgaattccgcctgctggacccgacggatgattccaatacgacttcagttcagttctatgagcgtaaaagctacctgaatccctgcctggattcttccaaacgctttgtggataaagtgattggcgaaatggctcagatgcataaagaagcgggtatgccgctgcaaacctggcactttggcggagatgaggcgaaaaatatccgtttgggcgcgggtttccaggataaaaacggcaagattgagccgggcaagggcattatcgatcagagcatcgaagataaaccttgggcgaagtctcaggtttgtcaggacatggttaagcaaggaaaaattgaggacgtggaacacctcgctagccactttgcgatagaagtgagcaagttggttaatgcgcacggtattgagaaaatgcaggcctggcaggatggtttgaaaaacgccaaagatgccaaagctttcgctaccaaacgcgtaggtgtgaacttctgggataccctgtattggggcggagccgattcggtgaacgattgggcgaataaaggctatgaagtcatcgcttctaacccagactatgtttacttcgatatgccttatgaagtgaacccgcgtgagcggggctattactgggcaactcgttttaccgatgaagctaaggtattcagttttgcgccaaataacatgccgcagaacgctgaaacttccgttgaccgcgatggtaaccatttcagcgccaagagtgataagccttggccgggtgttcacggtatttcaggtcagtcgtggaatgaaactgtacgtacggacgatcaaatggaatacatgatgttcccacgagcgctgccgttggcagaacgtgcttggcatcgcgcaccttgggagcaggattataaagcgggccgcgagtacaaaggtggagaaacccatcatgtggatactcaggcgttaagtgccgattggcagcgttttgccaatattatgggtcagcgcgagttggcaaaactggataaggccggtatctcgtatcgcctgccagtgccgggagcgcgtgttcagggcggcttattggaggctaacgttagcctgccggggctgaccatagaatactccgttgacggtggtcagcaatggcagaaatacgatatcaaaaaccagccgaaggtcagtggcgaagtgatgattcgttctgccagtccggacggtaagcgcaacagtcgtgctgaagtcgttagcgcaactttgtaa

SEQ ID NO: 1971 - DNA, 2676 bp, Yersinia sp.
atgaataaattcaaattaagtacgctggcggcgataaccgcgacctttggcttgatgggctctgcgctggcggataccacgccacaacagcttgttgatcaactcagtacgttaaaagttaactataaaattttggataaccgagcgggcgaaaacggggttgattgtgccaagctgggggccgattgggcatcgtgcaataaagtcttgattacgctgaccaacaccggggatgagatcaaaggccaagattgggctatttatttccacagcattcgccaaattctggcggtagataacgatcagttccgcattacgcacctgactggcgatctgcataaaatcgaacctacggcaaagtttgccggttttcctgccaatcaagcggttgaaatcccgataacgggtgaatactggcaactgtttgccactgactttatgccgcgctggtatgccacatcgggcgatgcgaaacccaaagtcttgaaaagcacggatacggaagatatcaacgagtatctgactcagttcacgggcgatcagtggaaacgaaccaaagacgacaacaacgtactgatgacgccagaatcacgtttcgtgaaaaacgaggcagtgaaaacattaacggcggctaacttgcgtggacagatcattcccacgccgatggacgtaaaagtgtatccgcaagatgtgaacctgagccaaggcgttgcactggatctgagtgcattacctcaaccggctgccgaagttgtacagcagcgtttcgagttgctcggcttgaagccgaatgcggcgggtttcccgataaaaacgtctattcaaccggcgaagtttaaaggtgacttagcggtttctggtgcttatgaactgaaaattggtgagaaaggtgctcaggtcattggttttgatcccacaggcgtattttatggcctgcaatcgatcctttctttagtgccgaccgatggtagccagaaaattgccacgttggacgcaaaggatgcaccacgttttgactaccgtggtgtgttccttgatgttggccgtaattttaaaaccaaagatgcggtgttgcgtttgctggatcaaatggcggcttacaaactgaataagttccacttccatctaagcgatgatgaaggctggcgtatcgagatccccggtctaccggaactgacggaagtgggcagcaagcgttgccatgatttaactgaaaacacctgtttattgccgcaattgggttcaggcccagatagcaacaatttggggagcggtcatttcacccgcgctgattacattgacatcctgaagtacgcgaaagcacgccaaattgatgttattccagaaatcgacatgcccgcccatgcccgcgccgccgtggtttccatggaagcccgctacaacaatttgatgaaacaagggaaagagaaagaggcgaacgaattccgtctactcgatcctaccgatgattccaacacgacctcggttcagttttatgagcgcaaaagctacctaaacccttgtctggattcatctaagcgcttcgtcgataaagtgatcggtgaaatggctcagatgcataaagaagcgggtatgccattaacgacttggcacttcggtggcgatgaggcaaaaaatatccgattgggtgcgggtttccaggataaaaacggtcctattgagcccggtaaaggcattattgataagagtgttgaagataagccatgggccaaatcgcaggtctgtcaggacatggtcaaacaaggcaagatccaggacgtcgagcatctatccagccacttcgccattgaagtgagcaaactggtgaacgcccatggcattgaaagaatgcaagcgtggcaggatggcttgaaagatgccaaagacgcgaaagactttgcgaccaagcgtgtcggcgtcaacttctgggacaccctgttctggggcggtgcggacgcgatcaatgattgggccaacaaaggctacgaagtggtggcgtctaaccctgattatgtctacttcgatatgccatacgaagttaaccccaatgagcgtggttactactgggcgacccgttttagtgatgaagctaaagtgttcagttttgcgccaaataacatgccgcaaaatgccgaaacctctgtcgatcgcgatggtaatcactttagcgcgaaaagtgataagccttggcctggtgtacacggtatttccggtcagtcatggaacgaaaccgttcgcactgatgagcaaatggaatacatgatcttcccacgcgttctgccgctggcggagcgtgcatggcaccgtgcgccatgggagcaagattatcaagcaggccgtgagtatatcggcggcgaaacacatcatgttgacaccaaggcattgagcatcgattggcagcgtttcgctaatatcatggggcaacgtgaattggcgaaactggacaaagcaggtatcgcttatcgcttacctgttccgggtgcgcgagtcgtggcgggtcaactggaagcaaatatctccttgccaggtttgaatatcgagtattcaacggatggtggccaacattggcaacagtatgatgccaaggtgcaaccaaaagtcagcggtgatgtgctgatccgttcaaccagctcagatggcaagcgtagtagtcgtgccgagccggttaaagcctga

SEQ ID NO: 1972 - DNA, 2691 bp, Yersinia sp.
atgaacaaattcaaattacatgcgttagctgcgctgactgcaacttttggttttatgagtgcggttcacgccagtcctgccgatcagctggttgttgatcaactgagccagttaaaagttaatttcaaaatgcaggataaccgcgccgcagaaaaggggacggattgtgctgcattgggtgccgactgggcatcatgcaataagacactgattactctgaccaacaccggggataaaatccaaggtaaagattgggctctgtatttccataatgtgcgtcaggtgttggcggtgggtaatgaccaattcaaaattactcatgtgactggcgacttgcacaaaattgagccgaccgacaagtttagtggcttccctgcgaataaagccgttgaaattccgattaccggcgaatattggcagttatttgaaaccgattttatgccacgctggtacgccacttctggcgatgcaaaacccaaggttttatccagtactgataccgagaatatcgatcagttcctaacccgttttactggcgaccagtggaagcgcaccaaggacgataataacgttctgatgacgccagaatcgcgattcgtcaagaacgagagcctgaaaacgttgccagcaaaaagcctgcgtgggcagatcgtgccaacgccgatgaacgtcaaagtacatcaaggcgatgttgacctgagtaacggtgttgcgctggaactgagtgcgttgccaaaacctgcagcagatgccgtgcaacagcgttttgacatgctgggcgtgaatgcaaaagctacgggcttcccgatcagtactcaaattaagccttcggcctttaaaggtgatttggcggtttctggtgcctatgaactgaagattggtgagaaaggtgcgcaggttattggtttcgatccagccggcgtattctatggcttgcaatccatcctgtcactggttccaacagatggcagtaagaaaattgccatgctggatgccaaggatgcaccgcgttttgaataccgtgcattgttcctcgatgttgggcgtaactttaaaaccaaacaggcggtattacgcctactagaccaaatgtcagcctataagctgaataaattccacttccatctcagtgatgatgaaggctggcgtatcgaaattcctggcttgccggagttgaccgatgtcggcagtaaacgttgtcacgacctgacagaaacgacctgtttgttgccgcaattgggttcaggcccagatagcaataatctcggctccggccactttagccgtagcgattacatcgatattctgaaatatgcgaaagcgcgtcagatcgaagttattcctgaaattgatataccggctcatgcgcgtgctgcggtggtttcaatggaagcccgttataacaatctgatgaaagaagggaaagaagggaaagaagcggaggcgaaagaattccgtctgcttgatccgactgatgattccaacacgacatcagtacagttctacgatcgtaagagttacctgaacccatgtctggattcctcaaaacgctttgttgataaagtgattggcgaaatggctcagatgcataaagaggccggaatgccgctacaaacttggcatttcggtggggatgaagcgaaaaacatccgtctgggtgccggttatcaggataaaaatggcaagatagagccaggaaaaggcattattgatcagagcatcgaagataagccttgggcgaaatctcaggtttgccaggatatggtcaaacaaggcaaagtccaggacgttgcgcacttgtccagctacttcgctattgaggtcagtaaactggtcaatgcccatggtattgagaaaatgcaggcttggcaggatggcttgaaagatgccaaaggcgcgcaggattttgctactaagcgtgtgggtgtgaacttctgggatacgctgtattggggcggtgcggacagcattaacgattgggccaacaaaggctatgaagtgatcgcatccaatccggattacgtgtacttcgatatgccgtatgaagtgaatccactcgaacgtggctactactgggcgacccgctttaatgatgaggccaaagttttcagctttgcgccgaacaatatgccgcagaatgctgaaacttccgtcgatcgcgatggcaatcatttcagcgccaagagtgacaaaccttggccgggagtcactggcatttcaggccaatcttggaatgaaaccgtacgtactgatgaacagttggaatatatggtcttccctcgagcattgccgctggcggaacgtgcatggcatcgcgcatcttgggaacaggattatcaggctggccgtgaatataaaggtggagaaacccagtttgttgatatcaaagcattaagctctgattggcaacgtttcgccaatattatggggcagcgtgaattggctaaattggataaggccggtatcgcttatcgcttgccggttccaggcgcacggattcagggaggattactggaagccaacgtgagcttgccggggctggccattgagtattcggttgatggcggcaagcaatggcagaaatatgatatgaaagtgcagccgaaagtcagcggtgaagtgatgatccgctctaccagccctgatggtaaacgtgccagccgtgctgaagtggtgagttctacattttga

SEQ ID NO: 1973 - DNA, 2679 bp, Yersinia sp.
gtgatgaacagattcaaattaaatgcgctggcggcaatggccgcaactttgggtttgatgggatacgccaatgcggataccgcccctcaacagttagttgataaactcagcaccttgaaagttaactataaaattttggataatcgcgccgctgaacatggcgtggactgcgctaagttgggcgctgattgggcctcatgtaacaaagtaatgataacgctgaccaacaccggggatcagataacaggccaggactgggctatttattttcacagtattcgacaaattctggctgtggataacagccagttcaaaattacgcacctgaccggtgacctacataaaattgaaccgacggaaaaatttgccggtttccctgccaatcaggtggttgaaatccccattaccggcgaatactggcagctgtttgccaccgactttatgccgcgctggtatgcaacttcgggtaatgctaagccaaaagtactgaaaaataccgatactgaggacatcaacgaatatctcactcagtttaccggagataactggcagcgaaccaaagacgataataatgtgttgatgacgccggagtctcgtttcgtcaaaaatgctgcagtgaaaacattggcggcggctgacttgcgtgggcaaattattccgaccccgctggaagtcaaaatccatcagcaagatgttgatcttagcaagggtgtggcattggatttgagcgcattgccgcaatcgggtgcagaggcggtgcagcaacgtttcgaattactcggcctgacactcaattcggcaggattcccgattaaaactgccattcaaccggctgactttaaaggtgatttagcactgtccggtgcctatcagctgaaaattggcgagcaaggtgcgcaagttattggctttgatcccgcgggcgtattttacggcctgcaatcaatcctttctttagtgccgaccgatggcagcaagaatattgccactcttgatgcacaagatgcaccgcgctttgaatatcgtggcgtcttcttagatgtcgggcgtaacttcaaaaccaaagccgcggtgctgcgtttgctggatcagatggcggcttacaagctgaataaattccactttcacctcagtgatgatgagggctggcgtattgagatccccggcctgccagagttgacggaggttggcggcaaacgttgccatgatttgactgagaatacttgcttgctaccccaattggggtctggcccggatagcaataatttgggttctggttactttacccgtgctgattatctcgacattttacactatgccaaagcccgccaaattgaggtgattcctgaaatcgacatgccagcacatgcccgtgcggcggtggtgtcgatggaggcccgttaccataatttaatgaagcagggtaaagaaacagcagccaatgaattccggctactcgacccgacagacgactctaacaccacctcagtacaattctatgaacgtaaaagctatttgaacccctgcctggattcttctaagcggtttgtcgataaagtcattggcgaaatggcgcagatgcacaaagaggccggtatgccgctaaccacttggcactttggtggcgatgaggcgaaaaatatccggctgggtgctggcttccaggacaagaatggcactattgaaccgggtaaaggcatcattgataagggagttgaagataagccctgggctaaatcgcaggtgtgccaggatagggtcaagcaaggcaagattcaggatgttgagcaccttgccagctacttcggcattgaggttagcaaactggttaatgcccacggtattgaaaaaatgcaggcctggcaagatgggttgaaagacgcaaaaagcgccaaagatttcgcgaccaaacgtgttggcgtcaacttctgggataccctttactggggtggggccgattctatcaatgattgggccaacaaaggttatgaggtggtggcctccaacccggattatgtttacttcgatatgccttatgaagttaatccgaatgagcgcggctattactgggccacccgctttaccgatgaagcgaaagtcttcagtttcgcccccaataacatgccgcaaaacgccgaaacatcggttgaccgcgatggtaatcatttcagcgcgaagagtgataaaccttggccgggagtgcagggtatttcaggtcaatcatggaatgaaacagtacgcactgataaacagatggaatatatgattttccctcgggtattgcctctggctgaacgcgcctggcaccgcgcatcttgggaacaggattaccaagcaggccgcgaatatcaaggcggtaagacgcaccatgtggatacccaagcattgaatacggattggcagcgtttcgctaatattatgggccagcgtgaattggcaaagctggataaatccggtgttgcttaccgcttgccggtgccgggggcgcgagttgttggcggaatattggaagctaatctctccttgccggggctgattatcgagttttctaccgatggcggaaagcaatggcagcagtatgatgccaaagtgccaaccaaagtcagcggtgaggtactgatccgtgctaccagcccggacggcaaacgcagtagccgggcggagccggttaaagtgtga

SEQ ID NO: 1974 - DNA, 2670 bp, Edwardsiella sp.
atgatgaaaggttataaactgagcgtagtggcgacggccttggggatgttggggatgagtgggatggcgcaagccgatcagcagctcgtcgaccgcatcagcagccaggtgaaggtgaactacgccgtcaccgacaaccgcggcgcggagaatggcgtcaactgcgcggcactgggcgcggactgggcctcctgtaaccaggccgtgatcagcctgaccaacgatggcagcgccatcgagggtaaagactgggccatctattttcataatattcgtcagatcctaaagagtggcaacgatcagtttaagatcacctttgtgaccggcgatctgcataagattgaaccgaccgataaattcaagggcttcgccgccggggaacgcgtcgagatcccgatcgttggcgaatattggcagttgttcgagagcgacgtgttgccgcgttggtatgtgacgtcgccggacgccaaacccaaggtgatcgccaataccgataccgaagatttgagccagtttgtcacgccgtttagcggtgatctgtggaagcgtacccaggatgacaagaacatcctgatgacgccggagaaccgtttcgccaagaatgccgatgtgaagaccctgccggcctccagcctacgcggtcagatcatgccgacgccgatgagcctgaaggtgcatcagcaggacgccgatctggcgcgtggcgtgagcctggatctgacggtgttgaacaatgccagcgccgacgtcatcaaggcgcgcctgagccagttgggggtgaagcaggtcaagggggggtacccgatcaaaacccagatcgccaccaaggccttcaagggcgacatggcggtcgcgggggcttatcaactgaagatcggcaccaagggcgctgaggtgaccggttacgatcaggccggggtcttctacggtctgcaatccattctgtcgttactgccggcggatggcagcgccaagatcgcgacgctggacgccgaggatgcgccgcgcttccaataccgtggcatcgagctggatgtcgggcgtaacttccattcactggcctccatcgagcgcctgctggatcagatggccgcctataagttgaacaagttccacttccatctgaccgatgatgagggctggcgtattgagatcccggggctgccggagctgaccgaaatcgggggcaagcgctgccacgatctgaccgagcagacatgtctgctgccgcagttgggctccggcccggatagcgacaacaatggcagcggctacttcacccgtgccgactatatcaagttgctgaaatacgcccaggcgcgtcatatcgaggtgatcccggagatcgacatgccggcccacgcccgcgcggcggtggtggcgatggaagcacgttataacaagctgaaggcggcgggtaacgagaagggggccaacgaatatcgcctgctggatccgaccgatgactccaacaccacctcggtgcagttctacgatcgccacagctacctcaacccgtgcctggactcctccaagcgcttcgtggataaggtgatcggcgaaatcgcccagatgcaccgtgaggcggggcagccgctgactacctggcacttcggcggtgacgaggcgaagaacatccgcttagggccggggtacaccgatgtgagcaagcctgaacccggcaaggggatgctcgacctgagcaaagaggacaagccgtgggccaagtcgcaggcttgtcaggcgatgatcaacacgggcaaggtcgccgatatggatcacctgccgagtcacttcgcagtcgaagtcagcaagatggtcaaggatcatggtatcggtaagatgcaggcctggcaggacggtctgaaggatgccaaggacgccaaggccttcgccacgccgcgcgtcggggtgaacttctgggataccctgtattggggaggattcgattcggctaacgactgggcgaataaaggctatgaggtgatcatctccaatccggattacgtctacatggacttcccgtatgaggtgaatccgaaagagaacggctactactggggcacccgctttagcgatgagcgtaagatcttcgcctttgcgccggataacctgccgcagaacgctgaaacctcggtcgaccgcgatggtaactacttcacggcgaagagcgataagccgtggccgggcgcccatggtctctccgcgcagttgtggagcgaagtggtgcgtaccgacgatatgatggaatacaagatctatccgcgcatcatggccgtggccgagcgagcctggcatcaggccggttgggaacaaccatatcaggcgggccgtgagtataagggcggcgagacgcatctggtcgatcagcaggcgctgttgaaagattggcagcgtttcgccaacctgatgggccagcgtgaactggccaagatggataagtcgggcgtggcctatcgtgtcccacagccgggggcccgcgtggttgacggtaagctggaaaccaacgtggcgatgccggggctggtggtcgagtactccgtcgacggcggtaagcagtggcagcgttacgatgcccaggcgcagccgacggtgagcggcgaggtccaggtacgtaccgtatcgccggacggccagcgttttagccgcgtcgagtccgttaaaccctaa

SEQ ID NO: 1975 - DNA, 2670 bp, unknown
  environmental sample
atgatcctttcgcgcagaacaaaactggcagcggccgtcgcactggggctgctgggctccgccagcctcagccaggcagaccagaagaccgtggacgaactgagccggctcaaggcccaggtgacggtaaaggacaaccgcgccgccgagcgcggcatcgattgcgccgccctgggtgccgactgggcctcgtgcaacctgtggagcgtcaccctgaccagcgacgcggacatcttcagcaaggactgggcgatctacttccacaaccctcgccaggtgctgaaggtgcagaacgagcagttcaaggtgaccttcatcaccggcgacctgcaccgcatcgagccgaccgagaaattccagggcttcaaggccggccaggccgtcgagatccccttcatcggcgaatactggcaactgttcgaaagcgacatcatgccgcgctggtacgccacctccacggacgctcggcccaaggtcatcgccagcaccgataccgaggacctgcgccagttcgtcacgcccttcacgggcgagctgtggaagcgcaccccggatgaccacaacatcctgatgctgcccggcagccgtttcgagagcaacgccgatctcgccctgctgccggccacgagcctgcgcgggcagatagtgccaacgccgcagaaggtgaagatcagcgatcacgacgccgacctcagccacggtgtgacgctggacctggccgcgctcgatcccgcgagcgcagccgccgtccaacagcgcttcgccctgctcggggtcaagtcggtggccaagggctacccgatcagcgccaccgtcgcggcctccgccttcaagggcaagcaggccgtgagcggcgcctaccagctgttcatcggcgaaaagggtgcgcaggtacgcggctacgaccaggccggcgtcttccacggcctgcagtccatcctctcgctgctgcccgccgacggcggcgcgaagatcgccgtgctggaagcgcaggacgcgccccgcttcccctaccgcggcatccagctggacgtgggacgcaacttccacagcaaggcggcggtcgagcgactgctggaccagatggccgcgtacaagatgaaccgcttccacttccacctgaccgacgacgaaggctggcgcctggaaatccccggcctgccggagctgaccgagatcggcagccggcgctgccatgacctcgaagagaagacctgcctgctgccccagctgggttcggggccgaacagcgacaacaacggcagcggctacctgacccgtgccgactacatcgacatcgtgaaatacgcccgggcgcggcagatcgaggtcattccggagatcgacatgccggcgcacacccgtgcggccatcatctccatggaagctcggcatgcgaaactgctggcggcgggcgacgagaaaggcgcggacgaattccgcctgctcgacccgaccgacacctccaacaccacctcggtgcagttctacgaccgccgcagctacctgaacccctgcctggagtcgtccaagcgcttcgtcgacaagatcatcggcgaagtggcgaagatgcacgacgaagccggtcagccgctgaagacctggcacttcggcggtgacgaggcgaagaacatccgcctcggcaccggctaccaggacaagaacggcaagatcgagccgggcaagggcatcatcgaccagagcgtcgaggacaaaccctgggccaggtcgcaagcctgccaggcgctggtcgccaatggcgtggtagcggacatggagcacctgccgagccacttcgcggtggaggtcagccaactgatccgccagcacggcatcgacggcatgcaggcctggcaggacgggctgaaggacgccaaggacgccaaggccttcgccacccgccgcgtcgccgtgaacttctgggacactctgtactggggcggctacgacagcgtcaacgactgggcgaacaagggctatgacgtggtcatctccaaccccgactatgtctacctggacttccccgccgaggtgaacccgcaggaaaacggctactactggggcacccgctacagcgacgagcgcaaggtcttcagcttcgccccggacaacctgccgcagaacgcggaaacctcattggaccgcgacggcaacccgttcaccgcgaagagcgacaagccctggccaggcgcccatggcctgtccgcgcaactgtggagcgaaaccacccgcaccgacgagatgatggagtacaagctctacccgcgcctgctcagcgtggcggagcgcgcctggcaccgcgcgggctgggagcaggattaccaggccggccgcgaatacaagggcggcgaaacccactgggtcgacaccaaggccctgcggggtgactggctgcgcttcgccaacctcctgggccagcgcgaactggcgaagatggacaaggccggggtcggctaccgtttgccggtccccggcgccaaggtggtggaaggcaagctgcaggccaacatcgccctgcccggcctgaccatcgagtactccaccgacggtggccagcactggcaaccctacgaccagaaggcacagccgcaggtcagcggcgcggtgcagatccgctccgtcagcccggacggccagcgccatagccgcgaggagccggtgggtatctga

SEQ ID NO: 1976 - DNA, 1062 bp, Pseudomonas sp.
gtggattgctcggcattcgtatggcgtggcctgaagaacgcgggttacgacgtgcgtggcgagaacgccgcggggttcactacctcgacgctgttcaatggcgcgaacacgaccgcttacgcacgcgagcatttcgacgtgacctcggctgccgaagcacgcaagccgaacggatcgctgaagcagggcgacatcctgatgttctcctcgtcgcagggccagcatgtcggtattttcaaaggctacgacgcgcagggaaacatccagttcatcggttcgcagggaagcacggggccggccgaagtcaccatccggccgggcgggtactgggatggcggaagcacccgcatcgttggtgcgctgacaccgaagccggaattccaggtgcgcgcgccgctgcatggcaatggcgaacctgcgctgtcccggcctggcgccaccgtgcagccggctgcatcacaccctgcggccagcgaggtgatgaagcaggggcagcgtggcaccgacgtgcaggcgttgcagcagaccctcaatcagctcggcgtgcgtgatgcgcagggccatcggttgtcggaggatggccgtttcggtgaccacacccgcgaagcggtgatcgcgttccagaagcagcaggggctggcggccgatggaattgtcggtcgccagaccactgccgcactggcggcgggccgtgcgcagggccatgaacctgcagcggctgcgccgaaggggccgtcgctgaacgatgcatcgcatccggaccacgcactgcacaacgccgtccgcagcaagcttcccagcgtgttttccgaagaggctgcggccaatatcaccctgcatgcaaagcagaacggtatcgacgcggccgacaagctgcagagcatcacggtgcaggatggcaaggcgttcgtgatgggcacgacgccgggcttccgcaccgctgtcgatctggcccaggcgccgccgtcgctggagcaaaccagtgccaagctgctggcagatccgtcgcaccagcagcaggtgcatgaggagcagcagcgggtcgcgatgggcggtcgctga

SEQ ID NO: 1977 - DNA, 1026 bp, Xanthomonas sp.
gtgcccggcgagaatgctgccgccttcacgaccgccaagttgttcagcggtaccaacattacgccctatgcgcgcgaacatttcgaagtcacgtcggccgctgaggcgcgcaagccgaatggatcgttgcatcagggcgacattttgatgttctcctcgtcgcagggccagcatgtcggcatattcaagggctacgactcaaaggggaatattcagttcatcggctcccagggcagtacggggccggccgaggtcacgatcactcccggcggttactgggatggcagcggtacgcgtatcgttggtgcgttgacgccaaagcccgaattccaagtgcgtgcaccgctacatggcgcgactgaacccagcgctgcgcgcactcagacacctgcaaatgtgtcgccaattcatcagggatcgagtgataccgcctctcatcacatgctcaagcgcgggatccgtggggacgaggtacagtcgctgcagcaggatctcaaccgcctcggcgtgcgcgatacacagggcaatcggcttgccgaggacgggcgctttggcgacaacacgcgcgaggcggtgatggcgttccagaagcagcatggcctgcagcaggacggtgtcgtcggccgtgatacgcgggcggcgttgtctgcgcccatggccaaagcggccgatgacccagccgcggcgcccaagggcccgtcgctcaacgatgcttcgcatccggaccatgcgttgcacaatgcgatccgcagcaagctgccgagcatgatctctaatgaggctgctgccaacgtcactttgcaggccaagcagaatggcatcgacagcgcggataaacttcagaacgtgacggtgcaagacggcaaggcattcgtgatgggaaccacgccagggttccgtgcagcagtggacctgaaccagcctgccccgtcattggagcagaccagcgcgcagttgctggctggccagtcgccgcagcaacaggcgcacgacgagcaacaaagggtcgccatcggcggccgctga

SEQ ID NO: 1978 - DNA, 1731 bp, Xanthomonas sp.
atgaccgacaccacgatctataccgaaatggttcaaccacgcggcgctgcatacagcagtgaccggatcaaaccctggagccattaccgcgagcccatcgacagcggagatggcagattgcatggcgaatcgcgtcgctggggcgatgccagtccacagacacaatcacgcgtgatcgatagccttatcgatgcctcgcgagatgcagggctttcagcgcgcgagactgcatacgtccttgccatcgcccgagttgagtcaggcttcaacccggatgcagctgcggggacaacgtctgcctctgggctaggtcaattcattgaccgtactggcgcgcattatggcgtcaacgcgtccaaccgctttgacgtggaaacgcagtcgcaggcattggtgcaacatttcgttgataaccgggacctcgcgcgtagccgcggccagggcgaggattacatttacaagtatcaccatgatggtcctagcaaggattatggtggcttggctctgtcacggcgcgagattgcgcctcatctggacaactacacccagtttgtcgagcagcgtcttgcacaaacgcagggcaatacagtaggtcagccgacgccagtgacgcagacggccgaacctagccatgccactcgcagcaatttccggcaaacgatggaacgcatgctgcccggtcaaggcagcaccgacccgcacattaccggtcattatggtgagcaccgcggtagccacgggccgcacggtggtacagatttcaactacgaaggtggtcagcaaggccgtaacctgcagcacccgacggtgcattcgccggtctccggaacggtaacgttcgcgggcggcaactacggcacggtcaagattcacgatgcgcagggtaactcgcacgagatcctgcacctggacgcactcaaggtgaaagaaggccagacgctgtccgcgggcgatgccatcggtacgatgggcggacttggcccgaacggtaacagccagtacgcgcagcatgtgcattaccaactgcgcgatgccaacggcaagttgaccagtccagaggcattctggaatcaaggtcaccagcacgagtcgggcgcccgtcaatcgcaaccatcggcaccggctggcaatggcacgctgcgtcatggcgagcagagcggcgatgtcggcaagttgcagcaggacctcaaccgtctcggcgttcgcgatgcacagggcaaccggcttgcggaagatggtcgttttggggacaacacacgggaggcggtgatcgcgtttcagaagcagcatgggctgcagcccgacggggtggtgggccgcaatacgcaggccgcgctgtccacacaaccggcacagacccagtcgcaggcgggcgagacgcaggttgctgtgcccaagggtccgtcgctcaacgatgcctcgcatccggaccatgcgttgcacaacgcgatccgcagcaagctgccgagcatgatctctaatgagaccgctgccaacgtcactttgcaggccaagcacaatggcatcgacagcgcagataaactgcagaacgtgacggtgcaggacggcaaggcgttcgtgatgggcaccacgccggggttccgtgcggcggtggatctaaaccagcctgccccgtcattggagcagaccagcgcgcagcttctggctgggcagtcgcaacagcaacaggcgcacgaagagcagcaaaaggtcgccatcggcggtcgctga

SEQ ID NO: 1979 - DNA, 1755 bp, Xanthomonas sp.
atggcaaccgatcgcgaaactgggctgctgcaggcagcctatgcagcgggaatcacccggccaaacgaattggccaatttcatggcacaggtaggccacgaatcgggcggactcaatcgcctggaagaagggttccgctatacacgcggctcctcgcaagtgagctcgaaagtgcgttctgcactgcgcgaaggaccggaggcgctggaagaagcgcgcctggaagcattgcgcggccagcctgagaaactcgccgaattgatgtatggcgggcgtatggggaacaacgagcccggcgatggttatctttaccgtggtcgcggctacatccagctcaccggcaaggatcagtatcgcgaggccggcgaagcgttgaaactcgacctggtcgcacaccccgaactggccgcgcaaccggaaaacgcgtcgcggatcgcaacctggtactggcagcacaatgtgccgcaagcggccaggcaggatgcgcatgcagcaggcgttgcgatcaacggcggcgatccgccgaatgggctggccgaccgcgaaagccgcttcgcgcgctggcagcgcgacctcacgcccgatgtgatgcacaagctcgaacacggtcaactcggacagacggtcgcacccgcgcagcattcggcaccggcgcaaacaccgcatgccggttcgaacgcgcattcgttccaggccaccatggagcgcatgcttccgccgcagagcggcactgcgccgcatgtcaccgggcattatggcgagcaccgcagcgcgcgcgaccacggcggcaccgacttcaattatcagggcggtcaggcaggacgcaatctgcagcatccaaccgtgcattcgcccgtcgccggaacggtgacctttgccggcggaagctacggcaccgtcaagattcgcgatgcacaaggcaattcgcacgagatcctgcatctggatggcgtcaaggtcaaagaagggcaaacgctgtcggcaggcgatgccatcggcacgatggggggacgtggacccaatggcgcaagccaatatgcgcagcatgtgcattaccaattgcgcgatgccaacggcaagttgaccagccccgagaacttctggaatcagggtcaccaacaccaagcgggtgcgcggcacacccaggcagcatcggcaagtggcacaggtgccgtgcggcatggcgacagcagtcaggatgtgggtaagctgcagcaggacctcaaccgtctgggcgtgcgcgatgcgcagggcaaccgactggccgaggatggccgtttcggcgacaacacgcgtgaggcggtgatggcgttccagaagcagcatgggctgcagcaggacggtgttgttggccgcgacacgcgggcagcgttgtctgcgcaaccggtgcagacccgcgaggcgcaggttgctgcgcccaaagggccttcgctcaacgatgcatcgcaccctgaccacgcgctacataacgcaatccgcagcaagctgccgagcatgatctccaacgagaccgcggcacatgtcacgctgcaggcgaagcagaatgggatcgacagcgcggacaagttgcagaacgtgacagtgcaggacggcaaggcgttcgtcatgggcaccacgccgggcttccgtgcggcggtggacctgaaccaacctgccccgacacttgagcaaaccagcgcacagttgctggctggtcagtcgcagcagcaacaggcccagcaagaacagcagaaggttgcgatgggcggtcgctga

SEQ ID NO: 1980 - DNA, 1755 bp, Xanthomonas sp.
atggcaaccgatcgcgaaactgggctgctgcaggcagcctatgcagcgggaatcacccggcccaacgaattggcgaatttcatggcccaggtaggccacgaatcgggcggactcaaccgcctggaagaagggttccgctatacccgcggcccctcccaagtgagctcgaaagtgcgttctgcactgcgcgaaggaccggaggcgctggaagaagcgcgccttgaggcattgcgcggccagccggagaaactcgccgaattgatgtatggcgggcgcatgggcaacaacgagcccggcgatggctatctttaccgtggtcgcggctacatccagctcaccggcaaggatcagtatcgcgaggccggcgaagcgttgaaactcgacctggtcgcgcaccccgaactggccgcgcaaccggaaaacgcgtcgcggatcgcaacctggtactggcagcacaatgtgccgcaagcggccaggcaggatgcgcatgcagcaggcgttgcgatcaacggcggcgatccgccgaatggactggctgaccgcgaaagccgcttcgcgcgctggcagcgcgacctcacgcccgatgtgatgcacaagctcgaacacggtcaactcggacagaccgtcgcgcccgcgcagcattcggcaccgacgcaagcaccgcatgccggttcgaacgcgcattcgttccaggccaccatggagcgcatgcttccgccgcagaacggcactgcgccgcatatcaccgggcattacggcgagcaccgcagcgcgcgcgaccacggcggcaccgacttcaattatcagggcggtcaggcaggacgcaatctgcagcatccaaccgtgcattcgccggtcgccggaacggtgacctttgctggcggaagctacggcaccgtcaagattcgcgatgcacaaggcaactcgcacgagatcctgcatctggatggcgtcaaggtcaaagaagggcaaacattgtcggcaggcgacgcgatcggcacgatggggggacgtgggcccaatggcgcaagccaatatgcgcagcatgtgcattaccaattgcgcgatgccaacggcaaattgaccagccccgagaccttctggaatcagggtcaccaacacgaagcgggtgcgcgccacacgcaggcagcaccggcaagcggcacaagtgccctgcggcatggcgacaacagtcaggatgtgggcaagctgcagcaggacctcaaccgtctcggtgtacgcgatgcacaaggcaaccgcctggccgaagacgggcgcttcggcgacaacacgcgtgaggcggtaatggcgttccagaagcagcatgggctgcagcaggacggtgttgtcggccgcgatacgcgtgcagcattggctgcacaaccggcgcagacccgcgaggcgcaggttgctgggccgaaagggccttcgctcaacgatgcatcgcatcccgaccacgcgctacataacgcaatccgcagcaggctgccgagcatgatctccaacgagacggcggcacatgtcacgctgcaggcgaagcagaatgggatcgacagcgcggacaagttgcagaacgtgacagtgcaggacggcaaggcgttcgtcatgggcaccacgccgggcttccgtgcggcggtggacctgaaccaacctgccccgacacttgagcaaaccagcgcgcagttgctggctggtcactcgcagcagcaacaggcccagcaagaactgcagaaggttgcgatgggaggtcgctga

SEQ ID NO: 1981 - DNA, 1194 bp, Stenotrophomonas Sp.
ttgtttctgcggcgcataccggccagcgccgaccatgccagacgaggcgaagtctggctgctctccggcggccctggtgagtcaggggcatccctgtatcccctgatccagacttaccagcgtgcatttcccggattcgatcttgtgattcccgaccaccggggtacaggccgatcttcgcggatctgtcccgtccaggagtcacctgaaagcccggaaggcagggggctggcaggaacggaatggggaccctgcatcgggtctatgtacgccaacctgcagcggacgtcggccttctctattaccgaggccgctcaggaccttggcatcctgatgtcggacggggatcgcggcggtcaggtgttgctgtatggcgtttcttacggcacccaactggcgctgcgcgcgctccaggtcaacgagcttgacgtggatggcctcattcttgacggactggtgccgccggaaaccactgaaaagttcgatctcagccggcgcacagcgcttgtcgaccaggtaggccgggagagcatggacgaaggtagcctcgttcgctatcgaacgctgctggcggcgaaggatgctgcttggcagagagaggtgccgggcggcgatgtgcgccgatttttcgccgcgctgctgagcttccctgcgctgcgcgatcgaatcccgaagatcgttcaggatctttccgctggcgatgcccggtcgctggttgccacggcaaacgattggaacattgcgctggcgcaactgggacagggtggaaacaatcaaccggccttgccgctggtgatgctcattgccgcctcggagaacaacgctcgtccggagctgagcctggccactgtcgatgaagaggccaggcacgcgctgttcgccagccccattcccggcctgctggtgaatggcggtgttccgcgctacccacgtgatgcatggttcggaaagagtccgcgcacccttccgcgaaccctggtaatgcaggggaccctggacccgaataccgcgtacgccggtgccgtagaacactctgccacgcttgccgggtcggggcctgtcacgttccacacagtggaccgcggcgcccatctgctcgcattggtggctccacgctgctttgtagcggcggtcgaaagcttcattgagggtgccgtggtgagcgaacgctgtgcagaacccgcgtcagggtga

SEQ ID NO: 1982 - DNA, 1194 bp, Stenotrophomonas Sp.
ctgttcctgcggcgcatagcggccagtgcggacgtacccagacgaggcgaggtctggctgatctctggcggcccgggcgagtcaggggcatccctgtatcccctgatccagacctaccagcgtgcgttccccgggtttgatcttgtgatccccgaccaccggggcacgggtcggtcatcgcggatctgcccgatccaggaggcaccggaaagcccggcaggcacgggactggcagacgccgaatggggcccgtgcatcggcagcatgtacgccaacctgcagcgcacgtcggccttttccattaccgaggctgcgcaggaccttggcattctgatgtcacaggcagatcgcagcgggcaggtgttgctgtatggcgtttcctacggcacccagctggcgttgcgttcgctccaggtcaatgagcttgatgtggatggcctcatcctcgacggactggtgccgcccgagaccactgaaacatgggacctcagccggcgcaccgcgcttgttgaccaggtcgggcggcagagcatggatgaacgtagcctccaacaatatcggacgctgctggcggtgaaagatgcggcttggcagaaggacgtgccgggcggcgacctgcgccggttcttcgccgctctgctgagcttccctgcgctgcgcgatcgaatgccgaagatcgtgcaggacctttccgagggtgatgcccgcaccctcgttgccacagtaaaggactggaatgccgcgctggcgcagctgggacaggcaggaaacaaccagccggccctgccgctggtgatgctcatcgccgcctcggagaacaacgcacgtccggagctcagcatggagaccgtgaacgaagaggccaaagatgcgttgttcgtcagtcccattcccggcctgctcgtcagtgggagtgtcccgcgttacacgcgtgatgcctggttcggaaagaccccggacaccctgccacggacactgatcctgcaggggacgctggatccgaataccgcctacgccggtgcccaggaacacgctgctatgctccgcaggtcggggcctgtcacgttccacacggtcgaccgcggtgcccatctactgccgttggtagcgccaggctgctttgttgcggctgtcggcagcttcattgggggtggcatggtcagcgagcgctgtgcagagcccctgctggagtga

SEQ ID NO: 1983 - DNA, 1194 bp, Stenotrophomonas Sp.
ctgttcctgcggcgcataccggccagcgcggaggtgcccaggcaaggcgaggtctggctgctgtctggtggcccgggcgagtcaggcgcctccctgtatcccctgatccagacttaccagcgtgcgtttcccgggtttgatcttgtaatccccgaccaccgcggcacgggccggtcatcgcggatctgccccatccaggaagcacctgaaagcccagaaggcacggggttggcagggtccgagtggggcccctgcatcagcagcatgtacgccaacctgcagcgcacttcggcgttttccgttaccgaggctgcgcacgatcttggtgttctgatgtcaggggcagaacgcggcgggcaggtgttgctgtatggcgtttcctacggcacccagctggcgttgcgttcgctccaggtcaatgatctacatgtggatgcgctcatcctcgacgggctggtgccgcccgaaaccactgaaacgtgggatctcagccggcgcacagcccttgttgacaaagtcgggcggcagagcatggatgaacgtagcctccagcagtatcggctgctgctggcggcgaaggatgcggcctggcagaaggtcgtgccgggcggtgacctgcgccggttcttcgctgcgctgctgagcttccctacgctgcgcgatcgaatgccgaagatcgtgcaggacctttccgagggcgatacccgcacgctggccgccacggtgaaggactggaatgcggcgctggcgcagctgggacagggaggaaacaaccaaccggccctgccgctggtgatgctcatcgccacctcggagaacaacgcacgccctgagctcagcctggagaccgtgaacgaagaagccaagaatgcgctgttcgtcagtcccattcccggcctgctcgtcagtggcagtgtcccgcgttacccgcgtgatgcctggttcggaaagaccccggataccctgccacggacactgatcctgcaggggacgctggatccgaataccgcctacaccggtgcccaggaacacgctgccttgctccgcaggtcggggcctgcgacgttccacaccgtcgaccgcggtgcccatctactgccgttggtggcgccaagatgctttgtttcggccgtgggcagtttcattaatggcgacgtggtgagcgagcgctgcgcagagcccgtgccagagtaa

SEQ ID NO: 1984 - DNA, 2550 bp, Streptomyces sp.
atgaggaccacggccctgccactggctctctccctggccgccggcggactgatcacgacgaccgccacgaccgcacacgccaccaccgcacacgccgctacctatggcactgtgcgcgaggcgttcaacaacacggcgatcagcccggacggcgaacccgcagcagccgacttcgacgccgcaggacgcagcctgtcggccaccgacctcgacaaggcgggctggcgccgcggcacccgcgtcacgatcggcgcaacgacctacacacgggccgatgtcgcccccggtcaacccgacaacgtcatggccgcaggccagatcctgacgacacggggcgccggcaacgcactcggattcctggcatctgcgacatccggccccgtcgccgcgcccgtcaccgtgacctacaccgacggcacatcggcacagcagaccctggaggtccccgactggaccgcgggcgcgacgaccacggccgccctcagcctggaccaccgcaacaccccgtccggacaacagacggcccccgcccggctccacgcggtcaccgtgccgctcgacccgcacaagaccgtcgcgtccgtgaccctgccgaagaccggcagctccgccgcaccaggcgcccccgcgctgcacgtcttcgacctcgccgtacgcagcacacccgccgctccgggcggaaagttctgggccggcagctggggtgcctccttcggctccgcccagccggttgcccagccgggctgggcccagcagaccctgcgcatggtcgtgaacccccacaccagcggtggcaccgcccgtatccggttcgccaacaccttctccccgcagccgatccggctcgggcacgtgacggtcgcagcccaggcggcggccgggggagcggccgcgacccaggtacccgtctccctgaccttcggcggcgcagcggagaccacccttccggccggcggggagatctacagcgatcccgtcgccttccccgtcaccgccggaaagaacctcctggtcagcatctacctccccgaccaggtcacgacggcgcccacgcacgactacgccctgacgacctccttcatcagcaaccgccaggcgggagatcacacggccgacactgccgcgacggcatttcccggcactctctcccactggacgctggtcaacggcatcgacgtcgccgcagccgagaacatcggaaccgtcgtcaccctgggcgactcccagacggacggagcccactccaccccggaccgcaaccagcgttggcccgaccactacgccgcggcgctcaacgccgcctcccggcccaccggcgtcgtcaatgcgggcatcagcgcgaaccggctgctgaccgaccgcgccgacaccgccggacccagcgccctgagcagactggaccgggacgtcttcgcccagagcaacgtccgtacggtcgttgtctacgagggcatcaacgacctcgcccacgacaacgcctccgcccagtcggtgacggacgcgatccgccgcatctgcgcacgggcgaaggcacgcgacatccgcgtcatcgtcgccaccctccccgcattcggcggctattccgcctacagcgacgccaaggagaccgcacgccagcaggtcaacgccgccatcaggacgatgacggaggccgacgcccccaccgacttcgacctcgccacccgtgaccccgacatgccgtcccagctcctgccgagcatgctgaagccgggcggcgaccacctccacttcggcgacgccggcaccaaggtcctcgccgacaccctggtccgggcagctgacgcgcccagcctcgccatgtcccagaccacggccgctgacttcaacggcgacgggatccaggacctcgtcgcgcgccaggactcgacgggcaccctcaagatgtggctcggacggggcaacggcacctttgcctcctccaccgacgtgaccgccggctggcgcccctactcccagaccacggccgccgacttcaccagtgacggcaaggccgacctcatcgcccgcgaatcctcgggcaccctgaaactctggaagggccacggcgacggcaccttcggctcggcgatcacggtgacgggcggctgggagttcacccagacgactgccgcggacttcgacggcgacggcaaggccgacctgatcgcccgcgactcctcggcgaacctgaagatctgggccggccgcggcgacggcaccttcggcgccggcgccgccctgagcagcggctgggacttcacgcagaccacggcggccgacttcaacggcgaccaccaggcggacatcatcgcccgtgacgcctccgggaacctcaagatgtggacgcacaacgccgccggctacttcaacgcccccttcaccgtcaccggcggctggagccccttctcccagaccacggcagccgacttcaccggcgacggcaaggccgacctcatcgcccgcgacgacaacaccggcgacctgcgcagctgggcaggccacaacgacgccaccttcgcaagccccaccaccctcaccggcggctggtga

SEQ ID NO: 1985 - DNA, 1944 bp, Streptomyces sp.
atgcccttcccgagacgtgccttccgccggatgcggaccacggccctgccgctggtcctctccctggccgcaggcggactgatcatgacgaccgccaccaccgcacgcgccgcgacgtacggcaccgtgcgcgaggcgttcaacaacacggcgatcagcccggacggcgaacccgcagcagccgacttcgacgccgcgggacgcagcctgtcggccaccgacctcgacaaggcgggctggcgccgcggtacccaggtcacgatcggcgcaacgacctacacacgggccgatgtcgcccccggccaacccgacaacgtgctggccacgggccagaccctcgcgatacggggcgccggcaacgcacttggcttcctggcatcggcgacatccggccccgtcaccgcgcccgtcaccgtgagctacaccgacggcacttcggcgcagcagaccctggaggtccccgactggagcgcgggcgcgacgaccacggccgccctcagcctggaccaccgcaacaccccgtccggacagcagacgtcccccgcccggctccacgcggtcaccgtgccgctcgacccgcgcaagaccgtcgcgtccgtgactctgccgaagaccggcagctccgccgcaccaggcgcccccgcactgcacgtcttcgacctctccgtacgcagcacaccctccgctccgggcggaaagttctgggccggcagctggggtgcctccttcggttccgcccagccggtggcccagccgggctgggcccagcagaccctgcgcatggtcgtgaacccccacaccagcggtggcaccgcccgtatccggttcgccaacaccttctcgccgcatccgatccggctcggtcacgcgacggtcgcagcccaggccgcggccgggggcgcggccgcggcccaggcacccctctccctgaccttcggcggcgcagcggagactacacttccggccggcggggagatctacagcgatcccgtcgccttccccgtcaccgccggaaggaacctcctggtcagcatctaccttcccgaccaggtcacgacggtgcccacgcacgactacgccctgacgacctccttcatcagcaaccgccaggcgggagaccacacggccgacaccgccgcgacggcattccccggcactctctcccactggacgctggtcaacggcatcgacgttgccacaaccgagaacatcggaacggtcgtcaccctgggcgattcccagacggacggagcccactccaccccggaccgcaaccagcgctggcccgaccactacgctgcggcgctcaacgacacctcccggcccgccggcgtcgtcaatgcgggcatcagcgcgaaccggctgctgaccgaccgcgccgacaccgccggacccagcgccctgagcaggctggaccgggacgtcttcgcccagagcaacgttcgtacggtcgtcgtctacgagggcatcaacgacctcctccacgacaacgcctccgcgcaggcggtgacggacgcgatccgccgcatctgcgcacgggcgaaggcacgcggcatccgcgtcgtcgtcgccactctccccgcattcggcggctattccgcctacagcgacgccaaggagaccgcacgccagcaggtcaacgccgccatcaggacgatgacggaggccgacgcccccaccgacttcgacctcgccacccgtgaccccgacatgccgtcccagctcctgccgagcatgctgaagccgggcggcggtgaccacctccacttcggcgacgccggcaccaaggtcctcgccgacaccctggtccgggcagccgacgggcccagcgtcaccatgtcccagaccgcggccgcggacttcaacggcgacggagcccaggacctcgtcgcgcgccaggactcgacaggcatcctcaagatgtggctcggacggggcaacggc

SEQ ID NO: 1986 - DNA, 1083 bp, Streptomyces sp.
ttgaagcaccgacgcatacccagccaccgcatcgcgatcgccggagccggcgtcgcggccctcgtcgccggcgcgttcacgctgaacagcgccaacgcgaccaccgcggacccggccccggcccccgccaccctgtcggtcgcctcggccgacaagctcgccggcaccctcctctccgacctcggggacgaggccgccggttcgtactacgacgcgaaggagcggaagctcgtcgtcaacgtcgtggacgagggcgccgccgagggcgtccgcgagcggggcgccgtggcgagagtcgtggagcactccctcgccgagctgaagtcggcccgcgccaccctgaaggccgaggccaccatcccgggcacctcctggtcggtcgacccggtgaccaacaaggtcgtcgtcacggccgacagcacggtcaagggcgcgaagctggagaagctcaacaaggtcgtcgacgggctggacggccgggcggccgtcgagcgggtcgccggcgagttcaagcccttcgccgcgggcggcgacgccatccacagcgggggcggacgctgttcgctcggcttcaacgtggtcaagggcggcgagccgtacttcatcaccgccggccactgcggtgagcagggcagcagctggtccgactccgccggcggcgccgcgatcggcaccatggaggagtccagcttcccgggcaacgactacgccctggtgaagtacgcctccggcgccgaccaccccagcgcggtgaacctctacaacggcagcacccaggagatcacccgggccggcgacgcgaccgtgggccagcaggtccagcgcagcggcagcaccacccaggtgcacgacggcgaggtcaccggcctcaacgagaccgtcaactaccaggaggggtcggtctcgggtctgatcaagaccaccgtctgcgccgagcccggtgacagcggcggctcgctcttcgcgggcagcacggcgctcggtctgacctcgggcggcagcggtgactgctcctccggtggcacgaccttcttccagccggtccccgaggcgctctccgcgttcggagcctcgatcggctga

SEQ ID NO: 1987 - DNA, 1077 bp, Streptomyces sp.
ttgaagcaccgacgcatacccagccaccgcatcgcgatcgccggagccggcgtcacggccctcgtcgccggcgcgttcacgctgaacagcgccaacgcgaccaccgcggaaccggcccctaccacgctgtcggccgcctcggccgacaagctcgccggcaccctcctctccgacctcggggacgaggccgccggttcgtactacgacgcgaaggagcggaagctcgtcgtcaacgtcgtggacgagggcgccgccgaggacgtccgcgagcggggcgccgtggcgagagtcgtgaagcacaccctcgccgaactgaagtcggcccgcgccaccctgaaggccgaggccaccatcccgggcacctcctggtcggtcgacccgaagaccaacaaggtcgtcgtcacggccgacagcacggtcaagggcgcgaagctggagaagctcaacaaggtcgtcgacgggctggacggccgggcggccgtcgagcgggtcgccggcgagttcaagcccttcgccgcgggcggcgacgccatccacagcggtggcgggcgctgctcgctcggcttcaacgtggtcaagggcggcgagccgtacttcatcaccgccggccactgcggcagtgcgggcagcacctggtccgcctcctccggcggttcggcgatcggcaccatggaggagtccagcttcccgggcaacgactacgccctggtgaagtacgcctcaggcgtcgaccacccgagcgtggtgaacctctacaacggcagcacccagcagatcacccaggccggcaacgcgaccgtgggccagcaggtgcagcgcagcggcagcaccacccaggtgcacggcggcgaggtcaccggcctcaacgagaccgtcaactaccaggagggttcggtctcgggtctgatcaagaccaccgtctgtgccgagcccggtgacagcggcggctcgctcttcgcgggcagcacggcgctcggtctgacctccggcggcagcggcaactgctcctccggcggcacgaccttcttccagccggtccccgaggcgctctccgcgttcggagcctcgatcggctga

SEQ ID NO: 1988 - DNA, 1077 bp, Streptomyces sp.
ttgaagcaccgccgcatacccaagcgtcgtgtcgtcatcgccggagccggcatagcggctctggtcgccacgggcatcacgcttcagagcgccaacgccgcccccggtgagccccagcccgacaccctctcggtcggcgccgccggaaagctcgccaacaccctcacctcctcgctcaagagcgacacggcgggttcgtactacgacgccaaggccaagaagctcgtcgtcaacgtggtcaacaagggcgtcgtggacaaggtccgggaggccggggccgaggccaaggtggtcaccaacaccctggccgagctgagcaaggcgcgcgagacgctgaagcagaaggccaccatccccggcacctcgtggtcggtggaccccagaagcaacaaggtcgtcgtcaccgcggacagctccgtcaagggcacccggatggccaccctcaacaaggtcgccgacgcgctcggcgacaaggtcgaggtgaagcgctcggccgggaagttctccaccttcatcgccggtggcgacgccatctggggcgacggtgggcgctgctcgctcgggttcaacgtcgtcaagggcggccagccgtacttcctgaccgccggtcactgcaccgaggccatcagcagctggtcggactcgcagggcggcggggagatcgggaccaacgagggcagcgagttccccggcaacgactacggcctggtcaagtacaccaaggacaccgaccacccgagcgcggtcgacctctacaacggcagctcccaggagatcaccaaggccggtgacgccaccgtcggccagaaggtgcagcgcagcggctccaccacccaggtgcacgacggcgaggtcaccggcctcaacgcgaccgtcaactaccaggaagggtcggtcgaagggctgatccagaccaacgtctgcgccgagcccggcgacagcggcggcgcgctcttcgcgggcgacacggcgctgggtctcacctccggcggcagcggtgactgctcctcgggcggcgagaccttcttccagccggtgccggaggcgctccaggcgttcggcgccgagatcggctga

SEQ ID NO: 1989 - DNA, 1086 bp, Streptomyces sp.
ttgaagcatcgacgcatatccaggaagcgcgcgacggttgccggatcggccgtggccgccctggtcgtagcgggtttcacgttccagagtgcgaacgccagtgacgaagtcccccagttcacggtcaagacgctcaacgcggatgcggccggaaagctcgccaccacgctcgaccgggacctgggcgcggacgcggccggctcgtactacgacacgaaggcgaaggccctcgtcgtgaacgtcgtcgacgaggccgccgccgagcaggtccgccaggcgggcggcaaggccagagtcgtggagcactccctcgccgagctgaagtcggcccggcagaccctcaccgacaaggcgaccatcccgggcacctcctgggccgtcgacccggtgagcaacaaggtcctcgtcaccgccgacagcacggtcgacggcgcggcctggaagaagctctcggccgtggtcgagggtctcggcggcagggccgaactgaacaagtcggcgggcgagttcaagccgctgatcgcgggcggcgacgcgatcttcggatccggctcccgctgctcgctcggcttcaacgtggtcaaggacggcgagccgtacttcctgaccgccggccactgcaccgagggggtcaccagctggtcggacacccagggcggcgcggagatcggggcgaacgagggctccagcttcccggagaacgactacggcctggtcaagtacacctcggacaccgagcacccgagcgaggtcaacctctacaacggctccacccaggcgatcacccaggcgggcgacgcgacggtcggccagcaggtcacccgcagcggctccaccacccaggtgcacgacggcgaggtcaccgcgctggacgccacggtcaactacggcaacggcgacatcgtcaacggcctcatccagacgacggtctgcgccgaaccgggcgacagcggcggcgccctcttcgcgggcgacaccgcgctcggcctgacctcgggcggcagcggcgactgctcctcgggcggcacgacgttcttccagccggtccctgaggcgctcgccgcctacggcgccgagatcggctga

SEQ ID NO: 1990 - DNA, 1206 bp, Streptomyces sp.
ctgggaatactcggcggcgcaatttggcatggacgcgctcccgcacgggcaggcgcgccccgtgccgtacgccctccgggccgggcaccccactgccaacggcccaaccccccactggaggaccgagagttgaagcaccgccgcatacccaagcgccgtgccgcccttgccggggccggagtcatggctctggccgccgccgccctcaccttgcagaacgccaacgccgcccccaccgagccgcaagcccagacgctctcggtgaactccgcgggcaagctcgcgaacaccctgacctctgcgctcaagagtgatgccgtcggttcgtactacgacgccaaggccaagaagctcgtggtcaacgtggtgaacaaggccgccgccgagcgggtccgcgacgcgggcgccgaggccaaggtggtcgagcacacgctggcccagctgaagcaggcgcgcaccaccctgaaggacaaggcgaccattcccggcacctcgtggtcggtcgaccccagagccaacaaggtcgtcgtcaccgcggacagcagtgtcaagggcgcccggatggccacgctcaacaaggtcgcggagagcctgggcgacaaggtcgaggtgaagcgctcggccggtaagttctccaccttcctggcgggcggcgacgccatctggggcggtggcgggcgttgctcgctggggttcaacgtggtcaaggacggcgagccgtacttcctgaccgccggtcactgcaccgagtccatcaagagctggtccgactcgcagggcggtgacgagatcggggccaacgagggcagcgacttccccggcaacgactacggcctggtcaagtacaccaaggacgtcgcgcacccgagcgaggtgaacctctacaacggcgacagccaggccatctccaaggccggtgaggccaccgtcggccagaaggtgaagcgcagtggctccaccacccaggtgcacgacggcgaggtcaccggcctggacgccaccgtcaactaccaggagggctcggtcagcgggctcatccagaccaacgtctgcgccgagcccggcgacagcggcggcgcgctcttcgcgggcgacacggcgctcggtctgacctccggcggcagcggtgactgctcctcgggcggcgagacgttcttccagccggtgccggaggcgctggaggcgtacggcgccaagatcggctga

SEQ ID NO: 1991 - DNA, 1086 bp, Streptomyces sp.
ttgaagcatcgacgcatatccaggaagcgcgcgacgctggccggctcggccgtcgtcgccctggtcgcagcgggattcacgttccagtctgcgaacgccagtgacgatgtgccgcagttcgcggccaagactctcagcgcggacgcggccggaaagctcgccgacagcctggaccgtgatctgggtgcggacgcggcgggctcgtactacgacacgacggcgaaggctctcgtcgtgaacgtcgtcgacgaggccggcgccgagcaggtccgccaggcgggcgccaaggccagaatcgtgcagaactccctcgccgagctgaagtcggcccggcagaccctcaccgacaaggcgacgatcccgggcacctcctgggccgtcgacccggtgaccaacaaggtgaaggtcaccgccgacagcacggtcgacggcgcggcctggaagaagctctcggccgtggtcgatggcctcggcggcaaggccgaactcacgaagaccaagggtgagttcaagccgctgatcgcgggcggcgacgcgatctggggctccggctcccgctgctcgctcggcttcaacgtggtcaaggacggcgaaccgtacttcctgaccgccgggcactgcaccgagtccgtcagcagctggtcggacagccagggcggcgcggagatcggggcgaacgagggctccagcttcccggagaacgactacggcctggtcaagtacacctcggacaccgagcacccgagcgaggtgaacctctacgacggctccacccaggcgatcacccaggccggtgacgcgacggtcggccaggcggtcacccgcagcggttccaccacccaggtgcacgacggcgaggtcaccgggctggacgccacggtcaactacggcaacggcgacatcgtcaacggcctcatcgagacgacggtctgcgccgagccgggcgacagcggcggcgccctcttcgcgggcgacaccgcactcggtctgacctcgggcggcagcggcgactgctcctcgggaggtacgaccttcttccagccggtcccggaggcgctggccgcctacggcgccgagatcggctga

SEQ ID NO: 1992 - DNA, 1086 bp, Streptomyces sp.
ttgaagcaccgacgcatatccaggaagcgcacgatggtcgccgggtcggccgtcgccgccctggtcgcagcgggactcacgttccagactgcgaacgccagtgacgacgtaccccggtccgaggccaggatgctcagcgcggacgcggccggaaagctcgccgccaccctcgacgaggagctgggcgcggacgcggccgggacgtactacgacaccggcgcgaaggccctcgtcgtcaacgtcgtggacgaggccgccgccgagcaggtccgccaggcgggcggcaaggccagaatcgtggagaactccctcgccgagctgaagtcggcccggcagaccctcaccgacagggcgaccatccccggcacctcctgggcggtcgacccggtgaccaacaaggtgcgcgtcaccgccgacagcacggtcgacggcgcggcctggaagaagctctcggcggtcgtcgacggcctcggcggcaaggccgaactcgccaggtccaagggtgagttcaagccgctgatcgcgggcggcgacgcgatctggggctccggctcccgctgctcgctcggcttcaacgtggtcaaggacggcgagccgtacttcctcaccgccggccactgcacggagtcggtcaccagctggtcggacacccagggcggctcggagatcggggcgaacgagggctccagcttcccggagaacgactacggcctcgtcaagtacacctcggacaccgcgcacccgagcgaggtgaacctgtacaacggctccacgcaggcgatctcccgggcgggcgacgcgacggtcggccaggcggtcacccgcagcggctccaccacccaggtgcacgacggcgaggtcaccgggctcgacgccacggtcaactacggcaacggcgacatcgtcaacggcctgatcgagacgacggtctgcgccgagccgggcgacagcggcggcgccctcttcgcgggcgacaccgcgctcggtctgacctcgggcggcagcggcgactgctcctcgggcggcacgaccttcttccagccggtaccggaggcgctggccgcctacggggccgagatcggctga

SEQ ID NO: 1993 - DNA, 1086 bp, Streptomyces sp.
ttgaagcaccgacgcatatccaggaagcgcacgatggtcgccgggtcggccgtcgccgccttggtcgcagcgggactcacgttccagactgcgaacgccagtgacgacgtaccccggtccgaggccaggacgctcagcgcggacgcggccggaaagctcgccgccaccctcgacgaggagttgggcgcggacgcggccgggacgtactacgacaccggcgcgaaggccctcgtcgtcaacgtcgtggacgaggccgccgccgagcaggtccgccaggcgggcggcgaggccagaatcgtggagaactccctcgccgagctgaagtcggcccggcagaccctcaccgacagggcgaccatccccggcacctcctgggcggtcgacccggtgaccaacaaggtgcgcgtcaccgccgacagcacggtcgacggcgcggcctggaagaagctctcggcggtcgtcgacggcctcggtggcaaggccgaactcgccaggtccaagggtgagttcaagccgctgatcgcgggcggcgacgcgatctggggctccggctcccgctgctcgctcggcttcaacgtggtcaaggacggcgagccgtacttcctcaccgccggccactgcacggagtcggtcaccagttggtcggacacccagggcggctcggagatcggggcgaacgagggctccagcttcccggagaacgactacggcctcgtcaagtacacctcggacaccgcgcacccgagcgaggtgaacctgtacaacggctccacgcaggcgatctcccgggcgggcgacgcgacggtcggccaggcggtcacccgcagcggctccaccacccaggtgcacgacggcgaggtcaccgggctcgacgccacggtcaactacggcaacggcgacatcgtcaacggcctgatcgagacgacggtctgcgccgagccgggcgacagcggcggcgccctcttcgcgggcgacaccgcgctcggtctgacctcgggcggcagcggcgactgctcctcgggcggcacgaccttcttccagccggtaccggaggcgctggccgcctacggggccgagatcggctga

SEQ ID NO: 1994 - DNA, 1179 bp, Streptomyces sp.
atggacgcgcccctgagtggggagaagcgccatgtcgctacgccctccgggccctggcaccccactgccgtcgggcccaaccccccactggaaggcagagacttgaagcaccgccgcatacccaagcgtcgtgtcgccatagccggagccggcatcgcggccctggtcgccacgggcatcaccctgcagagcgccaacgccgccccgggtgagacccagcccgacaccctctcggtcggcgccgccggaaagctggccagcaccctcacctcctcgctcaagagcgacacggcgggtgcgtactacgacgccaaggccaagaagctcgtcgtcaatgtggtcaacaagggcgtcgtggacaaggtccgggacgccggggccgaggtcaaggtcgtcaagcacaccctggccgagctgagcaaggcgcgtcagacgctcaaggagaaggccaccatccccggcacctcgtggtcggtggaccccagaagcaacaaggtcgtcgtcaccgcggacagctccgtcaagggcgccgggatggccaccctcgacaaggtcgccggcgcgctcggcgacaaggtcgaggtgaagcactcggccggtaagttctccaccttcatcgccggtggcgacgccatctggggcaacggcgggcgctgctcgctgggcttcaacgtggtcaagggcggccagccgtacttcctgaccgccggtcactgcaccgaggccatcagcagttggtcggactcgcagggcggcgaggagatcggcaccaacgagggcagcgacttccccggtaacgactacgggctggtcaagtacaccaaggacaccgaccacccgagcgcggtcgacctctacaacggcagcacccaggccatctccaaggccggtgacgccacggtcggccagaaggtgacgcgcagcggctccaccacccaggtgcacgacggcgaggtcaccggcctcaatgcgaccgtcaactaccaggaaggctcggtcgaagggctgatccagaccaacgtctgcgccgagcccggcgacagcggcggcgcgctcttcgcgggcgacacggcgctgggtctgacctccggcggcagcggtgactgctcctcgggcggcgagaccttcttccagccggtgccggaggcgctgcaggcgttcggcgcccagatcggctga

SEQ ID NO: 1995 - DNA, 1314 bp, Streptomyces sp.
ctgcccagaacctggagacgccagatgttcccgacgtccaagaagctccgcaccaccgtcgccggactcgccctgacggccgcctcgatgggcctcgtcaccgccaccggcgcgcagcccgccgtcgccgccgaggtctgcaccggcaccgcctccgtgtacgggatcctcggcgacgggcggctgacctactccgccatcaacaccaagggcgaccggctcaagacgctgatcggcccggacctgggcttcacgcccaaggcgatggccacgctgaacttcaacacgatcctggtgacctccaccgcgggcgccctctaccgcgtggatgttctgaccaacaacaacgccctggaactctccggcgtcgagaagatcgccgacagcggctggacccacgacaagctcgcctacgacggctacggccacctctacggcaccaccgccgccggaaacctgctccagtacctcgtctcccaggacaagccgcagggctcccagcacatcggccagcgcaaggagatcgggaccggcttcgtcctcaagaccctcaccgcgaccggcaaggaccggctgctggccaccgccgccgacggccgtctcctctcgtacaagatcatcggctccgcctggaagcgggacgacctgaagaacgacggctggtccgccttcgacgagctgacctcctccggcggcggcttctacttcggccggattccgaccacgggcgccatgtactggtacaaggacggcaatatctccgacggcagcggcagcgacatcgtctaccacaccaacgacccggtcgacacgtccggctggacccagaagctgctctccgccgcgcccgacaccacctcctgcaagcaggtcaacaccctcggccaggacatagccgccgacgccaaccgcgaggtcggcaacaacttcaacgacttcgacttcaaccacgcccgtgcctggtgcgccgagttcgtcgagtacatctgggcgggcaacagcgtcgaccactcccgtgagctggacgcccgagccatcagcctcaaggagtacggccagaggcacggcacctaccggaccagcggccccaaggtcggcgacgcggtgctctacgacgtcgaccgcaacctgaacgacggcgaggccgaccacgtcaacatcgtcgtcgcggtctcggcggacgggacgcagatccagaccgtcggcggcaacgagagcggcaaggtctccaaggccggctggttcaactgggacaccgcctccagcccggtcggcgccggacccgtcctcgcgttcgtctcccccaagggctga

SEQ ID NO: 1996 - DNA, 1296 bp, Streptomyces sp.
atgttccgcaccagcagaaccctgcgcaccgccgtcaccgccgtcgccgccggcgccttctccctcggcctcgtcaccgcgaacaccggcacggccgcggccgcggaaacggtgtgctcgggcacggcctcggtctacggcattcttccggacggccgcctgacctactccgcgatcaacccgaccaacggcgaccgcatcaagaccctgaccggcgccgacctcggcttcaccccccaggcgatggccaccctcaacttcaacaccatcctggtcacctccaccaccggcgccctctaccgcgtcgacgtccagaccaacaacaccgccctcaccctggccaacgcccccgtccgcatcgccgacagcggctggacccacgacaagctcacctacgacggctacggccacctctacggcaccacctcctcgggcctgctcctgcagtacaccgtcaccgaagacaagcccgccggatcccagcacatcggcatgcgcaaggaaatcgacagcggcttcgtcctcaagacgctgagcgccgtgggtcaggaccggctgatcgccaccaccgtcgacggcaagctgctctcctaccagatcgtcggcgacgcctggcgccgcagcgatttgaagaccgacggctggtccgccttcgaccagctcgtatcgcccggtgccggcttctactacggccgcatcccgaccaccggcgccatgtactggtacaaggacgggaacatctcggacggcagcggcgcggacatcgcctaccacacctccgacccggtcgacgcctccggctggacgcagcagctgctgtccgcggcgccccgcaccgtgagctgcaagagcgtgagcaccctcggccaggacatcgccaatgccgcgaacgcggaggtcggcaagaccttcaccagctacccgttcacgtacgactacgcctggtgcgccgagttcgtgaagtacatctgggccggggaggacgtcgactacgcctcgcagctcgacgcccgcgcctggagcctctacgagtacggcaccaaccacggcacctggaagaccggctcccccaaggtcggcgacgcggtgctgtacgacaaggacggcacgctgggagacagcgaggccgaccacgtcaacatcgtggtcggcgtctcctcggacggcacccagatccagacggtcggcggcaacgaaagccacaaggtcagcaagagcggctggttcacctggaggaccgcctccaacccggtcggcgcgggccgtgtgatgggcttcgcctccccgatcggctga

SEQ ID NO: 1997 - DNA, 978 bp, Streptomyces sp.
atgtccgtacagaagcccgccagtagcgcgaacgcgacccaggccgctgcctccccggacaccgcgcagtcgaccaccgctccggccggcccggacaccccggccgcgcaggacgagcgcaccgcggccacctcggaggcctcgtccgctcccggcacccccgccgaggcggccacgacagccgcggggacgggcgggtcacaggcgagggagtcggccgagtcgacggcggacgaggagcgcacggccgtcgcggcggccgccgtgccggcggtcccggccaggaccgcgagcggcgtcgacagcgggcgtccacgcaaacccatcctcgccgtggccgggattgtcggagccgccctgatatccgtaccgctgctgctggcgggtggcgcggacgacgacaagcggccggagagcaccaaggggttggccgcgggagagccggacaccgtgctggcccccggctcggccggcgccgcccttgacgactacgtcgtggagaagcccaccccgacgccgaccgaggagaagccggagccgagcgcgccggtcaaggccgtcgctccaccgccggcaccgaagcccgagcccgcgacgagcgcaccggcgaagaaggccatgccgaagccgaaggccaagccgacccccaagcccgcctggacggcctcgacagtccgcgccgtcagcactctggaggtcaaccaggcctggaccaccaaccgcatccgcatggtgatgcagcccgacggcaacctcgtcgtctacaacgagaagaacaagcccacctgggcgtcgatgaccttcggcgagaaccaccgggccatcttccagtccgacggcaacctcgtcatccacaacggcgacgaccgaccgatctgggcctccgacacctggggcaacgaaggagccgagctgatcctgcgcgaggacggcaaggtggtcatcgcccactccggcaaggtcctctggtcgacctga

SEQ ID NO: 1998 - DNA, 990 bp, Streptomyces sp.
atgtcctcgcagaagcccgcctccggcacgaacacgacgccggcctccggctcttccccggacaccccaccgtcgaccaccgccgcacccccggcggcggaggagcacaccgcgcccgccgcggaccccgcacccgcacccgcctccccggcggcagcggccgaggcaggtgaagcagccgaagcgggcgaggagtcgaccgcgacggcagccgccaccgccgaggcgaaggagccggagtcggccggaaggcgcacggccgtcgcggcggccgtcgcggcaccgcccccggccaagaccgccaccggcgtcgacaacgggcgcccccgcaagcccgttctggccgtggccgggatcctcggcgccgtcctgatagccgtaccgctgctgctggcgggcggcgcggaggacgagaagcggccggacagcgccaagttggccgccgaggacgcggacacggtgctggacccgggctcggcgggcgccgccctggacgactacgtggccgagaagcccagcgcgacgccgaaggagaagccggagccgagcgcgccggtgaaggcggtcgccccgcccccggcaccggaacccgcgacgagcgcaccggagaagaaggccgcgccgaagcccgagccgaagccgaaggccaagccgtccccgacgccggactggacgacctcgacggtccgcgccgtcagcaccctggaggtcaaccaggcctggaccaccaaccgcatccgcatggtgatgcagcccgacggcaacctggtcgtctacaacgagaagggcaaggcgacctgggcgtcgatgaccttcggcgagaaccaccgggcgatcttccagtccgacggcaacctggtcatccacaacggcgaggaccgccccatctgggcctcccagacctggggcaaggagggcgccgaactggtgctgcggaaggacggcaaggtggtcatctcccacaacggcaacgtcgtctggtccacctga

SEQ ID NO: 1999 - DNA, 672 bp, Bacillus sp.
atggtaacttcttacatggattacacgaagcctgacgtggaatatttctcggatttaaatacgaatcgattatttacaaggaattccgagaattatattaaccggttaggaagagatgtattaaatacattaagtaatgtatcgatacttgatatctatttaagcaagggtcatgttgttgagccacattatcatcaaaacgcagcagaattggtgtattgtattagtggttcagctgtcgtttcctttatgaaccctttcaataacgaagttaaaaatataccaatcacaccaggccaagttgcaaatatacctcagggatggtggcattgggaagaagcgtcagagaacaacacacatttactagccatttttgacgcgccatatcctgaatatatcttagggtcagatatcttgacaaaaactcctgtagacgttatagctcatacgtattgcttagatccagaagcatggaaagaggccgttgcaccgataaaaaacgaaaccattattattggaccaacggatgaatgtagtcgcaaatcaaaaaataacaaccaaggttatacttcagttcattatccaaacatgccgctaccacacccttataatccgatgcaatatgtatacagccatccccaccctggctattatcctggctacaattgttaa

SEQ ID NO: 2000 - DNA, 2469 bp, Xanthomonas Sp.
atgagcgactacgccgcctcactctctatggtagagaaagcagaatctctggaccaaatatcgcaaatcgcgaggtcgttttcggcaaaatctagtggtcagggtggaattctatatagccgtcgagttggggatgtgtcgtctgaagtcatggcagttgaactctccggtaagacgggacttcccatcatcaacgacaccccgcgcgccaagtttcttatggaagctcggaccgttatcgaggagaaggcgaccgatattttcagggcacaaggattgccggcgaagatggctagggagtccgccgcgtcgttcctgttcggcgacccgcaggctccaagccagaatcccacatccttgtcgaaatgcctctggcgcgaagcctccaacgaattcgcaagctcgctacgcggcgatatcaaagtggttgcttctgctgccaacctagagcgcgtcttcggacaggtcgaagtacctgccgtgctgaacaacccaaacgtcacttcgctgggtggacaaccgattcccaagttgcaggcgctatacgcacagggtggcgcgggcgctgtgctgccggaagtgcagacacactttatccaggctgcgcccaaaggcatctttgttacgcccgagagcatcggcacagagatcaagaatctaacgttctcgcgtgagttcgcagaaagccttgagttaaagcaaacgcacttcaaaccctccgcagaactcactgcgtcgggcatggtccgcgcaccgaccgggctcgatgtgccggccgcaagtatcgcggaaacggcgctcagcgctgaggcggcggcatcacgcaggctcgcgtcaggcgcggtccgtgggctgggtgtcgtgggtgcggcggcggcggtgtacgacctgggcgctacggcaagaaatactgcgcgactggatgcgcaaggcaacagcaccgccgccgatgcagaagtcactcgctacgccacgcgcaatctgggcactgttggcggagctgtgctcggcacaagcatgggcgcggcgctgggcgtggagtctgggccgggcttgttagtcaccggggcgattggcggcgtggtgggtgccgtgggcggcgacaagctcgccgatgccatcaatgaccaccggatttcccatcaacaagacgcgcaaggcaatacgtggcgcctggaaaatcatccgtccggggcgcgctgggcacgtgaggtcagcaccggcgaagtcgatccagccgccatcgccttcggcgaagccggcgtgccgctgcaaaagacgcgaacagaagttgcgaccccggaagtgtcagacctgttgacgtacaaagcatcaggtacgtccatcgaactggcgttgggctcgccaccacagaacaaggacccctatacccaaccggccaacgcgcacgacacccgaagcctgcgcgaggcaccgtgggtgcacaacccagacacacaacagtggacgcgccaggtggccgacgggctgatcgatcgcaccatgagcgcgcacaccgaaacggcgagccctcaacgtgcggcgcaactcgatgaggcatcgcagcagatcatcaggcagaacgcgatgcagacgccagcagcgatggcggcgcactacaagcagacctacgagcagaatggctgggaacgtcacggctacatgcccgccgcagtccacgacgcgttgaagcatcccggccggatcgtcggctcagacggcgacctttacgagcgtggcaacgatggtcagtggacgcatgacggcatgctctgggacagcaacgcgaagggaaatttgaagcaggagcttgatgcaacctatgcggcccagaccttggggacacagcgcacagctgcacagtctgggctcccggctgctgccgtaccgatcacgacgctggacaccatgcatgtcactgcgccacggatgcaaggccaagacagcgcagacgcactttcgaaaaaggctcaggacggcatagagacacggggcgatagcgcacctgctcggccgcaagcgtcgggtccgcaagatccgcagcatcccgatcatgcgatgttgaatcagatccgcgaaggcgtggccaagatcgatgagagcgtgggcaaaccctatgacgccatgagcgagcgcgtcagccgctgcctgctggcggcgtgcaaggacaatcgtgagcgctatccagacgccggcggtacatcgctcgccgcaaatgcgctgcaacgcgtggatcacgtgctgatgggcaacaacggcaaccttgtcgcgatcgaaggacgcatcgacgatccaacgcataagcgcgcagccgtttctatcgaccaggcgattcatatgccccttgaacagtcggacgcaaagctacaggccgccaaccaggccattgcacaggaacgcacgcaggcacagcagcaagagctggcacgcggaatgcacgaatcgcatcaggctgtgccgacaagatag

SEQ ID NO: 2001 - DNA, 2256 bp, Xanthomonas Sp.
atggaagcccggaccgccgtcgaggagaaggcctccgagattttcaggtcgcagggcttgccaccgaagatggccagggagtctgctgcatcgttcttgttcggcgacccagcggttccatcgcagagccccacgtccctctcgaaatgtctatggggtgaagcttcgcacgaattcgcaagctcgctgcgtggcgatatcaaagttgttgcttcggctgccaacctcgagcgtgtcttcggccaggtcgaggtccctgctgtactgagtaaccccaaggtcacttcgctaggcggagaacccattccgaagttgcagacgctatacgcgcaaggtggggcaggcgctgtactgccagaagtgcaaacacacttcatccaggctgccccaaagggcatcttcgtagcaccagagagtatcggctcaaagattgacaaggtcacgttttcgcgtgagttcgctggaagtttagagcttcagcaaacgcacttccggacctccgcagaactcaccgcgtcgggcatggtgcgtgcgccgaccgggcttgatgtgccagccgcaagcatcgcggagacagcgctcagtgctgaagcagcggcttcacgcaaactagcgtcaggcgcggtccgtgggctgggtgtcgtgggtgcagcggcggcggtgtacgacctgggcactacggcaagaaataccgcgcggctggatgcgcagggcaatagcactgctgcagatgcagaggtcacccgctacgccacacggagtgtgggcgctgttggcggggcggtgctaggcggaagcatgggcgccgtcttgggtgtggagtctggcccgggcttgcttgtcactggcgcgattggcggcattgttggtgccgtgggcggcgacaagcttgccaatgccatcaatgaccaccgtatttcccatcaacaagatgcgcaaggcaacacatggcgcctcgaaaatccttcgtccggcgcgcgatgggcgcgggatgtcagcactggcgaagtcgatccggctgccgtggccttcggcgaggccggtgtgccgttccaacggacgcgcacagaagtggcgctgccggaagtctcggacctattgacgttcaaagcatcaaatacgtccatcgaactggccttgggctcgccgccgcagaacaaagatccctataccctaccagccaacgcgcacgatacccggagcatgcgcgacgcaccatgggtgcaccacccagacacacaccagtggacgcgccaggtagccgacgggctggtcgatcggacaatgagcacacacactgagacggcgagccctcagcgtgcagcgcaacttgatgaggcttcgcagcaaatcatcaagcagaacgcgatgcagacgccagcagcaatggccgcacactacaaagaggcttacgaccagaacggctgggagcgtcacggctacatgcccgccgcagtccatgacgcgctgaagcatccgggccggatcgttggctcagacggtgacctctacgaacgcggcaaagatggtcaatggacccatgacggtatgctgtgggacagcgacgccaagggaaatttaaagcaagagcttgatggaacctacgcagcccagaccctaggcacacagcgtacagctgcacagccggcggcccaggccgctgccgaaccgatcaaaacgctagagacggtccatgtcacagcgccgcgggcgcaaagccacgataacgcggacacctcttcaaagaaaactcaggaagacacaggtgtacgcgaccttagtgggaccgcacgaccgcaagcgtcaggcccgcaagatacggatcatcccgatcacgcgatgttgaagcagatccgcgaaggcgtcgccaagatcgatgagagcgtgggcaagccgtatgacgaaatgagcgagcgcgtcagccgctgcttgctggcggcatgcaaggacaatcgcgagcgctatccagaagcaggcaacacctcgctggctgcgaacgcgctgcagcgcgtcgatcacgtactgatgggaaagaacggcaatcttgttgcgatagaggggcagatgaatgatccaacacacaagcgcgccgccgtctccatcgaccaggcaatcaatatgcccttggaacagtcggacgcaaagctgcaggctgccaaccaagccattgctcaggaacagacgcagacacgacaacaggagttggtacggagccagcagcaagatgcacagcaggcgccgcgcatgagtgtttaa

SEQ ID NO: 2002 - DNA, 2490 bp, Bacillus sp.
atggcgtttattcagcgatattcaaccacgactaatggagcggttacttttactggcaacacactgggtctaagtaataccaatatcagttatacagatattggtgcatttatcacattagatttgtctaagcaggtaccaggatatcttgcaggtaccacactggattggaaagaaaatgcttctgctgcacagcttcgcttaccaacgggaagcatagtattatatgcagagctaatttggggtggatcaacaaaaacgagtaccgaggatgtgacgagtgaaatagatcgggccataacgttaatctcgccaaaagggagcaccctcattacgccagatccgactacgagtcagcaagtagctcaggcgaaccaaatattttatgttcgctctgccaatgttactagttttatagatgcaggtggggctggtaattatactgtcagtggtgtaccagcgacagtacaaagatataaagggaacaacgtggggggatggactttatctgtggtttataaagatcctacactgcctcttcgaaatatgaacattcatgtcggaactgcatcgattgagaaaacgggatcagtaagccagaaaatttctggcttctctacgcctgaacttggtgatgtcaaagcaagattgttgctaaccgcaatggaaggagattcaaagattccaggagatcagttactttttggaaaagatgcctcttctttaaagcccatttcaggtcccaataatccgattgacaacttctttgcttcacaaattaatgatgatgcagggaatctagatacgagtggtacctatgggaatgtaaatgtcataccaggaagtgccggaccagcagttcgttataattgggatattaccaatgtggacgcttctacagctatggagaattcacaaacggaggcattagttcaactgacttcgaaatcagatggttatatagtgacaggtctgggtgtccaaattgatgtgaatagtccagaaatcaaaattaataaagaagtagataaagaagcagctatcgtgggtgaaatccttacttacactctattaattgaaaacagtggaatgaccgaagcacaaaaaactattttaaaagacactcttccaccagaattaaagtttgttgaagacagcttacagatcgatggcgttcctatacctggtggagatccgacaaaaggagtagacattggttccatatctatcgaaggcccgacggaagttacctttcaaaccttagtattaaaagtgccaccagacaatagagcggtgaataaagctactgtcgtgtatgatttccaaagtgccccaggcttaccggtctcttcaggtacagcagatagtaatgaagccattacggtcattcgaaaagtagaggtagaggtagtgaaacggcaagacatgtcagtttatgtcaaggcaggtaacattataacctataccattgaagttgctaatacaggtgatacacaactgaccgatgtcgtaattgaggatcaaattccaaatggaacgaagttggttccaggaagtttacagatagatgggagccctctctcaggcaatatagaaagtggcgtgaatattggtacggtagagcccgggacgacgacaagagtcaccttccaagtgttgattgataacccagtgcctaagaaagtgacaaacaaagcaaaagttgattataaatataagcttattcctgatggacaaatttatcgtaaagtagaaatgacgaatgaagtgacagctattcacgaaagcaattgtaaagaagcacagaagaaaatcgtgacaggtattggagaagctgagttagcggctgcaggagtaatcgtagcagaaaaattaaaaatacaagatgcaattcgggccttcaacgaagggaagcagagtgcagaagaattactcaatgagaatgaacagttgacccacaaactaacaaaaataattttagacgaaaaattgcaacaagatacattgcaaaaagcaaaaatactttgttgcgatggtattgacgggattgaagggattgactacagtggtgtctatagcatcaaaaataaaggaagtcaaaaagtattagatatatctagcgcctcaaaggataatggtgtaaacgtccaacaatgggattataacggcggagatcatcaaaaatgggaactagagaagatggcagatgggtattataaaatcaaagcagttcatagtggaaaattgcttactgtgtccggagcttcaaacagtgatggtgcgaatgtagaacaatgggaagacattggtggagataatcaaaaatggaaaatcgaaaaaaattcggatggaacgcttaaattaatagctaagcatagcggccaattacttgatctgaagagtagtatacaaaacaatggtgctaatattcaacaatggccagacaatggtacagatgctcaatgttgggaattgacaaaatcaaaataa

SEQ ID NO: 2003 - DNA, 2481 bp, Bacillus sp.
atggcgtttattcagcgatattcaaccacgactaacggagcggttacttttactggcaacacgctgggtctaagtaataccaatatcagttatacagatattggtgcatttatcacattagatttgtctaagcaggtaccaggatatcctgcaggtaccacactggattggaaagaaaatgcttctgctgcacagcttcgcttaccaacgggaagcatagtattatatgcagagttaatttggggtggatcaacaaaaacgagtaccgaggatgtgacgagtgaaatagatcgggccataacgttaatctcgccaaaagggagtaccctcattacgccagatccgactacgagtcagcaagtagctcaggcgaaccaaatattttatgttcgctctgccaatgttactagttttatagatgcaggtggggctggtaattatactgtcagtggtgtaccagcgacagtacaaagatataaagggaacaacgtggggggatggactttatctgtggtttataaagatcctacactgcctcttcgaaatatgaacattcatgtcggaacagcatcgattgagaaaacgggatcagtaagccagaaaatttctggcttctctacgcctgaacttggtgatgtcaaagcaagattgttgctaaccgcaatggaaggagattcaaagattccaggagatcagttactttttggaaaagatgcttcttctttaaagcccatctcaggtcccaataatccgattgacaacttctttgcttcacaaattaatgatgatgcagggaatctagatacgagtggtacctatgggaatgtaaatgtcacaccaggaagtgccggaccagcagttcgttataattgggatattaccaatgtggacgcttctacagctatggagaactcacaaacggaggcattagttcaactgacttcgaaatcagatggttatatcgtgacaggtctgggtgttcaaattgatgtgaatagtccagaaattaaaattaataaagaagtagataaagaagcagctatcgtgggtgaaatccttacttacactctattaattgaaaacagtggaatgaccgaagcacaaaaaactattttaaaagatactcttccaccagaattaaagtttgttgaaggcagcttacaagtcgatggcgttcctatacctggtggagatccgacaaaaggagtagacattggttccatatctatcgaaggaccgacggaagttacctttcaagccttagtattaaaagtgccaccagacaatagagcggtgaataaagctactgtcgtgtatgatttccaaagtgccccaggcttaccggtctcttcaggtacagcagatagtaatgaagccattacggtcattcgaaaagtagaggtagaggtagtgaaacggcaagacatgtcagtttatgtcaaggcaggtaacattataacctataccattgaagttgctaatacaggtgatacacaactgaccgatgtcgtaattgaggatcaaattccaaatggaacgaagttggttccaggcagtatacagatagatgggcgccctctctcaggcaatatagaaagtggcgtgaatattggtacggtagagcccgggatgacgacaagagtcaccttccaagtgttgattgataacccagtgcctaagaaagtgacaaacaaagcaaaagttgattataaatataagcttattcctgatggacaaatttatcgaaaagtagaaatgacgaatgaagtgacagctattcacgaaagcaattgtaaagaagcacagaagaaaatcgtgacaggtattggagaagctgagttagcggctgcaggagtaatcgtagcagaaaaattaaaaatacaagatgcaattcgggccttcaacgaagggaagcagagtgcagaagaattactaaatgagaatgaacagttgacccacaaactaacaaaaataattttagacgaaaaattgcaacaagatacattgcaaaaagcaaaaatactttgttgcgatggtattgaagggattgactacagtggtgtctatatcatcaaaaataaaggaagtcaaaaagtattagatatatctagcgcctcaaaggataatggtgtaaacgtccaacaatgggattataacggcggagataatcaaaaatgggaactagagaagatggcagatgggtattataaaatcaaagcagttcatagtgggaaattgcttactgtgtccggagcttcaaacagtgatggtgcgaatgtagaacaatgggaagacattggtggagataatcaaaaatggaaaattgaaaaaaattcggatggaacgcttaaattgatagctaagcatagcggccaattacttgatctgaagagtagtatacaaaacaatggtgctaatattcaacaatggccagacaatggtacagatgctcaatgttgggaattgacaaaattaaaataa

SEQ ID NO: 2004 - DNA, 2490 bp, Bacillus sp.
atggcgtttattcagcgatattcaaccacgactaacggagcggttacttttactggcaacacactgggtctaagtaataccaatatcagttatacagatattggtgcatttatcacattagatttgtctaagcaggtaccaggatatcctgcaggtaccacactggattggaaagaaaatgcttctgctgcacagcttcgcttaccaacgggaagcatagtattatatgcagagctaatttggggtggatcaacaaaaacgagtaccgaggatgtgacgagtgaaatagatcggaccataacgttaatctcaccaaaagggagcaccctcattacgccagatccgactacgagtcagcaagtagctcaggcgaaccaaatattttatgttcgctctgccaatgttactagttttatagatgcaggtggggctggtaattatactgtcagtggtgtaccagcgacagtacaaagatataaagggaacaacgtggggggatggactttatctgtggtttataaagatcctacactgcctcttcgaaatatgaacattcatgtcggaactgcatcgattgagaaaacaggatcagtaagccagaaaatttctggcttctctacgcctgaacttggtgatgtcaaagcaagattgttgctaaccgcaatggaaggagattcaaagattccaggagatcagttactttttggaaaagatgcctcttctttaaagcccatttcaggtcccaataatccgattgacaacttctttgcttcacaaattaatgatgatgcagggaatctggatacgagtggtacctatgggaatgtaaatgtcataccaggaagtgccggaccagcagttcgttataattgggatattaccaatgtggacgcttctacagctatggagaattcacaaacggaggcattagttcaactgacttcgaaatcagatggttatatagtgacaggtctgggtgtccaaattgatgtgaatagtccagaaatcaaaattaataaagaagtagataaagaagcagctatcgtgggtgaaatccttacttacactctattaattgaaaacagtggaatgaccgaagcacaaaaaactattttaaaagacactcttccaccagaattaaagtttgttgaaggcagcttacagatcgatggcgttcctatacctggtggagatccgacaaaaggagtagacattggttccatatctatcgaaggcccgacggaagttacctttcaagccttagtattaaaagtgccaccagacaatagagcggtgaataaagctactgtcgtgtatgatttccaaagtgccccaggcttaccggtctcttcaggtacagcagatagtaatgaagccattacggtcattcgaaaagtagaggtagaggtagtgaaacggcaagacatgtcagtttatgtcaaggcaggtaacattgtaacctataccattgaagttgctaatacaggtgatacacaactgaccgatgtcgtaattgaggatcaaattccaaatggaacgaagttggttccaggcagtatacagatagatgggcgccctctctcaggcaatatagaaagtggcgtgaatattggtacggtagagcccgggacgacgacaagagtcaccttccaagtgttgattgataacccagtgcctaagaaagtgacaaacaaagcaaaagttgattataaatataagcttattcctgatggacaaatttatcgaaaagtagaaatgacgaatgaagtgacagctattcacgaaagcaattgtaaagaagcacagaagaaaatcgtgacaggtattggagaagctgagttagcggctgcaggagtaatcgtagcagaaaaattaaaaatacaagatgcaattcgggccttcaacgaagggaagcagagtgcagaagaattactcaatgagaatgaacagttgacccacaaactaacaaaaataattttagacgaaaaattgcaacaagatacattgcaaaaagcaaaaatactttgttgcgatggtattgacgggattgaagggattgactacagtggtgtctatatcatcaaaaataaaggaagtcaaaaagtattagatatatctagcgcctcaaaggataatggtgtaaacgtccaacaatgggattataacggcggagatcatcaaaaatgggaactagagaagatggcagatgggtattataaaatcaaagcagttcatagtgggaaattgcttactgtgtccggagcttcaaacagtgatggtgcgaatgtagaacaatgggaagacattggtggagataatcaaaaatggaaaatcgaaaaaaattcggatggaacgcttaaattgatagctaagcatagcggccaattacttgatctgaagagtagtatacaaaacaatggtgctaatattcaacaatggccagacaatggtacagatgctcaatgttgggaattgacaaaattaaaataa

SEQ ID NO: 2005 - DNA, 2481 bp, Bacillus sp.
atggcgtttattcagcgatattcaaccacgactaacggagcggttacttttactggcaacacactgggtctaagtaataccaatatcagttatacagatattggtgcatttatcacattagatttgtctaagcaggtaccaggatatcctgcaggtaccacactggattggaaagaaaatgcttctgctgcacagcttcgcttaccaacgggaagcatagtattatatgcagagttaatttggggtggatcaacaaaaacgagtaccgaggatgtgacgagtgaaatagatcgggccataacgttaatctcgccaaaagggagtaccctcattacgccagatccgactacgagtcagcaagtagctcaggcgaaccaaatattttatgttcgctctgccgatgttactagttttatagatgcaggtggggctggtaattatactgtcagtggtgtaccagcgacagtacaaagatataaagggaacaacgtggggggatggactttatctgtggtttataaagatcctacactgcctcttcgaaatatgaacattcatgtcggaacagcatcgattgagaaaacgggatcagtaagccagaaaatttctggcttctctacgcctgaacttggtgatgtcaaagcaagattgttgctaaccgcaatggaaggagattcaaagattccaggagatcagttactttttggaaaagatgcctcttctttaaagcccatttcaggtcccaataatccgattgacaacttctttgcttcacaaattaatgatgatgcagggaatctggatacgagtggtacctatgggaatgtaaatgtcataccaggaagtgccggaccagcagttcgttataattgggatattaccaatgtggacgcttctacagctatggagaattcacaaacggaggcattagttcaactgacttcgaaatcagatggttatatagtgacaggtctgggtgtccaaattgatgtgaatagtccagaaatcaaaattaataaagaagtaaataaagaagcagctatcgtgggtgaaatccttacttacactctattaattgaaaacagtggaatgaccgaagcacaaaaaactattttaaaagatactcttccaccagaattaaagtttgttgaaggcagcttacaagtcgatggcgttcctatacctggtggagatccgacaaaaggagtagacattggttccatatctatcgaaggaccgacggaagttacctttcaagccttagtattaaaagtgccaccagacaatagagcggtgaataaagctactgtcgtgtatgatttccaaagtgccccaggtttaccggtctcggcaggtacagcagatagtaatgaagccattacggtcattcgaaaagtagaggtagaggtagtgaaacggcaagacatgtcagtttatgtcaaggcaggtaatattataacctataccattgaagttgctaatacaggtgatacaccactgactgatgtcgtaattgaggatcaagttccaaatggaacgaagttggttccaggtagtttacagatcgatgggcgtcctctctcaggcaatatagaaagtggcgtgaatattggtacggtagagcccgggacgacgaccagagtcaccttccaagtgttgattgataacccagtgcctaagaaagtggcaaacaaagcaaaagttgattataaatataggcttattcctgatggacaaatttatcgtaaagaagaaatgacgaatgaagtgacagctattcacgaaagcaattgtaaagaagcacagaagaaaatcgtgacaggtattggagaagctgagttagcggctgcaggagtaatcgtagcagaaaaattaaaaatacaagatgcaattcgggccttcaacgaagggaagcagagtgcagaagaattactcaatgagaatgaacagttgacccacaaactaacaaaaataattttagacgaaaaattgcaacaagatacattgcaaaaagcaaaaatactttgttgcgatggtattgaagggattgactacagtggtgtctatatcatcaaaaataaaggaagtcaaaaagtattagatatatctagcgcctcaatggataatggtgtaaacgtccaacaatgggattataacggcggagatcatcaaaaatgggaactagagaagatggcagatgggtattataaaatcaaagcagttcatagtgggaaattgcttactgtgtccggagcttcaaacagtgatggtgcgaatgtagaacaatgggaagacattggtggagataatcaaaaatggaaaatcgaaaaaaattcggatggaacgcttaaattgatagctaagcatagcggccaattacttgatctgaagagtagtatacaaaacaatggtgctaatattcaacaatggccagacaatggtacagatgctcaatgttgggaattgacaaaattaaaataa

SEQ ID NO: 2006 - DNA, 2481 bp, Bacillus sp.
atggcgtttattcagcgatattcaaccacgactaacggagcgattacttttactggcaacacactgggtctaagtaataccaatataagttatacagatattggggcatttatcacattagatttgtctaggcaggtcccaggatatcctgcaggtaccacactggattggaaagaaaatgcttctgctgcacagcttcggttaccaacggggagcatagtattatatgcagagctaatttggggtggatcaacaaaaacgagtaccgaggatgtgacgagtgaaatagatcgggacattacgttaatctcgccaaaagggagcaccctcattacaccagattcgactacgagtcagcaagtagctcaggcgaaccaaatattttatgttcgctctgccaatgttactagtcttatagatgcaggtggggctggtaattatactgtcagtggtgtaccagcgacagtacaaagatataaagggaacaacgtggggggatggactttatctgtggtttataaagatcctacactgcctcttcgaaatatgaatatttatgtcggaactgcatcgattgagaaaacgggatcagtgagccagaaaatttctggcttctctacgcccgaccttggtgatgtcaaagcaagagtgttacttaacgcaatggaaggagattcaaagattccaggagatcagttactttttggaaaagatgcctcttctttaaagcctatctcaggtcccaataatccgattgacaacttctttgcttcacaaattaatgatgatgcaggaaatctagatacgagtggtacctatgggaatgtaaatgttacaccaggaagtgctggaccagcagttcgttataattgggatattaccaatgtggacgcttctgcagctatggagaactcacaaacggaggcattagttcaactgacttcgaaatcagatggttatatcgtgacaggtctgggtgttcaaattgatgtgaatagtccagaaatcaaaattaataaagaagtagataaagaagcagctatcgtgggtgaaatccttacttacactctattaattgaaaacagtggaatgactgaagcacaaaaaactattttaaaagacacacttccaccagagttaaagtttgttgaaggcagcttacaggtcgatggcgtgcctatacctggtggagatccgacaaaaggagttgacattggttccatatctatcgaaggcccaacggaagttacctttcaagcattagtattaaaagtgccaccagacaatagagcggtgaataaagctactgtcgtgtatgatttccaaagtgccccaggcttaccggtctcgtcaggtacagcagatagtaatgaagtcattacggtcattcgaaaagtagaggtagaggtagtgaaacggcaagacatgtcggtttatgtcaaggcaggtaacgttataacctataccattgaagttgctaatacaggtgatacaccactgaccgatgtcgtaattgaggatcaagttccaaatggaacgaaattggttccgggcagtttacagatagatgggcgtcctctctcaggcaatatagaaagtggcgtgaatattggtacggtagagcctgggacgacgacaagagtcaccttccaagtgttgattgataacccagtgcctaagaaagtgacaaacaaagcaaaagttgattataaatataagcttattcctgatggacaaatttatcgtaaagaagaaatgacgaatgaagtgacagctattcacgaaagcaattgtaaagaagcacagaagaaaatcgtgacaggtattggagaagcagagttagcggctgcaggagtaatcgtagcagaaaaattaaaaatacaagatgcaattcgggccttcaacgaagggaagcagagtgcagaagaattactcaatgtgaatgaacagttgacccacaaactaacaaaaataattttagacgaaaaattgcaacaagatacattgcaaaaagcaaaaatactttgttgcgatggtattgacgggctcgactacagtggtgtctatatcatcaaaaataagggaagtcaaaaagtattagatatatctagcgcctcaaaggataatggtgtaaacgtgcaacaatgggagtataacggcggagatcagcaaaaatgggaactagagaagctggcagatgggtattataaaatcaaagcagttcatagtggaaaattgcttactgtgtccggagcttcaaacagtgatggtgcgaatgtagaacaatgggaagacattggtggagacaatcaaaaatggaaaatcgaaaaaagttcggatggaacgcttaaattgatagctaagcatagcggccaattacttgatctgaagagtagtttacaaaacaatggtgctaatattcaacaatggccagacaatggtacagatgctcaatgttgggaattgacaaaattaaaataa

SEQ ID NO: 2007 - DNA, 2358 bp, Bacillus sp.
ttgtctaagcaggtaccaggatatcctgcaggtaccacactagattggaaagaaaatgcttctgctgcacagcttcgcttaccaacgggaagcatagtattatatgcagagctaatttggggtggatcaacaaaaacgagtaccgaggatgtgacgagtgaaatagatcgggccataacgttaatctcaccaaaagggagcaccctcattacgccagatccgactacgagtcagcaagtagctcaggcgaaccaaatattttatgttcgctctgccaatgttactagttttatagatgcaggtggggctggtaattatactgtcagtggtgtaccagcgacagtacaaagatataaagggaacaacgtggggggatggactttatctgtggtttataaagatcctacactgcctcttcgaaatatgaacattcatgtcggaactgcatcgattgagaaaacgggatcagtaagccagaaaatttctggcttctctacgcctgaacttggtgatgtcaaagcaagattgttgctaaccgcaatggaaggagattcaaagattccaggagatcagttactttttggaaaagatgcctcttctttaaagcccatttcaggtcccaataatccgattgacaacttctttgcttcacaaattaatgatgatgcagggaatctagatacgagtggtacctatgggaatgtaaatgtcataccaggaagtgccggaccagcagttcgttataattgggatattaccaatgtggacgcttctacagctatggagaattcacaaacggaggcattagttcaactgacttcgaaatcagatggttatatagtgacaggtctgggtgtccaaattgatgtgaatagtccagaaatcaaaattaataaagaagtagataaagaagcagctatcgtgggtgaaatccttacttacactctattaattgaaaacagtggaatgaccgaagcacaaaaaactattttaaaagacactcttccaccagaattaaagtttgttgaagacagcttacagatcgatggcgttcctatacctggtggagatccgacaaaaggagtagacattggttccatatctatcgaaggcccgacggaagttacctttcaaaccttagtattaaaagtgccaccagacaatagagcggtgaataaagctactgtcgtgtatgatttccaaagtgccccaggcttaccggtctcttcaggtacagcagatagtaatgaagccattacggtcattcgaaaagtagaggtagaggtagtgaaacggcaagacatgtcagtttatgtcaaggcaggtaacattataacctataccattgaagttgctaatacaggtgatacacaactgaccgatgtcgtaattgaggatcaaattccaaatggaacgaagttggttccaggcagtttgcagatagatgggcgccctctctcaggcaatatagaaagtggcgtgaatattggtacggtagagcccgggacgacgacaagagtcaccttccaagtgttgattgataacccagtgcctaagaaagtgacaaacaaagcaaaagttgattataaatataagcttattcctgatggacaaatttatcgtaaagtagaaatgacgaatgaagtgacagctattcacgaaagcaattgtaaagaagcacagaagaaaatcgtgacaggtattggagaagctgagttagcggctgcaggagtaatcgtagcagaaaaattaaaaatacaagatgcaattcgggccttcaacgaagggaagcagagtgcagaagaattactcaatgagaatgaacagttgacccacaaactaacaaaaacaattttagacgaaaaattgcaacaagatacattgcaaaaagcaaaaatactttgttgcgatggtattgaagggattgactacagtggtgtctatatcatcaaaaataaaggaagtcaaaaagtattagatatatctagcgcctcaaaggataatggtgtaaacgtccaacaatgggattataacggcggagatcatcaaaaatgggaactagagaagatggcagatgggtattataaaatcaaagcagttcatagtggaaaattgcttactgtgtccggagcttcaaacagtgatggtgcgaatgtagaacaatgggaagacattggtggagatcatcaaaaatggaaaatcgaaaaaaattcggatggaacgcttaaattgatagctaagcatagcggccaattacttgatctgaagagtagtatacaaaacaatggtgctaatattcaacaatggccagacaatggtacagatgctcaatgttgggaattgacaaaattaaaataa

SEQ ID NO: 2008 - DNA, 2481 bp, Bacillus sp.
atggcgtttattcagcgatattcaaccacgactaacggagcaattacttttactggcaacacattgggtctaagtaataccaatatcagttatacagatattggtgcatttatcacattagatttatctaagcaggtaccaggatatcctgcaggtaccacactggattggaaagaaaatgcttctgctgcacagcttcgcttaccaacgggaagcatagtattatatgcagagctaatttggggtggatcaacaaaaacgagtaccgaggatgtgacgagtgaaatagatcgggccataacgttaatctcgccaaaagggagcaccctcattacaccagatccgactacgagtcagcaagtagcccaggcgaaccaaatattttatgttcgctctgccaatgttactaatcttatagatgcaggtgggactggtaagtatactgttagtggtgtaccagcgacagtacaaagatataaagggaacaacgtggctgggtggactttatctgtggtttataaagatcctacactgcctcttcgaaatatgaatgttcatgtcggaactgcatcgattgagaagactggatcaataagtcagaaaattgctggcttctctacgcctcaacttggggatgtcaaagcaagattgttgctaaccgcaatggaaggagattctaagattccaggggatcagttactttttggaaaagatgtctcttctttgaatcccatctcaggtcccaataatccgattgacaacttctttgcttcacaaattaatgatgatgcagggaatctagatacgagtggtacctatgggaatgtaaatgtcacaccaggaagtgccgaaccagcagttcgttataattgggatattaccaatgtggacgcttctacagctatggagaattcacaaacggaggcattggttcaattgacttcgaaatcagatggttatatcgtgacaggtctgggtgtccaaattgatgtgaatagtccagaaatcaaaattaataaagaagtagataaagaagcagctatcgtgggtgaaattcttacttacactctattgattgaaaacagtggaatgactgaagcacaaaaaactattttaaaagacactcttccaccagaattaaagtttgttgaaaacagcttacaggttgatggcgtgcctatacctggtggggatccgacaaaaggagttgacattggttccatatctatcgaaggcccgacggaagttacctttcaagctttagtattaaaagtgccaccagacaatcaagcggtgaataaagctactgtcgtgtatgatttccaaagtgccccaggtttaccggtctcggcaggtacggcaaatagtaatgaagccattacggtcattcgaaaagtagaggtagaggtagttaaacagcaagacatgtcggtttatgtcaaggcaggtaacattataacttataccattgaagttgctaatacaggtgatacaccactgaccgatgtcgtaattgaggatcaagttccaaatggaacgaagttggttccaggtagtttacagatagatgggcgcccactctcaggcaatatagaaagtggtgtgaatattggtacggtagggcctgggacgacgacaagagtcaccttccaagtgttgattggtgacccagttcctaagaaagtgacaaacaaagcaaaagttaattataaatataagcttattcctgatggacaaatttatcgtaaagaagaaatgacgaatgaagtcacagctattcacgaaagcaattgtgaagaagcacagaagaaaatcgtgactggtattggagaagctgagttagtggctgcaggagtaatcgtagcagaaaaattaaaaatacaagatgcaattcgggccttcaacgaagggaagcagaccgcagaggaattactcaatgtgaataaacagttgacccacaaactaacaaaaatcattttagacgaaaagctgcaacaagacacattgcaaaaagccaaaatactttgttgcgatggtattgttggacttgactacagtggtgtctatatcatcaaaaatagaggaagtcaaaaagtattagatatatctagcgcctcaaaggataatagtgcaaacgtgcaacaatgggattataacggtggagatcatcaaaaatgggaactagagaagctggcagatggatattataaaatcaaagcagttcatagtggaaaactgcttactgtgtctggagtttcaaacagtgatggtgcgaatgtagagcaatgggaagacattggtggtgacaatcaaaaatggaaaatcgaaaaaaattcggatggaacgtttaaattgattgctaagcatagcggccaattactcgatctgaagagtagtatgcaaaacaatggtgctaatattcaacaatggccagataatggtacagatgcccaacgttgggaattgacaaaattaaaataa

SEQ ID NO: 2009 - DNA, 2355 bp, Bacillus sp.
ttgtctaagcaggtaccaggatatcctgcaggtaccacactggattggaaagaaaatgcttctgctgcacagcttcgcttaccaacgggaagcatagtattatatgcagagttaatttggggtggatcaacaaaaacgagtaccgaggatgtgacgagtgaaatagatcgggccataacgttaatctcgccaaaagggagtaccctcattacgccagatccgactacgagtcagcaagtagctcaggcgaaccaaatattttatgttcgctctgccaatgttactagttttatagatgcaggtggggctggtaattatactgtcagtggtgtaccagcgacagtacaaagatataaagggaacaacgtggggggatggactttatctgtggtttataaagatcctacactgcctcttcgaaatatgaacattcatgtcggaacagcatcgattgagaaaacgggatcagtaagccagaaaatttctggcttctctacgcctgaacttggtgatgtcaaagcaagattgttgctaaccgcaatggaaggagattcaaagattccaggagatcagttactttttggaaaagatgcctcttctttaaagcccatttcaggtcccaataatccgattgacaacttttttgcttcacaaattaatgatgatgcagggaatctggatacgagtggtacctatgggaatgtaaatgtcataccaggaagtgccggaccagcagttcgttataattgggatattaccaatgtggacgcttctacagctatggagaattcacaaacggaggcattagttcaactgacttcgaaatcagatggttatatagtgacaggtctgggtgtccaaattgatgtgaatagtccagaaatcaaaattaataaagaagtaaataaagaagcagctatcgtgggtgaaatccttacttacactctattaattgaaaacagtggaatgaccgaagcacaaaaaactattttaaaagacactcttccaccagaattaaagtttgttgaaggcagcttacagatcgatggcgttcctatacctggtggagatccgataaaaggagtagacattggttccatatctatcgaaggcccgacggaagttacctttcaagccttagtattaaaagtgccaccagacaatagagcggtgaataaagctactgtcgtgtatgatttccaaagtgccccaggcttaccagtctcttcaggtacagcagatagtaatgaagccattacggtcattcgaaaagtagaggtagaggtagtgaaacggcaagacatgtcagtttatgtcaaggcaggtaacattataacctataccattgaatttgctaatacaggtgatacacaactgaccgatgtcgtaattgaggatcaagttccaaatggaacgaagttggttccaggcagtttacagatagatgggcgccctatctcaggcaatatagaaggtggcgtgaatattggtacggtagagcccgggacgacaacaagagtcaccttccaagtgttgattgataacccagtgcctaagaaagtgacaaacaaagcaaaagttgattataaatataagcttattcctgatggacaaatttatcgtaaagtagaaatgacgaatgaagtgacagctattcacgaaagcaattgtaaagaagcacagaagaaaatcgtgacaggtattggagaagctgagttagcggctgcaggagtaatcgtagcagaaaaattaaaaatacaagatgcaattcgggccttcaacgaagggaagcagagtgcagaagaattactcaatgagaatgaacagttgacccacaaactaacaaaaataattttagacgaaaaattgcaacaagatacattgcaaaaagcaaaaatactttgttgcgatggtattgaagggattgactacagtggtgtctatatcatcaaaaataaaggaagtcaaaaagtattagatatatctagcgcctcaatggataatggtgtaaacgtccaacaatgggattataacggcggagatcatcaaaaatgggaactagagaagctggatgggtattataaaatcaaagcagttcatagtgggaaattgcttactgtgtccggagcttcaaacagtgatggtgcgaatgtagaacaatgggaagacattggtggagataatcaaaaatggaaaatcgaaaaaaattcggatggaacgcttaaattgatagctaagcatagcggccaattacttgatctgaagagtagtatacaaaacaatggtgctaatattcaacaatggccagacaatggtacagatgctcaatgctgggaattgacaaaattaaaataa

SEQ ID NO: 2010 - DNA, 2367 bp, Bacillus sp.
ttgtctaagcaggtaccaggatatcttgcaggtaccacactggattggaaagaaaatgcttctgctgcacagcttcgcttaccaacgggaagcatagtattatatgcagagctaatttggggtggatcaacaaaaacgagtaccgaggatgtgacgagtgaaatagatcgggccataacgttaatctcgccaaaagggagcaccctcattacgccagatccgactacgagtcagcaagtagctcaggcgaaccaaatattttatgttcgctctgccaatgttactagttttatagatgcaggtggggctggtaattatactgtcagtggtgtaccagcgacagtacaaagatataaagggaacaacgtggggggatggactttatctgtggtttataaagatcctacactgcctcttcgaaatatgaacattcatgtcggaactgcatcgattgagaaaacgggatcagtaagccagaaaatttctggcttctctacgcctgaacttggtgatgtcaaagcaagattgttgctaaccgcaatggaaggagattcaaagattccaggagatcagttactttttggaaaagatgcctcttctttaaagcccatctcaggtcccaataatccgattgacaacttctttgcttcacaaattaatgatgatgcagggaatctagatacgagtggtacctatgggaatgtaaatgtcacaccaggaaatgccggaccagcagttcgttataattgggatattaccaatgtggacgcttctacagctatggagaactcacaaacggaggcattagttcaactgacttcgaaatcagatggttatatcgtgacaggtctgggtgttcaaattgatgtgaatagtccagaaattaaaattaataaagaagtagataaagaagcagctatcgtgggtgaaatccttacttacactctattaattgaaaacagtggaatgaccgaagcacaaaaaactattttaaaagatactcttccaccagaattaaagtttgttgaaggcagcttacaagtcgatggcgttcctatacctggtggagatccgacaaaaggagtagacattggttccatatctatcgaaggaccgacggaagttacctttcaagccttagtattaaaagtaccatcagacaatagagcggtgaataaagctactgtcgtgtatgatttccaaagtgccccaggtttaccggtctcggtaggtacagcagatagtaatgaagccattacggtcattcgaaaagtagagatagaggtagtgaaacggcaagacatgtcagtttatgtcaaggcaggtaacattataacctataccattgaagttgctaatacaggtgatacacaactgaccgatgtcgtaattgaggatcaaattccaaatggaacgaagttggttccaggaagtttacagatagatgggagccctctctcaggcaatatagaaagtggcgtgaatattggtacggtagagcccgggacgacgacaagagtcaccttccaagtgttgattgataacccagtgcctaagaaagtgacaaacaaagcaaaagttgattataaatataagcttattcctgatggacaaatttatcgtaaagtagaaatgacgaatgaagtgacagctattcacgaaagcaattgtaaagaagcacagaagaaaatcgtgacaggtattggagaagctgagttagcggctgcaggagtaatcgtagcagaaaaattaaaaatacaagatgcaattcgggccttcaacgaagggaagcagagtgcagaagaattactcaatgagaatgaacagttgacccacaaactaacaaaaataattttagacgaaaaattgcaacaagatacattgcaaaaagcaaaaatactttgttgcgatggtattgacgggattgaagggattgactacagtggtgtctatagcatcaaaaataaaggaagtcaaaaagtattagatatatctagcgcctcaaaggataatggtgtaaacgtccaacaatgggattataacggcggagatcatcaaaaatgggaactagagaagatggcagatgggtattataaaatcaaagcagttcatagtggaaaattgcttactgtgtccggagcttcaaacagtgatggtgcgaatgtagaacaatgggaagacattggtggagataatcaaaaatggaaaatcgaaaaaaattcggatggaacgcttaaattgatagctaagcatagcggccaattacttgatctgaagagtagtatacaaaacaatggtgctaatattcaacaatggccagacaatggtacagatgctcaatgttgggaattgacaaaatcaaaataa

SEQ ID NO: 2011 - DNA, 2478 bp, Bacillus sp.
atggcgtttattcagcgatattcaaccacgaccaacggggcgattacctttactggaaacacactcggtctaagtaataccaacaccagttatacagatattggtgcatttatcacgttagatctatccaagcaggtaccaggatatcctgcaggtaccacgctggattggaaagaaaatgcttctgcggcacagcttcgcttaccaacgggaagccaagtattatatgcagagctaatctggggtgggtcgacaaaaacgagtatagaggatgtaacgaatgaaatagatcggacgataacgttaacctcgccgaaaggaaccaccctcattacgccagatccaactacgagtcagcaagtagctcaggcgaaccaaatattttatgttcgttctgccaatgttactagcttcattgatgcaggtggggctggtaagtatactgtcagtggtgtaccagcgacagcacaaagatataaaggaaataacgtagggggatggactttatctgtggtttataaagatcctacactgcctcttcgaaatatgaatattcatgtcggaactgcatcgattgagaagactggatcaagaagccagaaaatttctggcttctctacgcctgagctcggggatgtcaaagcgagattgttactaaccgcaatggaaggagactcaaagattccaggagatcagttgctttttggaaaagatgtctcttcattaaagcccatctcaggtcccaataatccgattgataacttctttgcttcacaaattaatgatgatgcagggaatttagatacgagtggtacctatgggaatgtaaatgtcacaccaggaagtgctggagcagcagttcgttataactgggatattaccaatgtggacgcctcttcagccatggagaattcacaaacggaagccttagttcagttgacttcgaaatcagatggttatatcgtgacaggtctgggtgtccaaattgatgtgaatagtccagaaatcaaagtaaataaagaagtagataaagaagcagctatcgtaggtgaaatccttacctataccttattgattgaaaacaatgggatgactgaagcacaaaaaactattttaaaagacacgcttccaccagagctaaagtttgttgaaggtagtttacaggttgatggtgtgcctatacctggtggagatccgacaaaagggattgacatcggttctatatctatcgaaggcccgacggaagtcacctttcaagccttagtattaaaagttccaactgataatagagcggtgaataaagctactgtcgtgtatgatttccagagcgccccaggcttaccggtctcggcaggtacggcagatagtaatgaagctattacggtcattcgaaaagtagaggtagaagtagctaaacggcaagacatgcccgtttatttcaaggcaggtaatgttattacctataccattgaagttgttaatacaggtgatacaccactgaccgatgtcgtaattgaggatcaaattccaaatggaacgaagttggtttcaggtagtttacagatagatgggcgaccactctcaggaaacatagaaagtggcgtgaatattggtacggtagagcctgggacgacggcaagagtcaccttccaagtgttgattggtaacccagtgcctacgaaagtgacaaacaaagcaaaggtggattataaatataagcttattcctgatggacaaatgtatcgtaaagaagaaatgacgaatgaagtgacagctattcatgaaagtaattgtaaagaagcgcagaagaaaatcgtgacaggtattggagaagctgagttagcggctgcaggagtaatcgtagcagaaaaattaaaaatacaagatgcgattcgggctttcaatgaaggaaagctgagtgcagaagaattactcaatgtgaatgaacagttgacccaaaaactaagaaaaataacatcagatgaaaagcagcaacaagatacattgcaaaaagcaaaaaagctttgttgcgagggtgttgatgacattgactacagtggtgtctatatcatcagaaataaaggaagccaaaaagtattggatgtatttagcgcttcaaaggataatggcgtaaatgtgcaacaatgggagtataacggtggagatcatcaaaaatggaaactagagaagcaggcggatgggtattacacaatcaaagcagttcatagtggaaaattgcttactgtgtccggagcttcaaacagtgatggtgcaaatgtagaacaatgggaagacattggtggagacaaccaaaaatggaaaatcgtaaaaaattcggatggaacgtttaaatggatagctaagcatagtggccaattacttgatctgaagagtagtatgcaaaacaatggagctaacattcaacaatggccagataatggtacagatgctcaacgttgggaattgacaaaagtataa

SEQ ID NO: 2012 - DNA, 4710 bp, Variovorax sp.
atgaagatccggtatttcctgatggcgttcctggccccgctcgtcacattgctgacgcatgcggcaatcaccggggtcagtccgatgacgaccctgagcaacatagcgacggccgcagccgaagcggttgccgacccgctcccgctgcaggggccgggcctgggcaacctcacctacacctcggcggaactgttcaagccggtgtcgatgatcacgagcctcgcgcacccgctcgatccggcgcacagcagcgcctacgagtcgcgcgaggtgcccgccacgtacccgggccgcaaggactacggcatgaacgcgggcatcatgatcaacggctactttctcacctcctttgcgccggacagcggcctgggcccgggcggtttcctgctgtacgacgtgtcgaacccgcgccagatccaactggtcaagaagatctacgaacccgaggcccgcaccaaggagttccgcgaaacgcactccttcggcaccgcgaagatcggcggcaagacgtacgtggtgctgcccagcatctacggcgtcgagttctgggacttcaccgacatcaatgacatcaagcaggtgaagaagctggcgctgcccggcgtcaacgccggcgactacgaagacgtcagctggcagctctggtggcaggcgccctacctgtacgtggcctcggcgggccgcggcatcttcatcgtcgatgccagggaccccgtgaacgccgtggttgcgaaccgcggcgccggcaagcccaacccggtgcccacgggcgaactcggcaacttccggatcggtccgatcttcaccatgggcaaccacatggtgctgaccgcgatggaaagcaacggcggattcgcgagcctggatatctccgacccgctcaaccccaaggtgctcgattccatcgtgggcaccacgccgttctactacgccacctgcttcgacggcaggaacctgcacgcctcgacgcgcggcagcggcgccaggatgtacagctacgacctgagcgaccgctcgcgcttcgtggccgaggacaaccggctggtcatcgacgaacagctgtattgcgccacgcaggacaactatgtgatccagggcgcgcaaacgcgcatccacaaggtcgacgtgagcaatccgctcaatcacgtggaggtgggccgcggcagcatcctgcgcgaggacgacccgaacttctcgcattcggacaacggccaggtcgcgatgttcggcaacctcgtcttcgtgggcaacgaccacggctcgggcagcggcttcgtcgtgcatgcggtggaccccgacaccaccaagcctgaagtgaaacaggtttcgccggccaacggcgcgaagcagcaggcgctgacgtcccgcatcggcctgggcatgaccgacagcatccggcccgagagcgtcaacgccaacaccttcatcgtgcgggcggtgggcggcaacacgctggcgggcacctacagcgtgcagctgggcatcatcaacttccaccccgagcagccgctgtcgccgggcaccagctatgaagtgttcctgcccgccaacggcgtgaaggactatgcgggcaacgccatcggcgcagactacaagtcgaccttcaacaccggcaacgcaaccgacatcaacctgatgcactactggacgctggcgggcaacctctccgacctgatcggcaacaacaacggcacgccggtctcgggcgacgcgttcgaaagcatcggcatgagcttcgcgaaccgcaccgccggtgtgccgctgaagaacgattcggtggccaccgtgctcggcggcaccgcctcgctgagcttctacatgaagaccacgcaggcgggcggcccgaactcctggaccgcgcccggcatcttcgggcgcgaccagtcgggcggcgcggacgacgtgttctggggctggctcgacggcaacgggcgcatcaagctgtcggtgggcaatgacgccggcaccacctccacggcggtggtgaacgacggcaactggcaccacgtggtgttgacgcgcgacgccgcctcgggtgcgcaggcggtatacgtcgatggcgtgaagaccacgtccaccgggctcacgggcaacaagggcctgtcgaacaagttccaggtgctgggccagatccagggcaacgctgcgctcttcaagggcacgctggcggaggtgcgcgtctacggccgcgtgctcaacgacagcgaggtgggcacgctgcgtgggcaggccatcatcggcgacccgggcatcggcggcgggccgaagatcgtcaacggccagctggtcttcgacccggccacgctcggcagcagcggcgcgcagttccgctggaacttcggcgacggcacgcaaacggcctactccacccagccgcgctacacctatacctacacacggccggggcactacaccgtgacgctgacggtgcgcgacgcgagcggccgcgagaccttctacacctacaacctcacggtgatcgtcccggtcacggcgcgggcgcccacgcacacgaccaacatcgcgggcgatgcgaattcggtctactcggtcaatcccgacagcggcacggtcgccgccatcgacgcgcagaccctggccaagcgctgggaagtacgcgtgggcgacgagccgaagacgctggccgtgggccccgatgggcgcatctgggtcacggtgcagggcgaggacaagctggtggcgctcagcgcggccgacggcagcctctcggccaccgtgccgctggcctacggcagcggcccctacggcgtggccttcacgcctgacggcgcgaagggcctgctgacgctggagagcaagtcggtgctgatgagtttcgacccgagcaacggcgccaccaccggcgcggtcgccctcgaaggcaacctgcgcggcattgccgtgagctccgacgcgcaggtggcctacgtcacccgcttcaagtcaaagatgacgggcggccagctgcacaaggtgaacctccagagcatgagcgcgatgcccacgatcgcgctgccagtggacaccaccacggtggacaccgagagccgcgcgcgcggcgtggccaactacctgagccaggtggtgatctcgcccgacggcaggcgcgcggtgctgccttcgaagaaggacaacatcgtgcgcggccgcttccgtgacggtgtggacctgacgcacgaccagagcgtgcgctccatcctctcgcaggtcgacctgcaggcggccgcagaagtgttcgacgagcagatcgacttcgacgaccgcgcaccggcgcgcgcggcgctgttctctccgcccggggactacctcttcgtggcgcagatggaaggcaaccgcgtcgccatcgtcgacccgtacagccgggcggtgcgcggcgagatcaacgcgagcagcgcgccgcacggcctctacctggacgcagtgcgcaagcggctgttcgtcaacaactttctcgcgcgctcggtgtcggtgcacgacgtggcctcggtgctgtcgtcggaatccgccgccgcgatctttctccagaacgtctcgacggtggcgcaggagcccatggcggccgcagccttgcgcggcaagcaggtgttctacaacgcgtccgaccggcgcatgagcaaggacaactacatctcctgcgcgagctgccacgcggacgccggcgacgacggcatggtgtgggacttcacgcagcgcggcgaaggcttgcgccgcaccatcagcctcatgggccggcgcggcgcgggccacggcaagatgcactggactgccaacttcgacgaagtgcaggacttcgagaatgacgtccgcaacgaattcggcggcaccggcttcctgacgaatgcggatttcgccgccacggccgaccccttgggcgcgcccaaggccggcaagagtgcgcaactcgacgatctcgcggcctacctgagttcgctgaacaagtacatgcgcagcccggcgcgtgcggcggacggcagcctgagcgtcgaagcggtgcgaggccagacggtgttcaacacggcacagtgcgccacctgccacaccggaggcactttccgcgacggtctgcggcacgacgtgggcacgatccagctctcctccggcaagggcatcaaccagccgctggcgggcctgggcttcgacacgccgacgctctcgggcacctggaacaccaccgccttcttccacaacgggcaggcggccaccttgcaggacgtgctgaacagcggccacggcaatgcgtcgagcctgccggcgccggacgtggtggcgctgcgcgagtacgtgcgctcgctggacacggccccggcggtggtcacgcggatccgctcggacctcaacccgacgatgtgcgtgaacatcaagggcggggcgaccgcaagcggcaccgtggcggtgcagtggccctgcggcaccgcgagcaacgagaagttcacggtgacgtcgatcaccggcggctatgtgcagctcgtggccgagcacagcggcctgtgcctggcgcaggacggcaccgcgacgaccaacgcgccggtggtgcagctggcatgcacggcgggcaacacggcgcagtggagcctggtcggcggcaccctccgcaaccgcgcctcgggctcgtgcctcgacgtgcccaatggctcgacgacgcaggacacggcgctgatcacgtggacctgcaatgggggcaacaaccagaactggacgcagctgccttag

SEQ ID NO: 2013 - DNA, 4734 bp, Variovorax sp.
atgaagatccggtatttcctgatggcgttcctggccccgctcgtcacattgctgacgcatgcggccatcaccggggtcagcccgatgaccaccctcggcaacatggccacggcggtttccgaggccgttgccgacccgctcccgctgcaggggccgggcctgggcaacctcagctacacatcggcggaactgttcaagccggtgtcgatgatcacgagccttgcgcacccgctcgacccggcgcacagcagtgcctacgagtcgcgcgaggtgcccgccacgtacccgggccgcaaggactacggcatgaacgcgggcatcatggtcaacggctacttcctcacctccttcgcgccggacagcggcctgggcccgggcggcttcctgctgtacgacgtgtcgaacccgcgccagatccggctggtcaagaagatctacgaacccgatgacgcgacaggtggccgcaccaaggagttccgcgaaacgcactccttcggcaccgcgaagatcggcggcaagacgtacgtggtgctgcccagcatcaacggcgtggagttctgggacttcaccgacgtcaacgacatcaagcaggtgaagaagctggcgctgcccggcgtcaacgcgggcgactacgagaacgtcgcctggcagctctggtggcaggcgccctacctgtacgtggcctcggcgggccgcggcatcttcatcgtcgatgctgcggaccccgcgaacgccgtggtggcgaaccgcggcgccggcaagcccaacccggtgcccacgggcgaactcggcaacttccggatcggaccgatcttcaccatgggcaaccacatggtgctgaccgcgatggaaagcaatggcggcttcgcgagcctcgacatctccgacccgctcaaccccaaggtgctcgattccatcgtgggcaccacgccgttctactacgccacctgcttcgacggcaggaacctgcacgtctcgacgcgcggcagcggcgcgaagatgtacagctacgacctctccgaccgctcgcgcttcgtggccgaggacaaccggctggtcatcgacgaacagctgtactgcgccacgcaggacaactacgtgatccagggcgcgcaaacgcgcatccacaaggtcgacgtgagcaatccgctcaatcacgtggaggtgggccgcggcagcatcctgcgcgaggacgacccgaactactcgcattcggacaacggccaggtcgcgatgttcggcaacctggtcttcgtgggcaacgaccacggctcgggcagcggcttcgtcgtgcatgcggtggacccggacaccacccggcccgaggtgaagcaggtctcgccggccaacggcgcgaagcagcaggccctgagctcgcgcatcggcctgggcatgacggacaacatccgccccgagagcgtgaacgccaacaccttcatcgtgcggccggtgggcggcaacacgctcgcgggcacctacagcgtgcagctgggcatcatcaatttccatccggagcagccgctgcaaccgggcaccagctatgaagtgttcctgcctgccaacggcgtgaaggactatgcgggcaatgccatcggcgccgacttcaagtcgaccttcaacaccggcaacgcgaccgacatcaacctgcagcactactggacgctggccggcaacctgtccgacccgatcggcagcaacaacggcacgccggcgtcgggcgatacctttgaaagcatcggcatgagcttcgcgaaccgcaccgccggcgtgccgctgaagaacgacagcgtcgccaccgtgctcggcggcaccgcgtcgctgagcttctacatgaagaccacgcaggccggcagcgcgaacccatggaccgcgccaggcatcttcgggcgcgaccaggccagcggagcggacgacgtgttctggggctggatcgacggcagcggcttcatgaacctctcggtcgcgaacaaggccgccaacaaccccggcacccgctcgctggcggccgtgaacgacggcaactggcaccacgtggtgatgacgcgcgacgcggcctcgggcgcgcaggccatgtacgtggacggcgtgaagaccagctccacgggcctcaccggcaccaaggggctcgcgaacaagttccaggtcatgggccagatccagggcaacgccgacctgttcaagggcacgctggcggaagtgcgcgtgtacagccgcgtgctcaccgacggcgaggtggccacgctgcgcgggcaggcgatcatcggcgaccccggcatcggcggcggtccgaagatcgtcaacggccaactggtgttcgacccggccacgctcggcagcagcggcgcgcagttccgctggaacttcggcgacggcacgcggacggcctactccacccagccgcgctacacctacacctacacacggccggggcactacaccgtgacgctgacggtgcgcgacgcgagcggccgcgagactttctacacctacaacctcaccgtgatcgtgccggtcacggcgcgggcgcccacgcacacgaccaacatcgcaggcgatgcgaattcggtctactcgctcaaccccgacagcggcacggtcgccgccgtcgacgcgcagaccctggccaagcgctgggaagtgcgcgtgggcgacgagccgaagacgctggccgtgggaccggatgggcgcatctgggtcgcggtgcagggcgaggacaagctggtggcgctcagcgcggccgacggcagcctctcggccaccgtgccgctggcctacggcagcggcccctacggcgtggccttcacgcccgacggcgcgaagggcttgctgacgctggagagcaagtcggtgctgatgagcttcgacccgagcaacggcgccaccaccggcgcggttgcgctcgaaggcagcctgcgcggcattgccgtgagctccgatgcgcaggtggcctacgtcacccgcttcaagtcgaagctgacgggcggccagctgcacaaggtgaacctgcagagcatgagcgcgatgcccacgatcgcgctgccggtggacaccaccacggtggacaccgagagccgcgcgcgcggcgtggccaactacctgagccaggtggtgatctcgcccgacggccggcgcgcggtgctgccttcgaagaaggacaacatcgtgcgcggccgcttccgcgacggcgtggacctgacgcacgaccagagcgtgcgttccatcctctcgcaggtcgacctgcaggcggcggcggaagtgttcggcgagcagatcgacttcgacgaccgcgcaccggcgcgtgcggcgctgttctctccgcccggcgactacctcttcgtggcgcagatggaaggcaaccgcgtcgccatcgtcgacccgtacagccgggccgtgcgcggagagatcaacgcgagcagtgcgccgcacggcctgtacctggacgcggcgcgcaagcggctgttcgtcaacaacttccttgcgcgctcggtgtcggtgcacgacgtgtcgctggtgctatcgtcggaatcggcggcggcgaccttcctgcagaacgtggcgacggtcgcgcaggagccgatggcggccgcggcgctgcgcggcaagcaggtgttctacaacgcctccgaccggcgcatgagcaaggacaactacatctcctgcgcgagctgccatgcggacggcggcgatgacggcatggtgtgggacttcacgcagcgcggcgagggcctgcgccgcaccatcagcctcatgggccgccgcggcgcgggccacggcaagatgcactggaccgccaacttcgacgaggtgcaggacttcgagaacgacatccgcaacgagttcggcggcaccggctttttgacgaatgcggacttcgccgccacggccgaccccttgggcgcgcccaaggccggcaagagcgcgcagctcgacgatcttgcggcctacctgagttcgctgaacaagtacatgcgcagcccggcgcgtgcggcggacggcagcttgagcgtggaggcggcgcgcggccagacggtgttcaacaccgcgcagtgcgccacctgccacaccggcggcaccttccgcgacgggctgcggcacgacgtgggcacgatccagctctcgtcgggcaagggccacaaccagccgctcgcgggcctgggcttcgacacgccgacgctctcgggcacctggaacatcacggccttcttccacaacgggcaggccgcgacattgcaggacgtgctgaacagcgggcacggcaatgcctcgagcttgccgccagcggacgtggtggcgctgcgcgagtacgtgcgctcgctggacacggccccggcggtggtgacgcggctgcggtcggacctcaatccgacgatgtgcgtgaacatcaagggcggggcgacggcgagcggcacggtggcggtgcagtggccctgcggcacggcgagcaacgagaagttcacggtgacgtcggtcgcgggcggctatgtgcaactggtggccgagcacagtggcctgtgcctggcgcagaacggcaccgcgacgaccaacgcgccggtggtgcagctggcatgcacggtgggcagcacggcgcagtggagcctggtcggcggcacgctccgcaaccgcgcctcgggctcgtgcctcgacgtgcccaacggctcgacgacgcaggacacggcgctgatcacgtggacctgcaatggggggaacaaccagaactggacgcagctgccttag

SEQ ID NO: 2014 - DNA, 4734 bp, Variovorax sp.
atgaagatccggtatttcctgatggcgttcctggccccgctcgtcacattgctgacgcatgcggccatcaccggggtcagcccgatgaccaccctcggcaacatggccacggcggtttccgaggccgttgccgacccgctcccgctgcaggggccgggcctgggcaacctcagctacacatcggcggaactgttcaagccggtgtcgatgatcacgagcctcgcgcacccgctcgacccggcgcacagcagtgcctacgagtcgcgagaggtgcccgccacctacccgggccgcaaggactacggcatgaacgcgggcatcatggtcaacggctacttcctgacctccttcgcgccggacagcggcctgggcccgggcggcttcctgctgtacgacgtgtcgaacccgcgccagatccggctggtcaagaagatctacgaacccgatgacgcgacaggtggccgcaccaaggagttccgcgaaacgcactccttcggcaccgcgaagatcggcggcaagacgtacgtggtgctgcccagcatcaacggcgtggagttctgggacttcaccgacgtcaacgacatcaaacaggtgaagaagctggcgctgcccggcgtcaacgcgggcgactacgagaacgtcgcctggcagctctggtggcaggcgccctacctgtacgtggcctcggcgggccgcggcatcttcatcgtcgatgctgcggaccccgcgaacgccgtggtggcgaaccgcggcgccggcaagcccaacccggtgcccacgggcgaactcggcaacttccggatcggaccgatcttcaccatgggcaaccacatggtgctgaccgcgatggaaagcaatggcggcttcgcgagcctcgacatctccgacccgctcaaccccaaggtgctcgattccatcgtgggcaccacgccgttctactacgccacctgcttcgacggcaggaacctgcacgtctcgacgcgcggcagcggcgcgaagatgtacagctacgacctctccgaccgctcgcgcttcgtggccgaggacaaccggctggtcatcgacgaacagctgtactgcgccacgcaggacaactacgtgatccagggcgcgcaaacgcgcatccacaaggtcgacgtgagcaatccgctcaatcacgtggaggtgggccgcggcagcatcctgcgcgaggacgacccgaactactcgcattcggacaacggccaggtcgcgatgttcggcaacctggtcttcgtgggcaacgaccacggctcgggcagcggcttcgtcgtgcatgcggtggacccggacaccacccggcccgaggtgaagcaggtctcgccggccaacggcgcgaagcagcaggccctgagctcgcgcatcggcctgggcatgacggacaacatccgccccgagagcgtgaacgccaacaccttcatcgtgcggccggtgggcggcaacacgctcgcgggcacctacagcgtgcagctgggcatcatcaatttccacccggagctgccgctttctccgggcaccagctatgaagtgttcctgcccgccaacggggtgaaggactatgcgggcaatgccatcggcgccgacttcaagtcgaccttcaacaccggcaacgcgaccgacatcaacctgcagcactactggacgctggccggcaacctgtccgacccgatcggcagcaacaacggcacgccggcgtcgggcgatacctttgaaagcatcggcatgagcttcgcgaaccgcaccgccggcgtgccgctgaagaacgacagcgtcgccaccgtgctcggcggcaccgcgtcgctgagcttctacatgaagaccacgcaggccggcagcgcgaacccatggaccgcaccgggcatcttcgggcgcgaccaggccagcggagcggacgacgtgttctggggctggatcgacggcagcggcttcatgaacctctcggtcgcgaacaaggccgccaacaaccccggcacccgctcgctggcggccgtgaacgacggcaactggcaccacgtggtgatgacgcgcgacgcggcctcgggcgcgcaggccatgtacgtggacggcgtgaagaccagctccacgggcctcaccggcaccaaggggctcgcgaacaagttccaggtcatgggccagatccagggcaacgccgacctgttcaagggcacgctggcggaagtgcgcgtgtacagccgcgtgctcaccgacggcgaggtggccacgctgcgcgggcaggcgatcatcggcgaccccggcatcggcggcggtccgaagatcgtcaacggccaactggtgttcgacccggccacgctcggcagcagcggcgcgcagttccgctggaacttcggcgacggcacgcggacggcctactccacccagccgcgctacacctatacctacacgcgaccggggcactacaccgtgacgctgacggtgcgcgacgcaagcggccgcgagactttctacacctacaacctcaccgtgatcgtgccggtcacggcgcgggcgcccacgcacacgaccaacatcgcaggcgatgcgaattcggtctactcgctcaaccccgacagcggcacggtcgccgccgtcgacgcgcagaccctggccaagcgctgggaagtgcgcgtgggcgacgagccgaagacgctggccgtgggaccggatgggcgcatctgggtcgcggtgcagggcgaggacaagctggtggcgctcagcgcggccgacggcagcctctcggccaccgtgccgctggcctacggcagcggcccctacggcgtggccttcacgcccgacggcgcgaagggcttgctgacgctggagagcaagtcggtgctgatgagcttcgacccgagcaacggcgccaccaccggcgcggttgcgctcgaaggcagcctgcgcggcattgccgtgagctccgatgcgcaggtggcctacgtcacccgcttcaagtcgaagctgacgggcggccagctgcacaaggtgaacctgcagagcatgagcgcgatgcccacgatcgcgctgccggtggacaccaccacggtggacaccgagagccgcgcgcgcggcgtggccaactacctgagccaggtggtgatctcgcccgacggccggcgcgcggtgctgccttcgaagaaggacaacatcgtgcgcggccgcttccgcgacggcgtggacctgacgcacgaccagagcgtgcgttccatcctctcgcaggtcgacctgcaggcggcggcggaagtgttcggcgagcagatcgacttcgacgaccgcgcaccggcgcgtgcggcgctgttctctccgcccggcgactacctcttcgtggcgcagatggaaggcaaccgcgtcgccatcgtcgacccgtacagccgggccgtgcgcggagagatcaacgcgagcagtgcgccgcacggcctgtacctggacgcggcgcgcaagcggctgttcgtcaacaacttccttgcgcgctcggtgtcggtgcacgacgtgtcgctggtgctatcgtcggaatcggcggcggcgaccttcctgcagaacgtggcgacggtcgcgcaggagccgatggcggccgcggcgctgcgcggcaagcaggtgttctacaacgcctccgaccggcgcatgagcaaggacaactacatctcctgcgcgagctgccatgcggacggcggcgatgacggcatggtgtgggacttcacgcagcgcggcgagggcctccgacgcaccatcagcctcatgggccggcgcggcgcgggccacggcaagatgcactggaccgccaacttcgacgaggtgcaggacttcgagaacgacatccgcaacgagttcggcggcacgggctttctgacgaatgcggatttcgccgccacggtcgaccccttgggcgcgcccaaggccggcaagagtgcgcagctcgacgatcttgcggcctacctgagttcgctgaacaagtacatgcgcagcccggcgcgtgcggcggacggcagcttgagcgtggaggcggcgcgcggccagacggtgttcaacaccgcgcagtgcgccacctgccacaccggcggtactttccgcgacggcctgcggcacgacgtgggcacgatccagctctcgtcgggcaagggccacaaccagcccctcgcggggctgggcttcgacacgccgacgctctcgggcacctggaacacggcggccttcttccacaacgggcaagccgcgacgctgcaggacgtgctgaacagcggccacggcaatgcctcgagcctgccgccagcggacgtggtggcgctgcgcgagtacgtgcgctcgctggacacggccccggcggtggtgacgcggctgcgctcggacctcaatccgacgatgtgcgtgaacatcaagggcggggcgacggcgagcggcacggtggcggtgcagtggccctgcggcacggcgagccacgagaagttcacggtgacgtcggtcacgggcggctatgtgcagctggtggccgagcacagcggcctgtgcctggcgcagaacggcaccgcgacgaccaacgcgccggtggtgcagctggcatgcacggtgggcaacacggcgcagtggagtctggccgtcggcacgctgcgcaaccgcgcctcgggctcgtgcctcgacgtgccgaatggctcgacgacgcaggacacggcgctgatcacgtggacctgcaatggggggaacaaccagaactggacgcagctgccttag

SEQ ID NO: 2015 - DNA, 4722 bp, Variovorax sp.
atgaagatccggtatttcctgatggcgttcctggcgccgctcgtcacattgctgacgcatgcggccatcaccggggtaagtccgatgacaaccctcagcaacatggccacggcggtttccgaagccgtcgcggacccgctcccggtgcagggaccgggtctgggcaacctcacctacacctcggcggaactgttcaagccggtgtcgatgatcacgagcgccgcgcacccgctcgatccggcgcacagcagcgcctacgagtcgcgcgaggtacccgccacttaccccggccgcaaggactacggcatgaacgcgggcatcatggtcaacggctacttcctcacctccttcgcgccggacagcggcctcggcccgggcggcttcctgctgtacgacgtgtcgaacccgcgccagatccggctggtcaagaagatctacgagcccgaaggccgcacccaggagttccgcgaaacgcactccttcggcaccgcaaagatcggcggcaagacgtatgtggtgctgccgagcatcaacggcgtcgagttctgggacttcaccgacatcaacgacatcaagcaggtgaagaagctggcgctgcccggcgtcaacgccggcgactacgagaacgtggcctggcagctctggtggcaagcgccctatctgtacgtggcctcggcgggccggggcatgttcatcgtcgatgccaaggaccccgcgaacgccgttgtcgccaaccgcggcgccggcaagcccaacccggtgcccaccggcgaactcggcggctttcgcatcggcccgatcttcacgatggggaaccacatggtgttgaccgccatggaaagcaacggcggtttcgcgagcctggacatctccgacccgctcaaccccaaggtgctcgattccatcgtgggcaccacgccgttctactacgcgacctgcttcgacggccggaacctgcacgtctccacgcgcaacagcggcgccaggatgtacagctacgacctgagcgaccgctcgcgcttcgtggccgaggacaaccggctggtcatcgatgaacagctgtactgcgccacgcaggacaactatgtgatccagggcgcccagacacgcatccacaaggtcgacgtgagcaatccactgaaccacgtggaggtgggccgcggcagcatcctgcgcgaggacgacccgaacttctcgcattcggacaacggccaggtcgcgatgttcggcaatctcgtcttcgtgggcaacgaccacggctcgggcagcggcttcatcgtgcatgcggtggaccccgacaccactaagccggaagtgaagcaggtctcgcccgccaatggcgcaaagcagcaggcgctgacgtcgcgcatcggcgtcggcatgaccgacaacatccggcccgagagcgtgaacgccaacaccttcgtcgtgcgcgcggtgggcggcaacacgctcgcgggcacctacagcgtgcagctgggcatcatcaacttctttcccgaccagccgctttctccgggcaccagctatgaagtgttcctgcctgccaacggtgtgaaggactatgcgggcaacgccatcggcaccgacttcaagtcggtcttcaacaccggcaatgcgaccgacatcaacctgcagcactactggaccctggcgggcaacctctccgaccagatcggcagcaacaacggcacgccggcctcgggcgatgcattcgagagcatcggcatgaacttcgcggcgcgcaccgccggcgtcccgctgaagaacgacaccgtcgccacggtgctcggcggcaccgcgtcgctgagcttctacatgaagaccacgcaggccggcagcgccaacccgtggaccgccccgggcatcttcgggcgcgaccagcccagcggcgcggacgacgtgttctggggttggatcgacaacagcggcttcatgaatctctcggtggccaacaaggccgccaacaacccgggcacccgttcgccggcggccgtgaacgacggcaactggcaccacgtggtcatgacgcgcgatgcggcctccggcgcgcaggcgatgtacgtggacggcgtgaagaccagctccaccggtctcaccggcaccaagggccttgcgaacaagttccaggtcatgggccagatccagggcaacacagacctgttcaagggcacgctggcggaagtgcgcgtgtacagccgcgtgctcaccgacaccgaggtggccacgctgcgtgggcagaccatcatcggcgacccaggcatcggcggcggtccgaagattgtcaatggccaactggtgttcgaccccgccacgctcggcagcagcggcgcgcagttccgctggaacttcggcgacagcacgcaaaccgcctattccacccagccgcgctatacctacacctattcgcggccgggccactacaccgtgacgctgacggtgcgcgacgcgagcgggcgcgaaagcttctacacctacaacgtgacggtgatcgcaccggtgaccgcgaggccgcccacgcacaccaccaacatcacgggcgatgcgaacgcggtgtactccgtcaatcccgacagcggcacggtcgcctcgatcgacgcgcagacactggccaagcgctgggaaacgcgcgtcggcgacgagccgaaaacgctggccgtgggcccggacggccgcatctgggtcacggtgcaaggcgaggacaagctggtggcgctcagcgcggccgacggctcgctctcggtcaccgtgccgctggcctacggcagcggcccctacggcgtggccttcacgcccgatggcgcaaagggcctgctgacgctggagagcaagtcggtgctgatgagcttcgacccgagcaacggcgccaccaccggcgcggtcgcgctggaaggcaccctgcgcggcatcgcggtgaactccgattcgcaggtggcctacgtcacgcgcttcaagtcgaagatgaccggcggccagctgcacaaggtgaacctgcagaacatgagcgccatggccaccatcgcgctgccggtggacaccaccacggtggacaccgagagccgcgcacgcggcgtggccaactacctgagccaggtggtgatctcgccggacggaaagcgcgcggtgctgccttcgaagaaggacaacatcgtgcgcggcaagttcagggacggcaacaacctggtgcacgaccagacggtgcgctccatcctctcgcaggtcaacctgcagtcggccgcggaagtcttcgccgagcagatcgacttcgacgaccgtgcaccggcacgcgccgcgctgttctcgccctcgggcgattacctcttcgttgcgcagatggaaggcaaccgcgtggccatcgtggatccgtacagccgcgcggtgcggggcgagatcaatgccagcagcgcgccgcacggcctctacctggacgcggtgcgcaagcgcctgtttgtcaacaacttcctcgcgcgctcggtgtcggtgcacgacgtagcctcggtgctgtcgtcggaatcggcggcgccgatcttcctgcagaacgtggcgacggtcgcgcaggagcccatggcggccgcggcattgcgcggcaagcaggtgttctacaacgcgtccgaccggcgcatgagcaaggacaactatctctcctgtgcgagctgccatgccgatggcggcgacgacggcatggtatgggacttcacacagcgcggcgaaggcctccgacgcaccatcagcctcatgggcaagcgcggcgcgagccacggcaagatgcactggaccgccaacttcgacgaggtgcaggatttcgagaacgacatccgcaacgagttcggcggaacgggcttcttgagcaatgccgacttcgcggcgacgtccgatccgttgggcgcacccaaggccggcaagaacgcgcagctggacgatcttgcggcctacctgagctcgctcaacaaatacatgcgcagcccggcgcgcgcggcggacggcagcctgagcgtcgatgcggcgcggggccaggcgctgttcacctcggcgcagtgcgcgacctgccactcgggcggcaccttccgcgacggcctccggcacgacgtgggcacgatccaggcctcttcgggcaagggcatgaaccagccgctggcgggtgtgggcttcgacacgccgacactgtcgggcacctggaacaccaccgcgttcttccacaacggacaggccgcgacgctgcaggacgtgctcaccagtggccacggcaacgccaacagcctgcccgcggcagaccaggtggcgatccgcgagtacgtgcggtcgcaggacacggctccggccgtcgtcacacgcgtccgctcggacctcaaccccacgatgtgcgtgaacatcaagggcgtgtccaccaccagcggcgcgacggcggtgcaatggccgtgcggcaacgcaagcaacgagaagttcacggtgaacagcctcaccggcggctatgtgcagttcgtggccgagcacagcggcctgtgcctggcgcagaacggcaccgcgacgacgaatgcaccggtggtgcagctggcctgcacggcgggcaacacgacccagtggagcctggtgggagggaccatccggaatcgcgcctcgggttcctgcctggacgtgcccaacgggtccactgcgcaggacaccgcattgataacgtggacctgcaacggcggcaacaaccagaactggacgcagcttccgtag

SEQ ID NO: 2016 - DNA, 4710 bp, Variovorax sp.
atgaagatccggtattacctgatggctttgatggtgccgttcgtcacactgctgacgcacgcggcaatcaccggggtcagtccgatgacgaccctgggcaacatggcggcggcggtttccgaagctgtcgccgacccgctcccgctgcagggtccgggcctgggcaacctcacctacacctcggcggaactgttcaagccggtgtcgatgatcaccagcgcggcgcacccgctcgatccggcacacagcagcgcctacgagtcgcgcgaggtgcccgccacctacccgggccgcaaggactacggcatgaacgcgggcatcatgatcaacggctacttcctcacctccttcgcgccggacagcggcctcgggccgggcggtttcctgctgtacgacgtgtcgaacccgcgccagatccagctcgtcaagaagatctacgagcccgaggcccgcaccaaggagttccgcgagacccattccttcggcaccgcgaagatcggcggcaagacgtatgtcgtcctgcccagcatcaacggcatcgagttctgggacttctccgacatcaacgacatcaagcaggtgaagaagctggcactgccaggcgtcaacgggggcgactacgaggacgtcgcctggcagctctggtggcaggcgccttacctgtacgtggcgtcggccggccgaggcatcttcatcgtcgatgccagggaccctgcgaacgccgtgatcgcgaaccgcggcgcgggcaagcccaatccggtgcccaccggcgaactcggcggtttccgcatcggcccgatcttcacgatgggcaaccacatggtgctgaccgcgatggaaagcaacggcggcttcgcgagcctggacatctccgatccgctcaaccccaaggtgctcgattccatcgcgggcaccacgccgttctactacgccacctgtttcgacggcaggaacctgcacgcctccgcgcgcaacagcggcgccaggatgtacagctacgacctgagcgaccgctcgcgcttcgtggccgaggacaaccggctcgtcatcgacgaaatgctgtactgcgccacgcaggacaactacgtgatccagggcgcgcaaacgcgcatccacaaggtcgatgtgagcaatccgctcaatcacgtggaggtgggccgcggcagcatcctgcgcgaggacgacccgaacttctcgcattcggacaacggccaggtcgcgatgtttggcaacctggtcttcgtgggcaacgaccacggctcgggcagcggcttcatcgtgcatgcggtggaccccgacaccaccaagcctgaagtcaagcaggtctcgccggccaacggcgcgaagcagcaggcgctgacctcgcgcatcggcctgggcatgacggacaacatccggcccgagagcgtgaattccaacaccttcatcgtgcggccggtgggcggcaacacgctggcgggcacctacagcgtgcagctgggcatcatcaacttctcgcccgaccagccgctgcaacccggcaccagctatgaagtgttcctgccggccaacggcgtgaaggactatgcgggcaacgccatcgcggccgactacaagtcgaccttcaacaccggcaacgcgaccgacatcaacctgatgcactactggacgctggcgggcaacctgtccgaccagatcggcagcaacaacggcacgccggtcgcgggcgacgcgttcgagagcatcggcctgaacttcgcgaaccgcaccgccggcgtgccgctgaagaacgattcagtggccaccgtgctcggcggcaccgcgtcgctgagcttctacatgaagaccacgcaggcgggcggtgcgaactcgtggaccgcgcccggcatcttcgggcgcgaccaggcgagcggcacggacgacgtgttctggggctggctcgacaacggcgggcgcatcaagctgtcggctggcaacgacgccggcaccacctccaccgcggcggtgaacgacggcacctggcaccacgtggtgctgacgcgcgaggcggcctccggcgcccaggccgtgtacgtggacggcgtgaagaccacctccaccggccccacgggcaacaagggcctcacgaacaagttcagcgtgctggggcagatccagggcaatgccgcgctcttcaagggcacgctggcagaggtgcgcgtctacagccgcgtgctgagcgacaccgaggtcaacacgctgcgcagccaggccatcatcggcgaccccggcatcggcggcggtccgaagctggtcaacggccagctggtgttcaacccgggcacgctcggcagcagcggcgcgcagttccgctggaacttcggcgacggcacgcagacggcgtactcgaaccagccgaactacacctacacctacaaccgcccgggccacttcacggtgacgctgacggtgaaggacgtgaacggccgcgagaccttctacacctacaacctcaccgtgatcgccccggtcacggcgcgggcgccgacgcacaccaccaacatcgcgggcgatgcgaattcggtgtactcggtaaaccccgacagcggcacggtcgccgccatcgatgcgcagaccctggccaagcgctgggaaacgcgcgtgggcgacgagccgaagacgctggccgtcggccccgacggacgcatttgggtcacggtgcagggcgaggacaagctggtcgcgctgagcgcggccgacggcagcctctcgaccaccgtgccactggcctacggcagcggcccctacggcgtggccttcacgccggacggtgcgaaaggtctgctcacgctggagagcaagtcggtgctgatgagcttcgacccgagcaacggcagcactaccggcgcggtcgcgctcgaaggcaacctgcgcggcatcgcggtcaacgccgactcgcaggtggcttatgtcacgcgcttcaagtcgaagatgaccggcggccaattgcacaaggtcaacctgcagggcatgagcgccatgaccaccatcgcgctgccggtggacaccgccacggtggacaccgagagccacgcgcgcggcgtggccaactacctgagccaggtggtgatctcgccggacggaacgcgggcggtgctgccctcgaagaaggacaacatcgtgcgcggcaagttcagggacggccttgcgctggagcacgacaagacggtgcgttccatcctctcgcaggtcaacctgcagacggcagcggaagtgttcgccgagcagatcgacttcgacgaccgcgcaccggcgcgcgcggcgctgttctcgccgtcgggcgactacctcttcgtggcgcagatggaaggcaaccgcgtggccatcgtcgatccgtacagccgcgcggtgcgcggcgagatcaacaccagcagcgcgccgcatggcctgtacctggacgcgacgcgcaagcgcctgttcgtcaacaacttcctggcgcgctcggtgtccgtgcacgacgtggcttcggtgctgtcgtccgagacggcggccgcgatcttcctgcagaacgtggcgacggtggcacaggaaccgatggcggccgcggcgctgcgcggcaagcaggtgttctacaacgcctccgaccgtcgcatgagcaaggacaactacatctcctgcgcgagctgccacgcagacgccggtgacgacggcatggtgtgggacttcacccagcgcggcgaaggcctgcgccgcaccatcagcctgcaggggcggcgcgggctgggccacggcaagctgcactggacggccaacttcgacgaggtgcaggacttcgagaacgacatccgcaacgagttcggcggcaccggcttcctgacgaatgcggacttcgcggccacctccgacccgctcggtgcgcccaaggccggcaagaatgcgcagctcgacgaccttgcggcctacctgagctcgctgaacaagtacatgcgcagcccggcgcgcaatgccgatggcagcctgagcgtcgatgcggcgcggggccaggcactgttcacctcggcgcagtgcgtgacctgccacgcgggcggcaccttccgcgacggcatccggcacgacgtgggcacgatccaggcctcgtcgggcaagggcatgaaccagccgctcgcgggcatcggcttcgacacgccgacgctgtcgggcacctggaacaccgccgccttcttccacaacggccaggcggccacgctgcaggacgtgctcggcagcggccatggcaatgccaacagcctgccggccgccgacgtggtggcgatccgcgagtacgtgcgctcgcaggacacggccccggccgtcatctcgcgcatccgctcggacctcaaccccaccctgtgcgtgaacatcaagggtgcggcgaccaccagcggcgcgacggccgtgcaatggccgtgcggtacggcgggcaacgagaagttcacggtgacgagcctccccggcggctacgtgcagttcgtggccgagcacagcgggctgtgcctggcgcagaacggcacggcgacgacgaatgcgccggtggtgcagctggcgtgcacggcgggcaacgcggcgcagtggagcatggtcggcgggagcatccgcaaccgcgcctcgggttcgtgcctggacgtgccgaacagctcgacggcgcaggacacggcgctgatcacatggacctgcaacggcgggaacaaccagaactggacacagcttccgtag

SEQ ID NO: 2017 - DNA, 4710 bp, Variovorax sp.
atgaagatccggtattacgtgatggcattgatggtgccgttcgtcacactgctgacgcacgcggcgatcaccggggtcagtccgatgacgaccctcggcaacatggcgacggcggtctccgcagccgtcgccgacccgctcccgctgcaggggccgggcttgggcaacctcacctacacctcggccgaactgttcaagccggtgtcgatgatcaccagccccaaccacccgctcgacccggcgcacagcagcgcctacgagtcgcgcgaggtgcccgccacctacccgggccgcaaggactacgggatgaacgcgggcatcatggtcaacggctacttcctcacctccttcgcgccggacagcggcctcggcccgggcggcttcctgctgtacgacgtgtcgaacccgcgccagatccagctggtcaagaagatctacgagcccgaggcgcgcaccaaggagttccgcgagacgcactccttcggcaccgccaagatcggcggcaagacctacgtggtgctgcccagcatcaacggcgtcgagttctgggacttcaccgacatcaacgacatcaagcaggtgaagaagctggcgctgcccggcgtcaacgccggcgactacgagaacgtggcctggcagctctggtggcaggcgccctacctgtatgtggcctcggcgggccggggcatgttcatcgtcgacgcgagggaccccgcgaacgccgtcgtcgccaaccgcggcgccggcaagcccaacccggtgcctaccggcgagctcggcggctttcgcctcggcccgatcttcacgatgggcaaccacatggtgctgaccgcgatggaaagcaacggcggtttcgcgagcctggacatctccgacccgctcaaccccaaggtgctcgattccatcgtgggcaccacgccgttctattacgcgacctgcttcgacggcaagaacctgcacgtctccacgcgcaacagcggcgcgaagatgtacagctacgacctctccgaccgctcgcgcttcgtggccgaggacaaccgcctggtcatcgacgagcagctctactgcgccacgcaggacaactacgtcattcaaggcgcgcagacccgcatccacaaggtggacgtgagcaatccgctcaaccacgtggaggtgggccgcggcagcatcctgcgcgaggacgacccgaacttctcgcactcggacaacgggcaggtcgcgatgttcggcaacctggtcttcgtgggcaacgaccacggctcgggcagcggtttcgtcgtgcactcggtggacccggacatcaccaagcctgaagtcaagcaggtctcgcccgcgagtggtgcgaagcagcaggcgctgacctcgcgcatcggcctcggcatgacggacaacatccggcccgagagcgtgaacgccaacaccttcatcgtgaggccggtgggcggcaacacgctggcgggtacctacagcgtgcaactgggcatcgtcaacttccaccccgagcagccgctgctgccgggcacgagctacgaggtgttccttccggccaacggcctgaaggactatgcgggcaacgcgatcgccgcggactaccgatcgaccttcaacaccggcaacgcgaccgacatcaacctgatgcactactggacgctggcgggcaacctctccgaccagatcggcaacaacggcggcacgccggccgcgggcgatgcgttcgagagcatcggcatgaacttcgcgaaccgcactgccggcgtgccgctgaagaacgacagcgtggccaccgtgctgggcggcaccgcctcgctgagcttctacatgaagaccacccaggcgggcggccccaattcgtggaccgcgcccggcatcttcgggcgcgaccagtcgggcggcgctgacgacgtgttctggggctggctcgacagcaacgggcgcatcaagctgtccgtaggcaacgacggcggcaccacttccaccgcggtggtgaacgacggcaactggcatcacgtggtgctcacgcgcgacgcggcctccggtgcgcaggcggtgtacgtcgacggcgtgaagaccacttccgccggccttacgggcaccaagggcctcgcgaacaagttcaatgtgctcggccagatccagggcaatgcggcgctcttcaagggcacgctggcggaagtgcgcgtctacggtcgcgtgctctccgacaccgaggtgaacacgctgcgcgggcaagccatcatcggcgacccgggcatcggcggcgggccgaagctcgtcaacggccagctggtgttcaaccccggcacgctcggcagtggcggcgcgcagttccgctggaacttcggcgacggcacgcagaccgcctattccaaccagccgaactacacctacacctatacgcgccccggccacttcacggtgacgctgacggtgaaggatgccaacggacgcgagaccttctacacctacaacctgacagtgatcgtcccgacgacggcgcgggcgcccacgcacacgaccaacatcgcgggcgatgcgaactcggtgtactcggtcaaccccgacagcggcacggtcgccgccatcgatgcgcagaccctcgccaagcgctgggaagtgcgcgtgggcgaagaggccaagacgctggcggtcggccccgacggccgtgtctgggtcacggtgcagggcgaagacaagctggtggcgctcaatgcggccgacggcagcgtctcggccaccgtgccgctcgcctacggcagcggcccctacggcgtggccttcacgcccgacggcgccaagggcctgctgacgctggagagcaagtcggtgctcatgagcttcgacccgagcaacggcgccaccaccggcgcggttgcgctcgaaggcaacttgcgcggcatcgcggtgagctccgatgcgcaggtggcctacgtcacgcgcttcaagtcgaagatgacgggcggccagctgcacaaggtgaacctgcagagcatgagcgccatgaccaccatcgcgctgccggtggacaccaccacggtggacaccgagagccgggcgcgcggcgtggccaactacctgagccaggtgatcatctcgccggacggcacgcgggcggtgctgccttcgaagaaggacaacatcgtgcgcggcaagttcagggacggcaacaacctggtgcacgaccagacggtgcgttccatcctctcgcaggtcaatttgcagacggccgcggaagtgttcggcgagcagatcgacttcgacgaccgggcacccgcgcgcgcggcgctgtactcgccgtcgggcgactacctcttcgtcgcgcagatggaaggcaaccgcgtggccatcgtcgatccgtacagccgctcggtgcgcggcgagatcaacgccagcagcgcgccgcacggcctgtacctggacgcggcgaggaagcggctctacgtcaacaacttcctcgcacgctcggtgtcggtgcacgacgtggcctcggtgctggcctcggagacggcggcgccgatcttcctgcagaacgtctcgacggtcgcgcaggaaccgatgtcacccgcggcgctgcgcggcaagcaggtgttctacaacgcgtccgaccggcgcatgagcaaggacaactacatctcctgcgcaagctgccacgcggatgccggcgacgatggcatggtgtgggacttcacccagcgcggcgagggcctgcgccgcaccatcagcctcatgggcaagcgcggcctcggccacggcaagctgcactggacggccaacttcgacgaggtgcaggacttcgagaacgacatccgcaacgagttcggcggcaccggcttcctgagcaacgcggacttcacggccacgcaggacccgctgggcgcacccaaggccggcaagaacgcgcagctcgatgacctggcggcctacctgacctcgctgaacaagtacatgcgcagccccgctcgcaacgccgacggcagcctgagcgtcgatgcggcgcgggggcaggcactgttcgcttcggcgcagtgcgtgacctgccacaccggagccaccttccgcgacggacagcggcacgacgtgggcaccatccagctctcgtcgggcaagggcagcaaccagccgctggcgggcgtgggcttcgacaccccgacgctcgtgggcacctggaacacctcggccttcttccacaacggccaggcggccacgctgcaggacgtgctggccagcggtcacggcaacgccagcagcctgccggcggccgacgtggtggcgatccgcgagtacgtgcggtcgcaggacaccgacccgacgccgacgatcacccgcatccgttcgaacctcagcaacctctgcgtgaacatcaagggcgtatcgaccgccagcggcgcgacggcggtgcagtggccgtgcggcaatgcgaacaacgagcggttcacggtgaccaacctcacgggcggctacgtgcagttcaaggccgagcacagcggcctgtgcctggcgcagagcggcaccgcgacgacgaacgctgcggtggtgcagctggcctgctcggccggcgacacgacgcagtggagcctcgcgggcggtgcgatcaagaaccgcgcctcgggttcgtgcctggacgttccgaacagctcgacgacgcaggacactgcgctgatcacctggacctgcaacggcggcaccaaccagagctggacgcaactgccctga

SEQ ID NO: 2018 - DNA, 4710 bp, Variovorax sp.
atgaagatccggtactacgtgatggcattgatggtgccgttcgtcacactgctgacgcacgcggcaatcaccggggtcagtccgatgacgaccctcagcaacatggccacggcggtctccgaagcagtggccgacccgctcccgctgcagggaccgggcctgggcaatctcacctacacctcggcggaactgttcaagccggtgtcgatgatcaccagccccaaccacccgctcgatccggcgcacagcagcgcctacgagtcgcgcgaggtgcccgccacctacgcgggccgcaaggactacggcatgaacgccggcatcatggtcaacggctacttcctcacctccttcgcgccggacagcggcctcggcccgggcggcttcctgctgtacgacgtgtcgaacccgcggcagatccagctcgtcaagaagatctacgagccggaggcccgcaccaaggagttccgcgagacgcactccttcggcaccgcgaagatcggcggcaagacgtatgtggtgctgcccagcatcaacggcgtcgagttctgggacttcaccgacatcaacgacatcaagcaggtgaagaaactcgcgctgcccggtgtcaattccggcgactacgagaacgtggcgtggcagctctggtggcaggcgccctacctgtacgtggcctcggccggccgcggcatgttcatcgtcgatgcacgggacccggcgaatgccgtggtcgccaaccgcggcgcgggcaagcccaacccggtgcccaccggcgaactcggcggtttccgcctcggcccgatcttcacgatgggcaaccacatggtgctgaccgcgatggaaagcaacggcggtttcgcgagcctggacatctccgacccgctcaaccccaaggtgctcgattccatcgtgggcaccacgccgttctattacgcgacctgcttcgatggcaggaacctgcacgtctccacgcgcaacagcggcgcgaagatgtacagctacgacctctccgaccgatcgcgcttcgtggccgaggacaaccggctggtcatcgacgagcagctctattgcgccacgcaggacaactacgtcattcaaggcgcgcagacgcgcatccacaaggtggacgtgagcaatccgctcaaccacgtggaagtgggccgcggcagcatcctgcgcgaggacgatccgaacttctcgcactcggacaacggccaggtcgcgatcttcggcaacctcgtcttcgtgggcaacgaccacggctcgggcagcggcttcgtcgtgcatgcggtggacccggacatcgtcaagccggaagtgaaacaggtctcgcccgccaacggcgcgaagcagcaggcgctgacatcgcgcatcggcctgggcatgaccgacaacatccgccccgagagcgtgaactccaacaccttcatcgtgcgtccggtgggcggcaacacgctggcgggcacctacagcgtgcagttgggcatcgtcaacttccatcccgagcagccgctgcagccgggcacgagctatgaagtgttcctgccggccaacggcctgaaggactatgcgggcaacgccatcggcgcggactaccgctcgaccttcaacaccggcaacgcgaccgacatcaacctgatgcactactggacgctggcgggcaacctctccgaccagatcggcaacaacagcggcacaccggcctcgggcgacgcgttcgagagcatcggcatgaacttcgcgaaccgcaccgccggtgtgccgctgaagaacgacggcgtggccaccgtgctcggcggcaccgcatcgttgagcttctacatgaagaccacgcaggcgggcggtgcgaactcctggaccgcgcccggcatcttcgggcgcgaccagccgagcggtgcggacgatgtgttctggggctggctcgacagcaacgggcgcatcaagctctcggtcggcaacgacggcggcaccgcctccaccgcggcggtgaacgacggcaactggcatcacgtggtgctgacgcgagatgcggcctcgggcgcgcaggcggtgtacgtcgacggcgtgaagaccacctccgcgggcctcaccggcaccaagggcctcgcgaacaagttcagcgtgctgggccagatccagggcaacacggcgctcttcaagggcacgctggcggaggtgcgggtctacggccgcgtgctgtccgacaccgaggtgaacacgctgcgcgggcaggccatcatcggcgaccccggcatcggcggcggaccgaagctggtcaacggccaactggtgttcaaccccggcacgttggggagcagcggcgcgcagttccgctggaacttcggcgacggcacgcagacggcctactcgaatcagccgaactacacctacacctacacgcgccccggccacttcacggtgacgctgacggtgaaggacgccaacggccgcgaaaccttctacacctacaacctcaccgtgatcgttccgaccacggcgcgggcgcccacgcacaccaccaacatcgcgggcgatgcgaactcggtgtactcggtcaaccccgacagcggcacggtcgccgccatcaactccgaaacgctggccaagcgctgggaagtgcgcgtgggcgacgaggcgaagacactggcggtcggccccgacggccgcatctgggtcacggtgcagggcgaagacaagctggtggcgctcaacgcggccgacggcagcgtctcggccaccgtgccgctcgcctacggcagcggcccctatggcgtggccttcacgcccgatggcgccaagggcttgctgacgctggagagcaagtcggtgctgatgagcttcgacccgagcaacggcgccaccaccggcgcggtcgcgctcgaaggcaacctgcgcggcatcgccgtgagcggcgatgcgcaggtggcctacgtcacgcgcttcaagtcgaagatgaccggcggccagttgcacaaggtgaacctgcagagcatgagcgcgatgcccaccatcgccctgccggtcgacaccaccacggtcgacaccgagagccgtgcgcgcggcgtcgccaactacctgagccaggtgatcatttcgccggacggcacgcgggcggtgctgccttcgaagaaggacaacatcgtgcgcggcaagttcagggacggtatcaacctgtcgcacgaccagacggtgcgttccatcctctcgcaggtcaacctgcagacggccgcggaagtgttcgccgaacagatcgacttcgacgaccgggcaccggcacgcgccgcgctgtactcgccgtcgggcgactacctcttcgtcgcgcagatggaaggcaatcgcgtggcgatcgtcgatccgtacagccgctcggtgcgaggcgaaatcaacgccagcagcgcgccgcatggcctgtacctggacgcggcgaggaagcgcctgttcgtcaacaacttcctcgcgcgctcggtgtcggtgcacgacgtggcctcggtgctggcttcggagaccgcggcgccggtcttcctgcagaacgtctcgacggtcgcgcaggagccgatggcggccgctgcgctgcgcggcaagcaggtgttctacaacgcgtcggaccggcgcatgagcaaggacaactacatctcctgcgcgagctgccatgcggatgccggcgacgacggcatggtgtgggacttcacccagcgcggagagggcctgcgccgcaccatcagcctgatgggacggcgcggtctcggccacggcaagctgcactggacggccaacttcgacgaggtgcaggacttcgagaacgacatccgcaacgagttcggcggcaccggcttcctctcgaacgcggacttcacagccacgcaagacccgctgggtgcccccaaggccggcaagaacgcgcagctggacgatctcgcggcctacctcacctcgctgaacaagtacatgcgcagcccggcgcgcaacgcagacggcagcctcagcgtcgacgcggcgcggggccaggcgctgttcgcctcggcgcagtgcgtgacctgccacaccggcgccaccttccgcgacggacagcggcacgacgtgggcaccatccagctctcgtcgggcaagggcatgaaccagccgctggcgggcgtgggcttcgacacgccgacgctcttgggcacctggaacacgacggccttcttccacaacggacaggccgcgacgctgcaggacgtgctcgccggcggtcacggcaacgccagcagcctgccgcccgccgacgtggtggcgattcgcgagtacgtgcgatcgcaggacagcgacccgacgccgacgatcacgcgcatccgctcgaacctgagcaacctgtgcgtgaacatcaagggcgtgtcgacgaccagcggcgcgacggcggtgcagtggccgtgcggcactgcgagcaacgagaagttcacggtgacgagcctcacgggcggctacgtgcagttcaaggccgaacacagcggcctgtgcctggcacagagcggcaccgcgacgacgaacgcggcggtggtgcagctggcctgctcggccggcgacacgacgcagtggagcctggtgggcggcacgatcaagaaccgcgcctcgggttcgtgcctcgacgttccgaacgcctcgacggcgcaggacacggcgttgatcacctggacctgcaacggcggcaccaaccagagctggactcaactgccctga

SEQ ID NO: 2019 - DNA, 4710 bp, Variovorax sp.
atgaagatccggtattacgtgatggcattgatggtgccgttcgtcacactgctgacgcacgcggcaatcaccggggtcagtccgatgacgaccctcagcaacatggccacggcggtctccgaagcagtggccgacccgctcccgctgcagggaccgggcctgggcaatctcacctacacctcggcggaactgttcaagccggtgtcgatgatcaccagccccaaccacccgctcgatccggcgcacagcagcgcctacgagtcgcgcgaggtgcccgccacctacgcgggccgcaaggactacggcatgaacgccggcatcatggtcaacggctacttcctcacctccttcgcgccggacagcggcctcggcccgggcggcttcctgctgtacgacgtgtcgaacccgcgccagatccagctcgtcaagaagatctacgagccggaggcccgcaccaaggagttccgcgagacgcactccttcggcaccgcgaagatcggcggcaagacgtatgtggtgctgcccagcatcaacggcgtcgagttctgggacttcaccgacatcaacgacatcaagcaggtgaagaaactcgcgctgcccggtgtcaattccggcgactacgagaacgtggcgtggcagctctggtggcaggcgccctacctgtacgtggcctcggcgggccgtggcatgttcatcgtcgatgcacgggacccggcgaatgccgtggtcgccaaccgcggcgcgggcaagcccaacccggtgcccaccggcgaactcggcggcttccgcctcggcccgatcttcacgatgggcaaccacatggtgctgaccgcgatggaaagcaacggcggtttcgcgagcctggacatctccgatccgctcaaccccaaggtgctcgattccatcgtgggcaccacgccgttctattacgcgacctgcttcgacggcaggaacctgcacgtctccacgcgcaacagcggcgcgaagatgtacagctacgacctctccgaccgctcgcgcttcgtggccgaggacaaccggctggtcatcgacgagcagctctattgcgccacgcaggacaactacgtcattcaaggcgcgcagacgcgcatccacaaggtcgacgtgagcaatccgctcaaccacgtggaagtgggccgtggcagcatcctgcgcgaggacgatccgaacttctcgcactcggacaacggccaggtcgcgatcttcggcaacctcgtcttcgtgggcaacgaccacggctcgggcagcggcttcgtcgtgcatgcggtggacccggacatcgtcaagccggaagtgaaacaggtctcgcccgccaatggcgcgaagcagcaggccctgacctcgcgcatcggcctcggcatgaccgacaacatccgccccgagagcgtgaactccaacaccttcatcgtgcgtccggtgggcggcaacacgttggcgggcacctacagcgtgcagctgggcatcgtcaacttccatcccgagcagccgctgcagccgggcacgagctatgaagtgttcctgccggccaacggcctgaaggactatgcgggcaacgccatcggcgcggactaccgctcgaccttcaacaccggcaacgcgaccgacatcaacctgatgcactactggacgctggcgggcaacctctccgaccagatcggcaacaacagcggcacaccggcctcgggcgacgcgttcgagagcatcggcatgaacttcgcgaaccgcaccgccggtgtgccgctgaagaacgacggcgtggccaccgtgctcggcggcaccgcatcgttgagcttctacatgaagaccacgcaggcgggcggtgcgaactcctggaccgcgcccggcatcttcgggcgcgaccagccgagcggtgcggacgatgtgttctggggctggctcgacagcaacgggcgcatcaagctctcggtcggcaacgacggcggcaccgcctccaccgcggcggtgaacgacggcaactggcatcacgtggtgctgacgcgagatgcggcctcgggcgcgcaggcggtgtacgtcgatggcgtgaagaccacctccgcgggcctcaccggcaccaagggcctcgcgaacaagttcagcgtgctgggccagatccagggcaacacggcgctcttcaagggcacgctggcggaggtgcgggtctacggccgcgtgctcagcgataccgaggtgaacacgctgcgcgggcaggccatcatcggcgaccccggcatcggcggcggaccgaagctggtcaacggccaactgatgttcaaccccggcacgttggggagcagcggcgcgcagttccgctggaacttcggcgacggcacgcagacggcctactcgaatcagccgaactacacctacacctacacgcgccccggccacttcacggtgacgctgacggtgaaggacgccaacggccgcgaaaccttctacacctacaacctcaccgtgatcgttccgaccacggcgcgggcgcccacgcacaccaccaacatcgcgggcgatgcgaactcggtgtactcggtcaaccccgacagcggcacggtcgccgccatcaactccgaaacgctggccaagcgctgggaagtgcgcgtgggcgacgaggcgaagacactggcggtcggccccgacggccgcatctgggtcacggtgcagggcgaagacaagctggtcgcgctcaacgcggccgacggcagcgtctcggccaccgtgccgctcgcctacggcagcggcccctatggcgtggccttcacgcccgatggcgccaagggcttgctgacgctggagagcaagtcggtgctgatgagcttcgacccgagcaacggcgccaccaccggcgcggtcgcgctcgaaggcaacctgcgcggcatcgccgtgagcggcgatgcgcaggtggcctacgtcacgcgcttcaagtcgaagatgaccggcggccagttgcacaaggtgaacctgcagagcatgagcgcgatgcccaccatcgccctgccggtcgacaccaccacggtcgacaccgagagccgtgcgcgcggcgttgccaactacctgagccaggtgatcatttcgccggacggcacgcgggcggtgctgccttcgaagaaggacaacatcgtgcgcggcaagttcagggacggcaccaacctgtcgcacgaccagacggtgcgatccatcctctcgcaggtcaacctgcagacggccgcggaagtgttcgccgagcagatcgacttcgacgaccgggcgccggcacgcgccgcgctgtactcgccgtcgggcgactacctcttcgtcgcgcagatggaaggcaaccgcgtggccatcgtcgatccgtacagccgctcggtgcggggcgagatcaacgccagcagcgcgccgcacggcctgtacctggacgcgacgaggaagcgcctctacgtcaacaacttcctcgcgcgctcggtgtcggtgcacgacgtggcctcggtgctggcttcggagacggcggcgccggtcttcctgcagaacgtctcgacagtggcgcaggagccgatggcggccgcggcgttgcgcggcaagcaggtgttctacaacgcgtcggaccggcgcatgagcaaggacaactacatctcctgcgcgagctgccatgcggatgccggcgacgacggcatggtgtgggacttcacccagcgcggcgagggcctgcgccgcaccatcagcctgatgggacggcgcggcctgggccacggcaagctgcactggaccgccaacttcgacgaggtgcaggacttcgagaacgacatccgcaacgagttcggcggcaccggtttcctctcgaacgcggacttcacagccacgcaagacccgctgggcgcacccaaggccggcaagaacgcgcagctggacgacctcgcggcttacctcacctcgctgaacaagtacatgcgcagcccagcgcgcaacgccgacgggagcctcagcgtcgatgcggcgcggggccaggcgctgttcgcctcggcgcagtgcgtgacctgccacaccggcgccaccttccgcgacggacagcggcacgacgtgggcaccatccagctctcgtcgggcaaaggcatgaaccagccgctggcgggcgtgggcttcgacacgccgacgctggtgggcacctggaacaccacggccttcttccacaacggacaggccgcgacgctgcaggacgtgctcgccggcggccacggcaacgccagcagcctgccgcccgccgacgtggtggcgattcgcgagtacgtgcggtcgcaggacagcgacccgacgccgacgatcacgcgcatccgctcgaacctgagcaacctgtgcgtgaacatcaagggcgtgtcgaccaccagcggcgcgacggcggtgcagtggccgtgcggcactgcgagcaacgagaagttcacggtgacgagcctcacgggcggctacgtgcagttcaaggccgaacacagcggcctgtgcctggcgcagagcggcaccgcgacgacgaacgcggcggtggtgcagctggcctgctcggccggcgatacgacgcagtggagcctggtgggcggcgccatcaagaaccgcgcctcgggttcgtgcctggacgtgccgaacgcctcgacggcgcaggacacggcgctgatcacctggacctgcaacggcggcaccaaccagagctggactcaactgccctga

SEQ ID NO: 2020 - DNA, 4722 bp, unknown
  environmental sample
atgaagatccggtattacgtgatggcattgatggccccgctcgtcacactgttgacgcacgcggcaatcaccggggtcagtccgatgacgaccctgaacaacatggcgacggcggtctccgcggctgtcgccgacccgctcccgctgcagggaccgggcctgggcaacctcacctacacctcggcggaactgttcaagccggtgtcgatgatcaccagccccaaccacccgctcgatccggcgcacagcagcgcctacgagtcgcgcgaggtgcccgccacctacccgggccgcaaggactacggcatgaacgccggcatcatggtcaacggctacttcctcacttccttcgcgccggacagcggcctcggcccgggcggcttcctgctgtacgacgtgtcgaacccgcgccagatcaagctcgtcaagaagatctacgagcccgatgacgccacgggcggtcgcaccaaggagttccgcgagacgcactccttcggcaccgcgaagatcggcggcaagacctacgtggtactgcccagcatcaacggtgtcgagttttgggacttcaccgacatcaacgacatcaagcaggtgaagaagctggcgctgcccggcgtcaacgccggcgactacgagaacgtggcctggcagctctggtggcaggccccctacctgtacgtggcgtcggcgggccggggcatgttcatcgtcgatgcgagggaccccgcgaatgccgtggtcgccaaccgcggcgcgggcaagcccaatccggtgcccaccggcgaactcggcggtttccgactcggcccgatcttcacgatgggcaaccacatggtgctgaccgccatggaaagcaacggcggtttcgcgagcctggacatctccgacccgctcaatcccaaggtgctcgattccatcgtgggcaccacgccgttctattacgcgacctgcttcgacggccggaacctgcacgtctccacgcgcaacagcggcgcgaagatgtacagctacgacctcagcgaccgatcgcgcttcgtggccgaggacaaccgcctggtcatcgacgaacagctgtattgcgccacgcaggacaactacgtcattcaaggtgcgcagacgcgcatccacaaggtggatgtgagcaatccgctcaaccacgtggaggtgggccgcggcagcatcctgcgcgaggacgacccgaacttctcgcattcggacaatggccaggtcgcgatgttcggcaacctggtcttcgtgggcaacgaccacggctcgggcagcggcttcgtcgtgcactcggtggaccccgacatcaccaagcctgaagtgaaacaggtctcgcccgccaatggttcgaagcagcaggcgctgacctcccgcatcggcctgggcatgacggacaacatccgccccgagagcgtgaattccaacaccttcatcgtgcgcccggtgggcggcaacacgctggcgggcacctacagcgtgcagctgggcatcgtcaacttccaccccgagcagccgctgcaaccgggcacgagctatgaggtgttcctgccggccaacggcctgaaggactatgcgggcaacgccatcggcgcggactaccgctcgaccttcaacaccggcaacgcgaccgacatcaacctgatgcactactggacgctggcgggcaacctctccgaccagatcgccaacaacaacggcacgcccgccaccggcgatgcgttcgagagcatcggcctgaacttcgcgaaccgcaccgccggtgtgccgctgaagaacgattccgtggccaccgtgctgggcggcaccgcatcgctgagcttctacatgaagacgacgcaggcgggcggccccaattcgtggaccgcgccgggcatcttcgggcgcgaccagtcgggcggcgcggacgatgtgttctggggctggctcgacagcaatgggcgcatcaagctctcggtcggcaacgacggcggcaccacttccaccgcggcggtgaacgacggcaactggcaccacgtggtgctgacgcgcgacgcggcctcgggcgcgcaggcggtgtacgtcgacggcgtgaagaccacctcgaccggcctcacagggaccaagggcctcgcgaacaagttcaacgtgctgggtcaaatccagggcaacaccgcgatgttcaagggcacgctcgcggaggtgcgcgtctacggccgcgtgctgtccgacaccgaggtgaacacgctgcgcgggcaggccatcatcggcgaccccggcatcggcggcggaccgaagctcgtcaacggccagctggtgttcaaccccggcacgctcggcagcagcggcgcgcagttccgctggaacttcggcgacggcacgcagacggcctactcgaaccagccgaactacacctacacctacacgcgccccggccacttcacggtcacgctgacggtgaaggatgcgaacggccgcgagaccttctacacctacaacctcaccgtgatcgtcccgaccacggcgcggccgcccacgcacaccaccaacatcgcgggcgatgcgaactcggtgtattcggtcaaccccgacagcggcacggtcgccgccatcaactccgagacgctggccaagcgctgggaagtgcgcgtgggcgaagaaccgaagacgctggcggtcggtcccgacggccgcatctgggtcacggtgcagggcgaggacaagctggtggcgctcaacgcggccgacggcagcgtctcggccaccgtgccgctcgcctacggcagcggcccctacggcgtgaccttcacgcccgacggcgccaagggcctcctgacgctggagagcaagtcggtgctgatgagcttcgacccgagcaacggcagcaccaccggtgcggtcgcgctggaaggcaacctgcgcggcattgccgtcaactccgatgcgcaggtggcctacgtcacgcgcttcaagtccaagatgaccggcggccagctgcacaaggtgaacctgcagagcatgagcgcgatgaccaccatcgcgctgccggtggacaccaccacggtcgacaccgagagccgtgcgcgcggcgtcgccaactacctgagccaggtgatcatctcgccggacggcatgcgggcggtgctgccttcgaagaaggacaacatcgtgcgcggcaagttcagggacggcaacaacctggtgcacgaccagacggtgcgttccatcctctcgcaggtcaacctgcagacggccgcggaagtgttcgccgagcagatcgacttcgacgaccgagcaccggcacgcgccgcgctgttctcgccgtcgggcgactacctcttcgtcgcgcagatggaaggcaaccgcgtggccatcgtcgatccgtacagccgctcggtgcgcggcgagatcaacgccagcagcgcgccacacggcctgtacctggacgcggcgaggaagcgcctgttcgtcaacaacttcctcgcgcgctcggtgtcggtgcacgacgtggcttcggtgctggcctcggagacggcggcgccgatcttcctgcagaacgtctcgacggtcgcgcaggagccgatgtcgcccgcggcactgcgcggcaagcaggtgttctacaacgcatccgaccggcgcatgagcaaggacaactacatctcctgcgcaagctgccatgcggatgccggcgacgacggcatggtgtgggacttcacgcagcgcggagaaggcctgcgccgcaccatcagcctcatgggcaagcggggcctgggccacggcaagctgcactggacggccaacttcgacgaggtgcaggacttcgagaacgacatccgcaacgaattcgggggcacgggcttcctgagcaacgcggacttcgcggccacctccgacccgctgggtgcgcccaaggccggcaagaacgcgcagctggacgatctcgcggcctacctgacctcgctgaacaagtacatgcgcagcccggcgcgcaacgccgacggcagcctcagcgtcgacgcggcgcggggccaggcgctgttcgcctcggcgcagtgcgtgacctgccacaccggcgccaccttccgcgacggacagcggcacgacgtgggcaccatccagctctcgtcgggcaagggcatgaaccagccgctggcgggtgtgggcttcgacacgccgacgctgctgggcagctggaacaccgcggccttcttccacaacggccaggccgccacgttgcaggacgtgctcgccagcggccacggcaacgccagcagcctgccgcccgccgacgtggtggcgattcgcgagtacgtgcggtcgcaggacagcgacccgaccccgacgatcacccgcatccgttcgaacctcagcaacctgtgcgtgaacatcaagggcgtgtcgaccgccagcggcgcgacggcggtgcagtggccgtgcggcaatgcgaacaacgagaggttcacggtaacgagcctcaccggcggctacctgcagttcaaggccgagcacagcggcctgtgcctggcgcagagcggcaccgcgacgacgaacgcggcggtggtgcagctggcctgctcggccggcgacacgacgcagtggagcctcgtgggcggcgcgatcaagaaccgcgcctcgggttcttgcctcgacgtgccgaacagctcgaccacgcaggacaccgcgctgatcacctggacctgcaacggcggcaccaaccagagctggacccagttgccctga

SEQ ID NO: 2021 - DNA, 4707 bp, unknown
  environmental sample
atgaaaatccggtattacttgatggcgttcctgctgccgttcgtcacgctgctgacgcacgcggcaatcaccggggtcagtccgatgacgaccctgagcaacatggcgacggcgatggccgaagccgtggccgatcctctccccctgcagggaccgggcctcggcaatctcacctacacctcggccgagctgttcaagccggtctcgatgatcaccagtgccgcgcatccgctggaccccgcgcacagcaatgcctacgagtcgcgagaggtgcccgccacctacccgggccgcaaggactacggcatgaacgcgggcatcatgatcaacggctacttcctgacgtccttcgcgccggacagcggcctcggcccgggcggcttcctgctgtacgacatctcgaacccccgccagatcaagctcgtgaagaagatctacgagcccgagggccgcacgcaggagttccgcgagacgcactccttcggcaccgcgaagatcggcggcaagacctacgtcacgctgcccagcatcaacggcatcgagttctgggacttcaccgacgtcaacgacatcaagcaggtgaagaagctcgcgctgcccggcgtcaacggcggcgactacgagaacgtggcctggcagctgtggtggcaggcgccctacgtgtacgtggcctcggcgggccgaggcatcttcatcgtcgatgcctccgacccggccaacgctgtggtggcgaaccgcggcgcgaacaagcccaaccctgtgccaacgggcgaactcggcggtttccgcgtcggcccgatcttcaccatcggcaaccacatggtgctgagctcgatggacaacaccgcgggcttctccagcctcgacatctccgatccgctgaaccccaaggtgctggacgcgatcggctccaaccccaactactacgccacctgcttcgacggcaagaccctgcacgcatcggcacgcggcggcggcgccaagatgtacagctacgacctgagcgaccgctccaagttcgtggccgaggacaaccgcctcgtcgtcgacgagcagctctactgcgccacgcaggacagctacgtcttccagggcgcgcagacgcgcatccacaaggtcgacgtgagcaatccgctgaatcacgtcgaggtgggccgcggcagcatcctgcgcgaggacgatccgaacttctcgcactcggacaacggccaggtcgccgtcttcggcaacctggtgttcgtgggcaacgaccacggctcgggcagcggcttcatcgtgcaccaggtcgaccccgacaccaccaagccggaggtgcggcaggtctcgcccgccaacaacgcgaagcagcaggcgctgacctcgcgcatcggcctgggcatgagcgacagcatcctgcccgagagcgtgaactccaacaccttcatcgtgcgcccggtgggcggcaacacgctggcgggcacctacagcgtgcagctgggcatcatcaacttccaccccgcgcagccgctgcagcccggcaccagctatgaagtgttcctgccggccaacggcgtgaaggactatgcgggcaacgccatcgccgcggactacaagtcggtgttccacaccggcaacgccgccgagatcggcctgatgcactactggacgctggcgggcaacctctccgaccagatcggcgccaacaacggcacgcccgccaccggcgacgccttcgagagcatcggcctgaacttcgcgaaccgcacggtgggcgtgacgctcaagagcgacggcgtggcgaccgtgctcggcggcagcgcctcggtgagcctctacatgaagaccacgcaggccggcggggccaactcctggacggcgcccggcatcttcggacgcgaccagccctccggcgccgacgatgtcttctggggctggctcgacaacggcgggcgcatcaagctctcggtgggcaacgatgccggcaccgtctccaccgcggcggtgaacgacggcaactggcaccacgtggtgatgacgcgcgacgctgcctccggcgcgcaggccctgtacgtggacggcgtgaagaccacctccaccggccccacaggcaacaagggcctgtcgaacaagttcgccgtgctcggccagatccagggcaacacggcgctcttcaagggcacgctggcggaagtgcgcgtctacggccgcgtgctgagcgacaccgacgtgagcacgctgcgcagccaggccatcatcggcgaccccggcatcggcggcggtccgaagctggtcaacggccagctggtgttcaacccggccacgctgggcagcagcggcgcgcagtaccgctggaacttcggcgacggcacgcagaccgcctactcgaaccagccgaactacacctacacctacacgcgccccggccacttcacggtgacgctgacggtgaaggacgccagcggccgcgagaccttctacacctacaacctcacggtgatcatgccggtgactccgaacgcgccgacgcacagcaccaacatcgcgggcgacgcgaactcggtgtattcggtcaaccccgacagcggcacggtcgccgccatcgactctcagagcctcgtcaagcgctgggaagtgcgcgtgggcgacgagccgaagacgctggccgtgggccccgacgggcgcatctgggtcacggtgcagggcgaggacaagctggtggcgctcaacgccgccgacggcagcctctcggccaccgtgccgctggcctacggcagcggcccctacggcgtggccttcacgcccgacggcacgaagggcctgctgacgatggagagcaagtcgatactgatgagcttcaacccgagcaccggcgccaccaccggcgcggtcgcgctcgacggcgcgctgcgcggcatcgcggtcgagtcgggctcgcaggtggcctacgtcacgcgcttcaagtcgaagatgacgggcggccagctgcacaaggtgaacctgcagagcatgagcgccatgagcacgatcgcgctgccggtggacaccaccacgatcgacaccgagaaccgtgcgcgcggcgtggccaactacctgagccaggtggtgatctcgcccgacggcgcccgtgcggtgctgccctcgaagaaggacaacatcgtgcgcggcaaattccgcgacggcaacaacctggtgcacgaccagacggtgcgctccatcctgtcgcaggtcaacctgcagaccgcggcggaggtgttcgccgagcagatcgacttcgacgaccgggcgccggcgcgcgcggccctgttctccccctcgggcgactacctgttcgtcgcgcagatggaaggcaaccgcgtcgccatcgtcgatccgtacagccgcgcggtgcgcggcgagatcaacgccagcagcgcgccgcacggcctgtacctcgacgcggtgcgcaagcgcctgttcgtcaacaacttcctggcgcgctcggtgacggtgcatgacgtggcttcggtgctctcgtcggaaagcaacgtgccgaccttcctgcagacggtgtcgaccgtggcggcggaacccatgtcggcggcggcgctgcgcggcaagcaggtgttctacaacgcgtcggaccgccgcatgagcaaggacaactacatctcctgcgcgagctgccatgcggacggcggcgacgacggcatggtgtgggacttcacccagcgcggcgaaggcctgcgccgcaccatcagcctgcagggccggcgcggactgggccacggcaagctgcactggacggccaacttcgacgaagtgcaggacttcgagaacgatatccgcaacgagttcggcggcctcggcttcctgaccaacgcggacttcgcggccacctccgacccgctgggcgcgcccaaggccggcaagagcgcgcagctcgacgacctcgcggcctacctgagctcgctgaccaagtacatgcgcagcccggcgcgtgcggcggacggcagcctcagcgtggacgcggcgcgcggccagaccgtgttcaacacggcccagtgcgcgacctgccacaccggtgccaccttccgcgacggcgtgcggcatgacgtgggcacgatccaggcctcctcgggcaagggcctgaaccagccgctggcgggcgtgggcttcgacacgccgacgctgctgggcacctggaacaccaccgcgttcttccacaacggccaggcggccacgctgcaggacgtcctcacgagcggccacggcaatgcctccagcctgccggccaacgacgtggtggcgctgcgcgaatacgtgcgctcgctcgacaacgacccgacgccggtggtctcgcgcatccgctcgaaccacagcaacctgtgcgtgaacgtccgcggcgcctcgacggcgagcggcgcgacggtggtgcagtggccgtgcggcaacgacggcaacgagcgcttcaccatgacgcagaccaacgacggcttcgtgcagttcaaggtcgagcacagcggtctgtgcctggcccagagcggcaccgcgacgaccaacgccgcggtggtgcagctggcctgctcggccggcaccaccacgcagtggagcctggtcggctcgaccctgcgcaaccgggcctcgggctcgtgcctggacgtgccgaacaacgcgacgacgcaggacacggcgctgatcacctggacctgcaacggcggcaacaaccagaactggacgcagcttcagtag

SEQ ID NO: 2022 - DNA, 4716 bp, Variovorax sp.
atgaagatccggtattacctgatggcattgatggtgccgttcgtcaccctgttgacgcacgcggcgatcaccggggtcagtccgatgacgaccctcggcaacatggcgaccgcggtgtccgaggccgtcgccgatcccctcccgctgcaggggccggggctgggcaacctcacctacacctcggaggaactgttcaagccggtgtcgatgatcaccagccccgcgcatccgctcgaccccgcgcacagcaacgcctacgagtcgcgcgaggtgcccgccacctatccgggccgcaaggactacggcatgaacgccggcatcatggtcaacggctatttcctcacgtccttcgctcccgacagcggcctcggcccgggcggcttcctgctgtacgacgtgtcgaacccgcgccagatcaagctcgtcaagaagatctacgagcccgaggcccgcaccaaggagttccgcgaaacccactccttcggcaccgcgaagatcggcgacaagacctacgtggtgctgcccagcatcaacggcgtggagttctgggacttcaccgacgtcaacgacatcaagcaggtgaagaagctggcgctgcccggcgtgaatggcggcgactacgagaacgtcgcctggcagctctggtggcaggcgccctatctgtacgtggcttcggcgggccggggcatcttcatcgtcgatgccgccgaccccgcgaacgccgtgctcgccaaccgcggcgccggcaagtccaacccggtgtccaccggcgaactcggcggctttcgcatcggcccgatcttcacgatgggcaaccacatggtgctgaccgcgatggagagcaacggcggcttcgcgagcctcgatatctccgatccgctcaatcccaaggtgctcgactccatcgtgggcagcacgccgttctactacgcgacttgcttcgacggccggaacctgcatgtctccacccgcaacagcggcgcgaagatgtacagctacgacctcagcgaccgctcgaaattcgtggccgaggacaaccgcctggtcatcgacgagcagctgtactgcgccacgcaggaccactacgtgatccagggcgcgcagacgcgcatccacaaggtcgacgtgagcaatccgctcaatcacgtggaggtgggccgcggcagcatcctgcgcgaggacgatccgaacttctcgcattcggacaacggccaggtcgcgatgttcggcaacctcgtgttcgtgggcaacgaccacggctcgggcagcggattcgtcgtgcaccaggtcgaccccgacaccacccggcccgaggtcaagcaggtctcccccgccaacggcgcgaagcagcaggcgctgacctcgcgcatcggcctgggcatgaccgacaacatccggcccgagagtgtcaacgccaacaccttcatcgtgcggcccgtgggcggcaacacgctggccggcacctacagcgtgcagctcggcatcgtcaacttccatccgacgcagccgctgcagccgggcaccagctacgaggtgttcctgccggccaacggcgtgaaggactatgcgggcaacgccatcggcgccgacttcaagtccaccttcaacaccggcaacgcggccgaggtgggcctgagctatcactgggcgctcaacggcaagctcagcgacccgatctcgaacaacgacggcacgcccgcatccggcgacgccttcgagagcatcggcctgaacttcgcgaaccgcgcgggcggcgtgcagctcaagaacgacagcgtggccaccgtgctgggcggcaccgcctcgctgagcttctacatgaagaccacgcagaacggcagcgccaacgcctggaccgcgcccggcatcttcgggcgcgaccagtccggcggcgccgacgacgtgttctggggctggctcgacaacacgggccggctcaacctgtcggtggccaacgcggccaccaacaacccgggcacgcgctcgacctcgccggtcaacgacggcaactggcaccacgtggtgctcacgcgcgacgcgggctcgggcgcgcagaccatgtacatcgacggcgccaagaccagctcgaccggcctcaccggcgtgaagggcctcgcgaacaagttccagtggctgggccagatccagggcaatgccgacttcttcaagggcacgctggccgacgtgcgggtgttcagccgcgtgctcggcgacgccgaggtcgcgaccctgcgcggccaggcggtcatcggcgaccccggcatcggcagcgggcccaaggtggtcaacggcgcgctgaacttcaacccggcaacgctcggcagcggcggcgcgcagttccgctggaacttcggcaacggcaccgtcacggccttctcgagccaggccggctacagctacacctacaccacgcccggccactacaccgtgaccctgacggtgaaggacagcgcgggccgcgagacctactacacctacaacgtgaccatcattgcgcccgtcaccgcgagcgcgccgcggcacaccggcaacatcgcgggcgacgcgaaccgggtctacgcggtcaatcccgacagcggcacggtggcggcgatcgacgcccagagcctggccaagctgtgggaggtgtcggtgggcagcgaggccaagacgctggcgctcggtcccgacggccgggtctgggtcgcggtgcagggcgaggacaagctggtggcgctcaacgccgccgacggcagcgtctcggtcaccgtgcccttcgactacggcagcggtccctacggcgtggtcttcacgcccgacggcaccaagggcctgctgacgctggagagcaagtcgcgcctcgtgagcttcaatccctccaccggcgcggtcacggccaccctgccgctcgacggcacggtgcgcggcatcgcggtcacgggcgatgcgcagatcgcctacgtcacgcgcttcaagtcgaagatgaccggcggcgagctctacaaggtcaacctggcctcgatgagcacgctgccgaccatcgcgctgccggtggacaccaccaccatcgacaccgaggccggcgcgcgcggcgtggccaactacctgagccaggtcgtgatctcgcccgacggcaagcgcgccatcctgccctcgaagaaggacaacatcgtgcgcggccgcttccgcgacgggaaggacctggtgcacgaccagaccgtgcgctcgatcctgtcgcaggtcgacctgcagtcggcggcccacgtggccggcgagcagatcgacttcgacgaccgcgcgccggcgcgcgccgcgctgttctcgcccgcgggcgactacatcttcgtggcgcagatggaaggcaaccgggtcgcgatcgtcgattcctacacgcgctcggtgcgcggcgagatcgacaccagcagcgcgccgcacgggctgttcctcgacgccgcgcgcaagcgcctgttcgtcaacaacttcctcgcacgctcggtgtcggtgcacgacgtggcggcggtgctggcctcggagagcaacgcggcgaccttcctgcgcaacgtgcagaccgtggcgaccgagccgctggccgcggccgcgctgcgcggcaagcaggtgttctacaacgcggccgaccggcgcatgagcaaggacaactacatctcgtgcgcgagctgccatgccgatggcggcgacgacggcatggtgtgggacttcacccagcgcggcgagggcctgcgccgcaccatcagcctgcaggggcggcgcggcacgagccacggcaagctgcactggacggccaacttcgacgaggtgcaggacttcgagaacgacatccgcaacgagttcggcggcaccggcttcctgagcaatgccgactacgcggccacctccaatccgctgggcacgcccaaggccggacgcaatgcgcagctcgacgacctcgcggcctacctgtcgtcgctcgacaagttcatgcgcagcccggcccgcacggccgacggcaacctcagcgtggaggccgcgcgcggccagacggtgttcaacaccgcgcagtgcgcgacctgccacaccggcggcaccttccgcgacggccagcggcacgacgtgggcacgatccagctctcgtcgggcaagggaagcaaccagccgctggcgggcgtgggcttcgacacgccgacgctgtcgggcacctggagcgtgacctcgttcttccacaacggccaggccgcctcgctgcaggcggtgctcgacagcggccacggcaacgccaacggcctgccgccggccgacgtggtggcgctgcgcgagtacgtgcgttcgctcgacaccgcgccgccgctggtcgcgcgcatccgttcggacagcagcaacctgtgcgtgaacatcaagggcgtgtcgaccgccagcggcgccaccgcggtgcagtggccctgcggcaacgacgccaacgagaagttcaccgtgaccagcagcggcggctacgtgcagttcgtggcgcagcacagcggcctgtgcctggcgcagagcggtaacgcgaccaccaacgcggcggtggtgcagctggcctgcacggccggcaacgcgacgcagtggacggtggtcggctcgaccctgcgcaaccgcgcctccggatcctgcctcgacgtcccgaacggatccaccacgcaggacacggcgctgatcacctggacctgcaacgggggcaacaaccagaactggacccagctgccctga

SEQ ID NO: 2023 - DNA, 4716 bp, Variovorax sp.
atgaagatccggtattacctgatggcattgatggtgccgttcgtcaccctgttgacgcacgcggcgatcaccggggtcagtccgatgacgaccctcggcaacatggcgaccgcggtgtccgaggccgtcgccgatcccctcccgctgcaggggccggggctgggcaacctcacctacacctcggaggaactgttcaagccggtgtcgatgatcaccagccccgcgcatccgctcgaccccgcgcacagcaacgcctacgagtcgcgcgaggtgcccgccacctacccgggccgcaaggactacggcatgaacgccggcatcatggtcaacggctatttcctcacgtccttcgctcccgacagcggcctcggcccgggcggcttcctgctgtacgacgtgtcgaacccgcgccagatcaagctcgtcaagaagatctacgagcccgaggcccgcaccaaggagttccgcgaaacccactccttcggcaccgcgaagatcggcgacaagacctacgtggtactgcccagcatcaacggcgtggagttctgggacttcaccgacgtcaacgacatcaagcaggtgaagaagctggcgctgcccggcgtgaatggcggcgactacgagaacgtcgcctggcagctctggtggcaggcgccctatctgtacgtggcttcggcgggccggggcatcttcatcgtcgatgccgccgaccccgcgaacgccgtgctcgccaaccgcggcgccggcaagtccaacccggtgtccaccggcgaactcggcggctttcgcatcggcccgatcttcacgatgggcaaccacatggtgctgaccgcgatggagagcaacggcggcttcgcgagcctcgatatctccgatccgctcaatcccaaggtgctcgactccatcgtgggcagcacgccgttctactacgcgacctgcttcgacggccggaacctgcatgtctccacccgcaacagcggcgcgaagatgtacagctacgacctgagcgaccgctcgaaattcgtggccgaggacaaccgcctggtcatcgacgagcagctgtactgcgccacgcaggaccactacgtgatccagggcgcgcagacgcgcatccacaaggtcgacgtgagcaatccgctcaatcacgtggaggtgggccgcggcagcatcctgcgcgaggacgatccgaacttctcgcattcggacaacggccaggtcgcgatgttcggcaacctcgtgttcgtgggcaacgaccacggctcgggcagcggattcgtcgtgcaccaggtcgaccccgacaccacccggcccgaggtcaagcaggtctcccccgccaacggcgcgaagcagcaggcgctgacctcgcgcatcggcctgggcatgaccgacaacatccggcccgagagtgtcaacgccaacaccttcatcgtgcggcccgtgggcggcaacacgctggccggcacctacagcgtgcagctcggcatcgtcaacttccatccgacgcagccgctgcagccgggcaccagctacgaggtgttcctgccggccaacggcgtgaaggactatgcgggcaacgccatcggcgccgacttcaagtccaccttcaacaccggcaacgcggccgaggtgggcctgagctatcactgggcgctcaacggcaagctcagcgacccgatctcgaacaacgacggcacgccggcgtccggcgacgccttcgagagcatcggcctgaacttcgcgaaccgcgcgggcggcgtgcagctcaagaacgacggcgtggccaccgtgctgggcggcaccgcctcgctgagcttctacatgaagaccacgcagaacggcagcgccaacgcctggaccgcgcccggcatcttcgggcgcgaccagtcgggcggcgccgacgacgtgttctggggctggctcgacaacaccggccggctcaacctgtcggtggccaacgcggccaccaacaacccgggcacgcgctcgacctcgccggtcaacgacggcaactggcaccacgtggtgctcacgcgcgacgcgggctcgggcgcgcagaccatgtacatcgacggcgccaagaccagctcgatcggcctcaccggcgtgaagggcctcgcgaacaagttccagtggctgggccagatccagggcaatgccgacttcttcaagggcacgctggccgacgtgcgggtgttcagccgcgtgctcggcgacgccgaggtcgcgaccctgcgcggccaggcggtcatcggcgaccccggcatcggcagcgggcccaaggtggtcaacggcgcgctgaacttcaacccggcaacgctcggcagcggcggcgcgcagttccgctggaacttcggcaacggcaccgtcacggccttctcgagccaggccggctacagctacacctacaccacgcccggccactacaccgtgaccctgacggtgaaggacagcgcgggccgcgagacctactacacctacaacgtgaccatcatcgcgcccgtcaccgcgagcgcgccgcggcacaccggcaacatcgcgggcgacgcgaaccgggtctacgcggtcaatcccgacagcggcacggtggcggcgatcgacgcccagagcctggccaagctgtgggaggtgtcggtgggcagcgaggccaagacgctggcgctcggccccgacggccgggtctgggtcgcggtgcagggcgaggacaagctggtggcgctcaacgccgccgacggcagcgtctcggtcaccgtgcccttcgactacggcagcggtccctacggcgtggtcttcacgcccgacggcaccaagggcctgctgacgctggagagcaagtcgcgcctcgtgagcttcaatccctccaccggcgcggtcacggccaccctgccgctcgacggcacggtgcgcggcatcgcggtcacgggcgatgcgcagatcgcctacgtcacgcgcttcaagtcgaagatgaccggcggcgagctctacaaggtcaacctggcctcgatgagcacgctgccgaccatcgcgctgccggtggacaccaccaccatcgacaccgaggccggcgcgcgcggcgtggccaactacctgagccaggtcgtgatctcgcccgacggcaagcgcgccatcctgccctcgaagaaggacaacatcgtgcgcggccgcttccgcgacgggaaggacctggtgcacgaccagaccgtgcgctcgatcctgtcgcaggtcgacctgcagtcggcggcccacgtggccggcgagcagatcgacttcgacgaccgcgcgccggcgcgcgccgcgctgttctcgcccgcgggcgactacatcttcgtggcgcagatggaaggcaaccgggtcgcgatcgtcgattcctacacgcgctcggtgcgcggcgagatcgacaccagcagcgcgccgcacgggctgttcctcgatgccgcgcgcaagcgcctctacgtcaacaacttcctcgcgcgctcggtgtcggtgcacgacgtggcggcggtgctggcctcggagagcaacgcggcgaccttcctgcgcaacgtgcagaccgtggcgaccgagccgctggccgcggccgcgctgcgcggcaagcaggtgttctacaacgcggccgaccggcgcatgagcaaggacaactacatctcgtgcgcgagctgccatgccgatggcggcgacgacggcatggtgtgggacttcacccagcgcggcgagggcctgcgtcgcaccatcagcctgcaggggcggcgcggcacgagccacggcaagctgcactggacggccaacttcgacgaggtgcaggacttcgagaacgacatccgcaacgagttcggcggcaccggcttcctgagcaatgccgactacgcggccacctccaatccgctgggcacgcccaaggccggacgcaatgcgcagctcgacgacctcgcggcctacctgtcgtcgctcgacaagttcatgcgcagcccggcccgcacggccgacggcaacctcagcgtggaggccgcgcgcggccagacggtgttcaacaccgcgcagtgcgcgacctgccacaccggcggcaccttccgcgacggccagcggcacgacgtgggcacgatccagctctcgtcgggcaagggaagcaaccagccgctggcgggcgtgggcttcgacacgccgacgctgtcgggcacctggagcgtgacctcgttcttccacaacggccaggccgcctcgctgcaggcggtgctcgacagcggccacggcaacgccaacggcctgccgccggccgacgtggtggcgctgcgcgagtacgtgcgttcgctcgacaccgcgccgccgctggtcgcgcgcatccgttcggacagcagcaacctgtgcgtgaacatcaagggcgtgtcgaccgccagcggcgccaccgcggtgcagtggccctgcggcaacgacgccaacgagaagttcaccgtgaccagcagcggcggctacgtgcagttcgtggcgcagcacagcggcctgtgcctggcgcagagcggcaacgcgaccaccaatgcggcggtggtgcagctggcctgcacggccggcaacgcgacgcagtggacggtggtcggctcgaccctgcgcaaccgcgcctccggatcctgcctcgacgtcccgaacggatccaccacgcaggacacggcgctgatcacctggacctgcaacgggggcaacaaccagaactggacccagctgccttga

SEQ ID NO: 2024 - DNA, 4737 bp, unknown
  environmental sample
atgagcatcaagaaagttcttgcggtaggttccctgttctgctgcgccttgctgacgcacgcggcgatcaccggggtgaaccctctggacacgatcaggaaggctgccaccggcatggcttccgccgccgccgatctcatggccgatccgttgccgctgcaggggcccggaatgggcaacctcacctacacgcaggccgaactgttcaagcccatctccaggatctatgaagagtcggataccggcgctggcgccggcatcggcggcgacgtgccgaagattcccggtggcagcgtgacgcatcccaccgccggatacaccaagtaccactacggccagaacgtggggctcatgatcaacggctacttcctgacgacgttcgcgcccgatggcggcttgggccccgggggcttcctgctctacgacatttcagatccgcgcaacatcaagctcgccaagcggatctacgaaccggacggccgcaccaaggaattcagggagccgcatgccatcggcgtcgccaacatcggcggcaagcagtacgtggccatgcccagcgtcttcggcgtcgagttctgggacttcaccgacatcaacgacatcaagcaggtcaagaagctggtgctgcccaacgtcaacaagggcgactacggcaacgtgagctggcagctctggtggcaggcgccctatctgtatgtggcggcggcggagcaggggatcttcatcatcgacgccagggacccggccaacgccgtcctcgcgaaccgcggtgccggcaagcccaacccggtgccgaccggcgagctcgggggctttcgcgtggggccgatcttcaccatgggcaaccacatggtgctgacttcgatgacgaacaccagcggcttcgccagcctggacatttcagacccgctgaatcccaaggtgctcgacgccgttgcggggtcaacgcccaactactacgccacctgcttcgacggcaagaaggtctacgcctccgcacaggaaagcggcggcaagatgttcggctacgacctcagcgatcgatcgcgcttcgtggcggaggacaaccggctcgtgatcaaccagcagctgtactgcggcacgcaggaccactatgttttccagggtgcgcagaactacattcacaaggtcgatgtgagcaacccgctcaaccacgtggaggttgggcgcggcggacttttcgtggagtcggatccccatttctctagctccgaccatggccaggtgtcgcccttcggaaacctggtctacgtaggcaacgaccacggctcgggcagtggcttcatcgtgcatgcggtagccccggacaccaccaaacccgaagtgaaacaggtctcgcccgccaacggtgcgaagcagcaggcgctgacctcccgcatcggcctgggcatgacggacagcatccgccccgagagcgtgaattccaacaccttcatcgtgcgcccggtgggtggcaacacgttggcgggcacctacagcgtgcagttgggcatcgtcaacttccaccccgagcagccgctgcaaccgggcacgagctatgaggtgttcctgccggccaacggcctgaaggactatgcgggcaacgccatcggcgcggactaccgctcgaccttcaacaccggcaacgcgagcgacatcaacttgatgcaccactggccgctgacgggcaaccttggcgaccagatcagcgccaacaacggcacgcccgccaccggcgacgcgttcgagagcatcggcctgaacttcgcgaaccgcaccacgggcgtgcagctgaagaacgacgccgtggccaccacgctgggcggcaccgcatcgctgagcttctacatgaagaccacgcaggcaggtggtgcgagttcgtggaccgcgcccggcatcttcgggcgcgaccagtcgccgggcgtcgacgacgtgttctggggctggctcgacagcaccggcaagatcaagctgtcggtgggcgacgatgcgggcacgcgttcgcaggcggcggtgaacgacggcaactggcaccacgtggtgctgacgcgcgacgcggcctcgggcgcgcaggcggtgtacgtcgatggcgtgaagaccacctcgaccggccccaccggcaacaagggcctgtcgaccaagttcaaggtcctgggccagatccagggcaacaccgcgctcttcaagggcacgctggccgaggtgcgcgtgtacggccgcgtgctcggcgacagcgacgtggccgcgctccgggagcaggccgtgatcggcgatccgggcattgccggcgcgccgaagatcgtcaacggccagctgagcttcaacccggccacgctgggcagcagcggcgcgcagttccgctggaacttcggcgatggcacgcagagcgcatatgccacccagcccggcgtcacgcacacctacacgcgccccggccactacaccgtgacgctgacggtgaaggccgcgaacggccaggagaccttctacacgtacaacctcacggtgatcgcgcccgtcacggcgctggcgccgacgcacaccaccaacatcgcgggcgacgcgaactcggtgtattcggtcaaccccgacagcggcacggtcgccgccatcgacgcacagacgctggcaaagcgctgggaagtgcgcgtgggcgaggagccgaagacactggcggtcggccccgacggccgcatctgggtcgcggtgcagggcgacgacaagctggtggcgctcaacgcggccgacggcagcgtctcggccaccgtgccgctcgcctacggcagcggcccctacggcgtcgtcttcacgcccaatggggccaagggcctcctgacgctggaaagcaagtcgatgctgatgagcttcgacccgagcaacggcagcaccaccggcacgcttgccctggaaggcgccgtgcgcggcatcgcggtcgatgcgggttcgcaatcggcctatgtgacgcgcttcaagtcgaagatgacgggcgggcagttgcacaaggtgaacctgcagagcctcagcggcgccaccacgattgcgctcgcggtcgacaccaccacggtggacaccgaggccgccgcgcgcggcgtgcccaactacctgagccaggtggtgatttcccccgacggcgcgcgtgcgctcctgccctccaagaaagacaacatcgtgcgcggaaccttccgcgacggcctgccgctggagcacgacaagaccgtgcggtcgatcctctcgcaagtgaacctgcagacggcttcggaagtgttcagcgagcagatcgacttcaacgaccgcgcccccgcgcgcgccgcgctgtattcgccgagcggcgactacatcttcgtggcgcagatggagggcaacagcgtggccatcgtcgacgcatacaaccgttcggtgcgcggcgagatcaacgccagcagcgcgccgcacggcctgtacctggacgcggcgaggaagcgcctgttcgtcaacaacttccttgcgcgctcggtgtcggtgcacgacgtggcctcggtgctgtcctcggagtccgcggctgcggcattcctgcagagcgtgaccacggtcgcgcaggagccgatgtcgcccgcggcgctgcgtggcaagcaggtgttctacaacgcgtcagaccggcgcatgagcatgaacaactacatgtcgtgcgcgagctgccatgcggatgccggcgacgacggcatggtgtgggacttcacccagcgcggagaaggcctgcgccgcaccatcagcctgcagggacgtcgcggcaccggccacggcaagctgcactggacggccaacttcgacgaggtgcaggacttcgagcacgacatccgcaacgaattcggcggcacgggcttcctctcgaacgccgacttctcggccagcggcgatccgctcggcgtgcccaaggcgggccgcaacgcacagctggacgatctcgcggcctacctgaactcgctgaacaagtacatgcgcagccccgcccgcacggcggacggcaacctcagcgtggacgccgtgcgcggccagacggtgttcaacaccgcgcagtgcgcgacctgccacacggccggcagcctgcgcgacggactgcggcatgacgtgggaacgatccagctctcgtcgggcaagggcagcaaccagccgctgaccggcgtgggcttcgacacgccgacgctctacggcacctggagcaacccgacgttcttccacaacggccagaaggccacgctgcaggacgtgctcacaagcggccatggcaatgcctccagcctgccggcggccgacctgctggcgttgggcgagtacgtgaaatcgctcgacacggcgccggctttcgacacgcgcatccgctcggaggtcagcaacctgtgcgtcaacgtgtcgggcggctcgacggccagcggcgccacggtggtgcagtgggcctgcggcaacggcaacaaccagaccttcaccgtcaacagcagcggcggctacagccagttcgtcgccaagcacagcggcctgtgcctggcacagggcaacaccaacaccggcggcggccctctggtgcagctggcgtgcacggcgggcgtggccacgcagtggagcgtggtcggggcgacgctgcgcaaccgggtgtcgcccaacgcctgcctcgatgtccccggctcttcgaccacgcagggaacggcgctgtccacctacgcctgccatggcggcgccaaccagcgatggagccagattccctga

SEQ ID NO: 2025 - DNA, 4695 bp, unknown
  environmental sample
atgaagatccgttatctgttcacggtgatcttgctcggtgtggtctcgctgctcacgcatgcggccatcaccggcgtgagtccactcaccaccctcagcaacatggccagcagcgcaaagaccgcgctggtggccgacgccctgccgctcaaggggccgggactgggcaatctcagctacacctcgcaggagctcttcaaggccgtctcgatgatccatcgcgacgaccagggcgtgcccgagacctacccgggccgcaaggccttcggcatgaacgtcgggatcatgcacaacggctacttcctgaccaccttcgcgccggacagcggcctggggccgggcggcttcctgctgtacgacgtctccgacccgcgcgcgatcaagctggtcaagcgcatctacgagcccgatcccggagggcgcacgtcggagttccgcgaggcgcacgccatcggcaccgccaccatcggcggcaaggactacatcgccgtgcccagcaccaagggcgtggagttctgggacttcaccgacatcaacgacatcaagcaggtcaagaagctggccctgcccactgtcaacggcggcgactacgccaacgtgaactggcagatgtggtggcaggcgccctacctgtacgtggcctccgccaacgacggcgtgtacatcgtcgatgcgagcgatccggccaacgccgtgctggccaaccgcggcgcgggcaagcccaacccggtgcccgtcggggaactgggcggcttccgcgtcggccccatcttcaccatgggcaaccacatggtgctgacctcgatggacaacaccgcgggcttctccagcctggacatctccgatccgctcaaccccaaggtgctggacaccgtgggctccaaccccaactactacgccacctgcttcgacggcaagtcgctgcacgcctcggcgcgcggcggcggcgcgaagatgtacagctatgacctgagcgaccgcagcaacttcgtccccgaggacaaccgcctggtgatcgacgaacagctgtactgcggcacgcaggacaacttcgtgttccagggcgcgcagtaccgggtccacaaggtggatgtgagcaacccgctcaaccacgtcgaggtcggccgcggcagcctgttcgccgagaacgatccggagttctcgcactccgaccacggccaggtcgcgcccttcggcaacctggtcttcgtgggcaacgaccacggttcgggcagcggcttcctggtgcactcggtcgaccccgacaccacgcggcccgaggtgcggcaggtctcgccggccagcggcgccaagcagcaggcgctgagctcgcgcatcggcatcggcctgtccgacagcatcctgcccgagaccgtcaacgccagcaccttcatcgtgcgcccggtgggcggcaatgcactggccggcacctacagcgtgcagctgggcatcatcaacttcttccccagccagcccctggccgcgggcaccgcctacgaggtcttcctgcccgccggcggcgtgaaggactatgcgggcaacgccatcgccgccgactaccgctcggtcttccacaccggcaatgccgaggacatcggcctcatgcaccactggccgctggagggcacgctggccgacaccatcggcagcaacaacggcaccacgggctcgggcgatgccttcgccagcatcggcctggacttcgcgcagcgcaccggcggcgtgccgctgaagaacgactcggtggcggccacgctgggcggcaccgcctcgctgagcttctacatgaagaccacgcagcccggcgccgccaacccgtggacggcccccggcatcttcgggcgcgaccaggccaacggcaccgacgacgtgttctggggctggatcgacggcagcggccggctcaacctgtcggtcggcaaccaggcgagcaacaaccccggcacccgctccaccgcggcggtgaacgacggcaactggcaccacgtggtgatgacgcgcgacgccgcctccggcgcgcagaccctgtatgtcgacggcgtgaagaccagctccaccggcctcaccggcaccaagggcctgtcgaacaagttccaggtgctgggccagatccagggcaacgccgacttcttcaagggaacgctggccgaggtgcgcgtctacagccgcgtgctcaccgacgcccaggtcgccgcgctgcgcgggcaggcggtgatcggcaacccgggcatcggcagcggtccgcgctacgtcaacggccagctggtgctcaaccccgacacgctgggcagcaccggcgcgcagtaccgctggaacctgggcgacggcacgcagaccgcgttctcgaactcggccggctacacccacacctacagccgtcccggccactacacgctgacgctgacggtgcgcgacgccagcggccgcgagacctactacacctacaacgtgacggtggtcgtgcccatgaccgccagcaagcccacgcacagcaccaacatcaccggcgacgccagcaccgtcttcgccgtcaaccccgacagcggcaccgtcgccgcgatcgacgcgcagaccctggccaagcgctgggaggtgagcgtgggcagcgagcccaagacgctggccctgggccccgacgggcgcctgtgggtcacggtgcagggcgacgacaagctggtggcgctcaacgccgccgacggcgcgacctcggccaccatcgcgctggcctacggcagcggcccctatggcgtggccttcacgcccgacggcggcaagggcctgctgacgctggagagcaagtcgcagctgctgagcttcgaccccgccaccggcgccaccaccggtacgctggcgctgcaaggcgacgtgcgcggcatcgcggtcagcgccgattcgcagatggcctacgtgacccgcttcaagtcgaagatggacggcggccagctgcacaaggtcaatgtgcagaccatgacgacggtgaagaccgtggcgctgccggtggacaccgccaccatcgacagcgagagcaaggcccgcggcgtcgccaactacctgagccaggtggtgatctcgcccgacggcgcgcgcgccgtgctgccctcgaagaaggacaacatcgtgcgcggccgctaccgcgacggcaaggacatggtgcacgaccagaccgtgcgctcgatcctgtcgcaggtcgacctggtgcaggccagcgaggtgttcgccgagcagatcgacttcgacgaccgcgcgccggcccgcgccgcgctgttctcgccctggggcgactacctcttcgtcgcgcagatggagggcaaccgcgtggccatcgtcgacacctacacgcgcgccatccgcggcgagttcaacaccagcagcgcgccgcacgggctctacctggacgccacgcgcaagcgcctgttcgtcaacaacttcctcgcgcgctcggtgtcggtgcacgacgtcgcctcggtgctgtcctccgagacggcggccgcgaccttcctggcgagcgtgggcacggtggcgcaggagcccatgtcgcccgccgcgctgcgcggcaagcaggtgttctacaacgcggccgaccggcgcatgagcaaggacaactacatctcgtgcgcgagctgccacgccgacggcggcgacgacggcatggtgtgggacttcacccagcgcggcgaaggcctgcgccgaaccatcagcctgcagggccggcgcggcatggaccacggcaagctgcactggagcgccaacttcgacgaggtgcaggacttcgagaacgacatccgcaacgagttcggcggcgtgggcttcctcagcaacgcggacttcgccgccacctccgacccgctgggcgcgcccaaggccggcaagagcgcgcagctcgacgacctggcggcctacctgacgtcgctcaacaagtacatgcgcagcccggcgcgcaacgccgacggcagcctgagcgtggcggcggtgcgcgggcaggccgtgttcgccagcgcgcagtgcgccacctgccacaccggcgacaccttccgcgacgggcagcggcacgacgtgggcaccatccagccctcgtccggcaagggcatgaaccagccgctggcgggcgtgggcttcgacacgccgacgctgtcgggcacctggaagaattcctccttcttccacaacggccaggcggcgacgatgcaggacgtgctggccggcggccacggcaacgcctcgagcctgccggccggcgacgtggccgcgctgggcgagtacgtgcgctcgctcgacgcgccgcatgcggtgcccgacgtggtcgcgcggctgcgctccaaccacagcaacctgtgcctgaacatccgcggcgcctccaccgccagcggtgccctcgccgtccagtggccctgcggcaccgcgaccaacgagcgcttcacgttcaggacggtcagcggcggctacgtgcagttggtggcgcagcacagcgggctgtgcgtcgcgcagaacggcaccgccaccagcaacgcggcggtggtgcagctggcttgcagcgccggtccgacgaccgagtggagcatggccggcgcgaccctgcgcaaccgcgcctcgggctcctgcatggacgtgcccaacaactcgaccgcgcaggacaccgccctcatcacctggccctgcaacggcggcaacaaccagaactggacgcaactcccctag

SEQ ID NO: 2026 - DNA, 4749 bp, Variovorax sp.
atgagcatcaagaaagttcttgcggtaggttccctgttctgctgcgccgtgctgacgcacgcggcgatcaccggggtgaacccgctggacacgatcaggaaggccgccacgggcatggcttccgcggccgccggtctcatggccgatccgttgccgctgcagggccccggcttcggcaacctgacctacgcgcaggccgagctgttcaagcccatctcgacgattcatgaggtgtccgacgacggcgccggagcaggcaccggtgccgacgtaccgaagattcccggtggcagcgtgacgcaccccaccgccgggtacaccaagtaccactacggccagaacgtgggtctcatgctcaacggctacttcctcacgacgttcgcgcccgatggcgggctgggccccgggggctttctgctctacgacatttccgatccgcgcaacatcaagctcgccaagcggatctacgaaccggacggccgcaccaaggagttcagggagccgcatgcgatcggcatcgcccacatcggcggcaagcagtacgtcgccatgccgagcgtcttcggcgtcgagttctgggacttcaccgacatcaacgacatcaagcaggtcaagaagctggtgctgcccaacgtcaacaagggcgactacggcaacgtgagctggcagctttggtggcaggcgccctatctgtatgtggcggcggcggagcaggggattttcatcatcgatgccagagacccggccaacgccgtcctcgcgaatcgcggcgtcggcaagcccaacccggtgccgaccggcgagctcggcggctttcgcgtgggcccgatcttcaccatgggcaaccacatggtgctgacttcgatgacgaacaccagcggcttcgccagcctggacatttcggacccgctgaatcccaaggtgctcgacgccgttgccgggtccacggccaactactacgccacctgcttcgacggcaagaaggtctatggctccgcgcaggagagcggcggcaagatgttcggctacgaccttaccgatcgatcgcgcttcgtggcagaagacaaccggctcgtgatcaaccagcagctgtattgcggcacgcaggacaactacgttttccagggtgcgcagaactacattcacaaggtcgatgtgagcaacccgctcaaccatgtcgaagtcgggcgcggcgggctcttcgtggagtcggacccgcatttctcgagctccgaccatggccaggtgtcgcccttcggaaatctgatctacgtaggcaacgaccacggctcgggcagcggcttcatcgtgcatgcgttggccccggataccaccaagcccgaggtcaagcaggtctcgcccgtgaacggcgccaggcaacaggccctcacgtcgcgcatcggcctcggcatgacggacagcatcctgccggagagcgtcaacgccaacaccttcatcgtgcgtccggtgggcggcaacacgctggcgggcacctacagcgtgcagctgggcatcgtcaacttccaccctgagcagccgctgcagccgggcacgagctatgaggtgttcctgccggccaacggcctgaaggactatgcgggcaacgccatcggcgcggactaccgctccaccttcaacaccggcaacgccagcgacatcagcctgtcgcaccactggccattgaccggcagcctcgccgaccagatcggcgccaacaacggcacgcccgccaccggcgatgcgttcgagagcatcggcctgaacttcgcgaaccgcaccacgggcgtgcagctgaagaacgacaccgtggccaccacgctgggcggaaccgcatcgctgagcttctacatgaagaccacgcaggcgggcagcgcgaactcgtggaccgcgcccggcatcttcggacgcgaccagtcgccgggcgtcgacgacgtgttctggggctggctcgacagcaccggcaagatcaagctgtcggtgggcgacgatgcgggcacgcgctcgcaggcgtcggtgaacgacggcaactggcaccacgtggtgctgacacgcgacgcggcctcgggcgcgcaggcggtgtacgtcgatggcgtgaagaccacctcgaccggccccaccggcatcaagggcctgacggccaggttcaagatcctgggccagatccagggcaacaccgcgctcttcaagggcacgctggccgaggtgcgcgtgtacggccgcgtgctcggcgacagcgacgtggcggcgctgagagagcaggccgtgatcggcgatccgggcatcgccggcgcaccgaagatcgtcaacggccaactgagtttcaacccggccacgctgggcagcggcggcgcacagttccgctggaacttcggcgatggcacgcagagcgcctacgccacccaaccgggtgtcacgcacacctacacgcggcccggccactacaccgtgacgctgacggtgaaggccgcgaacggccaggagaccttctacacctacaacctcacggtgatcgcgcccgtcacggcgctggcgccgacgcacacgaccaacatcgcgggcgatgcgaactcggtgtactcggtcaatcccgacagtggcaccgtcgccgccatcgatgcacaaacgttggccaagcgctgggaagtgcgcgttggcgaggagccgaagacgctggcggtcggccccgacggccgcatctgggtcgcggtgcagggcgaagacaagctggtggcgctcaatgcggcggacggcagcgtctcggccaccgtggcgcttgcttacggcagcggtccgtacggcgtcgtcttcacgcccaatggggcgaagggcttgctgacgctggaaagcaagtcggtgctgatgagcttcgacccgagcaacggcagcaccaccggcacgctcgccctggagggcgcggtgcgcggcatcgcggtcgatgcgggttcgcaatcggcctacgtgacgcgcttcaagtcgaagatgacgggcggcgagctgcacaaggtgaacctgcagagcctcagcggcgccaccaccatcgcattggcggtcgacacgaccacggtggataccgaggccgccgcgcgcggtgtgcccaactacctgagccaggtggtgatttcccccgacggcgcgcgagcacttctgccctccaagaaggacaacatcgtgcgcggaaccttccgcgacggcctgccgctggagcacgacaagaccgtgcgttcgatcctctcgcaagtgaacctgcagacggcgtcggaagtgttcggcgagcagatcgacttcaacgaccgcgctcccgcgcgcgccgcgctgtattcgccgagcggcgactacatcttcgtggcgcagatggaaggcaacagcgtggccatcgtcgatgcgtacaaccgttcggtgcgcggcgagatcaacgccagcagcgcgccgcacggcctgtacctcgatgcggcgagaaagcgcctctacgtcaacaacttcctcgcgcgctcggtgtcggtgcacgacgtggcctcggtgctgtcctcggagtccgcggccccggcatttctgcagagcgtcaccacggtcgcgcaggagccgatggcggccgctgcgttgcgtggcaagcaggtgttctacaacgcctccgaccggcgcatgagcatgaacaactacatgtcatgcgcgagctgccatgcggacgccggcgacgacggcatggtgtgggacttcacgcagcgcggcgagggcctgcgccgcaccatcagcctgcagggacgccgcggcaccggccacggcaagctgcactggaccgccaacttcgacgaggtgcaggacttcgagcacgacatccgaaacgaattcggcggcaccggttttctctcgaacgccgacttctcggccacgggcgatccgctcggcgtgcccaaggcgggcaagaacgcacagctggacgatctcgcggcctatctgaactcgttgaacaagtacatgcgcagccccgcccgcacggcggacggcaacctcagcgtggacgccgtgcgcggccagacggtgttcaacaccgcgcagtgcgcgacctgccacacggccggcacgctgcgcgatggactgcggcacgacgtgggcacgatccagctctcgtcgggcaagggcagcaaccagccgctgaccggcgtgggcttcgacacgccgacgctctacggcacctggagcaacccgacgttcttccacaacggccagaaggccacgatgcaggacgtgctcgcggggggccacggcaatgcatcgagcctgccggccgccgacttgctcgcgctgggcgagtacgtgaaatcgctcgacacggcgccggctttcgacacgcgcatccgctcggaagtcagcaacctgtgcgtgaacgtgtcgggcggctcgacagccagcggcgccacggtggtgcagtgggcttgcggcaacggcaacaacgaaaccttcaccgtcaacagcagcggcggctacagccagttcgtcgccaagcacagcggcctgtgcctggcgcagggcaacaccagcaccggcggcggctccttggtgcagctcgcgtgcgcgacggcgggcgtggccaccttggccacgcagtggagtgtggtcggggcgacgctgcgcaaccgggtgtctcccaacgcctgcctcgatgtccccggctcttcgaccacgcaaggaaccgcgctgtccacctacgcctgccatggcggcgcgaaccagcgttggagccagattccctga

SEQ ID NO: 2027 - DNA, 4677 bp, Acidovorax sp.
atgaaaatccggtattacctgatggcactgctgctgccgttcgccaccttgctcacgcatgcggcgatcaccggggtcaacccgatgacgaccctcaccaccatggcggctgcggtcacgcaggccgccgaggttccgctcccgctgcaggggccgggcctgggcaatctcacctacacctcggccgaactgttcaagccggtctccatgatcacccgcgcctcgggcgacgtgccggccacctaccccggccgcaaggactacgggctgaacgtgggcatcatgctcaacggctatttcctgacctccttcgcgcccgacagcggcctgggccccgggggctttctgctgtacgacgtgtccaacccgcgggccatcgtgctcgtcaagaagatctacgagcccgagggccgcaccaaggagttccgcgaggcgcacgccttcggcacggccaagatcaatggccgccagtacgtggtggtgcccagcatcaagggcatcgagttctgggacttcaccgacatcaacaacatccagcaggtcaagaagctctcgctgcccacggtgaacgggggcgactacaccaacgtggcctggcagctgtggtggcaggcgccctacgtgtacgtggcctcggccaacgacggtgtctacatcgtggacgccagcgaccccgccaatgccgtgatcgccaaccgcggcgcgggcaagcccaatcccgtgcccacgggcgagctgggcggctttcgcgtggggcccatcttcaccatgggcaaccacatggtgctctcatcgatggacaacaccgacggctttgccagcctggacatctccgacccgctcaatcccaaggtgctggacaccgtgggctccaaccccaactactacgccacctgcttcgacggccgcaacctgcacgcctcggcccgcggcggcggcgccaagatgtacagctacgacctgctggaccgcacgcagttcgtggtggaggacaaccgcctggtcatcgatgagcagctgtactgcggcacgcaggaccactatgtgttccagggcgcgcagttcaaggtgcacaaggtggacgtgagcaacccgctgaaccatgtggaagtgggccagggcagcctgttcgccaccaacgaccccgaatactcgcattccgaccacggccaggtggcgcccatgggcaacctgctgttcatcggcaacgaccacggctcgggcagcggcttcatcgtgcaccagacggcgcccgacaccacgccgccggccgtcaagcagacctcccccgccaacggcgccaagcagcaggcgctgacctcgcgcatcggcgtgggcctgacggacagcatccggcccgagagcgtgaacgccgccaccttcatcgtgcgcccggtcaacggcaatgcactgcccggcacctacagcgtgcagctgggcatcatcaacttccaccccacgcaaccgctcacggccggcacgagctacgagatcgtgctcacggccggcggcgtgaaggactatgcgggcaacggcatcgcggcagagtacaaggccgtgttccacaccggcaatgccaccgacatcagcctgatgaaccactggccgctgtccaccaccctgaccgacgagatcggcgccaacaacggcacggcctcggcggccgaccagttcgccagcatcggcctgaacttcgcgcagcgcacaggcggcgtgccgctcaaaaacgatggcgtggccactgccctggggggcacggcctcgctggccttctacatgaagactacgcaaaacggctcggccaatgcctggacggcacccggcctcttcggtcgcgaccagtcgggcggcgcggacgatgtgttctggggctggatcgacaacaccggccgcatgaatctctcggtgggcaacgtggcggcgaacaaccctggcacccgctccaccgctgccgtgaacgacggcaactggcaccatgtggtgatgacgcgcgacgccgcctcgggcgcgcagacgctgtacatcgacggcaacaagaccagttccaccgggctcacgggcaccaagggcctgtccaacaagttcgcgctgctcggccagatccagggcaacaccgacttcttccgcggcagcctggccgacgtgcgcgtctacggccgcgtgctcagcgatgccgacgtcacgcagctgcgctcgcaggccatcatcggcgatgccggcgtgagcggcgggccgcagctggtgaacggacagttgaacttcgaccccacccggctcggcggcggcacgggcgtcacctaccgctggaacttcggcaacggcacgcagaccgccttctcgtcccagcccaacaccacctacagctacaaccgccccggccactacacggtgacgctgacggtgcgcaatgccgcaggccaggagaccttctacacctacaacgtcaccgtgaccttcccggtgacggccacggcgcccacgcattcgagcaacatcgtgggcgatgccaacagcatctatgcggtgaaccccgacagcggcacggtggcggccatcgatgcccaggccctgaccaagcgctgggagacgcgcgtgggcgacgagcccaagaccctggcgcgtgcgcccgacggccgcatctgggtgacagtacagggtgaggacaagctcgtggcgctgaatcccaccgacggcagcatctcggccacggtggccctgccctacggcagcggcccctacggcgtggccttcacgcccaatggcagcaagggcctgctgacgctggagagcaaatccacgctgatcgccttcgacccggccaacggcaacacctcgggcactctggccctggagggtgacctgcgcggcatcgccgtggcggccgattcgcagacggtctacgtcacacgcttcaagtcgaagatgacgggcgggcagttgcacaaggtgggcctgagcaccatgggcctcttgtccaccatcgccctgccggtggacaccaccaccatcgacaccgagaacagcgcgcgcggcgtggccaactacctgagccaggtggtgatctcgcccgatgggtcgcgtgccgtgctgccgggcaagaaggacaacatcgtgcgcgggcgcttccgcgatggcggtgacctgctgcacgaccagacggtgcgctccatcctctcgcaggtggacctgtcagcggccatgcacctgctgccagagcagatcgacttcgacgaccgggcaccggcgcgcgccgccctcttctcccctgcaggcgactacctgttcgtcgcgcagatggagggcaacaacatcgccatcgtcgatgcctacacccgtgccgtgcgcggcgaaatcaacgccagcagcgcgccccacggcctgtacctggacgccacgcgcaagcgcctgttcgtgaacaacttcctggcgcgctccgtcaccgtgcacgacgtggccgacgtcctggcctcgcgcagcgcggcagcggtgttcctgcagaacgtggccacggtggcgcaggagccgctgggtgccgcggcgctgcgcggcaagctggtgttctacaacgcggccgaccggcgcatgagcaaggacaactacatgtcctgcgcgagctgccacgccgatggcggcgacgacggcatggtctgggacttcacccagcgcggcgagggcctgcgccgcaccatcagcctgcagggccggcgaggcaccggccacggcaagctgcactggagcgccaacttcgacgaggtgcaggacttcgagaacgacatgcgcagcgccttcggcggcacgggcttcctgagcgacgcggactttgccgcgaccagcgacccgctgggcgcgcccaaggccggccgcaacgcgcagctcgacgatctggcggcctacctgggctctctcaacaagtacctgcgcagcccggcacgcgccgccgatggcaacctgacggtggaggcggcacgcggccagaccctgttcgccaacgccaactgcgccagctgccatgcgggcgggaccttccaggatggcctcaggcacgacgtggggaccatccagccatcgtccggcaagggtgccaaccagccgctggccggcgtgggcttcgacacgcccaccctgctgggcagctgggccgccaagtcctacctgcacaacggccagaaggccagcgtggcggacgtgctcgccggcggccacggcaacgtggcaggcctacccgcggccgaccggcaggcactggccgactacgtgcgctcgctggacacggcagccgagtacaccacgcggctgcgctccagccacagcaacctgtgcgtgaacatccggggggcttctgctgccagcggcgcggtcgccatccagtggccctgcggcacggcgaacaacgagaccttcacggtgcgcaacctcgcgggcggctatgtgcagctggtcgccaagcacagcaacctgtgcctggcacaggacagcgccgccaccaacggtgccggtgtggtgcaactggcctgtacggttggcaacacggcgcagtggacgctgtccggatcgacgctgcgcaaccgcgcatccggcgcctgcctggacgtgcccaacaactccacggcgcaggacatccccctgctcacctggacctgcaacggcggcaacaaccagaactggctgcagcagtga

SEQ ID NO: 2028 - DNA, 4680 bp, unknown
  environmental sample
atgaagatccggtactacttgctggcgctgctgctgccattcgccaccttgatgacgcacgcggcaataacgggcgtgagcccgatgaccaccttgaacacgatggtgaccacggtcacgcgggccggcgaggcgacgctggcgcttcagggcccgggcctgggcaacctcacctacacctcggccgagctcttcaagccggtctccatgatcacccgcgcctcgggcgatgtgccggccacctacccgggccgcaaggactacgggttgaacgtgggcatcatgctaaacggctacttcctcacgtcctttgcgccggacagcggccttggcccagggggctttctgctgtacgacgtgtccaacccccgcgccatcgtgctggtaaaaaagatctacgagcccgaggggcgcactaaggagttccgcgaggcacactctttcggcaccgcgaagatcggcggcaagcaatacgtggtggtgcccagcatcaagggcgtcgagttctgggatttcaccgacatcaacaacatccagcaggtcaagaagctggcgctgcccaccgtgaacgggggcgactacgccaacgtggcgtggcagctgtggtggcaggcaccgtatttgtacgtggcctcggccaacgacggggtctacatcgtggacgccagcgaccctgtcaatgccgtgatcgccaaccgcggcgctggcaagcccaaccccgtgcccacgggcgagctgggcggttttcgtgtggggcccatcttcaccatgggcaaccacatggtgctgacctcgatggacaacaccgacggctttgccagcctggatatttccgacccgctcaaccccaaggtgctcgacaccgtgggctccaaccctaactactacgccacctgttttgatggcaagaacctgcacgcatcagcacgcggcaatggcgccaagatgtacagctatgacctgtccgaccgcacacagtttgtggtggaagacaaccggctcgtgatcgacgagcagctgtactgcggcacgcaggaccactacgtgttccagggcgcgcagttcaaggtgcacaaggtggacgtgagcaacccgctcaaccacgtcgaggtaggccagggcagcctgttcgccaccaaccatcctgactactcacactccgaccacggccaggtcgcgcccatgggcaacctgctgttcatcggcaacgaccacggttcgggcagcggcttcatcgtgcaccagacggcgcgcgacaccacgccacccgccgtcaagcagacatcgcccacgaacggcgccaagcaacaggcactgacctcacgcatcggcgtgggcctcaccgacagcatcctgcccgagagcgtgaccgccagcaccttcatcgtgcggccggtcaacggcaacacactggccggcacctacagcgtgcagctgggcatcatcaatttccaccctgcacagcccctggcagctggcaccagctacgaaattctgctgacggccggaggagtgaaggactatgcgggcaacggcatcgctacagagtacagggctgttttccacaccggcaacgccaccgacatcagcctgagcaaccactggccgctgaccagcgcgctgaccgatgagatcggtgcgaacaacggtacggcctcggcggccgaccgcttcgagggcctgggcctgaactttgcgcaacgcaccggcggcgtcgcgctcaagaacgacagcttggccactgccctgggcggcacggcctcagttgcgttctatatgaagacgacacaggcaggctcggcgaacccctggaccgcgccgggcatttttgggcgcgaccaggccaacggcgcagacgacgtgttctggggctggctcgacaacaccgggcgcgtgaacctgtcggtgagcaacgtcgcggccaacaaccccggcacacgttccaccgccccggtaaacgatggcgcctggcaccatgtggtgatgacacgcgacgccgcgtcgggcgcgcagacggtgtacatcgacggcaccaagaccagctcgaccgggctcaccgggaccaaaggcctgtccaacaagttcacgctgctcgggcagatacagggcaatgccgacttcttccgcggcagcctggccgacgtgcgggtctatggccgcgtgctcagcgatgccgacgtggcgcaactgcgctcgcaggccatcattggcgacgttgccgtaagcggttccccgcagctggtcaatgggcagctgagcttcgacccgacccgcctgggcggcggcacgggcctcacctaccggtggaattttggcaacggcacgcagaccaacttctcagcccaggccaatgccagctacgcctacaaccgcccgggccactacaccgtgaccctgacggtgcgcgatgctgcgggccgggagaccttctacacctacaacgtgaccgtggtcttcccggtgaccgccaccgcgcccacgcattcgagcaatatcgtgggtgacgccaacagcgtgtatgcggtgaacccggacagcggcacggtagccgccatcgatgcggtgtcgctggccaagcgctgggaaacgcgtgtgggcgacgagcccaaaaccctggcgcgcgcgccggatggccgcgtctgggtcacggtgcagggcgaggacaagctggtggcgctgaaccccacggacggcagcatttcgaccacgatcacgctggcctacggcagcgggccgtacggcgtggccttcacgcccaatggcgccaaggggctgctgacgctggagagcaaatccacgctcattgccttcgaccccgccaacggcaacaccacgggcacgctcgcgctagaaggcgacttgcgcggtattgccgtggcggctgattcgcagacggcgtacatctcgcgcttcaagtccaggatgacgggtgggcagctgcacaaggtgggcttgaacagcatggcgctggtgtccacgattgcgctgccggtcgacaccaccacggtcgacaccgagaacagctcgcgcggcgtggccaactacctgagccaggtggtgatctcgcctgacggtggccgtgcggtgctgccgggcaagaaggacaacatcgtgcgcgggcgctttcgcgacggcaacgacctgccacacgaccagacggtgcgctccatcctgtcgcaggtggacctgtcgcagggcacgcatttgctggccgagcagatcgacttcgacgaccgggcaccagcgcgtgcggccctgtattccccggtcggagactacctgtttgtcgcgcagatggagggcaacaacatcgccatcgtcgacgcctacacccgcgccgtgcgcggcgagatcaacgcgagcagcgcaccgcacgggctgtacctggatgcgtcgcgcaagcggctgttcgtgaacaacttcctcgcgcgatcggtcaccgtgcacgacgtagccgatgtgctggcatctcgcagcgcggcggcggtctttgtgcagaacgtggccacggtggcacaagagcccctggcagccgcagcgctgcgcggcaagcaggtgttctacaacgcggccgaccggcgcatgagcaaggacaactacatgtcgtgcgccagctgccacgccgatggcggcgacgacggcatggtgtgggacttcacccagcgcggcgagggcctgcgccgcaccatcagcctgcagggccggcgcggcctgggccacggcaagctgcactggagcgccaacttcgacgaggtgcaggacttcgagaacgacatgcgcagcgcgtttgggggcacgggctttttgagcgacgccgactttgctgccacgtccgacccgctgggcgcgcccaaggccgggcgcaatgcgcagcttgacgacctggcggcttaccttacttcgctgaacaagtacatgcgcagcccggcgcgtgcggccgacggcaccctcacggtggaggcggcacgcgggcagacgctgtttgccagtgccaactgcgccagctgccacgcgggcgggacgctcaccgatgggctgcggcacgacgtgggcacgatccagccatcgtccggcaagggcggcaaccagccgctggccggcctgggctttgacacccccacgctgatcggcagctgggctgccaagtcctacctgcacaacggccagaaggcgagcgtgctggacgtgatggcggggggccacggcaatgccggtagcctgcctgctgccgaccggcaggcgctggccgagtacgtgcgctcgctggatacggcgacggacttcaccacgcgcctgcgctcggcccacagcgcgctgtgcgtcaacatccgcggcgcgtcacccaacagcggcgtggtcgcaatccagtggccttgcggcacggcggccaacgagacctttacggtgcgcaccgtggcgggcggttttgtgcaactggtggcgcggcacagcaacctgtgcctagcgcaggacagcgcggcggcgagtggtgctggcgtggtgcaactggcctgcagcacgggcaacacggcgcagtggagtctggtggggtcgacgctgcgcaaccgcgcatcgggggcctgcctggacgtgcccaacaactcgacagcgcaggatattccgctggtcacctggacctgcaacggtggcaacaaccagaactggacacagttgccctga

SEQ ID NO: 2029 - DNA, 4680 bp, Acidovorax sp.
atgaaaatccggtattacctgatggcactgctgttgccgttcgccaccttgctcacgcatgcggcgatcacgggggtcaaccccatgaccacccttaccaccatggcggctgcggtcacgcaggccgccgaggttccgctgccgctgcaggggccgggcctgggcaatctcacctacacctcggccgagctgttcaagccggtctccatgatcacacgcgcctcgggcgacgtgccggccacctaccccggccgcaaggactatgggctcaacgtgggcatcatgctcaacggctattttctgacctccttcgcgcccgacagcggcctgggccccggcggctttctgctgtacgacgtgtccaacccgcgcgccatcgtgctcgccaagaagatctacgagcccgagggccgcaccaaggagttccgcgaggcccatgccttcggcaccgcgaagatcggcggcaagcagtacgtggtggtgcccagcatcaagggcatcgagttctgggacttcagcgacatcaacaacatccagcaggtcaagaaactggcactgcccaccgtcaacggcggcgactacaccaacgtggcctggcagctgtggtggcaggcgccctacgtgtacgtggcctcggccaacgacggcgtctacatcgtggatgccagcgacccggccaacgccgtgatcgccaaccgcggcgcgggcaagcccaaccccgtgcccaccggcgagctcggtggctttcgcgtcgggcccatcttcaccatgggcaaccacatggtgctgacctcgatggacaacaccgatggttttgcgagcctcgatatctccgacccgctcaaccccaaggtgctggacaccgtgggctccaaccccaactactacgccacctgcttcgacggcaagaatctgcacgcctcggcccgcggtggcggcgccaggatgtacagctacgacctgtccgaccgcacgcagttcgtggtggaggacaaccgcctcgtcatcgacgagcagctgtactgcggcatgcaggaccactacgtgttccagggcgcgcagttcaaggtgcacaaggtggacgtgagcaacccgctcaaccacgtcgaagtgggccagggcagcctgttcgccaccaacgaccccgagtactcgcactccgaccatggccaggtggcgcccatgggcaacctgctgttcatcggcaacgaccacggctcgggcagcggcttcatcgtgcaccagacggcgcgcgacaccacgccgcccgcggtcaagcagacctcgcccaccaacggcgccaagcagcaggcgctgacctcgcgaatcggcgtgggcctgacggacagcatcctgcccgagagcgtgcacgccggcaccttcatcgtgcgcccggtcaacggcaacgccctggccggcacctacagcgtgcaactgggcatcatcaacttccaccccacgcagcccctggcggccggcaccagctatgagatcgtgctcacggctggcggggtgaaagactatgcgggcaacggcatcgcggccgagtacaaggccgtgttccacaccggcaacgccaccgacatcagcctcatgaaccactggccgctgtcgagcaccctgaccgacgagatcggtgccaacaacggcacggcctcggcggccgaccagttcagcagcatcggcctgaacttcgcgcagcgcacgggcggcgtgccgctcaagaacgaaggcgtggccaccgccctgggcggcacagcctcgctggccttctacatgaagaccacgcagaacggttcggccaacgcctggacggcgcccgggctcttcgggcgcgaccagtcgggcggcgccgatgacgtgttctggggctggatcgacaacaccggccggctcaacctctcggtgggcaacgtggcgggcaacaaccccggcacccgctccaccgcggccgtgaacgatggcaactggcaccatgtggtgatgacgcgcgacgcggcctcgggcgcgcagacgctgtacatcgacggcgccaagaccagctccaccgggctcacgggcaccaagggcctgtccaacaagttcgcgctgctcgggcagatccagggcaacgccgacttcttccgcggcagcctggccgacgtgcgggtctacgggcgcgtgctcagcgatgccgatgtcacgcagctgcgctcgcaggccatcatcggcgatgccggtgtgagcggcggtccacagttggtgaacgggcaactgagtttcgacccgacccggctgggcggtggcacgggcgtcacctaccgctggaacttcggcaacggcacgcagaccgccttctcgtcccaggccaacaccacctacagctacaaccgccccggccactacacggtgaccctgacggtgcgcaacgcggcgggccaggacaccttctacacctacaacgtgaccgtgatcttcccgaccacggccacggcgcccacgcactcgagcaacatcgtcggcgatgccaacagcgtctatgcggtgaaccccgacagcggcacggtggcggccatcgatgcgctggccctgaccaagcgctgggagacgcgcgtgggcgacgaacccaagaccctggcgcgtgcaccggacggccgcatctgggtcaccgtgcagggcgaggacaagctcgtggcgctgaacccggccgatggcagcatcgcggccacggtgaacctgccctacggcagcggcccctatggcgtgaccttcacacccaatggcagcaagggcctgctgacgctggagagcaaatccacgctggtcgccttcgacccggccaacggcaacaccacgggcaccctggcgctggagggcgacctgcgcggcatcgcggtggcggccgattcgcagacggtctacgtcacgcgcttcaagtcgaagatgacgggcgggcaattgcacaaggtgggcctgagcaccatgggcctgctgtccaccatcgccctgccggtggacacgaccacgatcgacaccgagaacagttcgcgcggcgtggccaactacctgagccaggtggtgatctcgcccgatggctcgcgcgccgtgctgcccggcaagaaggacaacatcgtgcgcgggcgcttccgcgacggtggcgacctgctgcacgaccagacggtgcgctccatcctctcgcaggtcgacctggcgcaggccacgcacctgctgcccgagcagatcgacttcgacgaccgggcgccagcacgcgccgccctcttctcccctgcgggcgactacctgttcgtagcacagatggaaggcaacaacatcgccatcgtcgatgcctacacccgcgccgtgcgcggagagatcaacgccagcagcgcgccccacggcctgtacctggacactgcgcgcaagcggctgttcgtgaacaatttcctcgcgcgttcggtcaccgtgcacgacgtggccgacgtgctggcctcgcgcagcgcggcggcggtgttcctgcagaacgtggccacggtggcgcaggagcccctggcggcagcggcgctgcgcggcaagctggtgttctacaacgcggccgaccggcgcatgagcaaggacaactacatgtcctgcgcgagctgccacgcagacggcggtgacgacggcatggtctgggacttcacccagcgcggcgagggcctgcgccgcaccatcagcctgcagggccggcgcggcactggccacggcaagctgcactggagcgccaacttcgacgaggtgcaggacttcgagaacgacatgcgcagcgccttcggcggcacgggcttcctgagcgacgcggactttgctgccaccagcgacccgctgggcacgcccaaggcgggccgcaacacgcagctcgacgacctggcggcctacctggcctcgctcaacaagtacatgcgcagcccggtgcgcgcggccgatggcagcctcacggtggaggcagcgcgtgggcagaccctgttcgccaacgccaactgcgccagctgccatgcgggcggcaccttccaggacggcctcaggcacgatgtgggcagcatccaggcctcctcgggcaagggcgccaaccagccgctggccggggtgggcttcgacacgcccacgctgattggcagctgggccgccaggtcctacctgcacaacggccagaaggccagcgtgctcgacgtgatcgccggcggccacggcaacgtggccggcctgcccgcggccgaccggcaggcgctggccgactacgtgcgctcgctggacaccgcgtcggagttcaccacgcgcctgcgctccagccagagcacgctgtgcgtcaacatccgcggggcttcggccgccagcggcgcggttgccatccaatggccctgcggcacggcgaacaacgagaccttcacggtgcgcaacctggcgggcggctatgtgcagctggtggccaagcacagcaacctgtgcctggcgcaggacagcgcagccaccagcggcgcgggggtcgtgcaactggcctgcacggtgggcaacacggcgcagtggacgctgtcgggatcgaccgtgcgcaaccgcgcatcgggcgcctgcctggacgtgcccaacaactccacggcgcaggacactcccctgctcacctggacctgcaacggcggcaacaaccaaaactggaaccagctgccctga

SEQ ID NO: 2030 - DNA, 4680 bp, unknown
  environmental sample
atgaaaatccggtattacctgatggcactgctgttgccgttcgctaccttgctcacgcatgcggcgatcacgggggtcaaccccatgaccaccctcaccaccatggcggctgcggtcacacaggccgccgaggttccgctgccgctgcaggggccgggcctgggcaatctcacctacacctcggccgagctgttcaagccggtctccatgatcacccgcgcctcgggcgacgtgccgtccacctcccccggccgcaaggactacggtctgaacgtgggcatcatgctcaacggctatttcctgacctccttcgcacccgacagcggcctaggccccggcggctttttgctctacgacctgtccaacccgcgcgccatcgtgctcgtcaagaagatctacgagcccgagggccgcaccaaggaattccgcgaggcgcacgccttcggaacggccaagataaatggccgccagtacgtggtggtgcccagcatcaagggcatcgagttctgggacttcactgacatcaacaacatccagcaggtcaagaagctggtcctgcccaccgtcaacggcggcgactatgccaacgtggcctggcagctgtggtggcaggcaccctacgtgtacgtggcctcggccaacgacggcgtctacatcgtcgatgccagcgacccggccaacgccgtgatcgcaaatcgcggtgcgggcaaacccaaccccgtgcccaccggcgagctcgggggctttcgcgtcgggcccatcttcaccatgggcaaccacatggtgctgacctcgatggacaacaccgatggttttgcgagcctggacatctccgacccgctcaaccccaaggtgctggacaacgtgggctccaaccccaactactacgccacctgcttcgacggccgcaacctgcacgcctcggcccgcggtggcggcgccaagatgtacagctacgacctgtccgaccgcacgcagttcttggtggaggacaaccgcctggtcatcgacgagcagctgtactgcggcatgcaggaccactacgtgttccaaggcgcgcaattcaaggtgcacaaggtggacgtgagcaacccgctcaaccacgtggaggttggccagggcagcctgttcgccaccaatgaccccgagtactcgcactccgaccacggccaggtggcgcccatgggcaacctgctgtttatcggcaacgaccacggctcgggcagcggcttcatcgtgcaccagacaacacgcgacaccacaccgcctgcggtcaagcaaacatcgcccacccaaggcgccaagcagcaggcgctgacctcgcgcatcggcgtaggtctgacggacagcatcctgcccgagagcgtgaacgcgagcaccttcatcgtgcgccctgtcaacggcaacaccctgcaaggtacctacagcgtgcaactgggcatcatcaatttccaccctgcacaacccctggcagcgggcaccacctatgaaatcctgctccccgcaggcggcgtgaaagactatgcaggcaatgccatcgccagtcagtaccgttccgtgttccacaccggcaacgccaccgacatcagcctgatgaaccactggcctctgaccagcgggcttgccgatgagatcagcgccaacaatggcacggcctcggcagccgaccagttcggcagcatcggcctgaattttgcgcagcgcaccggcggcgttccgctcaagaacgatggcgtggccaccgccctgggtggcacagcctcgctggcgttctacatgaagaccacgcagaacggttcggccaacgcctggactgcgcccggcatcttcgggcgcgaccagtccggcggcgcggacgacgtgttctggggctggatcgacaacaccggccgcatgaacctctcggtgggcaacgcggcgggcaacaaccccggcacccgctccactgctgcggtgaacgatggcaactggcaccacgtggtgatgacgcgcgacgcggcctcaggcgcacagacgctgtacatcgacggcgccaagaccagctcgacaggcctcaccggcaccaagggcctgtctaacaagttcgcgctgctcgggcagatccagggcaacgccgacttcttccgcggaagcctggccgatgtgcgcatctacgggcgtgttctcaacgatgccgatgtcgcgcagctgcgctcgcaggccatcataggcgatgcgggcgtgagcggcgggccgcagctggtgaacgggcagatgaacttcgcccccacccggctgggcggtggcacgggcgtcacctaccgctggaacttcggcaacggcacgcagaccgccttctcgtcccaggccaacaccacctacagctacaaccgccccggccactacaccgtgaccctgacggtgcgcgacgcagcgggcctggagaccttctacacctacaacgtgacggtgaccttcccgaccacggccacggcacccacgcattcaagcaacatcgtcggcgacgccaacagcatctacacggtgaacccggacagcggcacggtcgcggccatcgacgccacggccctgaccaagcgctgggaaacccgcgtgggcgacgagcccaagaccttggcacgcgggccggacggccgtctctgggtcaccgtgcagggcgaggacaagctcgtagccttgaacccaaccgatggcagcatctccgcaaccattgcactggcctacggcagcggcccttatggcgtggcgttcacccccaacggcagcaagggactgctctcgctggaaagcaaatctaccctgctcaccttcgatccggccaacggcagcatcacgggaacactggcgctcgaaggcgacctgcgcggcattgcagtggcggcagactctcaaactgcctacatcacacgcttcaagtcgacgatgacgggcggccagttgcacaaggtgaatctcaatggcatgcaactgctgtccaccatcgctctgcctgtggacacgactacagtggacaccgagaacagcgcgcgcggcgtggccaactacctgagccaggtggtgatctcgcccgatggctcgcgcgcagtgctgccgggcaagaaggacaacattgtgcgcgggcgcttccgcgacggcaacgacctgctgcacgaccagacggtgcgctccatcctctcgcaggtggatctgacccaggccacgcacctgctgccagagcagatcgacttcgacgaccgggcccccgcgcgcgccgccctcttctcccctgcgggcgactacctgttcgtcgcgcagatggagggtaaaaacatcgccatcgtcgatgcctacacccgcgctgtgcgcggcgagataaaggccagcagcgcgccgcacggcctgtacctggacgccacacgcaagcgattgttcgtgaacaacttcctcgcgcgctcggtcaccgtgcacgacgtggctgacgtgctggcctcgcgcagcgcggcagccgtgttcctgcagaacatcgccacggtggcgcaggagcccatggcagcggctgctctgcgcggcaagctggtgttttacaacgccgccgaccggcgcatgagcaaggacaactacatgtcctgcgctagctgccatgccgacggaggcgacgacggcatggtctgggacttcacgcagcgcggcgagggcctgcgccgcaccatcagcctgcagggccggcgcggcaccggccacggcaagctgcactggagcgccaacttcgacgaggcgcaggacttcgagaacgacatgcgcagcgccttcggcggcaccggcttcctgagcgacgcggactttgcagcgaccagcgacccgctgggcgcacccaaggccggccgcaatccgcagctcgacgacctcgctgcctacctggcatcgctcaacaagtacctgcgcagcccggcgcgcgctgccgacggcaacctgacggtggaggctgcgcgtgggcagaccttgttcgccaacgccaactgcgccagttgccatgcgggcgggactttccaggatggacttcggcacgatgtgggcagcatccagccctcgtcaggcaaaggggctaaccagccactggccggtgtgggctttgacacgcccaccctgctgggcagctggacggccaagtcctacctccacaacgggcagaaggccagcgtgctggatgtgatcaccgatgggcacggcaacgccgccggcttgcccgccgccgaccagcaggcactggctgcctacgtgcgttcgctggacgccacggccgagtacaccacccgcctgcgctccaaccacagcaacctgtgcgtcaacatccgtggggcctcggccaatgctggtgcagtggccatccaatggccctgcggcacggccaacaacgaaaccttcacggtgcgcagcggggcaggcggctatgtgcagttggtggcgcggcacagcaacctgtgtctggcgcaggacagcgccgcagcgagcggcgccagcgtggtgcagctggcctgcagcgcgggcaacacggcgcagtggtcgctagtgagctctactctacgcaaccgcgcctcaggcgcttgcctggacgtgcccaacaatgcgacggcgcaggacactccccttctgacctggacctgcaacggcggcaacaaccagaactgggttcaattgccctaa

SEQ ID NO: 2031 - DNA, 4740 bp, unknown
  environmental sample
atgaaacttcgaaaaatcctgggggtgggtcttttgagttcctgtgtctggctcgcgcatgcggccatcaccggcaccagcccctaccagaacctcaagagcgccgccaatgcggtggccgcgctggtggcggacccgctgccgctgcaggggcccggcctgggcaacctgagctacacccaggcggaactcttcaagccgctgtcgatgatcaaggaggaggtcgtcccgggcggcgacgggctcggcgcggacgtgcccaagatccccggcggcagcgtcacgcaccccaccgccggctacaccaaataccacttcggcctcaacgtggggctgatgatcaacggctactttctcaccgcgttcagtcccgacggcggcttggggccgggcggcttcctgatgtacgacatctcgaacccgcgccagatcaagctggtcaagaagatcttcgagcccgacggccgcaccaaggagttccgcgagccgcatgcgatcggcgccgcgaagatcaacggcaagcagtacgtggtgatcccgagcacccgcggcatcgagttctgggacttcaccgacatcaacgacatccagcaggtcaagaagctggccttcccgaccgtcgaccgcggcgactatgccaatgtgagctggcaactgtggtggcaggcgccgtatgtgtacgtggcgtcgtccaacgacggcatgtacatcgtcgacgcgcgcgacccggccaacgcggtgctggccaaccgcggcgccggcaagcccaatccggtgcccacgggcgaactgggcggcttccgcctcggccccatcttcaccctgggcaaccacatggtgctgacctcgatggacaacaccgccggcttctccagcctggacatctccgatccgctcaaccccaaggtgctggacacggtgctgtccaaccccaactactacgcgacctgcttcgacggcagggagctgcatgcctccgcgcgcggcaccggcgcgaagatgtacagctacgacctcgacgacccgtcgcgcttcgtggcgcaggacaagcgcctgcagatcgacgagcagctgtactgcggcacgcaggacaacttcgtcttccagggcgcgcagcgcaagatccacaaggtggacgtgagcaacccgctcaaccacgtggaagtcggccgcggcggcatcttcccgccgggctccacggacgaggccaattccgaccacggccaggtcgcgcccttcggcaacctggtcttcgtgggcaacgaccatggctcgggcagtgccttcatggtgcacgcgatggatcccgacaccacgcggcccgaggtcaagcaggtctcgccgcgcagcggcgcgaagcagcaggcgctgagcacgcgggtgggcgtgggcatgaccgacagcatcctgcccgagacggtgaatgcgagcaccttcatcgtgcgcccggtcggcggcaacagcctggccggcacctacagcctgcagctgggcatcctgaacttcttccccgaccagccgctgcagcccaacaccacctacgaggtgttcctgcccgccggcggcgtgaaggactacgccggcaattcgctcggcgccgactaccgctccaccttcacgacgggcagctccaccgacatcaacctggtgcaccactggacgctggccggcacgctgggcgacagcatcggcaacaacaacggcacgcctgccggtggcgatgcctatgacccgatcgggctgaacttcgcgcagcgcagcggcggcgtgccgctgcagtccgatggcgtggcctcggtgctgggcgggaccgcctcgctgagcttctacatgaagaccacgcagaccggcagcgccaacccctgggacgcgcccggcattttcgggcgcgaccagtcgcccggcggcagcgacgtgttctggggctggctcgacgcgagcggctacatcaacctgtcggtgggcaacaagagcgcgagcaatcccggcacgcgctccacggcggcggtcaacgacggcaactggcaccacgtggtgctgacccgcgacgccgcctccggcgcgcagaccctgtacgtcgacggcgtgaagaccggcagcaccggcgccaccggcacgctgggccttaacaacaagttccaggtgatgggccagatccagggcgctgccgccttcttcaagggcacgctggccgaggtgcgcgtctacaaccgcgtgctgggcgatgccgacgtggcgctgctgcgcgagcgcgccgtggtgggcgacccgggcctgggcagcgggccgaagatcgtcaatggccagatcgcgttcggcccgagcgtcctcggcggcggcggcgcgacctacagctggaacctgggcgacggcacgcgcacgccgttctcggcgcaggcgggctacacccacacctatgcgcagcctggccactacacggtgacgctgaccgtgcgcgacgccaacgggcgcgagagctactacacctacaacgtcaccgtgatcacgccgatcaccaccgccagcccgagccacagctccaacatcgtgggcgacgcgggcagtgtctacagcgtcaacccggacagcgggacggtcgcggcggtggatgcgcagaccctggccaagcgctgggaggtcagcgtaggcacggagcccaagacgctggcggtggggccggacgggcgcatctgggtgacggtgcagggcgacgacaagctggtcgcgctcaacgccgccgacggcagcctgtcggccaccgtcgcgctggactacggcagcggcccctacggcgtggccttcacgcccgacaggaccaccggcctgctgaccctggaaagcaagtcggcgctggccagcttcgacccggccagcggtgccatcaccggccgcgtcgcgctgcagggcgatgtgcgcggcatctcggtggcagccaactcgcagaccgcctatgtcacgcgcttccgctccactgccaccggcgggcagctgcacaaggtcgcgctgcagccgctggcgctcaccggcaccatcgcgctgagcgtcgacaccaccaccgcggacgacgagagcaaggcgcgcggcgtgcccaactacctcagccaggtggtggtgtcgcccgacggcgcccgcgcgatgctgccttcgaagaaggacaacatcgtgcgcggcctgttccgcgacggccagcgcatggagcacgaccgcacggtgcgctccatcctgtcgcaggtgaacctggcgcaggccacggaggtgttctccgagcagctcgacttcgacgaccgcgcaccggcgcgcgcagcgctgtactcgccgtggggcgacttcatcttcgtcgcacagatggagggcaaccgggtggcgatcgtcgacagctacacccgcgccatccgcggcgagatcgccgacgtgggcagcgcgccgcacgggctgtacctggacaccgcgcgcaaccggctgttcgtcaacaacttccttggccgctcggtcgcggtatacgacgtgggcgcggtgctgtcggcgcagaccaacgcggccaagccgctgggcagcgtcgccacggtggcgcaggagccgctggccgcggcggtgctgcgcggcaagctgctgttctacaacgcggccgaccggcgcatgagcaaggacaactacatgtcctgcgcgagctgccacgccgacggcggcgacgacggcatggtgtgggacttcacccagcgcggcgagggcctgcgccgcaccatcagcctgcaggggcgccagggcctgggccacggcaagctgcactggagcgccaacttcgacgaggtgcaggacttcgagaacgacatccgcgccgagttcggcggcatcggcttcatgagcaacgtggattactcggccaccgccgatccgctggggccgcccaaggccggaaagagcgcgcagctcgacgacctggccgcctacctcgcgtcgctcaacaagtacatgcgcagcccggcgcgcaacgccgacggcagcctgagcgtggacgccgcgcgcgggcagacggtgttcgccagcgcgcagtgcgccacctgccacagcggcgcgaccttccaggacgggcagcggcacgacgtgaacaccatccagccgtcctccggcaagggcatgaaccagccgctggccggcgtgggcttcgacacgccgacgctcaccggcacctggaagaacgcctccttcttccacaacggccaggcggcgacgatgcaggacgtgctggccggcggccacggcaacgcggccagcctgccggccgccgacgtggtcgcgctacgcgagtacgtgcgctcgctggacaccggtgtggcggcggcgcaggtggtgcgcattcgctccagcctgagcagccagtgcgtgaacatccgcggcgcggcgaccaccagcggtgccgcggcggtgcagtggccctgcggttcggcagagcacgagaagttcaccgtcaacgacgtcggcggcggctacgtgcagttcgtcgcgaagcacagcgggctgtgcctggcgcagaacggcagcggcgccagcaatgtgccggtggtgcagttggcctgctccgtcggcgcgacggcccagtggagcctgagcggggccaccatccgcaaccgcgcctcgggcgcctgcctcgacgtgcccggcagcagcacggcgcaggacacccagctcatcgcctggacctgcggcggcaccaacaaccagaactggagccagatcccctga

SEQ ID NO: 2032 - DNA, 207 bp, Actinomyces Sp.
atggacaagttcacccgccgcaccaccaccctgagcgacagcgacttcagccaggccgtcagctccgagacccaggcccccatcgaaggtgctgagggcttcagctgccccggcgccgagtacgcctgcaacaaccgctgccgaagcatcggctacaggggaggctattgcggctcctggctcaacctccagtgccgctgctactga

SEQ ID NO: 2033 - DNA, 1065 bp, Arthrobacter sp.
gtgaaaaaatccttggcaactttcaggaccctggccgtgtccggagtcctggcgctggccgtcgtggcaggacctgcaccgctggccaacgctgtgggtgaaggccccaactacgacgggaacggccagatcaccacctcgaaactggccacctacgaccagatggtgtcgttcctgaaggaccaggatgcgcgccagtccgccatggagctggaggtcatcggccagaccgtcaaggggcgcgatatccacctggtcaagtacatctcggacccggccaagcccaccatcctctacttgacccaacagcacggcaacgagcagctcaccaccgagggtgcgctggaattcgtcaagcacctggggacgggcaagtccgcagacatcctggacggcgtgaacatcctgatcgttcccatgctcaacgcggacggcgccatgggggacgtgaacttcccgctggacgattacctggcaaagggtgaccgcaacatgacccgctacaacgccgaggaggtggacctcaaccgtgaccatgtagccaagatccagccggaaacgcaggcgctgcacaacaacgtcatgcgcaagtacaacatcgactacatgatcgatctccaccaccagggcacgcgcagcgaacgcgacggggaactggtatcaggctccatcctttaccccaccacgccgaacgccaatcctgctgttgtggagaaatcgaagcagctgggcgccgtcgtgttccacaacgttgactccaccggctggggccacctgggcaagtacgttggcggaagcgccgaaaccatcagccgcaacgggatcgccgtggagtacggaatcgcaacactgctgttcgagatgcgtggcatgtccgaccactacctggatggatacgccctggggctcaggagcaacggttatctgattaagcagactgtgactacgctggccgccacagcggccgccatcgctgacggatcgattgccggcgcggacacctccttctgggacagcctggccacccagacctcccgcccgggcggggaagccgacgacgagtag

SEQ ID NO: 2034 - DNA, 1065 bp, Arthrobacter sp.
gtgaaaaaatccttggcaactttcaggaccctggccgtgtccggagtcctggcgctggccgtcgtggcaggacctgcaccgctggccaacgctgtgggtgaaggccccaactacgacgggaacggccagatcaccacctcgaaactggccacctacgaccagatggcgtcgttcctgaaggaccaggatgcgcgccagtccgccatggagctcgaggtcatcggccagaccgtcaaggggcgcgatatccacctggtcaagtacatctcggacccggccaagcccaccattctctacttgacccaacagcacggcaacgagcagctcaccaccgagggtgcgctggaattcgtcaagcacctggggacgggcaagtccgcagacatcctgggcggcgtgaacatcctgatcgttcccatgctcaacgcggacggcgccatgggggacgtgaacttcccgttggacgattacctggcaaagggtgaccgcaacatgacccgctacaacgccgaggaggtggacctcaaccgtgaccatgtagccaaggtccagccggaaacgcaggcgctgcacaacaacgtcatgcgcaagtacagcatcgactacatgatcgacctccaccaccagggcacgcgcagcgaacgcgacggggaactggtatcgggctccatcctttaccccaccacgccgaacgccaatcctgctgttgtggagaagtcgaagcagctgggcgccgtcgtgttccacaacgttgactccaccggctggggtcacctgggcaagtacgtaggcggaagcgccgaaaccatcagccgcaacgggatcgccgtggagtacggcatcgcaacactgctcttcgaaatgcgtggcatgtccgaccactacgctgacggcgtcgccctgggcctgcgcagcaacggctacctgatccagcagaccgtcaccaccctgacatccaccgccgcggccatcgccgacggctcgatcgccgacgccgacatctccttctgggacagcctcgccacacagacgtcccggccgggcgaggaagccgacggcgagtaa

SEQ ID NO: 2035 - DNA, 1062 bp, Arthrobacter sp.
gtgagaaaaaccctggcaaccttcaggaccctggccgtaaccggagccctggccctggcagtcgtggccgcgccggcacccgcgatggccgtcggcgaaggccccaactacgacggcaacggccagatcaccacatcgaagcttgccacctatgaccagatggtctcgttcctcaaggaccaggacgcacgccagtccgccatggagctcgaggtcatcggccagaccgtgaaaggccgggacatccacctggtcaagtacatctcggaccctgccaagcccaccatcctgtacctgacgcagcagcacggcaacgagcagctcaccacggaaggcgccctggaattcgtcaagcacctcggcaccggaaagtcagcggatatcctcgacggcgtgaacatcctcatcgtgcccatgctcaacgcggacggcgccatgggggacgtgaacttctccctggaggactacatcgccaagggcgaccgcaacatgacccgctacaacgcgaatgaagtggacctcaaccgcgaccacgtggccaagatccagcccgaaacccaggccctgcacgacaacgtgatgcgcaagtacaacatcgactacatgatcgacctgcaccaccagggcacgcgcagccagcgggacggggaactcgtctccggctccatcctgtaccccaccacgcccaacgctgatcccgccgtcgtggagaagtccaagcagttgggcgccgtggtgttcgagaacgtcgactccaccggctggggccacctgggcaagtacgtgggcggcagcgctgaaaccatcagccgcaacggcatcgccgtggagtacggcatctcaaccctgctgtttgaaatgcgcggcatgtcggaccactacctggacggctacgcccttggccttcggagcaacgggtacctgatcaagcagacggtcaccacgctgaccgccacggcagcggccattgctgacggatccattgccgacgccgacacttccttctgggacagcctcgccacccagacctcccgcccgggcgaggaagccgacgacgagtag

SEQ ID NO: 2036 - DNA, 1062 bp, unknown
  environmental sample
gtgagaaaaaccctggcaaccttcaggaccctggcactaaccggagcgctggctttggcggcagtgaccgtcccggcgccggcccttgccgtcggcgaaggccccaattacgacggcaacggccagatcaccacatcgaagcttgccacctacgaccagatggttgcgttcctcaaagaccaggacgcccgccagcccgccatggagctggaagtcattggccaaacggtcaagggccgggacatccacctggtcaagtacatttcggaccccgccaaccccaccatcctctacctgactcagcagcacggcaacgaacagctcaccaccgagggcgccctggaattcgtcaagcacctgggcaccggcaagtcaggggacatccttgacggcgtgaacatcctcgttgttcccatgcttaacgccgacggtgcgatgggggacgtgaatttctccctggacgactacctggccaagggcgaccgcaacatgacccgctacaacgccgaggaagtggacctcaacagggaccacgtggccaaggtccagcctgaaacgcaggcgctgcacaacaacgtgatgcgcaagtaccaggtggactacatgatcgacctccaccaccagggcacgcgcagtgaacgtgacggaaagctggtgtccggctcgatcctgtaccccaccacgcccaacgccgatccggcagtggtgcagaagtccaagcagctgggcgcggtggtcttcgacaatgtcgactccaccggctggggccacctgggcaagtacgtgggcggcagcgccgagaccatcagccgcaacggcatcgccgtggagtacggcattgcgacgctgctcttcgagatgcgcggcatgtccgaccactacctggacggctacgccctggggctgcgcagtaacggctacctgatcaagcagaccgtcaccacgctgacggccaccgccgccgccatcgctgacggttcaatcgccgacgccgacacctccttctgggacagcctcgccacccagacctcccgcccgggtgaggaagccgacgacgagtag

SEQ ID NO: 2037 - DNA, 1056 bp, unknown
  environmental sample
gtgaagaaatccttgaggacccttgctgtgtccggagccctggcactcgccgtcgtcgcaggaccggccccgctggcgcaggccgtcggcgagggcccgaactatgacggcaacggccaggtcacaacctcgaagctggccacctatgaccagatggtttccttcctgaaggaccaggacgccaagcagcaggcgatggaactggaagtcatcgggcagaccgtcaagggacgggacatccacctggtcaagtacatctcggacgaggacaatcccagcatcctttacctcacccaacagcacggcaatgaacagctcaccactgagggcgccctggagttcgtcaagcacctggggacgggcaagtcaggggacatcctggccggcgtcaacatcctgatcgttcccatgctgaatgcagacggggccatgggcgacgtgaacttcccgctggacgattacgtggcgaagggtgaccgcaacctgacccgctacaacgccgagggcgtggacctgaaccgcgaccatgttgccaaggtccagcccgaaacgcaggcgctccacaacaatgtgatgcgcaagtacgacatcgactacatgatcgacctgcaccaccagggcacccgcagcgagcgtgacggcgagctggtgtccggctccatcctgtaccccaccacccccaacgcggaccccgccgtcgtcgaaaggtccaagcagctgggtgccgtggtgttcgacaatgtggactccacaggctggggccacctgggcaagtaccagggtggcagcgccgaaaccatcagccgcaacggcatcgcggtggagtacgggatctccaccctgctgttcgagatgcgcggcatgtcggaccactacctggacggctacgccctggggctgcgcagcaacggctacctgatcaagcagacggtcaccactctgacgtccaccgccgcggccatcgctgacggttcaatcgccgacgccgacacctccttctgggacagcctcgccgagcagacgtcccggccgggcggggaggctgacgacgagtag

SEQ ID NO: 2038 - DNA, 1056 bp, Arthrobacter sp.
gtgacgaaatccctcaggacccttgccgttagcggagccctcgcgctcgccgtcgcagcaggtccggcgcccctggccggcgccgtaggcgaagggccttcctacgacggcaacggccagatcaccacgtcgaagctggccacctacgaccagatggtctcgttcctgaaggaccaggatgcgcgccagcccgccatggagctggaggtcatcggccagaccgtcaaaggccgcgacatccacctggtcaagtacatatcggacccggccaagcccaccatcctgtatttgacccagcagcacggcaatgaacagctcaccaccgagggtgccctcgagttcgtcaagcacctgggcacgggcaagtcggcaggcatcctggacggcgtgaacatcctcatcgtgcccatgctcaacggggacggtgccatgggggatgtcaacttctccctggacgactaccttgccagaggggaccgccacctcacccgctacaacgcggaaggcgtggacctgaaccgggaccatgtggccaaggtccagccggagacccaggcgctgcacaacaacgtgatgcgcaagtaccgcattgactacatgatcgacctgcaccaccagggcacccgcgccgagcgcgacggcaagctggtttccggctccatcctgtaccccaccaccccgaacgccgaccccgccgtcgtcgagaaatcaaagcggctcggcgccgttgtcttcaacaacgttgactccaccggctggggccacctgggcaggtaccagggcggcagcgccgagaccatcagccgcaacggcatctccgtggaatacggcattgccaccctgcttttcgagatgcgcggcatgtccgaccactacctggatggttacgcgctggggcagcggagcaatggttacctgatcaagcagacggtcaccacgctggcgtccaccgccgcggccatcgcggatggatccattgccgacgccgacacctccttctgggacacgctcgccgagcagacgtcccggcccgcgggggaggccgaggacgagtag

SEQ ID NO: 2039 - DNA, 1056 bp, Arthrobacter sp.
gtgacgaaatccttcaggatccttgccgtaaccggagccttggcgctcgccgtcgtggcaggcccggcgccgctggccaatgccgtgggcgaagggcccacctacgacggcaatggccagatcaccacgtcgaagctggccacctatgaccagctggtctcgttcctgaaggaccaggacgcacgccagccggccatggagctggaggtcatcggccagaccgtcaagggccgcgacatccacctggtgaagtacatctcggatccggccaagcccaccatcctgtacctcacccagcagcacggcaatgaacagctcaccaccgaaggtgccatggagttcatcaagcacctggggacgggaaagtctgcaggcatcctggacggcgtgaacatcctgatcgtgcccatgctcaatgcggacggcgccatgggggacgtcaacttctccctggaggactatctggccaagggggaccgccacctcacccgctacaacgcagagggtgtggacctgaaccgggaccacgtggccaagatccagccggaaacccaggcgctgcacaacaacgtgatgcgcaagtaccgcatcgactacatgatcgacctgcaccaccagggtacccgggccgagcgcgacggaaagctggtctccggctccatcctgtatcccaccaccccgaacgccgaccccgccgtcgtggagaaatccaagcagctcggcgccgtggtcttcaacaacgtcgactccaccggctggggccacctgggcaagtaccagggcggcagcgccgagaccatcagccgcaacggcctttccgtggaatacggaatcgccaccctgctcttcgagatgcgcggcatgtcggaccactacgtggacggctatgcgctggggcagcggagcaacggctacctgatccagcagacggtcaccacgctgacctccactgccgcggccatcgcggatggatcaattgccgacgccgacacctccttctgggacacgcttgccgagcagacgtcccggcctgcaggggaagccgaagacgagtaa

SEQ ID NO: 2040 - DNA, 1029 bp, unknown
  environmental sample
gtgtccggagccctggcactcgccgtcgtcgcaggaccggccccgctggcgcaggccgtcggcgagggcccgaactatgacggcaacggccaggtcacaacctcgaagctggccacctatgaccagatggtttccttcctgaaggaccaggacgccaagcagcaggcgatggaactggaagtcatcgggcagaccgtcaagggacgggacatccacctggtcaagtacatctcggacgaggacaatcccagcatcctttacctcacccaacagcacggcaatgaacagctcaccactgagggcgccctggagttcgtcaagcacctggggacgggcaagtcaggggacatcctggccggcgtcaacatcctgatcgttcccatgctgaatgcagacggggccatgggcgacgtgaacttcccgctggacgattacgtggcgaagggtgaccgcaacctgacccgctacaacgccgagggcgtggacctgaaccgcgaccatgttgccaaggtccagcccgaaacgcaggcgctccacaacaatgtgatgcgcaagtacgacatcgactacatgatcgacctgcaccaccagggcacccgcagcgagcgtgacggcgagctggtgtccggctccatcctgtaccccaccacccccaacgcggaccccgccgtcgtcgaaaggtccaagcagctgggtgccgtggtgttcgacaatgtggactccacaggctggggccacctgggcaagtaccagggtggcagcgccgaaaccatcagccgcaacggcatcgcggtggagtacgggatctccaccctgctgttcgagatgcgcggcatgtcggaccactacctggacggctacgccctggggctgcgcagcaacggctacctgatcaagcagacggtcaccactctgacgtccaccgccgcggccatcgctgacggttcaatcgccgacgccgacacctccttctgggacagcctcgccgagcagacgtcccggccgggcggggaggctgacgacgagtag

SEQ ID NO: 2041 - DNA, 1080 bp, Arthrobacter sp.
atgcactcgaaagaggtaacgcgctgtgaagaaatccttgaggaccttgccgtgtccggagccctggcactcgccgtcgtcgcaggaccggccccgctggcgcaggccgtcggcgagggaccgaactatgacggcaacggccaggtcacaacctcgaagctggctacctatgaccagatggtttccttcctgaaggaccaggacgccaagcagcaggcaatggagctggaagtcatcgggcagaccgtcaaggggcgggacctccacctggtcaagtacatctcggacccggacaatcccaccatcctctacctcacccaacagcacggcaatgaacagctcaccaccgagggcgcgctggaattcgttaagcacctggggacgggcaagtcaggggacatcctgtccggcgtgaacatcctgatcgttcccatgctgaatgcagacggggccatgggcgacgtgaacttcccgctggacgattacgtggcgaagggtgaccgcaacctgacccgctacaacgccgagggcgtggacctgaaccgcgaccatgttgccaaggtccagcccgaaacgcaggcgctccacaacaatgtgatgcgcaagtacgacatcgactacatgatcgacctgcaccaccagggcacccgcagcgagcgtgacggcgagctggtgtccggctccatcctgtaccccaccacccccaacgcggaccccgccgtcgtcgaaaggtccaagcagctgggtgccgtggtgttcgacaatgtggactccacaggctggggtcacctgggcaagtaccagggcggcagcgccgaaaccatcagccgcaacggcatcgcggtagagtacgggatctccaccctgctgttcgagatgcgcggcatgtcggaccactacctggacggctacgccctggggctgcgcagcaacggctacctgatcaagcagacggtcaccactctgacgtccaccgccgcggccatcgctgacggttcaatcgccgacgccgacacctccttctgggacggcctcgccgagcagacgtcccggccgggcggggaagctgacgacgagtag

SEQ ID NO: 2042 - DNA, 1086 bp, Arthrobacter sp.
atgcactcgaaagaggtaacgcacgtgaagaaatccctggctactttcaggacccttgctgctaccggggcgctggcacttgccgtcgtagccgcaccggccccggccatcgccgtcggcgagggccccaattacggcggcaacggccagatcaccacatcgaagctggccacctatgaccagatggtttctttcctgaaggaccaggacgccaagcagcctgccatggaacttgaggtcatcggcaaaacggtcaagggccgggacatccacctggtcaagtacatttcggacccggccaagcccaccatcctgtacctgacccaacagcacggcaacgaacagctcaccacagagggagcactggagttcgtcaagcacttgggcacggaaaaatcggcggacatcctcaagggcgtcaacatcctggtggttccgatgctcaatgcggacggagccatgggtgacgtcgacttctccctggaggactacatcgccaagggcgaccgcaacatgacccgcttcaacgccaagggcgtggacttgaaccgggatcacgtagccaagatccagccggaaacccaggccctgcacaacaacgtgatgggcaagtaccgggtggactacatgatcgacctgcatcaccagggcacccgcgctgagcgcgacggcaaactggtgtccggctccatcctgtatcccaccacccccaacgccgatcccgccgtcgtggaacggtccaagcagttgggcgccgtggtcttcgacaacgttgactccaccggctggggccacctcggtaaataccagggcggcagcgccgagaccatcagccgcaacggcatctcggtggaatacggcatcgcaaccctgctctttgagatgcgcggcatgtcggaccactacctcgacggctacgcgctgggacagcgcagcaacggctacctgatcaagcagaccgtcaccacgctgacgtccaccgccgccgccatcgcggacggttcaattgccgacgccgatacctccttctgggacaccctcgccgagcagacctcccgcccggcgggcgaggccgacgacgaataa

SEQ ID NO: 2043 - DNA, 1086 bp, Arthrobacter sp.
atgcactcgaaagaggtaccgcacgtgaaaaaatccctggctgctttcaaggcccttacggcagcaggcgccctgtcgctcgctgtcgtcgccgcacccgcgccggccctggcagttggcgaaggccccaactacggcggcaacggccagatcaccacaagcaagctggctacgtacagtcagatggtctccttccttaaggaccaggacgccaagcaaccggccatggagctggaagtgatcggccagacggtcaagggccgcgatatccacctggtcaaatacatctctgacccggccaaacccaccatcctctacctgacccagcagcatggcaacgaacagctcaccaccgagggcgccatggagttcatcaagcacttgggcaccggcaagtcgtccggcatcctggacggcgtcaatatcctgatcgtgcccatgctcaatgccgatggcgccatgggggacgtgaatttttccttggacgactacctcgccaaaggcgaccgccacctgacgcgttacaacgcggagggcgtggacctgaaccgggaccacgtggccaaggtccagccggagacccaggccctgcacagcaacgtgatgcgcaagtaccgcgtcgattacatgatcgacctgcaccaccagggcacccgcgctgaacgcgacggcaagctggtgtccgggtcaatcctgtaccccaccaccccgaacgccgatcccgccgtcgtcgagaaatccaagcggctcggcgccgtggtcttcaacaacgtggactccaccggctggggccacctgggcaagtaccagggcggcagtgcggagaccatcagccgcaacggcatctccgtggaatacggaattgccaccctgcttttcgagatgcgcggcatgtccgaccattacctggacggctacgcgctggggcagcggagcaacggctacctgatcaagcagacggtcaccaccctgacctccaccgccgcggcgatcgcggacggttccattgccgacgccgacacctccttctgggacactctcgccgaacagacgtcccggccggccggggaagccgaggacgagtaa

SEQ ID NO: 2044 - DNA, 1029 bp, Arthrobacter sp.
gtgaagaaaacactcgccgccgccgccctggccggtgcgctcaccatctcctccgtcgccggccccgccgtcgcggtaggcgaaggcccccactacaacggcaacgaaaccatcaacacatccatcctccgcacgtatgacgagctggcgagttatctgaaaacgcaggacgcgaagcaggaagccatggagctcgaggtgattggtcagtccgtcaagggccgggatcttcacctcgcaaagtacatctccaacccggacaatccgaccatcctcttcctgacccagcagcacggaaatgagcagctcaccaccgagggcgcgctcgagttcatcaaacacctcggcaccggcaagaccggcgacgtgctcgacggcgtcaacgtcctcattgtgccgatgctcaacccggacggcgccatgggagatgtcgatttcccgctcgatgactacatcgcgagcggtgaccgccacctcacccgctacaacgccctcggggtggacctgaaccgggatcacgtcgacaagatccagcccgagacgcaggctctgcacaccaacgtgatggagaagtaccgcatcgactacatgatcgatctccaccatcagggcaccagcagcgagcgcgacggcgagctggtttccggctccatcctgcaccccaccacccccaacgtggatccggcagtgctcgaaggatccaagcggctcggggccgtggtgttcggcgccgtggattccaccggctggggccacctcggcaagtacaacggcggttcagccgaaacgatcagccgcaacggcatcgccgtcgagtacgggatctccaccctgctcttcgagatgcgcggcatgtcagatcatttcaatgagggtgctgtgctgggccagaagagcaacggttacctgatcaaacagaccatcaccaccctcgatacatctgtccgggcgatcgcggacggttcgatcaacacggcggatacctccttctgggacacgctttccacccagaacacccgcgccgagtaa

SEQ ID NO: 2045 - DNA, 1029 bp, Arthrobacter sp.
gtgaagaaaactctcgcagccgccgttctggccggcgcgctcaccatctcctccgttgccggccccgccgtcgcggtaggtgaagggcccaactacaacggcaacgaaacaatcaacacgtccatcctccgcacgtatgacgagctggcgagctacctgaagacgcaggacgcaaagcaggaaaccatggagctcgaggtgattggtcagtccgtcaagggccgggatctttacctcgcaaagtacatgtccaacccggacaatccgaccatcctcttcctgacccagcagcacggaaacgagcagctcaccaccgagggcgcgctcgagttcatcaaacacctcggcaccggcaagaccggtgacgtgctcgccggcgtcaacgtcctcattgtgccgatgctcaacccggacggcgccatgggagatgtcgatttcccgctcgatgactacatcgcgagcggcgaccgccacctcacccgctacaacgcccttggggtggacctgaaccgggaccatgtcagcaagatccagcccgagacgcgggcactgcacaccaacgtcatggcgaaatacggcatcgactacatgatcgacctccaccaccagggcaccagcagcgagcgcgacggcgagctggtttccggctccatcctgcaccccaccaccccgaacgtggatccggccgtgctggaagggtccaagcggctcggggcagtggtgttcggcgccgtggactccaccgggtggggccacctcggcaagtacaacggcggttcagctgaaacgatcagccgcaacggcatcgccgtcgaatacgggatctccaccctgctcttcgaaatgcgcggcatgtccgatcacttcaatgacggcgctgtgctcggccagaagagcaacggctacctgatcaagcagaccatcaccacccttgatgcgtctgtacgggcgatcgcagacggttcgatcaactcggcggatacctccttctgggacactctcgccacgcagaacacccgcgctgaatag

SEQ ID NO: 2046 - DNA, 1041 bp, Sporosarcina sp.
gtgaagaaaaccgttcttaatttatccattgctggagcgatgatgctcagcgtatcttccttcggttctcctattgcgaacgcggtcggaaatggtcctacttatggagggaatgaaacgattaatacttcgatactccatacttatgatgaaatggtagactacctaaaaaaagaagaagcaaaacaacaagatatggaacttgaagtaattggccaaagtattaagggaagagatttatatctggcgaaatatatgaaaaaccctgaaaatcctacgattctgtttttaacccaacagcacggaaatgaacaacttacaactgagggtgctcttgaatttattaagcatctaggtacaaacaagatgaaagatgttacagacgaggtgaatatcttaattgttcctatgctgaatgcagacggcgcaatgggtgatgtggacttctctcttgatgattatatcgcaaagggagatcgaaatttaactcgatataatgcagcggaagtagatttaaaccgtgatcatgttactaaaatccaaccagaaacaaaagcactgcataataatgttatgaagaaatacaatattgattatatgattgatcttcatcatcaaggagcaatgagtgaaagggacggtaagcttgtttctgggtccattctttatccgacaactccaaatgctgatcccgaagtagtagaaaagtcgaaacaactaggtgcagttgtgtttgatgcgattgatgaaaaaggctggggccaccttggcaaatacaacgggggctctgctgaaacaatcagcagaaacggtattgctgttgaatacggaatttcgacactgttatttgaaatgcgtggaatgtctgatcatgagtacgaatcatatgtgttagggcaaaagagcaatggctatttgattaaacaaactattaccactcttgaagcaacggtaaatgcaattgcagacggttcgattgaaactaaagacacatcgttttgggattcactggcttaccagacaacccgtccatctgagtaa

SEQ ID NO: 2047 - DNA, 1041 bp, Bhargavaea sp.
atgaagaaaacgatgatttcacttgttgccgcgggggcgcttgttctgagcgcggcaccattgcaggcggacgcagtaggaaacggtccgaattacgggggaaatgagacgatcaatacgtcgattctccatacgtacagcgagatggcgtcgtacctgcagaagcaggaggccaagcagaaggatatggagctcgaggtgatcggccagtcggtcaagggccgcgacctgtaccttgtgaagtacatgaagaacccggaaaacccgacgatcctcttcctgacccagcagcacggcaacgaacagctgacgacggaaggcgcacttgagttcatcaagcacctcggcacgggcaaaatgaaaggcgtgacggacaacgtcaacatcctcatcgtgccgatgctgaatccggacggggcgatgggggatgtcgacttctcgctggatgactatgtggcgtccggggaccgccacctgacgcgctacaacgcgctcggcgtcgacctgaaccgcgaccacgtcacgaagatccagccggaaacacaggcgctgcacaatcaggttatgcagaagtatgatatcgattatatgatcgatttgcatcatcagggggcacgcagcgaacgtgacggagagctcgtatccggctcgatcctctatccgacaacaccgaacgttgaccccgacgtactcgagggatctaagaagctgggagcggtcgtctttgacgccgttgactccacaggctggggacacctcggcaagtacgtcggcggcacggccgagacgatctcccgcaacggcattgcggtcgaatacggcatttccacgctcctctttgaaatgcgcggcatgtccgaccacgaatacgagccgtatgtccttggccagaagagcaacggctatctgatcaagcagacaatcacgacgcttgatgcaacggtccgggcgattgcagacggctcgatcgagtcaaaagatacgtcgttctgggacacgctcgctgaacagaggacccgccaatccgaagaagacgaataa

SEQ ID NO: 2048 - DNA, 1038 bp, Arthrobacter sp.
atgaagaagcaactcgcagcagccgccatggccggcgccctggcgttcacctccgtagcagtagccgcgcccgcagcgctggcggtcggagaaggtcccggctatggcggcaaggaaaccatcaacacctcaatcctccgcacctatgacgagctggcggatttcctcaaaacccaggacgccaagcagccgcagatggagcttgaggtcattgggcaatcagtcaagggcagggacctgttcctggccaagtacatccagaatcccgagaatcccaccatcctgttcctgactcagcagcacggcaacgagcagctgactacggagggtgcactggagttcatcaagcatctcggaacgggtaaaacgggggatgtgctggacaacgccaatgtcctgattgttcccatgctcaatccggatggcgccatgggcgatgtcgacttctccctggacaattacattgccagcggcgaccggcacctcacccgcttcaacgccctcggcgtggacctcaaccgcgaccacgtggccaagatccagcccgaaacccaagcgctccacagtaatgtcatggcgaaatacgacatcgactacatgatcgacctgcaccaccagggcgccaacagcgagcgcgacggccaactggtttccggctccatcctgcaccccaccacgcccaacgtggacccggcggttctggaaggatccaagaagctgggagctgtggtgttcgacgccgttgactccaccggctggggacacctgggcaagtacagcggcggcgacgccgaaaccatcagccgcaatggcatcgcggtggagtacgggatctctaccctgctcttcgagatgcgcggaatgtccgatcatttcaacgaaggatcggtgcttggccaaaagagcaacggctacctgatcaagcagaccatcaccacgctggacgcaacggtcaacgccattgcggacgggtcaatcgacaccgcggacacgtccttctgggacacgctggcaacgcagaacacccgctccgagtag

SEQ ID NO: 2049 - DNA, 1044 bp, Arthrobacter sp.
atcgtgaaggcacccaggaaattcgccgcactctcgctggcggtacttctgacaacaggagcaaccgccgccgccccggccttcgctgtcggtgagggacccaactacgggggcaacgagaccatcaatacctcgatcctgcgctcctatgacgaggttgttgctgagctgaaagagcaggatgcccgacagtcggcacttgagctcgaagtgatcgggcagtcggtcaagggccgtgacctctacctcgcgaagtacatcaccaatcccgacaacccgaccatcctctacctgacgcagcagcacggcaatgagcagctgaccacggagggtgcactcgagttcatcaagcacctcgggacggggaagtccgggggagtgctcgacggcgtcaacatcctcgtggtacccatgctcaatcccgacggcgccatgggagacgtcgacttcgcgctggacggctacatcgcggacggcggcaggacgctgacgcgggccaatgcgaacaatgtggacctcaaccgtgaccatgtgaacaagctcgagccggagacccaggcgctccacgacaacgtgatgcgtgcctacaacatcgactacatgatcgatctccaccaccagggcacgcagagcgaaagagacggggacctcgtgtcgggctcgattctctaccccaccacccccaacgtcgacccggcggtgctggacggatcgaagcgcctcggctccgtagtgttcgacgccgtggactccaccgggtggggccacttgggccggtatgtcggcggggatgccgaaaccatcagccgcaacggcatcgccgtggagtacggcatctcgaccctcctgttcgaaatgcgcggaatgtccgacaacacgagggattccgccgtgctgggccagaagagcaacgggtacctgatcaagcagaccgtcgtcacgctggatgcgacggcccaagccatcgcggacggctcgatcgtcacggccgacacctccttctgggataccctcgccgaacagaccacgcgaacctcggaatag

SEQ ID NO: 2050 - DNA, 1044 bp, Sporosarcina sp.
atgaaaaaaacaatgcttgcattttcgcttgcaggagcattagttctaagtgcatcaccgtttgcactgccgatagcggaggcggttggaaacggtccgaattatggcggtaatgaaacgataaatacatccatcttacacacttacgacgaaatggtagataaccttaagaagcagcaaacaaaacaaaaagatatggaactggaagtgattggacaaagcgttaaaggaagggatctgtatcttgtaaagtatataaagaatcctgaaaacccaacaatccttttccttacacagcagcatggaaacgagcagctgacgacagaaggatcacttgagttcatcaaacacctcggtaccgggaagatgaaaggtgtcatcgatggtgtaaatatcttgatagttccaatgctcaatgcagacggtgcaatgggagatgtcgacttttccttagatgattatatcgctagcggaagtcgccatttaacccgttacaatgcgctaggagtagatctgaaccgggatcatgtaaacaaaattcaacctgaaacgaaagcactccatgataatgtaatacgtgcttataacgtagactacatgattgatttgcatcaccaaggtactaagagtgagcgagatggagaattagtgtcaggttccattctttatcccactacaccgaatgttagtcctgatgtattactgaaatccaaacagcttggcgcagttgtttttgattcagtcgattcaacgggatggggccatcttggcaaatataatggagggtctgccgaaacgattagccgtaatggaatcgcagtggaatatggcatttccacacttctttttgagatgcgaggcatgtcggatcattcctccgagtctgctgttctgggtcaaaagagtaatggttacttaattaagcagaccattaagacgcttgatgcgactgtacgtgctatagcggaccgttctatcgataataaggacattagtttctgggatacactggctactcagcaatcacaaccttccaaagagtaa

SEQ ID NO: 2051 - DNA, 1089 bp, Planomicrobium sp.
atggcaaatcgattcacggaacagagggttgaaaagcaaaaccgcacaaagagaaaattgatggctttttcagtggccggggcattgatgctcagcgctgcgccatttacggcaccggttgccgaggctgttggcaatgggccgggatatggcggcaacgaaaccataaatacctcaatattgcacacatacgatgaaatggtgagctacttgaaaacgcaagaggcgaaacaaaaaaatatggaactggaagtgatcgggcaaagtgtgaaagggcgcgatctctatctggtaaaatacatgaccaatcctgaaaatcctaccattctttttttgacccagcagcatggcaatgagcagctgacgactgaaggcgcgcttgaatttatcaagcacttggggaccggaaaaatgaaaggggtaacagatggcgtcaatattctgattgtgccgatgctgaatgcagacggggcgatgggcgatgtcgacttttctttggaagattatgtagccagcggtgaccgcaacttgacgcgctacaacgcccgcgaagtggatttaaaccgtgaccatgtcaataaaatccagccggaaacgcaggcgctccacaacaacgtcatgcgtaaatacgacatcgattacatgattgatttacatcaccaaggtacgcagagcgagcgggacggccaactggtatccggttccatcctatacccgacgacaccgaatgttgatccggatgtcttattgaaatccaaacagctgggtgcagtggtctttaatgccgtcgattcgaccggctggggccatatcgggaaatacagcgggggcactgcagaaaccatcagccgcaacggcatcgctgtagagtatggcatttctacgctgctgtttgaaatgcggggaatgtccgaccacgaatacgagccgtatgtccttggccagaagagcaacggctatttgatcaagcagaccattacgacactggatgcggcagtgcgtgccattgcagacgggtccatcgcggatgcggatgtctctttctgggatacactggcaacacaaacgaaccgtccgtctgaagaataa

SEQ ID NO: 2052 - DNA, 825 bp, Bacillus sp.
atgaaaaagcaacttgttacagcaacaacggcagtggttttggggacgactttgtttgcgggcgcggcatctgcgcaaacgattaaggtaaaaaaaggcgatacattatggggactttcaaatcggtacggaacgtcaattaattccattaaatctgagaacaaattaaaatcggatatcatttacatcggccagacgctttcgatcaacggtaaatcatcttcaggttcaaattcgggcagcaagtcatcatcgtctacatataaagtcgtaaaaggcgacagcctttggaaaattgcgaataaatataaaatgacggtaaaccaattaaaaagtttaaacggtttaaaaacggacctgatccgcatcggacaagttcttaaagtaaagggatcaacttccggttcaacgtcttcaggatcttcgtcatcaaagcagccttcatccagccataatgctgcacagacgagcctgaatgtaaacaagctgatttctgatgcgcaatctttaatcggcacgccgtatgtatggggcggaacaacgacttccggctttgactgcagcggatttatctggtacctgttaaacaaacagacgagtgtcggcagaacaagcactgcgggatactggagctcaatgaagagcgtgtccagcccgtcaagaggagacttcgtcttctttacaacatatcaggccggcccttcacacatgggtgtgtacatcggaaacaacaagttcatccatgccggttctgacggcgtcacaacaagtgatctgaataacagctactggaaacctcgctaccttggcgcgaaaagattctag

SEQ ID NO: 2053 - DNA, 825 bp, Bacillus sp.
atgaaaaagcaacttgttacagcaacaacggcagtggttttggggacgactttgtttgcgggcgcggcatctgcgcaaacgattaaggtaaaaaaaggcgatacattatggggactttcaaatcggtacggaacgtcaattaattccattaaatctgagaacaaattaaaatcggatatcatttacatcggtcagacgctttcgattaacggtaaatcatcctcaggttcaagctcaagcagcaagtcatcatcgtctacatataaagtcgtaaaaggcgacagcctttggaaaattgcgaataaatataaaatgacggtaaaccaattaaaaagtttaaacggtttaaaaacggacctgatccgcatcggacaagttcttaaagtaaagggatcaacttccggttcaacgtcttcaggatcttcgtcatcaaagcagccttcatccagccataatgctgcacagacgagcctgaatgtaaacaagctgatttctgatgcgcaatctttaatcggcacgccgtatgtatggggcggaacaacgacttccggctttgactgcagcggatttatctggtacctgttaaacaaacagacgagtgtcggcagaacgagcactgcgggatactggagctcaatgaagagcgtgtccagcccgtcaagaggagacttcgtcttctttacaacatatcaggccggcccttcacacatgggtgtgtacatcggaaacaacaagttcatccatgccggttctgacggcgtcacaacaagtgatctgaataacagctactggaaaccgcgctacctgggcgcgaaaagattctag

SEQ ID NO: 2054 - DNA, 825 bp, Bacillus sp.
atgaaaaagcaacttgttacagcaacaacggcagtggttttggggacgactttgtttgcgggcgcggcatctgcgcaaacgattaaggtaaaaaaaggcgatacattatggggactttcaaatcggtacggaacgtcaattaattccattaaatctgagaacaaattaaaatcggatatcatttacatcggtcagacgctttcgatcaacggtaaatcatcctcaggttcaagctcaagcagcaagtcatcatcgtctacatataaagtcgtaaaaggcgacagcctttggaaaattgcgaataaatataaaatgacggtaaaccaattaaaaagtttaaacggtttaaaaacggacctgatccgcatcggacaagttcttaaagtaaagggatcaacttccggttcaacgtcttcgggatcttcgtcatcaaagcagccttcatccagccataatgttgcacagacgagcctgaatgtaaacaagctgatttctgatgcgcaatctttaaccgggacgccgtatgtatggggcggaacaacgacttccggctttgactgcagcggatttatctggtacctgttaaacaaacagacgagtgtcggcagaacgagcactgcgggatactggagctcaatgaagagcgtgtccagcccgtcaagaggagacttcgtcttctttacaacatatcaggccggcccttcacacatgggtgtgtacatcggaaacaacaagttcatccatgccggttctgacggcgtcacaacaagtgatctgaataacagctactggaaaccgcgctacctgggcgcgaaaagattctag

SEQ ID NO: 2055 - DNA, 831 bp, Bacillus sp.
atgaaaaagcaacttgttacagcaacaacggcagtggttttagggacgactttgtttgcgggtgcggcatctgcgcaaacgattaaggtaaaaaaaggcgatacattatggggactttcaaatcaatacggaacgtcaattaattccattaaatctgagaacaaattaaaatcggatatcatttacatcggacagacgctgtcaatcaacggtaaatcatcttcaggttcaagctctggcagcaaatcatcatcgtctacatataaagtcgtaaaaggcgacagcctttggaaaattgcgaataaatataaaatgtctgtaaaccaattgaaaagtttaaacggtttaaaaacagacctgatccgcatcggacaagttcttaaagtaaaaggatcaacttccggttcaaactccggaacgtcaacgggatcttcatcaaatcagtcttcatctaaccataacgctgcacagacgagcctgaatgtaaacaagcttgtttctgatgcgcaatctttaatcggcacgccgtatgtatggggcggaacaacgacttccggctttgactgcagcggatttatctggtacctgctgaacaaacagacgagtgtcggaagaacaagcactgcgggatactggagctcaatgaagagcgtgtccagcccgtcgaaaggggacttcgtcttctttacaacatatcaggccggcccttcacacatgggtgtgtacatcggaaacaacaagttcattcatgccggctctgacggcgtcacaaccagtgacctgaataacagctactggaagcctcgctacctgggcgcgaaaagattctag

SEQ ID NO: 2056 - DNA, 831 bp, Bacillus sp.
atgaaaaagcaacttgttacagcaacaacggcagtggttttagggacgactttgtttgcgggtgcggcatctgcgcaaacgattaaggtaaaaaaaggcgatacattatggggactttcaaatcaatacggaacgtcaattaattccattaaatctgagaacaaattaaaatcggatatcatttacatcggacagacgctgtcaatcaacggtaaatcatcttcaggttcaagctctggcagcaattcatcatcgtctacatataaagtcgtaaagggcgacagcctttggaaaattgcgaataaatataaaatgtctgtaaaccaattgaaaagtttaaacggtttaaaaacagacctgatccgcatcggacaagttcttaaagtaaaaggatcaacttccggttcaaactccggaacgtcaacgggatcttcatcaaatcagtcttcatctaaccataacgctgcacagacgagcctgaatgtaaacaagcttgtttctgatgcgcaatctttaatcggcacgccgtatgtatggggcggaacaacgacttccggctttgactgcagcggatttatctggtacctgctgaacaaacagacgagtgtcggaagaacaagcactgcgggatactggagctcaatgaagagcgtgtccagcccgtcgaaaggggacttcgtcttctttacaacatatcaggccggcccttcacacatgggtgtgtacatcggaaacaacaagttcattcatgccggttctgacggcgtcacaaccagtgacctgaataacagctactggaagcctcgctacctgggcgcgaaaagattctag

SEQ ID NO: 2057 - DNA, 831 bp, Bacillus sp.
atgaaaaagcaacttgttacagcaacaacggcagtggttttagggacgactttgtttgcgggtgcggcatctgcgcaaacgattaaggtaaaaaaaggcgatacattatggggactttcaaatcaatacggaacgtcaattaattccattaaatctgagaacaaattaaaatcggatatcatttacatcggacagacgctgtcaatcaacggtaaatcatcttcaggttcaagctctggcagcaattcatcatcgtctacatataaagtcgtaaagggcgacagcctttggaaaattgcgaataaatataaaatgtctgtaaaccaattgaaaagtttaaacggtttaaaaacagacctgatccgcatcggacaagttcttaaagtaaaaggatcaacttccggttcaaactccggaacgtcaacgggatcttcatcaaatcagtcttcatctaactataacgctgcacagacgagcctgaatgtaaacaagcttgtttctgatgcgcaatctttaatcggcacgccgtatgtatggggcggaacaacgacttccggctttgactgcagcggatttatctggtacctgctgaacaaacagacgagtgtcggaagaaccagcactgcgggatactggagctcaatgaagagcgtgtccagcccgtcgaaaggggacttcgtcttctttacaacatatcaggccggcccttcacacatgggtgtgtacatcggaaacaacaagttcatccatgccggttctgacggcgtcacaaccagtgacctgaataacagctactggaagcctcgctacctgggcgcgaaaagattctag

SEQ ID NO: 2058 - DNA, 831 bp, Bacillus sp.
atgaaaaagcaacttgttacagcaacaacggcagtggttttagggacgactttgtttgcgggtgcggcatctgcgcaaacgattaaggtaaaaaaaggcgatacattatggggactttcaaatcaatacggaacgtcaattaattccattaaatctgagaacaaattaaaatcggatatcatttacatcggacagacgctgtcaatcaacggtaaatcatcttcaggttcaagctctggcagcaattcatcatcgtctacatataaagtcgtaaagggcgacagcctttggaaaattgcgaataaatataaaatgtctgtaaaccaattgaaaagtttaaacggtttaaaaacagacctgatctgcatcggacaagttcttaaagtaaaaggatcaacttccggttcaaactccggaacgtcaacgggatcttcatcaaatcagtcttcatctaactataacgctgcacagacgagcctgaatgtaaacaagcttgtttctgatgcgcaatctttaatcggcacgccgtatgtatggggcggaacaacgacttccggctttgactgcagcggatttatctggtacctgctgaacaaacagacgagtgtcggaagaaccagcactgcgggatactggagctcaatgaagagcgtgtccagcccgtcgaaaggggacttcgtcttctttacaacatatcaggccggcccttcacacatgggtgtgtacatcggaaacaacaagttcatccatgccggttctgacggcgtcacaaccagtgacctgaataacagctactggaagcctcgctacctgggcgcgaaaagattctag

SEQ ID NO: 2059 - DNA, 834 bp, Bacillus sp.
atgaaaaagcaaattataacagctacaacagcagtagttttggggtcaactttgtttgcaggagcggcgtctgcacaaagcgtcaaagtgaaaaaaggcgatactttatggggattgtccaagaaatatggcacatctatcaacagcattaaatcagaaaacaaattaaaatcagatatcatttacataggacaaacgttatccgttaacggcaaatcgtcctcaacaagctcaagcagcagttcatcatcatcatctacttataaagtagtgagtggtgacagtctttggaaaatttcgaaaaaatacagcatgacaattaacgaattgaaaaaattaaacggcctaaaaacagatttaatccgcgtcggccaggttcttaaagtgaagggctcaagctcaagttcaaaccaaagctcgtcaaatgtttctgcatcaaaaccgtctacatcatcaggcagcaacgtgtcatcaacgtcacttaatgtaagcaagcttgtatctgatgcaaaagcgctcactggcactccgtataaatggggcggaacaactacttctggttttgactgcagcggatttatctggtacttgctgaataaacaaacaaacgtgggcagaacaagcactgcgggatactggagttctatgaagagcgtatcaagcccgtctgtcggcgactttgttttctttacaacatatcaagcaggcccttctcacatgggtgtgtatatcggaaacaacaagttcatccatgcaggatctgatggcgtgcagacaagcgatctgaacaacagctattggaaacctcgttatcttggcgcaaaacgtttctaa

SEQ ID NO: 2060 - DNA, 837 bp, Bacillus sp.
atgaaaaagcaaattataacagctacaacagcagtagttttggggtcaactttgtttgcaggagcggcgtctgcccaaagcgtcaaagtgaaaaaaggcgatactttatggggattgtccaagaaatatggcacatctatcaacagcattaaatcagaaaacaaattaaaatcagatatcatttacataggacaaacgttatccgttaacggcaaatcgtcctcaacaagctcaagcagcagttcatcatcatcatcatctacttataaagtagtgagcggtgacagtctttggaaaatttcgaaaaaatacagcatgacaattaacgaattgaaaaaattaaacggcctaaaaacagatttaatccgcgtcggccaggttcttaaagtgaagggctcaagctcaagttcaaaccaaagctcgtcaaatgtttctgcatcaaaaccgtctacatcatcaggcagcaacgtgtcatcaacgtcacttaatgtaagcaagcttgtatctgatgcaaaagcgctcactggcactccgtataaatggggcggaacaactacttctggttttgactgcagcggatttatctggtacttgctgaataaacaaacaaacgtgggcagaacaagcactgcgggatactggagttctatgaagagcgtatcaagcccgtctgtcggcgactttgttttctttacaacatatcaagcaggcccttctcacatgggtgtgtatatcggaaacaacaagttcatccatgcaggatctgatggcgtgcagacaagcgatctgaacaacagctattggaaacctcgttatcttggcgcaaaacgtttctaa

SEQ ID NO: 2061 - DNA, 828 bp, Bacillus sp.
atgaaaaaacaagtaataacagcagcatcagcggttgttttaggatcgactttatttgcgggagcggcttccgcgcaaaccataacggtgaaaaaaggggatacgttatggggattttcgaagaagtacggtacaagtatcagcaagattaaacaggaaaacaagctgaaatccgatatcatttacatagggcagaggttgtcgatcaatggaagcagctcatcgtctgcaaaagcgtcgcaagcttcatcagctacgcataaagtggtcaaaggagacagcctttggaaaatttctcggacatacggcatgactgtcaatgaactgaagtctctgaatggcttaaaaacagatttaatccggatcggacaagtattaaaagttaaagggacgaaaagcgtaaaagctgcatcaacgacaaagccttcttcttcaagcaaaacaagtaaggcacctgcgcaaacctcttcagcgctgaatacgtcaaagcttgtttcagatgcaaaagcccttatcggaacgccttataaatggggcggaacatctacatcaggatttgactgcagcggatttgtctggtacatcctcaataaacagacaaatgtggcgagaacgaacacagccggttactggaattcgatgaagagcgtatcaagccctgcagtaggtgatttcgtattcttcacgacatatcagccgggaccttcgcatatgggggtttacatcggaaacaatcaattcgttcatgccggttctgacggcgtaacgatcagcgatatgacaaacagctattggaagccccgctatcttggagcaaaacgcttctaa

SEQ ID NO: 2062 - DNA, 828 bp, Bacillus sp.
atgaaaaaacaagtaataacagtagcatcagcggttgttttaggatcgactttatttgcgggagcggcttccgcgcaaaccataacggtgaaaaaaggggatacgttatggggattttcgaagaagtacggtacaagtatcagcaagattaaacaggaaaacaagctgaaatccgatatcatttacatagggcagaggttgtcgatcaatggaagcagctcatcgtctgcaaaagcgtcgcaagcttcatcagctacgcataaagtggtcaaaggagacagcctttggaaaatttctcggacatacggcatgactgtcaatgaactgaagtctctgaatggtttaaaaacagatttaatccggatcggacaagtattaaaagttaaagggacgaaaagcgtaaaagctgcatcaacgacaaagccttcttcttcaagcaaaacaagtaaggcacctgcgcaaacctcttcagcgctgaatacgtcaaagcttgtttcagatgcaaaagcccttatcggaacgccttataaatggggcggaacatctacatcaggatttgactgcagcggatttgtctggtacatcctcaataaacagacaaatgtggcgagaacgaacacagccggttactggaattcgatgaagagcgtatcaagccctgcagtaggtgatttcgtattcttcacgacatatcagccgggaccttcgcatatgggggtttacatcggaaacaatcaattcgttcatgccggttctgacggcgtaacgatcagcgatatgacaaacagctattggaagccccgctatcttggagcaaaacgcttctaa

SEQ ID NO: 2063 - DNA, 825 bp, Bacillus sp.
atgaaaaaacaagttttaactgcaacaacggcgattgttttggggacttcattatttgcgggagcggcatccgcacaaacggtgaaggtgaaaaaaggcgatacattatggggattttctaaaaagtacgggacaacaatcaacaagattaaaaaagagaacaaactgacatccgacaccatttacataggccaaacgctatccatcaatggaagcagcaagcagtcaaaagcatcaaaatctgctgcttcttcgtcttcaacacataaggtcgtcagaggagacagcctttggaaaatttcaaagacttataatatgactgttaatgaactaaaaaagctgaacggtttaaaaacagatttaattcggatcggacaagttctgaaagtaaaagggacaagcagtgtaaaagcggcatctacaaccaaaccaagctcgacaagcaagaaaacgacgcaatcttctacaaagcttaatacatcaaagcttgtctcagatgcgcgcgctctgatcggaactccttataaatggggcggcacgactccatcaggctttgattgcagcggatttatctggtacctgttgaacaagcagacaaatgtggcgagaacgagcacagccggatactggagctctatgacgaaagtgtcaagccctgctgtcggcgactttgtcttctttacgacttacaaggcaggaccgtcacatatgggtgtatacattggaaacaataaattcattcatgccagctcagacggcgtcatgacgagcgatatgacatcaagctactggaagccccgctatcttggcgcaaaacgcttctaa

SEQ ID NO: 2064 - DNA, 828 bp, Bacillus sp.
atgaaaaaacaagtcataacagcagcatcagcggttgttttaggatcaactttatttgcgggagcggcttccgcacaaaccataacggtgaaaaaaggggatacgttatggggattttcgaagaagtacggcacaagtgtcagcaagattaaacaggaaaacaagctgaaatccgatatcatttacatagggcagaggctgtcgatcaatggaagcagctcttcgtctgcaaaagcgtcgcaagcttcatcagctacgcataaagtggtcaaaggagacagcctttggaaaatttctcggacatacggcatgaccgtcaatgaactgaagtctctgaatggtttaaaaacagatttaatccggatcggacaagtattaaaagttaaagggacgaaaagcgtaaaagctgcatcaacgacaaagccttctgcatcaagcgggacaagcaaggcgcctgcgcaaacctcttcagcgctgaatacgtcaaaactagtttcagatgcaaaagcccttatcggaacgccttataaatggggcggaacatctgcatcaggatttgactgcagcggatttgtctggtacatcctcaacaaacagacgaatgtggcgagaacgaacacagccggttactggaattcgatgaagagcgtatcaagccctgcagtaggtgatttcgtattcttcacgacatatcagccgggaccttcgcatatgggggtttacatcggaaacaatcaattcgttcatgccggttctgacggcgtaacgatcagcgatatgacaaacagctattggaagccccgctatcttggagcaaaacgcttctaa

SEQ ID NO: 2065 - DNA, 825 bp, Bacillus sp.
atgaaaaaacaagttttaactgcaacaacggcgattgttttggggacttcattatttgcgggagcggcatccgcacaaacggtgaaggtgaaaaaaggcgatacattatggggattttctaaaaagtacgggacaacaatcaacaagattaaaaaagagaacaaactgacatccgacaccatttacataggccaaacgctatccatcaatggaagcagcaagcagtcaaaagcatcaaaatctgctgcttcttcgtcttcaacacataaggtcgtcagaggagacagcctttggaaaatttcaaagacttataatatgactgttaatgaactaaaaaagctgaacggtttaaaaacagatttaattcggatcggacaagttctgaaagtaaaagggacaagcaatgtaaaagcggcatctacaaccaaaccaagctcgacaagcaagaaaacgacgcaatcttctacaaagcttaatacatcaaagcttgtctcagatgcgcgcgctctgatcggaactccttataaatggggcggcacgactccatcaggctttgattgcagcggatttatctggtacctgttgaacaagcagacaaatgtggcgagaacgagcacagccggatactggagctctatgacgaaagtgtcaagccctgctgtcggcgactttgtcttctttacgacttacaaggcaggaccgtcacatatgggtgtatacattggaaacaataaattcattcatgccagctcagacggcgtcatgacgagcgatatgacatcaagctactggaagccccgctatcttggcgcaaaacgcttctaa

SEQ ID NO: 2066 - DNA, 837 bp, Bacillus sp.
atgaaaaaacaagtaattacagcagcatcagcggttgttttaggatcgactttgtttgcgggagccgcttccgcgcaaaccataacggtgaaaaaaggggatacgttatgggggttttcgaagaagtacggcacatctgtcagcaagattaaacaggaaaacaagctgaactccgatatcatttacataggacagaggctgtcgatcaatggaagcagttcttcatctgcaaaagcttcacaagcttcatcagctacacacaaagtggtcaaaggagacagcctttggaaaatttcacggacatacggcatgactgttaatgaactgaagtctctgaacggcttaaaaacagatttaatccgaatcggacaagtattaaaagtgaaagggacgaaaagcgtaaaagcagcatcaacaaccaagccttctgcatcaagcgggacaagcaaaacaagcaaggcacctgcgcaaacctcttcagcgctgaatacgtcaaaacttgtttcggatgcaaaagcacttatcggaacgccttataagtggggcggaacatctacatcaggatttgactgcagcgggtttgtctggtacatcctcaacaaacagacaaatgtggcgcgaacgaatacagtcggatactggaattcgatgaagagcgtatcaagtccggcagtaggcgatttcgtattctttacgacatatcagccgggaccttcgcatatgggggtttacatcggaaacaatcaattcgttcatgccggttctgacggcgtaacgatcagcgatatgacaaacagctattggaagccgcgctatcttggagcaaaacgcttctaa

SEQ ID NO: 2067 - DNA, 834 bp, Bacillus sp.
atgaaaaaacaagtaataacagcagcatcagcggttgttttaggatcgactttgtttgcgggagccgcttccgcgcaaaccataacggtgaaaaaaggagacacgttatggggtttttcgaagaagtatggcacaactgtcagcaagattaaacaggaaaacaagctgaaatccgatatcatttacataggacagaggctgtcgatcaatggaagcagttcttcgtctgcaaaagcgtcgaaagtttcatcagctacgcataaagtggtcaaaggagacagcctttggaaaatttcgcggacatacggcatgactgttaacgaactgaaaactctgaacggtttaaaaacagatttaatccggattggacaagtattaaaagtcaaagggacgaaaagcgtaaaagcagcatcaacaaccaagccttccgcatcaagcgggacaagcaaaacaagcgcacctgcgcagaaatcttcaacgctgaatacgtcaaaacttgtttctgatgcaaaagcccttatcggaacgccttataaatggggcggaacatctacatcaggatttgactgcagcgggtttgtctggtacatcctcaacaaacagacaaatgtagcgagaacgaatacagtcggatactggaattcaatgaagagcgtatcaagcccggcagtaggcgatttcgtattcttcacgacatatcagccgggaccttcgcatatgggggtttacatcggaaacaatcaattcgttcatgccggttctgacggcgtaacgatcagcgatatgacaaacagctattggaagccccgctatcttggagcaaaacgcttctaa

SEQ ID NO: 2068 - DNA, 834 bp, Bacillus sp.
atgaaaaaacaagtaataacagcagcatcagcggttgttttaggatcgactttgtttgcgggagccgcttccgcgcaaaccataacggtgaaaaaaggagacacgttatggggtttttcgaagaagtatggcacaactgtcagcaagattaaacaggaaaacaagctgaaatccgatatcatttacataggacagaggctgtcgatcaatggaagcagttcttcgtctgcaaaagcgtcgaaagtttcatcagctacgcataaagtggtcaaaggagacagcctttggaaaatttcgcggacatacggcatgactgttaacgaactgaaaactctgaacggtttaaaaacagatttaatccggattggacaagtattaaaagtcaaagggacgaaaagcgtaaaagcagcatcaacaaccaagccttccgcatcaagcgggacaagcaaaacaagcgcacctgcgcagaaatcttcaacgctgaatacgtcaaaacttgtttctgatgcaaaagcccttatcggaacgccttataaatggggcggaacatctacatcaggatttgactgcagcgggtttgtctggtacatcctcaacaaacagacaaatgtagcgagaacgaatacagtcggttactggaattcaatgaagagcgtatcaagcccggcagtaggcgatttcgtattcttcacgacatatcagccgggaccttcgcatatgggggtttacatcggaaacaatcaattcgttcatgccggttctgacggcgtaacgatcagcaatatgacaaacagctattggaagccccgctatcttggagcaaaacgcttctaa

SEQ ID NO: 2069 - DNA, 816 bp, Bacillus sp.
atgaagaaacaagtattaacggctgcatcagcgattgttttggggacaactttgtttgcgggagcggcgtcggcacaaacggttaaggtgaaaaaaggcgacacattatggggattttccaaaaagtacggaacgacagtcagcaagattaaaaaagaaaacaagctgaattccgatatcatttacataggacaaacgctttccatcaatggaagcagtaaaacatcttcaagcacaaacacatcttcttcgacatacaaagtcgtaagaggagacaccctctggaaaatttcgcggtcctacaatatgacggtgaatgagctgaaaaatctgaacggtttaaaaacagatttaatccgtatcgggcaagtgttgaaggtaaaggggaatgcaaaagcggcatcttcaaatacagcggtcaaatccagccagacaagcaaatctcaaacgtcttcttcaaagctgaatacatcaaagcttgtctcagatgcacaagccctgatcggcacaccttacaaatggggcggcacatcgccttcaggttttgactgcagcggctttgtctggtatctcttaaataaacaaacgaatgtcgcaagaacgaatacagtcggctactggaattccatgaccagcatatcaagcccagctgtcggcgactttgttttctttaccacataccagcccggaccgtcacatatgggcgtgtatattggcaacaacaagttcattcatgccggttcagacggtgtgacaacaagcgatatgacaagcagctattggaagccgcgctatcttggtgcaaaacgcttctag

SEQ ID NO: 2070 - DNA, 387 bp, Burkholderia Sp.
atgccctctctcgcttcccttgcccgccttcgccccggcacgctgcgcgcggccggcctcgcgctgatgccgctgttgatcgccctgcccctggccgcccaggccgccagcttcgactgcaagcaagccaggcaggccgacgagcgcgcgatctgcgcctcgcgcgcgctcagcgagcaggatgtggagatgtcggtgcgctacgagatgctgatggggctggtggcgatgggcacccgcggcgacatgggcgaggcgcagcagcagtggctcaagcgccgcgcgcgttgcggcgcttcgcagtcctgcctggccaccgcctatcgcgagcggatcgacgcgctcaagcagcagtatcggcaattgcagagccgcgggccgttctga

SEQ ID NO: 2071 - DNA, 387 bp, Burkholderia Sp.
atgccctatccctcttgccttgcccgccttcgccccggcacgctgcgcgcggccggcctcgcgctgctgccgctgttgatcgccctgcccctggccgcccaggccgccagcttcgactgcaagcaagccaggcaggccgacgagcgcgcgatctgcgcctcgcgtgcgctcagcgagcaggatgtggagatgtcggtgcgctacgagatgctgatggggctggtggcgatgggcacccgcggcgacatgggcgaggcgcagcagcagtggctcaagcgtcgcgcgcgttgcggcgcttcgcagtcctgcctggccaccgcctatcgcgagcggatcgacgcgctcaagcagcagtatcgccagttgcagagccgcgggccgttctga

SEQ ID NO: 2072 - DNA, 387 bp, Burkholderia Sp.
atgccctatctctcttgccttgcccgccttcgccccggcacgctgcgcgcggccggcctcgcgctgatgccgctgttgatcgccctgcccctggccgcccaggccgccagcttcgattgcaagcaagccaggcaggccgacgagcgcgcgatctgcgcctcgcgcgcgctcagcgagcaggatgtggagatgtcggtgcgctacgagatgctgatggggctggtggcgatgggcacccgcggcgacatgggcgaggcgcagcagcagtggctcaagcgccgcgcgcgttgcggcgcttcgcagtcctgcctggccaccgcctatcgcgagcggatcgacgcgctcaagcagcagtatcggcaattgcagagccgcgggccgttctga

SEQ ID NO: 2073 - DNA, 345 bp, Burkholderia Sp.
ctgcgcgcggccggcctcgcgctgctgccgctgttgatcgccctgcccctggccgcccaggccgccagcttcgactgcaagcaagccaggcaggccgacgagcgcgcgatctgcgcctcgcgcgcgctcagcgagcaggatgtggagatgtcggtgcgctacgagatgctgatggggctggtggcgatgggcacccgcggcgacatgggcgaggcgcagcagcagtggctcaagcgccgcgcgcgttgcggcgcttcgcagtcctgcctggccaccgcctatcgcgagcggatcgacgcgctcaagcagcagtatcgacaattgcagagccgcgggccgttctga

SEQ ID NO: 2074 - DNA, 297 bp, Burkholderia Sp.
ctggccgcccaggccgccagcttcgattgcaaagaggccaggcaggccgacgagcgcgcgatctgcgcctcgcgcgcgctcagcgagcaggatgtggagatgtcggtgcgctacgagatgctgatggggctggtggcgatgggcacccgcggcgacatgggcgaggcgcagcagcagtggctcaagcgccgcgcgcgttgcggcgcttcgcagtcctgcctggccaccgcctatcgcgagcggatcgacgcgctcaagcagcagtatcgacaattgcagagccgcgggccgttctga

SEQ ID NO: 2075 - DNA, 492 bp, Collimonas sp.
atgaaaggtttcacgcctggattgtttgacagactgatgggcggcgacaatacgcctgcgcaatccgacctggtagtgcgtttatcgatggacgccttgaaagacgcggttgcccgcgatctcgaagcgatgctgaatacgcgtaccgtgattcccgaagaaatactgaagaatttccctgaatgcagccagtcgatattgacctacggcttgaatgatttttccggtatgagcctggcaagcatggatgatcgtgcatatatctgccaatgcctggaacaaggcattgcgcgccatgaaccgcgcttgcgagatgtcaaggcctcgctcgaactgcgcgaaggatcgatcaaccgcttgaattttgcgattgccgccatgctggttgtcggaccggccaaggaagccgtaagcttcgacgccgtactgcagccttctaccttgcaatactcaatcagcagagcacgccgcgcgatgcgaatggacggttaa

SEQ ID NO: 2076 - DNA, 489 bp, Herbaspirillum sp.
atgaaaggcttcgcccccagcctgtttgatcgcctgatgaacgatagcgcaaggtcagccgccaatcccgtcatcagtcgcctgtcgatagaagaacttaaggataccgtagcacgcgacctggaggcgatgctcaacacgcgcgcggtcatccccgaggatctgctcaagaatttccccgaatgcggaaaatccattgtggcctacgggttgaacgatttcgccggcatgagcctggccagcatcgatgatcgcaatgccatctgccgttcgctggaaggggccatcgcccgccacgagcctcgtctgcgtaatgtgcgcgctacgctcgagatacgcgaaggcgccatcaaccggcttaattttgccatcagcgccttgctggtggtcaatgctgcgcgcgaggcagtcagcttcgacgccgtgttgcagccgtcgacgttgcagtactcgatcagcaagacgcgtccgacgcgcataggaatctaa

SEQ ID NO: 2077 - DNA, 489 bp, Janthinobacterium sp.
atgaagggttttacgccggggttgttcgaccgcctgatggacacgcccgtccagggcgcttccagtagcaccgtctcgcgcctgtcgctggaggatttgaaagacaccgtggcacgcgacctggaggcgctgctcaacacgcgcaccgtgataccggaagcgctgctgaaaaaatttcccgaatgcggccgttcgatcgtcacctacggcctcaatgatttcgccggcctgagcttgtcgagttccgacgaccgcgcgtatatctgccagtgcctggaaaaagccatcgcgcgccatgaaccgcgcctgcgcagcgtgcgcgcttcgctggaaatccaggaaggctcgatcaaccgcctcaatttcgccattaccgcgctactggtggtgcactcggcccaggaacctgtcaacttcgacgccatcctgcagccgtccagcctgcattacacgatcagcaaggcgcgccgtacggcgcaaggagcctga

SEQ ID NO: 2078 - DNA, 489 bp, Janthinobacterium sp.
atgaagggttttacgccggggttgttcgaccgcctgatggacacgcccgtccagggcgcttccagtagcaccgtctcgcgcctgtcgctggaggatttgaaagataccgtggcacgcgacctggaggcgctgctcaacacgcgcaccgtgataccggaggcgctgctgacaaaatttcccgaatgcggccgttcgatcgtcacctacggcctcaatgatttcgccggcctgagcttgtcgagttccgacgaccgcgcgtatatctgccagtgcctggaaaaagccatcgcgcgccatgaaccgcgcctgcgcagcgtgcgcgcttcgctggaaatccaggaaggctcgatcaaccgcctcaatttcgccatcaccgcgctactggtggtgcactcggcccaggaacctgtcaacttcgacgccatcctgcagccgtccagcctgcattacacgatcagcaaggcgcgccgtacggcgcaaggagcctga

SEQ ID NO: 2079 - DNA, 492 bp, Oxalobacteraceae sp.
atgaagggttttacgccgggactgttcgaccggctgatggatatgccagtcaacggcgcctccagcggcacggtatcgcgcttgtcgatcgaggacttgaaggactcggtcgcgcgcgatctggaagcgctgctcaacacgcgcaccgtgatcccggaagagctgctgaagcggtatcccgaatgcggacgctcgatcgtgacttacggcttgaatgactttgccggcttgtcgctgtcgagcaccgatgatcgcgcctttatatgccgatgtcttgagaaagccatcgcgcgccacgagccgcgcctgcgcaatgtgcaggcttcgctcgaactgcgcgctgactcgatcaaccgcctcaacttcgccatcacggcgttgctggtggtgagttcggcccatgaaccggtcaattttgatgctgtgttgcagccgtccagcctgcactacaccataagcaaggcgcgccgcgtggcgcaatcgggagcctga

SEQ ID NO: 2080 - DNA, 2274 bp, Collimonas sp.
atgaaaaaatatcatcgtcttacttgccgcctatatttcagcatggttgtggccggcgtcttgcctgcggcggcgcatgccaacgcagttttacagaatccattctggcgtgtcgcactcgatccggcgacgttggcgatcagggttacgccggcagacggaccggaagttgccgtatccaacggagttgatgcacacaaggtatcttccctccatgttgccgtcgacgaggcgagctggcgctgggatgagcgtgctgataatggctacgcgatcgaggcaaaactcactgagcgcgatctggccctgacgatacgcgcgaagggaacaggccagctcgcacttatccgccagcccgggcaagccatcggccgtggtttgatcctgccgctcacggaaggtcgctacgttgcgcgcgacaacaaggtctggaacgacttcatactgcaacacatggagcggatcaacgctacacaggacctcagcttgccgttgtggggattggatcacggcaagttcacgctgaactggctgctgaccaatccattcaataaccagctcgatttcagtgcagacaagaacggtgatggtgtggcgctcaaggtcagccataccttcacaacgctgtcggccgacacgccgatgacattgattctgcatctgggcgaggccgatccgctggccggcgccaaacgctatcgcgcgtggttgaaagaaaccggtcgctttgaatcgctggccgacaagatcgccaaaacaccggatgccgccaagctgatcggcgcatcgcacatctatctgtggggcagcggcctgatcgccgccaaggatatccgcgactggccggtcttcctgacggcgttgcgcggcaaggatgggctggcccaagatttgcgccgcacatttgatcgggagagcaaatccgtcctggcgcaggcaagcgccaaaccggacaggtatcagcaaaaagtcatcatccgcgctttcaacggcgccatcaacgcccttgcgcgcgcggcatggcaggtagatgaacccgatgtcgggctgctggcaaatcgctacggcgaattgcgtgcgcaggtggcgcggacattttccgccgcgttgagtaaagatcctgccggctggggcgacggcgtttccgtcaacaccatgtcgcaattgcaggctgccggcttgccgcgtctctggatcggtctcggcgaaggttgggagggcggcctgtggcatcccgaagcgatcgccgccggcgtcaaggcgggctatatggtggcgccatacgactcctatgaaacagccttgccgcgcggcgataatcccgattgggccaccgcccatctcggcgaaaaggcctatcgcgattgcgccatcgtgcagcaggacggtacgttcaaatccggcttcaaccagtccggtcattacaccaatccactgtgcatgcgcccgctgttagaggcaagggtacgtgcgttgcaggaaaaaaccggcttcaacagctggttcctggatgcctacgcaacgggcatggtgttcgacgattatagaaaagcggcgccaatgagcatggcgcaaaacgccatcgccaatgtcgacagttcgcgctggatttcgcaagaccggcaaatgccgacgggttcggaggatggcaatgccaccacctcgcagggaattttctttgcgcacggcatgcagaccccggtaatcggctggggcgacaaggacatgcagaaagataaaacatcgccgtattatctcggcaagtattatccgccggaagaaccggaagtcatgttcaaggccgtgccattgaaagagctgtaccgcaaagtcgacttcgatccggcggcgcgtctgccgctataccaggcggtattccacgattcggtcatcaccacgcatcactggctgttcgatagcttgaaattgaacaatgtccgcatggaaaacgaactggcgcaattgctctacaacgtgccgccgctgtttcacctaagtagcgcgacattcaaagccagattgccgctgatgcagcggcaggatgcgttcttccggccgctacatcaacgcttggcgacccaggcgttgactggatttcgctggctgtcgacagacaagatgctgcaggaaaccagttttgccgatggcaccacgctggtggtgaatttctctgatagcgaacgtcaggctgaaggccgacgcttcaagccatacagcatgacggcgcgtttcaatgacggtagtacatcgatatatgcggctgataaaaaatag

SEQ ID NO: 2081 - DNA, 1548 bp, Collimonas sp.
atgcgaacaaaagcaggcgtaaaaataggcggagccttgatgctgggactggtcggcagcctgctggcaggttgcggcgacggcggcggatcgacggatgctgcaggcgccagccagaaacaacttgtagccaccgctaaagccagcgtgacggcatgcgccgctgcctgggacgccaacaccatctatgtcggcggcaacagcgccagcgccaacagcaccaattacacggcaaactggtggacacaagggaacaacccggtcaccgatagcggcggcagcggtagcggcaagccatggacttccaccggcgcctgcggcagcggcacacccactccgccgcccgtcgcgcctccgcctgtcacacccccacccgttaatcctccaccggcaatgccaggcacgactaccggcaccatcaactatcacttgctgctgggcgcaggcagcgcccaggaccagatggtgctggatggcggcaactacaatgacctgatcatgtcgaacatcattgccggcgtcatgtacggccacctggtgcagcagtactatccgggaatgcaattccagaaagactacctgtacggttcgatcatgggccagctgctgcaggaaaacatcgagacaagcttgtacgccagcagcagcgacctgatcgatccgtcgccagaccagcaagccgtgatgggcgcaggccaaggcggcccgtaccaaatcaacaattacgccgccgacatggtttccggctcttacgcaccggccggccattcgctgatcaactacgtcgccatccagaaaaacatcggctacacgatggctaccgcagcccagcaatacaccaaggtgacgccaccctcgttcaacaacaaatactacggcccgatgctgaccgcgtatttccactacaacgattttgtcgcgctgatcctcaccggcaaaggcaccggcggctggacaacaccatgggaaccctactacgacaatgcgctggccaactttaccaagctgcctaacaacttcctcgatgtcttgctgaatgtggcttacaaccaaggttactacggtaccctgatgaccagctacagcaaactgggcgcgacggcgactgcggcgacggttgccagcgtcaatgcctacagctcggtatggggtgtgaccgatacctaccagcagtatccgtaccaggtgcgttactacctcgaccagctatatggcaacccgatcccgaccaccagcgccaccaccttcactacaccggccaaccatgtggccttcaacatcccggcgctggaaaccgtgttctccaatgtattccagacgctcgcttacgtgaacagctcagggacatcggtatacatttcggcagcccaggcgcaaaccgcgtttaacagcgcactggcaagcgtcggcgtcgccggcagcgccacgctggacttgagcaacggcgctaaccgcgcgcagatcttcagcatattggaaactgcgatcggcaatcttgaaaccaatctgaacaccaagttcagcgccaccaccagcgcacagctgtaa

SEQ ID NO: 2082 - DNA, 1521 bp, Collimonas sp.
atgagaacaaaaataggtgatgccttgctgcttggtctgtttggcgtcatgttggcgggttgcagcgacggcggcagttcgcaggatgcggcgaatgccagccagaaaccactaagccctggcgcaaaagccagcgcgccggcgtgcgccacagcctggaatgccaatgccgtctatgtcggcggcaacagcgtcagtgacaacggcacgaactacaccgcgaactggtggacccaggggaataatccggccaccgacagcggcggcagtggcagcggcaaaccatggacatccaccggcgcttgcggcagcgggacgccagcaccgcctgtcactccacctgtcacgccgcccgtcacgccaccgacgcccggcagcacagtcggcaccatcagctatcacctgctgctaggggccggttcagcacaagatcaattgatcctcgacggcggcaattacaacgacttgatcatgtcgaatatcatcgccggggtcatgtacgggcacttggtgcaggaatactacccaggcatgcaattccagaaagactacctgtacggctcgatcatgggacagctactgcaagaaaacatcgagaccggcttgtacgtcaacacaggtaatctcatcgatccttcgcccgatcaacaggcggtgatgggcgccggccagggcggtccgtatcagatcaataattatgcggccgacatggtctccggctcctacacgccggctggtcattcgctgatcaactatatcgccatccagaaaaacatcggctacaccatggccgccgcgcctcagcaatatacgaaagcgacgccgccgtcgttcaacaataaatactacggcccgatgctgaccgcgtatttccattacaacgattttgtggcactgatcctcaccggcaaaggcacaggcggttgggtcacgccgtggcagccgtattacgacaatacgctgattaatttcaccacactaccgaacaacttcctggacgtgctgctgaacgtcgcctataaccagggctactacggcacattgatgaccagctacagcaagctgggagcaacggctaccgccgccacggtagctgccgtcaacgcttacagcgccatttggggtgtgaccgacacttaccagcagtatccctatcaggtgcgctattacctcgaccagttctacggcaatccgatcccgaccaccagcgccaccaccttcgcaacgccggccaatcatgtcgcgttcaacattgcgacactggaaacggtatttgccaacgtattccagactctggcgtacgtgaacggcaccggtcaatcggtatacatcacctcggcacaggcgcaaaccgcattcaacagcgccttggcaagtagcggcgtgtccgccagcggcacactggatctgagtactgcgaccgaccgggcacagatattcagtgttcttgaaagcgcaattggcaacctggaaaccaatctgggcaccaagttcaacgctacaaccaacgttcagctatag

SEQ ID NO: 2083 - DNA, 1263 bp, Collimonas Sp.
atgaaactacctgcagcatggcttattcctgtttgcggcgtattggcggcttctcaagcgtctgcgtgggaaaaatacggcatccattcggtctacccggcggccatcagcgtccagatcaatccgtcgcaaatatcaaaccagcaactggcggccatcaaggatgccggtttcgaatacgtcaggttcggcacccgtccgccggtcagcgacaagccgcaggatttttcggaactgctggagcgcttgcgcaaggcgcagctgaaacccatcatcaccttgtttggcggcgccacggtctgggtgcagccgaaacggatgatgtcggcgaccatgacgccgctggatgcggctgacaatttttccaaatttgcgttgaccaccttgaatcagtactcggatccgaacatcttgtgggaattgtggaacgagcctgacaatccgactttcctgaagccaggcatgctgcaagccggcctggtgccggcaatacagaaaatctgctcggcgctggagcagcaaaagggtggcgtaaagaaaaacatcttcggcttcggtttcgccaagctgccgaatctgcaacccaagatcccggacgacaagttgctcgccatttcgctgcaaaactgcctgagcggcgtatcggtgcacccgtaccggaaaatccccgagacattggccgacgatgcgaccaagagccgcgagctgctgcacaagtacggcaagggcgaattgccgatgattgcatccgaatggggttattccaactttaccgccgcccgggaccagggcgggcaggcgcagctggtgctgagggaatacctgtcgacggtattcgccggcattccgctggtgaatatctaccagtggcaagacaccgggccggaccgggctgcgcgcgagcagaattacggcctgaccgacagcagcggccaggtcaagcaggctttgccggcgctcaagcatttgctgggcaagctgaaagatacccagcttgccggcagcgagaaggtgggggaggcctaccagctggtcttgaacagccagccgggagcatctgcaaaacgcagcgtccacgtcgtatggagttctgcggcgcactctggccctggcggcggtttttcgatcccgaggaacaaggggcagcgctgcgtcatcagtgagttttatccacagcagggcgacaagccctgcccggaaggcgccggcaatgttgatatcaacgctggcccgtcgccgctggcagtcacgctatacgattag

SEQ ID NO: 2084 - DNA, 2295 bp, Collimonas sp.
ttggcatgggcagcgctggcgcttggactgctgcatgtaaatgcagcgattgcaacggacacgtcggcggcggatgccaaagcagtaacggcggaggtgcacggtcggccgcgcataggtctggtgttgtccggcggcggcgcccgtggatatgcccatctcggcgtgctcaaagcgctggagcaaatgcatatcccaatcgattatgttgccgcaaccagtatgggggcggtggttggcgggttgtacgcgagcggattgtcggccgacgaactggaccacatcctgaccggcaccaatctgagcgacattgctttcgaccgtaatgagcgcgccgaattgccgcagtcgcagcgtgaggatgatttccagtatccgatcggcctgtcggccggctacggcgacggcaagttgaaactgccggcaggcctggtgcagggaaacaatttactggcgctcctgcagaactggacgccgcagttgccggcgaatatttctttcgacaagttgccgacaccgtttcgcgctgtggcaaccgatctcggcagcggcgccgaggtgatcctcaagcaaggctcgctgccacgcgcgatccgcgccagcatggcagtgccggggctgttcgcgccgctcaagctggatggccatacgctggtcgatggaggcctggtgcgcaacctgccggtccagcttgcgcgcgacatgggcgcggacatcatcattgccgtcaacattgccaccgacctgcaagacccgtcgacgctcgattcgccgactgcagtggcgcagcagatggtgaccatcctgattcggcagaacgtcaagcagcagattggattgctgaagaagggcgatgtgctgatcgagcccgatctgggtgacttgtcgtttgccgatttttcgcgcggcaaggatggcgtcgcggccggctacgccgccgcgcagaagcagcgcgccaaactggaagcgctggcgctgccgccggaacaatggaaatcctacctggctgggcgtagcggtggacctgtgctggcccaggaaacgcgcatcgacaagattgaaatcaatagccatggccccgtgccggcagcggcagtgcgccgctcactggacgtgaatgagggggatttctacaatcctgtggcgctcaaccaagacatggcgcgcctgtcgaccaacggcgatttcaagagcgtcacgcaggaactggtgactgaggacggcattaacgtactgaaagtcgatgcagacgccaaatcctgggggccgcatttcctgctgttcggattgggtgtctcaaacagcttcaacggccgcggcgactttaacctgcagatcggccatcggttgccgtggattaccgatagtggcctggagtggcgcaatgacgtcgtgctgggcagtaagcaggccagcctgcataccgaattgcggcagccgatatggaatacagtcggtttgtatgtggcgccttatgccgaatacgggcgtcggcatcttgatatctattccgatgacaacaatgccactgctgcaacggtgccggtcaccgcttatcgcgttgacaccaccaaagtcggggttgatctcggcatcccgatcgggcgtttgggcgagttcagggccggtgtcaattatcagtggctggtcgcggcaccgtcctacaatataccgctcggctcagacggttcggcatcggacgggctcttcgattcattccggatcaagcaaccggtggtcagtgccaagctcaccgtcgatcaattggacgatccgttatttccgcgtaaaggctattacgtctcggccatcagcaacgttggtcttggtggagcggacaatcgctatagtgacgcccaagccaaggggctgtgggctgtcagccacggcggcaataccttgaatttcgcgctggaggcggccggtacttatggcaatgaggagaatggcgtcagcggaaacggtggtctgggattttctttaggagggttccagcatttgtcggcgtatgcgcctgaccagttcaccggcaattacctgttgtacggccgcttgacctatctgcgtgacatgcctgatctggatttgcctggattgcgtagtaccgtgctgggaaccagcctggaagccggcgatgtgtggcaaacccgtaccgcgttcggcaccggtccgctcaagaaaagcgccagcatgttcttaggtggcaacagtttcctgggtccggtttactttggtctggcgctggcgccgcgtggcgtctggaatctttatttgcaattggggcgagtgttctga

SEQ ID NO: 2085 - DNA, 2172 bp, Collimonas sp.
gtgctgtctggcggcggcgcgcgcggctatgcccatctgggtgtgttgcaggcattggagaaaatgcatattccgattgattatgttgcggctaccagcatgggggccgtggtaggtggcctgtatgcaagcggcttgtcggtggatgagctggatcacattctttctggcaccaacctcagcgacatcgcttttgaccgcaacgagcgggccgatctaccgcaaagacagcgcgaagacgattaccaatatcctatcggcctctccgccggctacggcgacggcaagctaaagctgccggccggtctggtgcagggaaacaatctgttggcgttgctgcaaaactggatgccgcagcttcccgccaatatttccttcgataagctgcccaccccgtttcgtgcggtggcgaccgatctcggcagcggcgaagaagtgatactggatcatggctccctgccgcgtgcgattcgcgccagcatggcggtgccgggcttgttcgcgccgctcaagctggatggacgtactctggtggacggcggcctggtgcgcaatttgccggtggaccaggcgcgcgccatgggtgccgacatcattattgccgtcaatatcgctgcggatctgcaagatccgaccacgcttgaatcaccaacagcggtggcgcagcagatggtaacgattttgatccggcaaaacgtcaagcggcaggtcgattcgctcaagaaggacgacatattgattgagccggatatgggcgacctgggctttgccgatttttcacgcggcaacgatggcgtcaaggcgggctacgacgccgcagagcggcaacgcgccaagctggcgccattggccctgccgccagagcaatggaaggcttatctcgccgcccgcagcggtggcccggtactggcccaggatacgcgtatcgactctatagaaatcaatagcaaggggcgagtaccggcggcggtggtgcggcgctcgctgaatgtcaaggaaggcgatttctacaacccgatcgcgctcaacaaggatatggcaagcttgtcgactaatggcgacttcaaaagcgtgacgcaggaactggtgacggagaatggtcgcaatgtgttgaaggtggacgccgaggaaaaatcctggggccccaattttctcttgttcggcctgggtgtctccaatagtttcaatggccgcggcgacttcaatctgcaggtgggacatcgcttgccctggattaccgatagcggcctggagtggcgcaacgacattgtgctaggcagtaagcaagctagcctgcataccgaattgcggcaacccatatggaacacggtcggactgtatgtggcgccttacgccgagtatgcgcgcaggcatattgacttgtatttggatgagggttcggtaacctcaagcacggtacctgtgacggcctatcgggtggacacgaccaaagtagggattgatctcggcatgcctatcggccggctcggtgagttgcgtacgggtgtttattaccaatggctcgaggcgcgacctacctacaatttacccatggactttacccagatcgccccgggcctggtgttcagtagctttcgcgtaaagcaacccgtggttagcacccaactgatcgtcgaccaacttgacgatccgttgtttccgcgcaagggctactatctttccgcaatcagtaatctggcttttggtggcgctgataacagctacagcgatgcgcagggcaaggcgctgtgggcgattagtcgtggcggcaatacacttaacctggcgttggaagcggctggcacctatggtaacgaacagagcggcgcaagccagaacggcggcctgggattcacattgggagggttccagcatttatctgcatacgctcctgaccaattttccggtaattacctgttgtatgggcgtatgacctacttgcgcgatatgccaggactggatttgcctggtttgcgcagtgcggtgctgggaaccagtctggaagtgggtgacgtctggcaaaccaaggacgcgtttgccagcggtccgttcaagaagagcgtgagcatgtttttaggtggcaacagcttcctcggcccgctttattttggcgctgcgatcgcgccacgcggcatctggaacctgtacctgcagttgggccgggttttctaa

SEQ ID NO: 2086 - DNA, 1881 bp, Collimonas sp.
atgaaatcgaaagtaccagcaggaaattttgcgattccccaggtttcggcattgtcattagcgctgtccttggtgtttgcctccttgtccgtccatgcagccgtggcggataccggcacttgggtcgcaaccaagacacaagcattcttgccgcaagtgcaggctaatcagaaaagcctggcggccgacgccagcatagcaacgccggcagcatcggcagtgcaattggcgcagggcgaaccagtccatgtaacgctgagtctgaatctgcgcaacgaagccaagctcgataaattcctgcaagatctgcatacgccgggcactgcctcctacggcaaattcctgaagcctgcgcagttcgctgcgttgtatgcgccgacggaaaaagatgtcgctgcggtggtcgcgcacttgagcaagtctggtttcgtcaacatccggattgcacctaaccgtcaactggtgttcgccgacggcactgccgccaccgtgcaaactgcattccgtacttcgctcaagcgcttccagcaagacggccgcaaagtgttcgccaataccgacgcagcgcaagtgcctgcggcgctgggcaatatcgtcggttcggtgctcggactgcaaaacgtcgcggtggcccagacccatcatcgctggatacctaacgcgcagggtagcgtggcgctgcaagccaaggccaagccaagcgcaacccctatcgcaacgccgcacagcccagcgcagttccccgcaatttataacgccggctcgacgccgaccgcatccaacaccacggtcgccatcatttccgaaggaaatatcgatccgacgatcagcgatctgggaaccttcacttcggccaacggtttcgctaccgtcaacacttcagtggtgcaaaccggccctgcaggcagcgattacagcgatacgtctggccaggtcgagtggaatctggacagccagaccatcaccggcacctccggcggcgcagtacagcagttgatattctacgcatcgccagacatgaatttcagcagcatcactgcctcctataaccaggcagtcagcgacaacctggcaaaagtgatcaacgtctcgctcggcggctgcgaatcggatacgcatagcgacggcacccaggccgctgacgacaatgtgttcaagcaagccgtggcgcaaggacaaaccttctcgatctcgacaggcgacgccggcacctacaattgccagaccagctcgatctccggcgcgccaggcgtaccgaagaacaaatccacctatgatgtcagcgagcctgccagctcgccatacgtgatcgctgtcggcggtactaccttgtacaccgcgtccggtgcctacagcagcgaaacagtctggaatgagggattgagcgcgattggcgtgtacgatgccaatggcgattccgatccgaccaagcgcttgtgggcaaccggcggcggctacagcaaatacgaagcagcaccgtcctatcagtcgggcgtaattgctgccggcaagaccacccgtggcctgccggacatcgcgtttgatgcggccagcgccagtggcgccaccatctactacaacggccaaaccggtacagtgggcggcaccagcctggcagcgccgatcttcaccggcacctgggcacgtctgcaatcggccaacggcaatgcgctgggcttcccggcagccagcttctacaagtatttcccgctggccgccaatgccgcgctgctgcacgacgtgacttccggcaccaatggcgccagcagctcgtacggctacaaggctgccaaaggctgggacgcaacgacgggctttggtagcctgaacatcgccaacctgaataccttcatccagaacacatcggattttgcacgttga

SEQ ID NO: 2087 - DNA, 1887 bp, Collimonas sp.
atgaaatcggaatcatcagcgaaagtagcaggaagtttcaagattccccaggttacggcgttgtcgttagcgctgtcgctggtgtttgcatccatggccgcgcatgcagccgtggtggataacaccacttgggtagctaccaagacacaggcgtttttgccgcaggtgcaagccaatcaaaaaagcgtggctgccgacgccagcgtgcaaacgccggcagagtccgccgtgcagctggcgcaaggcgagccggtccatgtgacgctgagcctgaacctgcgcaacgaagcgcagctcgatcagttcctgcaagagctgcgtacgccaggcagcgcttcctacggaaaattcctgacatccgctcaattcgctgaaaaatacgcaccgactgaaaaagatgtcgccgcagtagtcgcgcatctgagcaaagccggttttgtgaatatctcggtttcgccgaatcgccagctggtgtccgccgacggcactgccgcgacggtgcaaaccggctttcgcactgcgctgaaacgtttccagcaagacggccgcaaagtattcgccaatacagacgcagcgcaagtaccggcaacccttagcggtatcgtcggttcggtgctgggcctgcaaaacgttgctatcgcccagactcaccatcgtttcgtgccggatgcagcaggcagtgcgaggttgcaagccacggccaagccaagtgcgacgccggtggccacaccgcatagccccgcggaatttcctgcaatctataacgcaggcagcacgccaaccggttcgaacactatagtcggcatcatttccgaaggcgatatcacgccgaccattaccgacctgaaggcgttcacgacagccaagggtctcgctactgtcagtacttcggtggtgcaaaccggcccttccggcagcgactatagcgatacttccggccaggtcgaatggaacctggacagccagaccatcaccggtacttccggcggcgtcaggaaactgattttctacgcatcgccagacatgcagttcagcagcatcacgacatcgtataacaaggcggtgacggacaacgtggcgaaagtcatcaacgtatcgctcggcggctgcgaatcggatacgcatagcgacggcacccaggctgcggacgataatgtgttcaagcaagctgttgcgcaaggccagaccttctcgatttcgacaggcgacgccggtacctacaattgccagaccagctcgatttcgggagcgcctggcgtaccgaaaaacaaatcgacctatgacgtcagcgagcccgccagttcgccatacgtgatcgccgtcggcggcaccaccttgtataccaatgccggtgcatacagcagcgaaacggtgtggaatgaaggactgagccctatcggcgtctacgacagccagggtgattccgatccgaccaagcgcttgtgggcaacaggcggcggtttcagcaaatacgaagctgcgcctagttatcaaaaaggcgtgatcacagctggcaagactacccgtggcctgccggacatcgcttttgatgcagccagcgccagcggcgccaccatttactacaacggccaaaccggaacagtaggcggcaccagccttgcagcgccgattttcactggcacctgggcccgtctgcaatcggccaacggcaacgcgctgggcttcccggcagccagcttctacaagtatttcccattggctgccaatgcctctttgctgcatgacgtcatttcgggcaccaacggcgccagcagttcctatggctataaagcaggcaagggctgggacgcgacgacaggtttcggtagcctgaacatcgccaacctgaataccttcatcaagaatacttcggattttgcgcgttaa

SEQ ID NO: 2088 - DNA, 1908 bp, Collimonas sp.
atgaaatcggaaacatcagcgaaaacagcagcaggcagttttgcggttccccgggcttcggtcttgtcattggcgctgtccctggcgcttgcatccttgtcggtacatgcggcgactaacgatacctgggtcgcgaccaagaccaaggcattcctgccgcaagtacaagcgaaacaaaaaagcgcagcagttgacgccagcgtgcaaacatctgcggaagctgccgtgcaaatggcgcaaggcgaaccagtccacgtcacgctgagcctgaacctgcgcaatgaagccaagctggataaatttctgcgggagttgcgtacgcctggcagccgggtccacaacaaattcctgacgcccgcacaattcaaggcggaatatgcccctactgaaaaagatgtggtgactgtagttgcccatctgcgcaaagccggtttcgtcaatatcaaggtcgcgccgaatcgccagctggtgacagctgacggtactgcagctaccgtccaggctggtttccataccgcgctgaaacgcttcgaacaagatggccgcaaggtgtttgccaatacggacgccgcacaagtgccggcagcgctcggccacatcgtcggctcagtgctgggcttgcaaaacgtagcgctcgcccataccaaccacgtcatgctgccggccgccaaagccaacgcatcgctgttcgccaaagcacgcaccaacgcgacgccgatcgccacttcacatagccctgcggaattccccggcatctacaacgccggttccacgccaaccgctgccaataccaccgtcgccgtcatctcggaaggcgacctgacgcagacgattgccgaccttaataccttcaccgcaaacaataatttcgccaccgtcaataccaacgtggtgcaaaccggtcccgacggcagcgactatagcgatacctctggcatggtcgagtggaatctggatagccagaccatcaccggcaccagcggcggcgcggtacaacaattgatattctacgcatcgccagacatgcagttcagcagcatcaccgcgtcttataaccaggccgtatccgacaatctggcaaaggtcatcaacgtctccctgggcggctgcgaatcggataccaatagcgacggcacccaggccgccgacgacaatgtattcaagcaagcggtggcgcaaggccagactttctcagtctcgaccggcgatgccggcgcctacaactgccagaccagttcgatttccggccagcctggcgtgccgacaaacaaggcggcctatgacgtcagcgaaccggctgcatcaccctatgtgatcgcggtcggcggcaccactctgtacacaacgtcaggctcgtacagcagcgaaaccgtctggaatgaaggcttgcgcgccatcggccagtacgatgccgccggcgacgtcgacaataccaaacgcatctgggccaccggcggcggttacagcaagttcgaggcagcgccaagctatcaatccggcgtaacggcaacgggcgccactacccgcggcttgccggacatcgcattcgacgccgccagcgccagcggcgccaatctggtcatcaacggcagcaccaccaaccagaacggcaacctgtacacagtcggcggcaccagcctcgctgcaccgatattcaccggcgtctgggcccgcatgcagtcggccaacaacaacggcctgggcttccctgccgccagcttctacaagtacttcccgcagtcagccaacgcatcgctgctgcatgacgtgacttccggcaccaacggctacagcagctcttacggctacaaggctggcaagggctgggatgcggttaccggcttcggcagcctgaacatcagcaacctgaacagcttcatcgccaatacgtctgactttgcgcgttaa

SEQ ID NO: 2089 - DNA, 552 bp, Collimonas Sp.
atgactatcaataaaatcctcgcgaccatgctgatcggcgttgccggttttagcggcacatcgctggccttggcggccgacagcgccaaagccagctacaaggcggcagaagatgcagccgacaccacttacaaggccgacaaggcaaaatgcgacgagctcagcggcaacggcaaggacgtttgcctcaagcaagccaaggccactcgcgaacatgccaagcaagacgcaaaggccgagtataaaaatacgccaaaagccgtcgccagcgcgcgtaaatccgaagccgacgccgactatgcggtagccaaggaaaaatgcgatggcctggcgggtaacgccaaggatgtctgcgtcaagcaggccaaggcagaccagaccaatgccgtagcgaacgccaacacccagaaagatgtgtccaaggccaaggccgacgctcgggaagaacgggcagatgcgcgatacaaggtggccatggccaagtgcgatgcgctggcaggagctgccaaggatgactgtgtcgccgcagccaaggcagagcttggcaaatga

SEQ ID NO: 2090 - DNA, 552 bp, Collimonas Sp.
atgaaaatcaagaaaatcatcgcgggcgtattgattggcgtcgctggtttcagcggcgcttcgctggcattggcggcagatggctccaaggccagctacagcgctgcgcaagatgcggcagatgctacatacaaggccgatagagccaggtgcgattcgctcagcggcaacggcaaggacgtatgcgtcaagcaagccgaggcaacgcgcgaacacagcaagcaggacgccaaggcggaatacaagaacactcccaaggcactggccagtgcgcgcaaatccgaagcggatgccgactacgcggtagccagggaaaaatgcgacagcctggcgggcaacgccaaggatgtctgcatcaagcaagccaaggctggacaagccaatgcagtcgccaacgccgataagcagctggagatcaccaaggccaatgccgacgcgcgtgaagagcgtgccgacgcgcgctacaaggttgcgcttgccaagtgcgatgcgctggccggcgctgccaaggacgattgcgtaacgaccgccaaggccgcattgaacaagtaa

SEQ ID NO: 2091 - DNA, 282 bp, Collimonas Sp.
atgtccttgccggcaacgctgcaggcacgctatctcagcttgaccgccagaatgaagatttacggccctcatttgggggagcctcataccaaggtgcttggcaatggcttgcttgagttacgcttgaagggcgcggaaggcattgcccgtgttttttattgcacgatggtcgggaagcagattgtcatgctgcacagtttcgtcaagaagacacaaaaaattccttttaaggaaaaacggattgcagaaattcgcatgagggaagttaaaaatgagcgctaa

SEQ ID NO: 2092 - DNA, 1491 bp, Collimonas sp.
ttgcaatcgccacaacggatactgcttgctgcgctcgtcagcgtgtgttgcgcgctgccgctgccgtccgccttggccatacaaaacctgccgacattgggcgattctgcgcgcgaatcgctgccgccgttgatggaacgcaagctcggcgaggagatcatgcacgatatccggcgcgatccggattacatgaacgatgctccgctgctggagtacctgaacaatttcggctggacgctggttgccgcgcggccggaagtacgcggcgaagcgggttttgattttttctttttcgcggtacgcgatccggtcttgaacgcatttgcattgcccggcggttttatcggcgtgcattccggactgatcctggcggcgcagagtgaatccgagttggcttcggtgctggcgcatgaaatcggccacgtcgcgcagcgccatatcgcgcgcatgctgggcagccaaaaacaggattcgatgattgccctggcttcgatgctgctgggtgcgctggcgatgcgcggcagcggcgacgccggcgcggcggtgatgatgggcggcaccggcctggcgatgcagcggcagttgaacttcagccgtgatgcagagcgcgaggcggatcggatcgggctgtcgatcctggattccggcggcttcgacaccagcggcatggtggcattttttggccgcatgcaaaccgcttcgcgcaattattccgatgcgattccgccgtatctgctgacgcatccgctgaccaccgaacgcatcgccgacatcgaggcgcggatccgcgagcagcgctatcggcagcgtgccgataacctggattttcagttgatacgtgcccgtgtccgagtgctgcaggatgataccgagctgggccggcgcgatgcgcaatacgtcttcgaagcgcagctgaatctgtacaccaagcagcaaatcgttgccgccaaatacggcatggctttcctggcgttcaagaaggaagattacgccaaggcggaagacttgctgaaccaggccgtggcggctgctgcgccggccaagcaaagcctggtactgaccgatctggggatcgaaatcatgctggccaccaagcgcgaggcggaggcgctgaagctggtggagcaggcgcaagtgcaatttccgctgtcgcgcggattggcgcatcagtatgccagggtgctgattgccagcaaacggctggatgaagtgaccaagtacctgcgcgaacaggcgcagatttatcgacaggatgcggacgtgcaggatttgctggccaaggcgtattcggcgcagggtaaacgggcgttgcagcatatggctttggcggagtcttacgtgttgaccggtagtgtgccggcggcgctggatcagttgcgcattgcgcgtaattcgccggatgcggggttttacgatcagtcgatgattgatgcgcgtgaacgggagttgcaggagcggtggaaagaggaagtgaaggcttccaaggagtag

SEQ ID NO: 2093 - DNA, 1449 bp, Collimonas sp.
gtgtgttgcgcgctgccgctgccgtccgccttggccatacaaaacctgccgacattgggcgattctgcgcgcgaatcgctgccgccgttgatggaacgcaagctcggcgaggagatcatgcacgatatccggcgcgatccggattacatgaacgatgctccgctgctggagtacctgaacaatttcggctggacgctggttgccgcgcggccggaagtacgcggcgaagcgggttttgattttttctttttcgcggtacgcgatccggtcttgaacgcatttgcattgcccggcggttttatcggcgtgcattccggactgatcctggcggcgcagagtgaatccgagttggcttcggtgctggcgcatgaaatcggccacgtcgcgcagcgccatatcgcgcgcatgctgggcagccaaaaacaggattcgatgattgccctggcttcgatgctgctgggtgcgctggcgatgcgcggcagcggcgacgccggcgcggcggtgatgatgggcggcaccggcctggcgatgcagcggcagttgaacttcagccgtgatgcagagcgcgaggcggatcggatcgggctgtcgatcctggattccggcggcttcgacaccagcggcatggtggcattttttggccgcatgcaaaccgcttcgcgcaattattccgatgcgattccgccgtatctgctgacgcatccgctgaccaccgaacgcatcgccgacatcgaggcgcggatccgcgagcagcgctatcggcagcgtgccgataacctggattttcagttgatacgtgcccgtgtccgagtgctgcaggatgataccgagctgggccggcgcgatgcgcaatacgtcttcgaagcgcagctgaatctgtacaccaagcagcaaatcgttgccgccaaatacggcatggctttcctggcgttcaagaaggaagattacgccaaggcggaagacttgctgaaccaggccgtggcggctgctgcgccggccaagcaaagcctggtactgaccgatctggggatcgaaatcatgctggccaccaagcgcgaggcggaggcgctgaagctggtggagcaggcgcaagtgcaatttccgctgtcgcgcggattggcgcatcagtatgccagggtgctgattgccagcaaacggctggatgaagtgaccaagtacctgcgcgaacaggcgcagatttatcgacaggatgcggacgtgcaggatttgctggccaaggcgtattcggcgcagggtaaacgggcgttgcagcatatggctttggcggagtcttacgtgttgaccggtagtgtgccggcggcgctggatcagttgcgcattgcgcgtaattcgccggatgcggggttttacgatcagtcgatgattgatgcgcgtgaacgggagttgcaggagcggtggaaagaggaagtgaaggcttccaaggagtag

SEQ ID NO: 2094 - DNA, 1440 bp, Collimonas sp.
ttgccgtacgcaccggcagcggctgcgcaaaacctgccgactttaggcgacacctcacgcgaaacgctatcgccgctgatggagcgcaagcttggcgaggaagtcatgcacgatatccggcgcgatcccgattacatgaccgatgcgccgctgctggaatacctgaacaatttcggctggacgctggtcaacgctcggccggacgtgcgtggcgaggcgggttttgatttctttttctttgcggtgcgcgatccggtcttgaatgcgtttgccttgccggggggcttcatcggggtgcattcgggtttgttgctggcggcgcaaagcgagtctgagctggcttcggtgctggcgcatgaaatcggccatgtggcgcagcgccatattgcacgcatggtgggcagccagaagcaggattcgatgatcgcgctggcgtcaatgttgctgggcctgttgacaatgcgtggcagcccggatgctggcgcggcggtgatgatgggtggcacgggcctggcgatgcagcggcagttgaatttcagccgcgacgccgagcgtgaggcggatcgcatcgggctttctatcctcgatgcgggcggtttcgataccagcggtatggtagtgttctttggtcgcttgcaaaccgcttcgcgtaattattcggatgcggttccgccgtatctgctgacacatccgctcaccaccgaacgcatcgcagatatcgaagcgcgcattcgcgagcaacgttatcggcagcatgcagacagcctggatttccagttgatccgggcgcgagtgcgggtgctgcaggacgataccgaactgggccggcgcgaggcgcaatttttcttcgagacgcagctgaagcaaaataccaagcagcaaatcgtcgcggctaaatacggtatggctttccttgccttcaagcaggaggattacggcaaggcggaagcgttgctggaagaggctatggctgcagccgcgccagccagaaagaacctggtcctgaccgatctggggatagaaatcatgctggcgaccaagcgcgaggcggaggctttgaagttggtggaacaagcgcagctgcaatatcctttatcgcgcggcttggcgcatcagtatgcacgggtgctgattgcatccaagcgtttggatgaggcgaccaaatatttgcgcgaacaggcgcagctgtatcgacaggatgcggatgtgcaggatttgctggcccaggcgtattcggcgcagggaaagagggcgttgcagcacatggctctggcggagtcttatgtgctgacggggagtgtgccggcggcgctggaccagttgcggattgctcgtaacgcgccggatgcagggttttatgaccagtccatgattgacgcgcgggagcgggagttgcaggcgcggtggaaggaagaattacaggcttccaaagatcgctag

SEQ ID NO: 2095 - DNA, 1146 bp, Collimonas sp.
atgaaaaaaatactcgcggcgcttgctgcaaccgtcctttccatctccgctgccttcgcgcagacactgccgccgccgacagtcgccgccaaatcgtggctgctgctcgacaccaccagcaatcaagtagttgccgcccaagatcccgacatgcgcatcgagcctgcttcgctggccaagatcatgactgcgtacgtggtgttcggcgcattgcgcgacaagaagatcagcctcgatcaaatggtgaatgtgtcggtgcgcgcctggaaagtcgatccgagcagctcgaagatgtttatcgatccggccacaccggtctcggtcaacgacctgctgtacggcctgatggtggtatcgggtaacgacgccgcggtagcgctggcggaagccgtggccggcaccgaagattcgttcgtggcgctgatgaaccacgaagccgaacgcatgggcatgaagtcgacccatttcgggaatccacacggcctgccaagcgccgatacttactcgaccgcgcgcgacctgtcgacgctggcggcgcacgtgattgtcgatttccccgagttctacaagatcgactcgaccaagaaatacacttacaacaagatcacccagcctaaccgcaaccgcctgctgtggctcgacccaaccgttgacggtatgaagaccggccacaccagcagcgctggctattcgatcatcgccagcgccaagcgtccgaatgcaggcggcgatcgccgtctgctggccgtcgtgattggcaccgattccgacagcatccgcacccaggaagcacaaaaactgttgaactggggcttccagaactttgacgcagtcaagctgtacagcaagggtcaggcagtcgacacgccgcaagtctggaaaggcgccaagagccagatcaagatcggcttcaaccatgacgtctacgtgaccgtaccgaagggcatcgccgacaagatcaagccagtgctggaacgcaccgatccgctgatcgcaccgatccagcagaacgccaaggtcggcaccctgaaagtcaacgccgacggcaagaccatcgccgaattcccggtactggcgctggaaggcgtgaaccaggcttcgatcttcggccgcgcctgggattcgattcgtttgatgttcaaataa

SEQ ID NO: 2096 - DNA, 1272 bp, Collimonas sp.
gtgaggttgtttgcccgccgtctccacccactcattttttcaaccattcacgctaataaagttgctcaatatccacattggcaattgcataattttgttggtactgatttcattactcgatactccatgaaaaaaatactcgcggcgcttgctgcaaccgtcctttccatctccgctgccttcgcgcagacactgccgccgccgacagtcgccgccaaatcgtggctgctgctcgacaccaccagcaatcaagtagttgccgcccaagatcccgacatgcgcatcgagcctgcttcgctggccaagatcatgactgcgtacgtggtgttcggcgcattgcgcgacaagaagatcagcctcgatcaaatggtgaatgtgtcggtgcgcgcctggaaagtcgatccgagcagctcgaagatgtttatcgatccggccacaccggtctcggtcaacgacctgctgtacggcctgatggtggtatcgggtaacgacgccgcggtagcgctggcggaagccgtggccggcaccgaagattcgttcgtggcgctgatgaaccacgaagccgaacgcatgggcatgaagtcgacccatttcgggaatccacacggcctgccaagcgccgatacttactcgaccgcgcgcgacctgtcgacgctggcggcgcacgtgattgtcgatttccccgagttctacaagatcgactcgaccaagaaatacacttacaacaagatcacccagcctaaccgcaaccgcctgctgtggctcgacccaaccgttgacggtatgaagaccggccacaccagcagcgctggctattcgatcatcgccagcgccaagcgtccgaatgcaggcggcgatcgccgtctgctggccgtcgtgattggcaccgattccgacagcatccgcacccaggaagcacaaaaactgttgaactggggcttccagaactttgacgcagtcaagctgtacagcaagggtcaggcagtcgacacgccgcaagtctggaaaggcgccaagagccagatcaagatcggcttcaaccatgacgtctacgtgaccgtaccgaagggcatcgccgacaagatcaagccagtgctggaacgcaccgatccgctgatcgcaccgatccagcagaacgccaaggtcggcaccctgaaagtcaacgccgacggcaagaccatcgccgaattcccggtactggcgctggaaggcgtgaaccaggcttcgatcttcggccgcgcctgggattcgattcgtttgatgttcaaataa

SEQ ID NO: 2097 - DNA, 1146 bp, Herminiimonas sp.
atgaaaaaaatcttcgcggccttcgccgccagcgtcctatccctctccgttgccgtcgcgcaaaccctgccgtcgcccaacattgccgcccgctcctggctgttgctggacatgaacagcaaccaggtgatcgccgcgcaagatccggacatgcgcatcgaaccggcctcgctgaccaagatcatgaccgcctacctgacttttgccgcggtcaaggacaagaagctggcgctgaaccagatggtgacggtgtccgagcacgcctggaaagtcgaccccagcagctccaagatgttcatcgacccgcgcgtaccggtcagcgtgaacgacttgctgtacggcctgatggtgcagtccggcaacgacgcggcggtggcgctggccgaagcggtgtccggcaccgaggatgcatttgtagtgctgatgaaccgcgaagcgcaacgcatgggcatgaaaaacacccgcttcggcaatccgcacggcctgcccagtgcagagaattactcgaccgcgcgcgacctgtcgctgctggccgagcacatcatcgccgactacccggagttctataagatcgattcgaccaagtacttcacctacaacaacatcaagcaaccgaaccgcaaccgcctgctgtggtccgacccgtcagtcgacggcatgaaaaccggccacaccgcgggctccggctacagcatgatcgcgtcggccaaacggcccaacggcaacagccagcgccgcctgctcagcgtgctgtcgggcgcgacttcggatcagctgcgcgcgcaggaaagccagaagctgctgaactggggcttccagaatttcgaagcggtcaagctgtactcgaaggaccaggcgatcgccaccccgcaggtatggaaaggcgcgcagggccagctcaagatcggcttcaaccgcgacgtcttcgtgacgctgccaaaaggcaccgccgacaagctcaagccggtgctggagcgtcgcgacccgctggtggcgccgatcaaccagaacagcaaggtcggcacgctgaagatgatggtcgacggcaaggtagtgacggaattgccggtgctggcgctggagcaggtcaatcaggccagcatcttcggccgcgcctgggattctctgcggctgtggctgaagtaa

SEQ ID NO: 2098 - DNA, 1146 bp, Duganella sp.
atgaaaaaaattatcgcggcactggccaccagtgtgatgttgatgtccgccgccgtagcgcaaaccctgcctccgccgaccatcgccgccaagtcctggctgctgctggacgccaccagcggccagatcatcgcctcgcaagacccgaacgcccgcatcgagccggcctcgctgaccaagatcatgacggcctacgtcaccttcggcgcgctgcgcgacaagaagatcgacctcaagcagatggtcaacgtctccaccaaggcgtggaaggtcgattccagcagttccaagatgttcatcgacccggccaccccggtcagcatcaacgacctgctgtacggcctgatggtgcagtcgggtaacgacgccgccgtggcgctggccgaagcggtcgccggcgacgagtccgccttcgtggtgatgatgaacaaggaagcccagcgcatgggcctgaccaacacccgcttcgccaacccgcacggcctgcctagcccggagaactattcgaccgcgcaagacctgtcggtgctggccaagcgcgtgatcctggacttccccgagttctacaagatcgactcggtcaagagcttcacctacaacaagatcacccagccgaaccgcaaccgcctgctgtggctggacccgaccgtcgacggcatgaagaccggccacaccgaagcggccggttactgcatgatcgcctccgcgcaccgtccgaacggcgccggcgagcgccgcctggtgtcggtggtgctgggcacctcgtccgaccagtcgcgcacgcaggaaagccagaagctgctgaactggggcttccagaacttcgacacggtcaagctgtactccaagggccaggccatcgcgacgcctgaaatctggaagggttcgaaaggcgtggtcaagatcggcttcgccaacgacgtgctggtgacggtgccgaaaggcgtggccgccaagatgaagccgctgctggagcgcaaggatccgctggtcgcgccgctggccgagaacagccgcgtcggctcgctgaagatgatggtggacggcaagccgctgctggaattgccggtggtggcgctggaaaccgtcgatcaagcctcgatcttcggccgcgcctgggattcgatccgcctctggctgaagtaa

SEQ ID NO: 2099 - DNA, 1149 bp, Janthinobacterium sp.
atgaaaaaattacttgcggccattgctgctaccgtcctatcgctttcctccgcttttgcccaaagtgttccttcgcctaccatcaatgccaaatcgtggttactgctggatgcaaccagcaaccaggtactggcatcgaatgagcctgatatgcgtatcgaaccggcatcgctgaccaaactgatgaccgcgtatgtagccttcaccgcaatccaggataaaaaactggacctgaaccagatgatcacaatttccaccaatgcgtggaaagtcgatccaagcagctcgaaaatgtttatcgaaccgcgcgtaccggtcaaggtcaacgacctgctgtacggcctgatcgtgcaatccggtaatgacgcggctgtcgccattgccgaagccgtcgccggcaccgaagatgccttcgtcgccctgatgaaccgtgaagcggaacgcatgggcatgaagtccacccacttcgccaacccgcacggcttgccaagcgccagcaactactcgaccgcacgcgacctgtcggtactggcttcgcacctgatcaacgatcatcctgagttctacaaaatttattcgaccaaggaatacacctacaacaacatcaagcagccgaaccgcaaccgcttgctgtggctggatccaaccgtggacggtatgaaaaccggttacacccagggcgcaggctactgcctgatctcgaccgcaaaacgtcctaacggcactggtgaacgtcgcctgatttcagtcgtacttggcaccatttccgaccaggcacgcgcacaggaaagccaaaagctgctgaactggggcttcctgaacttcgacaccgtgaagctgtatgcgaagaacgagcctatcgccacgccgaatgtctggaaaggcacgcagaacagcatcaagatcggcttcacccgtgacgtctacatcaccgtaccaaaaggcgtggcaaacaccatgaaaccggtactggcgcgcaaagacccgctggttgcgcctatcgacaaaaacagccaggtcggcaccatcaaggtgatgtcggctgacggcaaagtcgtttccgaattaccggtactggcattggaacaagtcggccaggccggtttgttcggtcgtgcgctggattcgatccgcctgtgggtgcattaa

SEQ ID NO: 2100 - DNA, 1146 bp, Massilia sp.
atgaaaaaactgttagcggcgtttgccgccagcctggtgatggtctcggccagcgcgcaaaccgtgcctgcaccgaccatcgccgccaaatcgtggctgctgctcgatgcgacgagtggccaggtcatcgcttcgcaggaccagaacgcgcgcatcgaaccggcctcgctcaccaaggtcatgacggcctacgtgacctttgccgcgatccgcgagaagcgcctggcgctgaaccagatggtgaacgtgtcgacccgcgcctggaaggtcgatggcagcagctcgaagatgttcatcgatccggccaccccggtgtcggtgaacgacctgctgcacgggctgatgatccagtcgggcaatgacgcggcagtggcgctggccgaagcggtcgccggcgacgaaggcaccttcgtgaccctgatgaaccgcgaagccgagcgcatgggcctgaagggcacccgcttcgccaacccgcacggcctgccggacgcgaacaactattcgaccgcgcacgacctgtcgatgctggcggcgaacgtgatccgcgacttccccgagttctacaagatcgactcggtcaagcagttcacttataacaagatcacccagcagaaccgcaaccgcctgctgtggctggatccgaccgtggacggcatgaagaccggccacaccgactcctcgggctacagcatgatcgcttcggcgcgccgcccgaacggcaccaccggccagcgccgcctgatctcggtcgtgctgggcaccccctcggattcggtgcgtacccaggaaagccagaagctgctgaactggggcttccagaacttcgacaccgtgaagctgtactcgaagggccaggcgatcgcgacgccggaagtgtggaagggttcgcagtcgaacgtgaagatcggcttcacccgcgacatcctggtcaccgtgccgaagggcgtggcgggcaagctcaagccggtcctggaacgcaaggacccgctggtcgcgccgctggcccgcaatggccaggtcggcaccctgaagatgatggcggacgggaagccgctgctggtgctgccggtggtggcgctggaagaggtgcaggaagcgagcatcttcggacgcgcctgggattcggtgcggctctggctgcagtaa

SEQ ID NO: 2101 - DNA, 1212 bp, Oxalobacteraceae sp.
ttgttccaccacgccatggccttgccggcacggcgcttaccattgaccctcatgaaaatctttatcgcggccctcgccgctactgtcatatcgctttcttccgtttttgtacaaccggcttccgctcagaccatgccggcgcccatcgtcgcggccaaatcctggttgctgctcgataccaccagcggccaggtactggcctcgcaagacccgaccatgcgcatcgagcccgcctcgctgaccaagatcatgaccgcctatgtcacgttccaggcgatcaaggaaaaacgcctcgacctcgcgcagatggtcaacgtgtcagtgcgcgcttggaaggtcgatccgagcagctcgaaaatgttcatcgatccggccacgccggtgtcggtcgacgatttgctgcatggcctgatggtccagtccggcaatgacgccgccgtcgccctggccgaagccgtagccggtaccgaagaagccttcgtggtgctgatgaaccgcgaagccaagcgcatgggcctgaccaatacccagtttggcaacccgcacggcttgccaagccagagcaattattcgaccgcacaggacctgtccaaactggccgcggcggtgatcaccgattaccccgagttctacaagatcgattcggtcaagagcttcacgtacaacaagatcacgcaacccaaccgcaaccgcctgctgtggctggacccgagcgtcgatggcatgaaaaccggccataccgaagcggccggctattgcatcatcgcctcggccaaacggcccaacggcagtggcgagcgtcgcctgatctcggtcgtactgggtgccaattcggaccagtcgcgcacacaggaaagccagaagctgctgaactggggcttccagaacttcgacacggtcaagctgtatggcaagggccagccggtagaaaccccacccgtctggaagggctccgagaagaccatcaagatcggcttcacgcaggatatctacgtcacggtggccaaaggtgtcgccgccaaaatgaagccggtgctcgaacgcaaggatccgctggtcgccccgattgccgccaacagcaaggtcgggatgatgaagatgatggtcgacggcaagtcgatcgccgaattccctatcctggcgctggaaaacgtcaacgaagccggcatcttcggccgcgcctgggattcgatccggctctggatccagtaa

SEQ ID NO: 2102 - DNA, 309 bp, Microbispora sp.
atgaaaaggttcgtcctcgtccccgccctgacggccgcgacgatcgcgatcagcgccggcgccgcctacgcctcccagtacgtcgcctatgagggccccggcttcagcggcaggtcggtggtcatcgaccgctgcggcgtgtccaacatccccttccacgggtcctaccgctggtatggcgacggccagagcggccggatgtacaaccagcccgacgcgcagggcgtcgcccacttcacactcgccgccgacaggaacgcggagcagaggactccggtcggctggaagagcatcttcatcgtctgctga

SEQ ID NO: 2103 - DNA, 1446 bp, unknown
  environmental sample
atggatgacaaagacggtacgccctacagggttgagcaactgggcccgccgcggggacgcgcggggttgcagatcaacgagccggtagcggatttcgacggactggccacgcatcatccgggcgacaacagacatgcgaagttgcgcgatggcttggtggtggacgggcaatcgggacgattgcacgccgtcatcggtggggaaatccaagaaatcgaaatggctcggggcggtagggatttcggtgggctgaagcccgatcaggtcctgctgaaaaaagatttcctcctggaagattccaccaagccccgtggtagcggccgcgatgtggatgtgcctgcgccgatggatggctatgtacagagagtcagccgcggcgaaggcctggtcgatatctacgaccgaaaggacggcgacctgatcgcccgcgtgcggcacatgagcaagattcccgacctggaggggaaacaggtcgtttatgggcagacgctgggtcaacaagacgacgtggcgaccaaaggcaagcacgtccatcttgagatggatacccgttatcaccggcagttcgaaaactacgtcgccgacctgaccgaggggcgattcaagttggagccggagcatcgcgaaggcgtccggccgcgtccggtcatggatgacggcacgctgagactgggcgagtccagcacgcgcatacgggatttgcaggaacatctgaacggacttggctacatcggcgcggacggcgaggcgttgaccgccgacggcgtgtatcggctgagcatgcagcgtgcggtactggactatcagcgtgagcagtgcctgccgcaaaccggcgatatcggccgcgagatgctgcaagcggtgcccgcgcgaacgccggagccgttcgatccggcgctgtcaggcatccccgcacagggattgccgcatgccccgatgccgcatcccttcggtacgggccctgatgatcgcccctgcgccccgccgacgcctcagcaaatcgaggatgccgcggaaaggcgccggccgttggacccggtgttttccgcggcgccgccgtcgatctccagcgacccgttggtgcaatcgattcgcgaacggctgccgcaggcgtttgccagtcacggggccgtgccgccggacgcggatttggaccgcatcgccgccggtctggccgtcgaatgctgtaagcaaggcatcgagcgtcccgaccacatcgtggtcggtaacccggcggccgatggttccggacgccacgttttcgccgtggtgggcgatttgcgcgatccggccagtcatcgggtggacgtggccggtcaggcggcggcgcaagttccggtcgaagcgtcgctgcgtaagctcgatgccttgcaggcttcgacgcctgcgctggtgcaggcggatcaggctcaggagcagcagaaggcttcgatcatgcgggtttga

SEQ ID NO: 2104 - DNA, 810 bp, unknown
  environmental sample
atgacccacacgacccgaaccccgaccctggcgatggccgcttgcgtgctggccgcgctcgccctgatcggttgttcgagcacggtcgtgcgcgagccctcgcgcggcggccacagccgtccgggcacgtcggtgcgtcccggcggctcgcgtccgtcgaccacgccaccggcgtccaagcccaagtacggcgccacctacaccgtgcagcgcggcgaaggcctgtaccgcatcgccgccaacaacggcatccagctggccgacctggccgcctggaacaacttgtcgccgccgtacaacctgtatccgggccagcgcctgcgcctgtacccgtccaacggcagccgcccgccggcgtcctcgggttcgtcgtcggccggcaccacgccgccgcgcaccagcacgcccgcgccgaccccggccgcgccgatcaacagcggcatccgctggcgctggccggccgacggtccgctgctgggccgctacgtcgccaacgaaccgaccaagcagggcgtcgacatcggcggcgccagcggcaccccggtgcgcgccgcggccgatggcgtggtggtgtattcgggcaccggcctggtcggttacggcgaactgatcatcgtcaagcataacgagcagtggctgtcggcctatggccacaaccgcaagcgcctggtcaacgaaggccagttggtgaaggccggcgaacagatcgccgagatgggccgcagcggcgccgcgcgcgacatgctgcatttcgaagtgcgctacaacgccaagccggtcgatccgttgttgtacctgccggcgaaataa

SEQ ID NO: 2105 - DNA, 813 bp, Lysobacter sp.
atgacccacacgacccgaaccccgaccctggcgatggccgcttgcgtgctggccgcgctcgccctgatcggttgttcgagcacggtcgtgcgcgagccttcgcgcggcggccacagccgtccgggcacgtcggcgcgtcccggcggctcgcgcccgtccaccccgtcgcagccggcgtccaagcccaagtacggcgccacctacaccgtgcagcgcggcgaaggcctgtaccgcatcgccgccaacaacggcatccagctggccgacctggccgcctggaacaacctgtcgccgccgtacaacctgtatccgggccagcgcctgcgtctatacccgtccaacggcagccgcccaccggcgtcctcgggttcgtcgtcggccggcaccacgccgccgcgcaccagcacgcccgcgccgaccccggccgcgccgatcaacagcggtatccgctggcgctggccggccgacggtccgctgctgggccgctacgtcgccaacgaaccgaccaagcagggcgtcgacatcggcggcgccagcggcaccccggtgcgcgccgcggccgatggcgtggtggtgtattcgggcaccggtctggtcggttacggcgaactcatcatcgtcaagcacaacgagcagtggctgtcggcctatggccacaaccgcaagcgcctggtcaacgaaggccagttggtgaaggccggcgaacagatcgccgagatgggccgcagcggcgccgcgcgcgacatgctgcatttcgaagtgcgctacaacgccaagccggtcgatccgttgttgtacctgccggcgaaataa

SEQ ID NO: 2106 - DNA, 810 bp, Lysobacter sp.
atgacccacacgacccgaaccccgaccctggcgatggccgcttgcgtgctggccgcgctcgccctgatcggttgttcgagcacggtcgtgcgcgagccctcgcgcggcggccacagccgtccgggcacgtcggcgcgtcccggcggctcgcgtccgtcgaccacgccaccggcgtccaagcccaagtacggcgccacctacaccgtgcagcgcggcgaaggcctgtaccgcatcgccgccaacaacggcatccagctggccgacctggccgcctggaacagcctgtcgccgccgtacaacctgtatccgggtcagcgcctgcgcctgtacccgtccaacggcagccgcccgccggcgtcctcgggttcgtcgtcggccggcaccgcgccgccgcgcaccagcacgcccgcgcccaccccggccgcgccgatcaacagcggcatccgctggcgctggccggccgacggtccgctgctgggtcgctacgtcgccaacgaaccgaccaagcagggcgtcgacatcggcggcgccagcggcaccccggtgcgcgccgcggccgacggcgtggtggtgtattcgggcaccggtttggtcggttacggcgaactcatcatcgtcaagcacaacgagcagtggctgtcggcctatggccacaaccgcaagcgcctggtcaacgaaggccagttggtgaaggccggcgaacagatcgccgagatgggccgcagcggcgccgcgcgcgacatgctgcatttcgaagtgcgctacaacgccaagccggtcgatccgttgttgtacctgccggcgaaataa

SEQ ID NO: 2107 - DNA, 798 bp, Lysobacter sp.
atgagcgagacgacccgaaccccgaccctggcgatggccgcctgcgtactggcctcgctcgtcctgatcggttgttcgagcacggtcgtccgcgaaccctcgcgcggcggttccagccgccccggcgcgcgcccgccggcctcgcgcccggcgccgcgcccgtcgacgccgaagtacggcgctaccgtcaccgtgcagcgcggcgaaggcctgtaccgcatcgccaccaaccacggcatcgcgatgagcgatctggccgcctggaacggcctgtcggcgccgtacaacctctatccgggccagcgcctgcgcctgtatccgcccggcggccgcgcgccgtccggcggttcgggttcctcctccgcttcgaccggcacgccgccgcgcacggcaccggcaccggtgcctgcggcgccggtcaacagcggcatccgctggcgctggccggccgacggcccgctgctgggtcgctacgtcgccaacgaaccgaccaagcagggcatcgacatcggcggcgccagcggcgcgccggtgcgcgcggcggccgacggcgtggtggtgtactccggcaccggcctggtcggctacggcgaactggtcatcgtcaagcacaacgaacaatggctgtcggcctacggccacaaccgcaaacgcctggtcaacgaaggccaggtggtcaagtccggcgagcagatcgccgagatgggccgcagcggcgccgcgcgcgacatgctgcacttcgaggtccgctacaacgccaagccggtcgatccgctgctgtacctgccggcgaagtga

SEQ ID NO: 2108 - DNA, 795 bp, Lysobacter sp.
atgatcaagacgacccggaccccgaccctggcgatggccgcctgcgttctggccgcgcttgccctgatcggctgttcgagcacggtggtccgcgaaccctcgcgcggtcattccagccgcggcccgtcgcgcccctcgtcgcgtccggcgccgccgcgtccgtcccggcccaagcccggcgccacggtcgtcgtgcagcgcggcgaaggcctgtaccgcatcgccaccaacaacggcatccaggtcgccgatctcgctgcctggaacggcctctcgccgccttacaccctctaccctggccagcgtttgcgcctgtacccgcccagcggtggcgctcgcccgtcggcgggcacgccgtcgagcggcggcaccagcgcgccgcggcccacgcccgcagcgccggtcgccgcgccggtcaacagcggcatccgctggcgttggccggccgacggccccttgctgagccgctacgtcgccaacgagccgaccaagcagggcgtcgatatcggcggctccagcggcgcggcggtgcgtgccgccgccgacggcgtggtggtctattccggtaccggcctggtcggttacggcgaactgatcatcgtcaagcacaacgaacaatggctgtcggcctacggccacaaccgcaaacgtctggtcaacgaaggccaggtggtcaagtccggcgaacagatcgccgagatgggccgcagcggcgccgcgcgcgacatgctgcacttcgaggtgcgctacaacgccaagccggtcgaccccttgttgtacctgccggcgaaataa

SEQ ID NO: 2109 - DNA, 792 bp, unknown
  environmental sample
atgagcgagacgacccgaaccccgaccctggcgatggccgcctgcctgctggccacgctcgccctgatcggatgttcgagcacggtcgtccgcgaaccttcccgcggcggttcgcgcggcggcggcagccggccctcgaccccggcgcagcggccctcggtggccaagcccggcgcgaccgtgatcgtgcagcgcggcgaaggcctgtaccgcatcgcggtcaacaacggcatccaactggccgatctggccgcgtggaacggcctgtcgccgccgtacagcctgtacccgggccagcgcctgaagttgtacccgcccgggcgcggcggctcgtcgtcgtcgggttcctcgtcctcgggcggctcgaccgccacgcgtccgagcgcgcccgcgccggcgccggccgcgccgatcgacagcggcatccgctggcgctggccggccgacggcccgctgctgggccgcttcgtcgccaacgaaccgaccaagcagggcgtcgacatcggcggcgcgccgggcaccccggtgcgcgcggccgccgacggcgtggtggtgtactcgggcacgggcctggtcggctacggcgagctcatcatcgtcaagcacaacgagcagtggctgtcggcgtacggccacaaccgcaagcgtctggtcaacgaaggccagctggtcaaggccggcgagcagatcgccgagatgggccgcagcggcgcggcgcgcgatcagctgcacttcgaggtgcgctacaacgccaagccggtggacccgctgttgtacttgccggcgaagtga

SEQ ID NO: 2110 - DNA, 789 bp, unknown
  environmental sample
atgagcgagacgacccgaaccccgaccctggcgatggccgcctgcctgctggccacgctggcgctgatcggatgttcgagttcggtcgtccgcgaaccttcccgcggcggttcgcgcggcggcgccagccgcccctcgaccccggcgcagcggccgtcggtggccaagcccggcgcgaccgtggtcgtgcagcgcggcgaaggcctgtaccgcatcgccaccaacaacggcatccaattggccgacctggccgcgtggaacggcctgtcgccgccgtacagcctgtatccgggccagcggctgaagctgtatccgccggggcgcggttcgtcctcgtcgggctcgtcttcttccggcggctcgagcgccacccgcccgagcgcgccggcaccggcgccggccgcgccgatcgacagcggcatccgctggcgctggccggccgacggcccgctgctgggccgcttcgtcgccaacgagccgaccaagcagggcgtcgacatcggcggcgcgccgggcacaccggtgcgcgcggccgccgacggcgtggtggtgtattcgggcaccggcctggtcggctacggcgaactcatcatcgtcaagcacaacgagcagtggctgtcggcttacggccacaaccgcaagcgcctggtcaacgaaggccagctggtcaaggccggcgagcagatcgccgagatgggccgcagcggcgcggcgcgcgaccagttgcacttcgaggtgcgctacaacgccaagccggtggatccgctgttgtatctgccggccaagtga

SEQ ID NO: 2111 - DNA, 783 bp, unknown
  environmental sample
atgagcgagaccaaccgaaccccgaccctggcgatggccgcctgcctgctggccacgctcgccctgatcggttgttcgagttcggtcgtgcgcgaaccttcccgcggcggctcgcgcggcggccgtccggcgacgccggcgcagcgcccgtcggtggccaagcccggcgcgaccgtggtcgtgcagcgcggcgaagggctgtaccggatcgccgccaacaacggcatccagatggccgacctggcggcgtggaacggcttgtcgccgccgtacaacctgtatccgggccagcgcctgaagctgtatccgccgggccgcggttcctcatcgtcctcgggttcgtcctccgccggttcgaccgcgacgcgtcccagcgcgcccgcgccggcgccggccgcgccgatcgacagcggcatccgctggcgctggccggccgacggcccgctgctgggccgctacgtcgccaacgaaccgaccaagcagggcatcgacatcggcggcgccccgggcacgccggtgcgcgcggccgccgacggcgtagtggtgtactccggcaccggcctggtcggctacggcgagctgatcatcgtcaagcacaacgaacagtggctgtcggcgtacggccacaaccgcaagcgtctggtcaacgaaggccagttggtgaagtcgggccagcagatcgccgagatgggccgcagcggcgcggcgcgcgaccagttgcacttcgaggtgcgctacaacgccaagccggtggatccgttgttgtacctgccggcgaagtga

SEQ ID NO: 2112 - DNA, 771 bp, Lysobacter sp.
atgagcgagaccaaccgaaccccgaccctggcgatggccgcctgcctgctggccacgctcgccctgatcggttgttcgagttcggtcgtgcgcgaaccttcccgcggcggccgcccggcggcgcctgcgcagcgcccgtccgtggccaagcccggcgcgaccgtggtcgtgcagcgcggcgaaggcctgtaccggatcgccgccaacaacggcatccagatggccgacctggccgcctggaacggcctgtcgccgccgtacaacctgtatccgggccagcgcctgaagctgtatccgccgggacgcggcggttcgtcgtccgcgggttcgtcctcggccggctccggcggctcgcgtcccagcgcgcccgcaccggcgccggccgcgccgatcgacagcggcatccgctggcgctggccggccgacggcccgctgctgggccgctacgtcgccaacgaaccgaccaagcagggcatcgacatcggcggcgccccgggcacgccggtgcgcgcggccgccgacggcgtggtggtgtactccggcaccggcctggtcggctacggcgagctgatcatcgtcaagcacaacgaacagtggctgtcggcgtacggccacaaccgcaagcgcctggtcaacgaaggccagttggtgaagtccggccagcagatcgccgagatgggccgcagcggcgcggcgcgcgaccagttgcacttcgaggtgcgctacaacgccaagccggtggatccgttgttgtacctgccggcgaagtaa

SEQ ID NO: 2113 - DNA, 765 bp, Lysobacter sp.
atggccgcctgcgttctggccgcgcttgccctgatcggctgttcgagcacggtggtccgcgaaccctcgcgcggtcattccagccgcggcccgtcgcgcccctcctcgcgtccggcgccgccgcgtccatccaggccgaagcccggcgcgaccatcgtcgtgcagcgcggcgaaggcttgtaccgcatcgccaccaacaacggcatccaggtcgccgacctcgccgcctggaacggcctctcgccgccttacaccctttacccgggccagcgtctgcgcctgtacccgtccagcggcggcgggactcgcccatcgccaggggcaccgtcgagcgcgggcaccagcgcgccgcgccccgtgccggcggcgccggtcgccgcaccgatcaacagcggtatccgctggcgttggccggccgacggccccttgctgagccgctacgtcgccaacgagccgaccaagcagggcgtcgacatcgccggctccagcggcgccgcggtccgcgcggctgccgacggcgtggtggtctattcgggcaccggcctggtcggctacggcgagctgatcatcgtcaagcacaacgaacagtggctgtcggcctacggccacaaccgcaagcgcctggtcaacgagggccaggtggtcaagtccggcgaacagatcgccgagatggggcgcagcggcgccgcgcgcgacatgctgcacttcgaggtgcgctacaacgccaagccggtcgatccgttgttgtacctgccggcgaagtaa

SEQ ID NO: 2114 - DNA, 1005 bp, Paenibacillus sp.
atgtataaaacaaagttccttatgatcttgctaagctttactgtaatcgcttctttctctagcttatccggcccttcacctagcaaggcttttgctgaagagaatggaactccggtgcagaaaacgatcgatttaaatgagggcttcgaccattcaaatgaagctagtatagagccattatcccttaccagcgaagaagctactagccaagcaacggttacagctattgatcatgatgctaatttctcaccttcaacacttcagtttctgaaggctaatacaggactcgacggtgagcaatgggataatattatgaagctagtgaacaaaccggagcaagattctttgaaatggactgaattctatggctatgctgaagatatcggcgataatcgcggatacacaatcggtatctttggagcaacaacaggcggttcaaatgatacaggacccgatggtccggacttattcaaagcttttgatgctgctagtggagctagtaacccttccattgcaggtggattaacacgtgctggtctgaaggggaaaatgagtggttcgattctaaaactcagcgatagcgatagtgtaatcaagaagaagatcaacgctctccaaaacaatgaagcttggagagaagccatgtggcgtacgttctatgacacctatatcgaatatagtgtacagcaagcacagaaacgcggatttaatactgctctgacgattggatcatttgtcgacacagcactcaatcaaggcgctactggtgattcaggtagtcttgaaggaatcctctcacgctcaggcagtagtacgaatgagaagaagttcatgactagcttctatgctaagcgtacattggttgtcgataccaatgattataaccaacctcccaatggtaagaatcgtgtgaaacaatggagctccctcttagcttctggcgaaacagatcttaagaacgcagatgcagctgtgatcaaagcaacgaattgggaactgaagtaa

SEQ ID NO: 2115 - DNA, 1005 bp, Paenibacillus sp.
atgtataaaataaagttccttatgatcttgctaagctttactgtagtcgcttctttctctagcttgtccggctcttcacctagcaaggcttttgctgaagagaatgggactccggtgcagaaaacgatcgatttaaatgagggcttcgacaactcaaatgaagctagtatacagccattatcccttaccagcgaagaagctactagccaagcagcggttacagctattgaccatgatgctaatttctcaccttcaacacttcagttcctgaaggctaatacaggactcgacggtgagcagtgggataatattatgaagctagtgaacaaaccagagcaagattctttgaaatggactgaattctatggctatgctgaagatatcggcgataatcgtgggtacaccattggtatctttggagcaacaacaggcggttcaaatgatacgggaccagatggcccgtacttatttaaagcttttgatgctgctagtggagctagcaacccttccattgcaggtggattaacacgtgctggtctaaaggggaagatgaatggttcgattctaaagctcagcgatagcgatagtgtaatcaagaagaagatcaacgctctccaaaacaatgaagcttggagagaagccatgtggcgtacgttctatgacacctatatcgaatatagtgtacagcaagcacataaacgcggatttaatactgctctaacgattggatcatttgtcgacacagcactcaatcaaggcgctactggtgattcaggtagtcttgaaggaatcctctcacgttcaggcagtagtacgaatgagaagaatttcatgactagcttctatgctaagcgtacattggttgtcgataccaacgattataaccaacctcccaatggtaagaatcgtgtgaaacaatggagttctctcttagcttctggcgaaacagatcttaagaacgcagatgcagccgtgatcaaagcaacgaattgggaactgaagtaa

SEQ ID NO: 2116 - DNA, 1005 bp, Paenibacillus sp.
atgtataaaataaagttccttatgatcttgctaagctttactgtagtcgcttctttctctagcttgtccggctcttcacctagcaaggcttttgctgaagagaatgggactccggtgcagaaaacgatcgatttaaatgagggcttcgacaactcaaatgaagctagtatacagccattatcccttaccagcgaagaagctactagccaagcagcggttacagctattgaccatgatgctaatttctcaccttcaacacttcagttcctgaaggctaatacaggactcgacggtgagcagtgggataatattatgaagctagtgaacaaaccagagcaagattctttgaaatggactgaattctatggctatgctgaagatatcggcgataatcgtgggtacaccattggtatctttggagcaacaacaggcggttcaaatgatacgggaccagatggcccgtacttatttaaagcttttgatgctgctagtggagctagcaacccttccattgcaggtggattaacatgtgctggtctaaaggggaagatgaatggttcgattctaaagctcagcgatagcgatagtgtaatcaagaagaagatcaacgctctccaaaacaatgaagcttggagagaagccatgtggcgtacgttctatgacacctatatcgaatatagtgtacagcaagcacataaacgcggatttaatactgctctaacgattggatcatttgtcgacacagcactcaatcaaggcgctactggtgattcaggtagtcttgaaggaatcctctcacgttcaggcagtagtacgaatgagaagaatttcatgactagcttctatgctaagcgtacattggttgtcgataccaacgattataaccaacctcccaatggtaagaatcgtgtgaaacaatggagttctctcttagcttctggcgaaacagatcttaagaacgcagatgcagccgtgatcaaagcaacgaattgggaactgaagtaa

SEQ ID NO: 2117 - DNA, 1029 bp, Paenibacillus sp.
atgtataaaataagcaataagctcatttccaataaaacaaagtttcttatgatcttgctaagctttactgtaattgcttctttctctagcttgtcgggcccacctgccaaggcttttgctgaagagaatggaactccagtacagaaaacgatcgatttaaatgaggacttcgacaactcaaatgaagctagtatagagccattatcccttaccagcgaagcagctactagccaagaagcggttacagctattgatcatgatgctaatttctcaccttcaacacttcagtttctgaaggctaatacaggactcgacggtgagcaatgggataatattatgaagctagtgaacaaaccagagcaagattctttgaaatggactgaattctatggatatgctgaagatatcggcgataatcgcggatacaccattggtatctttggagcaacaacaggcggttcaaatgatacgggacccgatggtccggacttattcaaagcttttgatgctgctagtggagctagtaacccttccattgcaggtggattaacacgtgctggcctgaaggggaaaatgagtggttcgattctaaagctcagcgatagcgatagtgttatcaagaagaagatcaacgctctccaaaacaatgaagcttggagagaagccatgtggcgtacgttctatgacacctatatcgaatatagtgtacagcaagcacagaaacgcggatttaatactgctctgacgattggttcatttgtcgacacagcactcaatcaaggcgctactggtgattcaggtagtcttgaaggaatcctctcacgttcaggcagtagtacgaatgagaagaagttcatgactagcttctatgctaagcgtacattggttgtcgataccaacgattataaccaacctcccaatggtaagaatcgtgtgaaacaatggagctctctcttagcttctggcgaaacagatcttaagaacgcagatgcagctgtgatcaaagcaacgaattgggaactgaagtaa

SEQ ID NO: 2118 - DNA, 1032 bp, Paenibacillus sp.
atgtataaaataagcaataaactcatttccaataaaacaaagttccttatgatcttgctaagcttttctgtaatcgcttctttctctagcttgtccggtccttcacctaccaaggcttttgctgaagagaatggaactccggtacagagaacgatcgatttaaatgagggctttgacaactcaaatgaagctagtatagagccattatcccttaccagcgaagaagctactagccaaggagcggttacagctattgatcatgatgctaatttctcaccttcaacacttcagtttctgaaggctaatacaggactcgacggtgagcaatgggataatattatgaagctagtaaacaaaccagagcaagattctttgaaatggactgaattctatggctatgctgaagatatgggcgataatcgcggatacaccattggtatatttggagcaacaacaggcggttcaaatgatacgggaccagatggtccggacttattcaaagcttttgatgctgctagtggagctagtaacccttccattgcaggtggattagcacgtgctggtctgaagggaaaaatgagtggttcgattctaaagctcagcgatagcgatagtgtaatcaagaagaagatcaacgctctccaaaacaatgaagcttggagagaagccatgtggcgtacgttctatgacacctatatcgagtatagtgtacagcaagcacagaaacgcggatttaatactgctctgacgattggatcatttgtcgacacagcactcaatcaaggcgctactggtgattcaggtagtcttgaaggaatcctctcacgttcaggcagtagtacgaatgagaagaagttcatgactagcttctatgctaagcgtacattggttgtcgataccaacgattataaccaacctcccaatggtaagaatcgtgtgaaacaatggagttctctcttagcttctggcgaaacagatcttaagaacgcagatgcagctgtgatcaaagcaactaattgggaactgaagtaa

SEQ ID NO: 2119 - DNA, 1029 bp, Paenibacillus sp.
atgtataagacaagtgataaactcgtttcaaataaaacaaagttctttatgatcttgctaagctttactgtaatcgcttcattctcaagcttgtccggcccttcacctgccaaggcttttgctgaagagaacggaactacagtacaggaaacggttgatttaaatgagggtgacaattcaaatgaagcaagtacagagtcattatcccttactaatgaagaagctactagccaggcagcggttacagctactgatcatgatgctaatttctcaccttcaacacttcagtttctaaaggctaatacaggactcgacggtgagcaatgggataatattatgaagctagtgaacaaaccagagcaagattctttgaaatggactgaattctatggctatgctgaagatataggcgataatcgcggatacacaattggtatctttggcgcaacgacaggcggttcaaatgatacgggacctgatggtccggacttattcaaagcttttgatgctgctagtggagctagcagcccttccattgcaggtggattaacacgtgctggtctgaaggggaaaatgagtggttcgattctaaaactcagcgatagcgatagtgtaatcaagaagaagatcaaggctctccaaaacaatgaggcttggagagaagccatgtggcgtacgttctatgatacctatatcaaatatagtgtacagcaagcacagaaacgcggatttaataccgctctgacgattggatcatttgtcgacacagcactcaaccaaggcgctactggtgattcaggtagtcttgaaggaatcctctcacgttcaggcagtagtacgaatgagaagacattcatgactaacttctatgctaagcgtacattgattgtcgataccaacgattataaccagcctcctaatggtaagaatcgtgtgaaacaatggagttctctcttagcttctggggaaacagatcttaagaacgcagatgcagccgtcattaaagtaactaattgggaaatgaagtaa

SEQ ID NO: 2120 - DNA, 993 bp, Paenibacillus sp.
atcagcagtaaactcatttcccataaaacgaagttttttatgatattgctaagcttttctgtaatcgcttcattctctagcttgtacggtcccttacccgccaaggctcttgctgaagaaaacggaactccagtacaagaaacaaatgaatcaaatatacagcaaatccccctcaccagcgaggagactactagccaaacagcggttacagctattgatcatgatgctaatttctcaccttcaacacttcagtttctgaaggataatacaggactcgacggtgagcaatgggataatattatgaagctagtgaacaagccagagcaggattctttgaaatggactgaattctatggctatgccgaagatattggcgatgatcgtggatataccattggtatttttggagcaacaacaggcggttccaatgatacgggaccagacggtccggccttattcaaagcttttgatgctactagtggagctagcaatccttccattgcaggtggattagcccgtgctggactgaaggggaaaatgagtggctcgattttaaaactcagcgatagcgatagtgtaatcaaaaagaagatcaaggctctccaaaataatgaagcttggagagaagccatgtggcgtacgttctatgacacctatatcgaatatagtgtgcagcaagcccggaagcgcggatttaatactgctctgacgattggatcatttgtcgacactgcactcaatcaaggtgctacgggtgatgacggtagtcttgaaggagtcctctcacgatctggcaatagcacgaatgaaaagacattcatgactaacttctatgctaagcgtacattggttgtcgataccaacgattataaccaacctcctaatggtaagaatcgggtgaaacaatggagttctcttttagcttctggcgaaacagatcttaagaacgcagatgcagccataatcaaagtaactaattgggaaatgaagtaa

SEQ ID NO: 2121 - DNA, 1002 bp, Paenibacillus sp.
atgtttaaaatcaggagtaaactcatttcccataaaacgaagttttttatgatattgctaagcttttctgtaatcgcttcattctctagcttgtacggccccttacccgccaaggctcttgctgaagaaaacggaactccagtacaagaaacaaatgaatcaaatatacagcaaatccccctcaccagcgaggagactactagccaaacagcggttacagctattgatcatgatgctaatttctcaccttcaacacttcagtttctgaaggataatacaggactcgacggtgagcaatgggataatattatgaagctagtgaacaagccagagcaggattctttgaaatggactgaattctatggctatgccgaagatattggcgatgatcgtggatataccattggtatttttggagcaacaacaggcggttccaatgatacgggaccagacggtccggccttattcaaagcttttgatgctgctagtggagctagcaatccttccattgcaggtggattagcccgtgctggactgaaggggaaaatgagtggctcgattttaaaactcagcgatagcgatagtgtaatcaaaaagaagatcaaagctctccaaaataatgaagcttggagagaagccatgtggcgtacgttctatgacacctatatcgaatatagtgtgcagcaagcccggaagcgcggatttaatactgctctgacgattggatcatttgtcgacactgcactcaatcaaggtgctacgggtgatgacggtagtcttgaaggagtcctctcacgatctggcaatagcacgaatgaaaagacattcatgactaacttctatgctaagcgtacattggttgtcgataccaacgattataaccaacctcctaatggtaagaatcgggtgaaacaatggagttctcttttagcttctggcgaaacagatcttaagaacgcagatgcagccataatcaaagtaactaattgggaaatgaagtaa

SEQ ID NO: 2122 - DNA, 1002 bp, Paenibacillus sp.
atgtttaaaatcagcagtaaactcatttcccataaaacgaagttttttatgatattgctaagcttttctgtaatcgcttcattctctagcttgtacggccccttacccgccaaggctcttgctgaagaaaacggaactccagtacaagaaacaaatgaatcaaatatacagcaaatccccctcaccagcgaggagactactagccaaacagcggttacagctattgatcatgatgctaatttctcaccttcaacacttcagtttctgaaggataatacaggactcgacggtgagcaatgggataatattatgaagctagtgaacaagccagagcaggattctttgaaatggactgaattctatggctatgccgaagatattggcgatgatcgtggatataccattggtatttttggagcaacaacaggcggttccaatgatacgggaccagacggtccggccttattcaaagcttttgatgctgctagtggagctagcaatccttccattgcaggtggattagcccgtgctggactgaaggggaaaatgagtggctcgattttaaaactcagcgatagcgatagtgtaatcaaaaagaagatcaaagctctccaaaataatgaagcttggagagaagccatgtggcgtacgttctatgacacctatatcgaatatagtgtgcagcaagcccggaagcgcggatttaatactgctctgacgattggatcatttgtcgacactgcactcaatcaaggtgctacgggtgatgacggtagtcttgaaggagtcctctcacgatctggcaatagcacgaatgaaaagacattcatgactaacttctatgctaagcgtacattggttgtcgataccaacgattataaccaacctcctaatggtaagaatcgggtgaaacaatggagttctcttttagcttctggcgaaacagatcttaagaacgcagatgtagccataatcaaagtaactaattgggaaatgaagtaa

SEQ ID NO: 2123 - DNA, 993 bp, Paenibacillus sp.
atcagcaataaacttatttcccataaaacgaagttttttatgatattgttaagcttttctgtaatcgcctcattctctagcttgtgcggcccctcgcctgccaaggctcttgctgaagaaaacggaactccattacaggaaacaaccgaaacacatatacagcaaatccccaccaccagcgaggatactactagccaaacagcggttacaactattgatcatgatgctaatttctcaccttcaacacttcagtttctgaaggacaatacaggactcgacggtgagcagtgggataatattatgaagctagtgaacaagccagagcaggattctttaaaatggactgaattctatggctatgctgaagatatcggcgatgatcgtggatacaccattggtattttcggagcaacaacaggcggttccaatgacacgggaccagatggccccgccttattcaaagcttttgatgctgctagtggagctagcaatccttctattacaggtggactagcacgtgctggactgaagggtaaaatgagtggttcgattctaaagctcagcgatagcgatagtgtaatcaaaaagaagatcaaggctctccaaaacaatgaagcttggagagaagccacgtggcgtacgttctacgacacctatatcgaatatagtgtacagcaagctaagaaacgcggatttaatactgctctgacgattggatcatttgtcgacacagctctgaatcaaggtgctacgggtgattacggtagtcttgaaggaatcctctcacgttctggcaatagtacgaatgaaaagacgctcatgaccaacttctatgctaagcgcacattagttgtcgataccaacgattataaccaacctcctaatggtaagaatcgggtgaaacaatggagtgctctcttagcttctggtgaaaccgatcttaaggacgcagatgcagctataatcaaagtaactaattgggaaatgcagtga

SEQ ID NO: 2124 - DNA, 1002 bp, Paenibacillus sp.
atgtttaaaatcagcaataaacttatttcccataaaacgaagttttttatgatattgttaagcttttctgtaatcgcctcattctctagcttgtgcggcccctcgcctgccaaggctcttgctgaagaaaacggaactccattacaggaaacaaccgaaacacatatacagcaaatccccaccaccagcgaggatactactagccaaacagcggttacaactattgatcatgatgctaatttctcaccttcaacacttcagtttctgaaggacaatacaggactcgacggtgagcagtgggataatattatgaagctagtgaacaagccagagcaggattctttaaaatggactgaattctatggctatgctgaagatatcggcgatgatcgtggatacaccattggtattttcggagcaacaacaggcggttccaatgacacgggaccagatggccccgccttattcaaagcttttgatgctgctagtggagctagcaatccttctattacaggtggactagcacgtgctggactgaagggtaaaatgagtggttcgattctaaagctcagcgatagcgatagtgtaatcaaaaagaagatcaaggctctccaaaacaatgaagcttggagagaagccacgtggcgtacgttctacgacacctatatcgaatatagtgtacagcaagctaagaaacgcggatttaatactgctctgacgattggatcatttgtcgacacagctctgaatcaaggtgctacgggtgattacggtagtcttgaaggaatcctctcacgttctggcaatagtacgaatgaaaagacgctcatgaccaacttctatgctaagcgcacattagttgtcgataccaacgattataaccaacctcctaatggtaagaatcgggtgaaacaatggagtgctctcttagcttctggtgaaaccgatcttaaggacgcagatgcagctataatcaaagtaactaattgggaaatgcagtga

SEQ ID NO: 2125 - DNA, 1032 bp, Paenibacillus sp.
atgtataagacaagtaataaacccgctaatcatagagtgaagttcttgatgattttactttcctttaccgtggtagcttcattctccagcttctctggccctattcaaacaaaagcttatgctgatgaggatattgctcctatagaagaaaatatagattcgagtgaaatatataacgatgcgaatgaagcaaatattcaatcgttttctgtaacagatgagaattctttgagtagcgtagctgctgcagctatcgatcatgatgccaatttttcagcttcaaccttgcaattcctaaagactaatacaaaactcgatggtgagcaatgggataatattatgaagctcgtgaacaaacctgagcaggattctttaaaatggactgatttctatggctatgcagaagatattggagataaccgtggatacaccattggtatctttggagcaacgacaggcggttcgaatgatacggggcctgatggtccagacttatttaaagcttttgatgctgctagtggtgctagcagcccttccattgcaggtggattaacacgtgcgggtctgaagggtaaaatgagcggttcgattctcaagctcagtgatagcgatagtgttatcaagaagaagatcaaagctcttcaaaacaatgaagcttggagagaagcgatgtggcgtacattctatgacacgtacattaaatatagtgtacagcaagcacagaaacgcggattcactacggctctaaccattggatcatttgtcgacacagcactgaatcaaggggctactggtgattctggtagtctggaaggagttctgtcccgttctggaagcagcaccaatgagaagacttttatgacgaatttctatgctaaacgtactttgatcgtagacaccaatgactacaaccaagctccaaatggtaaaaaccgagtaaaacaatggagttcgctattggccgctggcgaaacggatctcaagaatgcagatgcggcagtgattaaagcgaccaactgggaacttaaataa

SEQ ID NO: 2126 - DNA, 1032 bp, Paenibacillus sp.
atgtataagacaagtactaaacccgctacaaatagagtaaagttttttgttatcatgctttgttttatcgttattgcttcattttctgctatgtccagccctattcaaacgaaggcttttgctgatgagaatattgctcctacggaggaatatatcgatccaagtgagttatatgatgattcaaatgaggtaaacacagattcattatctacgatagacgaagatgtgttcagccaagaagccataacagccattgatcatgacgctaatttctctccagtgacgctccagttcctgaagaccaatacgggtcttaatggcgaacagtggaataacattatgaagctcatcaacaaaccagagcaagattccctcgattggacaaagtactatggatatgctgaggatattgatgatgatcgcggatataccatcggtatatttggggctactacaggcggttctaacgacactggccctgatggcccagcattattcaaagaatttgatgctgccagtggagctagcaacccatcgatccaaggtggattgacacgtgccggtattaaaggaacgatgaatggtaagattttgaaaattaccgatagcaacagtgtttttgtcaaaaaaatcaatgcactccaaaataatgcagtatggagagaagcgatgtggcgcactttctataacgtatatatcaaatacagtgtgcaacaagcgaaaaatcgcggattcaattcggctctgactatcggatctttcgtcgatgcagcgctaaatcatggagcatctggtgattctaatagtctcgaaggcatactctcccggtctggaaacagcaccaacgaaaaaaccttcatgaccaatttctatgccaaacgtaccttgatcgtagacaccaatgaatacaatcagccgcccaatggcaaaaaccgtgtgaagcagtggagttctctcctgaactcgggtgagacggatctgaagaatgcagatgctgcagttgttaaagccaccaaatggaccatgcaataa

SEQ ID NO: 2127 - DNA, 669 bp, Paenibacillus sp.
ttgaaacatctaaaacatattggtaaaacgatgaaatttgcggtgcttgccgcagctattgcagggctgacacagacagctggagtagcggatgctgcttcgcttcacactgccaaagagggcgataccttctttttgcttgctcaacgttatggggtatcggtagacgagctaacgaaggcgaacccaaacattgcctccaacaatatatatgcaggtctgcaaattaaggtgcctggcgaaaaaagagtgaaggcagcttcggattcgaagccgcagcttcttacggagaaagcaccagcgaatgaggggccaacgattgaagcgtggggcaaaacattcaactatagcaaaatagttgatgttaaggcttcagcgtattctgccgcagccgacgagaatggtaaatggggggcagtggactactacggcaatccgcttaaactaggtacaattgcggtagacccgaacgtcattccgatgggcacgaaagtgctggttacaggctattcccacccaggtttgccggatcattcttttgtagctgtcgctcgcgatcagggcagcgccattacaggaaagcggattgatatctttattcctggcaacaaatcatttgtgaacgactttggattccaaaatgtgaagctgtacgttattgataaatag

SEQ ID NO: 2128 - DNA, 669 bp, Paenibacillus sp.
ttgaaacatctaaaacatattggtaaaacgatgaaatttgcggtgcttgccgcagctattgcagggctggcacagacagctggagtagcggatgctgcttcgcttcacactgccaaagagggcgataccttctttttgcttgctcaacgttatggagtatcggtagacgggctaacgaaggcgaacccaaacattgcctccaacaatatatatgcaggtctgcaaattaaggtgcctggcgaaaaaagtgtgaaggcagcttcggattcgaagccgcagcttcttacggagaaagcaccagcgaatgaggggccaacgattgaagcgtggggcaaaacattcaactatagcaaaatagttgacgttaaggcttcagcgtattctgccgcagccgacgagaatggtaaatggggagcagtggactactacggcaatccgcttaaactaggtacgattgcggtagacccgaacgtcattccgatgggcacgaaagtgctggttacaggctattcccacccaggtttgccggatcattcttttgtagctgtcgctcgcgatcagggcagcgccattacaggaaagcggattgatatttttatttctggcaacaaatcatttgtgaacgactttggatttcaaaatgtgaagctgtacgttattgataaatag

SEQ ID NO: 2129 - DNA, 669 bp, Paenibacillus sp.
ttgaaacatctaaaacatattggaaaaaccatgaaatttgcggtgcttgccgcagccattgcagggctggcacagacagctggagtagcggatgctgcttcgcttcatactgccaaagatggcgataccttctttttgcttgctcaacgttatggagtatcagtggacgagctgacgaaggcgaacccaaacattgcctctaacaatatatatgcaggtctgcaaattaaggtacctggtgaaaaaagtgtgaatgcagcttcggattcgaagcctcagcttcttacggagaaagcaccagcgaatgaggggccaacgattgaagcgtggggcaaaacatttaactatagcaaaatagttgacgttaaggctactgcgtattctgccgcagccgatgagaatggtaaatggggagcagtggactactacggcaatccgcttaaactaggtacaattgcggtagacccgaacgtcattccgatgggcacgaaagtgctggttacaggctattcccacccaggtttgccggatcattcttttgtagctgtcgctcgcgatcagggcagcgccattacaggaaaacggattgatatctttattcctggcaacaaatcatttgtgaacgactttggatttcaaaatgtgaagctatacgttattgataaatag

SEQ ID NO: 2130 - DNA, 669 bp, Paenibacillus sp.
ttgaaacatttaaaacatattggtaaaacgatgaaaattgcggtgcttgccgcagctattgcagggttggcacagacagctggaatagcggatgctgcctcgcttcacactgccaaagagggcgataccttctttttgcttgctcaacgttatggagtatcggtagacgagctaacaaaggctaacccaaacattgcctccagcaatatatatgcaggtctgcaaattaaggtgcctggcgaaaaaagtgtaaaggcagcttcggaatcgaagccgcagcttcttacggagaaagcagcagcgaatgaggcgccaacgattgaagcttggggtaaaacattcaactatagcaaaatagttgacgttaaggcttcagcgtattctgccgcagccgatgagaatggtaaatggggcgcagtggactactacggcaatccgcttaaactaggtacaattgcggtagatcctaacgtcattccgatgggcacgaaagtactggttacaggctactcccatccaggtttgccggatcattcttttgtagctgtcgctcgcgatcagggcagcgccattacaggaaagcggattgatatctttattccaggcaacaaatcatttgtgaacgactttggatttcaaaatgtgaagctgtacgttattgataaatag

SEQ ID NO: 2131 - DNA, 669 bp, Paenibacillus sp.
ttgaaacacttaaaacatattggaaaaaccatgaaatttgcggtgcttgccgcagcgattgcaggattggcacagacagctggagtagcaaatgctgcttcgcttcatactgccaaagaaggcgatactttctttttgcttgctcaacgttatggggtatcggtagatgacttgacgaaggctaacccggatattgcgtccaacaacatatatgcaggtctacaaattaaagtgccagacgaaaaaagtgtgaaggcggcttcggattcgaaaccacagcttcttacggagaaagcaccagcgaatgagaggccaacaattgaagcatggggcaaaacattcaattacagtaaagttgttgatgttaaagcaacagcatattcagccgcagctgatgaaaatggcaaatggggtgcagtcgattactacggtaatccgcttaaactgggtacaattgcagtagacccgaaagtcattcctatgggaacaaaggtgctagttacaggctattcccatcccggcttgccagaccattcttttgtagccgttgcccgtgatcagggcagcgctattaccggaaagcggattgatatctttatccctggcaacaaatcattcgtgaacgacttcggcttccaaaatgtgaaactgtacgttattgataaatag

SEQ ID NO: 2132 - DNA, 669 bp, Paenibacillus sp.
ttgaaacacttaaaacatattggaaaaaccatgaaatttgcggtgcttgccgcagcgattgcaggattggcacagacagctggagtagcaaatgctgcttcgcttcatactgccaaagaaggcgatactttctttttgcttgctcaacgttatggggtatcggtagatgacttgacgaaggctaacccggatattgcgtccaacaacatatatgcaggtctacaaattaaagtgccagacgaaaaaagtgtgaaggcggcttcggattcgaaaccacagcttcttacggagaaagcaccagcgaatgagaggccaacaattgaagcatggggcaaaacattcaattacagtaaagttgttgatgttaaagcaacagcatattcagccgcagctgatgaaaatggcaaatggggtgcagtcgattactacggtaatccgcttaaactgggtacaattgcagtagacccgaaattcattcctatgggaacaaaggtgctagttacaggctattcccatcccggcttgccagaccattcttttgtagccgttgcccgtgatcagggcagcgctattaccggaaagcggattgatatctttatccctggcaacaaatcattcgtgaacgacttcggcttccaaaatgtgaaactgtacgttattgataaatag

SEQ ID NO: 2133 - DNA, 669 bp, Paenibacillus sp.
ttgaaacgcttaaaacatattggaaaaaccatgaaatttgcggtgcttgccgcagcgattgcaggattggcacagacagctgaagtagcaaatgctgcttcgcttcatactgccaaagaaggcgatactttctttttgcttgctcaacgttatggggtatcggtagatgacttgacgaaggctaacccggatattgcgtccaacaacatatatgcaggtctacaaattaaagtgccagacgaaaaaagtgtgaaggcggcttcggattcgaaaccacagcttcttacggagaaagcaccagcgaatgagaggccaacaattgaagcatggggcaaaacattcaattacagtaaagttgttgatgttaaagcaacagcatattcagccgcagctgatgaaaatggcaaatggggtgcagtcgattactacggtaatccgcttaaactgggtacaattgcagtagacccgaaagtcattcctatgggaacaaaggtgctagttacaggctattcccatcccggcttgccagaccattcttttgtagccgttgcccgtgatcagggcagcgctattaccggaaagcggattgatatctttatccctggcaacaaatcattcgtgaacgacttcggcttccaaaatgtgaaactgtacgttattgataaatag

SEQ ID NO: 2134 - DNA, 669 bp, Paenibacillus sp.
ttgaaacaactgaaacatattggacaagccatgaaatttgcggtgcttgctgctgctattgcaggactggcacaaacagccggggtagcagatgccgcttcgcttcatactgccaaagagggcgataccttctttttgcttgctcaacgttatggagtatcggtagacgagctaacgaaggcgaacccgaatattgcccctagcaacatatatgcagggttgcaaattaaggtgcctggagaaacaagtgtgaaggctgcttcagattcggagccacagcttcttaaggagacagcacctgcgaatgaggggcaaacgattgaagcatggggcaaaacatttaattacagtaaagtagttgacgttaaagctacagcgtattctgccgcagctgatgaaaatggtaagtggggggcggtagactactatggcaatccgcttaagctaggtacgattgcggtagacccgaatgtaattccgatgggaacgaaggtgttggttacagggtattctcaccccggcctgccggaccattcatttgtggccgttgcccgcgatcagggaagtgccattacaggcaagcgaattgatatctttattcctggcaacaaatcatttgtgaacgactttggctttcaaaatgtgaaattatacgttattgataaatga

SEQ ID NO: 2135 - DNA, 669 bp, Paenibacillus sp.
ttgaaacatctgaaacgtattggacaaaccatgaaatttgcggtgcttgccgcagctattgcaggactggcacaaacagccggagtagcgaatgccgcttcgctacatactgccaaagaaggcgataccttcttcttgcttgctcaacgttatggagtatcggtagacgagctgacgaaggcaaacccgaatattgccccgagcaacatatacgcaggtctgcaaattaaggtgcctggcgaaacaagtgtgaaggctgcttcggattcgaagccacagcttcttaaggagacaggaccggcaaatgggggtccaacgattgaagcatggggcaaaacattcaattacagtaaagtagttgatgttaaagctacagcgtattctgccgcagctgatgaaaatggcaagtggggcgcggtagactactacggcaatccgcttaagctaggtacgattgcggtagacccgaacgtaattccgatgggaacgaaggtgctggttacagggtattcccaccccggcctgccagaccattcttttgtggccgtcgcccgcgatcagggtagtgccattacaggcaagcgaattgatatctttattcctggcagcaaattatttgtgaacgactttggctttcaaaatgtgaaattatacgttattgataaataa

SEQ ID NO: 2136 - DNA, 669 bp, Paenibacillus sp.
ttgaaacatctgaaacgtattggacaaaccatgaaatttgcggtgcttgccgcagctattgcagggctggcacaaacagccggagtagcgaatgccgcttcgctacatgctgccaaagagggcgataccttcttcttgcttgctcaacgttatggagtatcggtagacgaactgacgaaggcaaacccgaatattgccccgggcaacatatatgcaggtctgcaaattaaggtgcctggcgacacaggtgtgaaggctgcttcggattcgaagccacagcttcttaaggagacagcaccagcaaatgagggtccaacgattaaagcatggggcaaaacattcaattacagtaaagtagttgatgttaaagctacagcgtattctgccgcaggtgatgaaaatggcaaatggggcgcggtagactactacggcaatccgcttaagctaggtacgattgcggtagacccgaacgtaattccgatgggaacgaaggtactagttacagggtattcccaccctggcctgccagaccattcttttgtggccgtcgcccgcgatcaaggcagtgccattacaggcaagcgaattgatatctttattcctggcagcaaatcatttgtgaacgattttggctttcaaaatgtgaaattatacgttattgctaaataa

SEQ ID NO: 2137 - DNA, 669 bp, Paenibacillus sp.
ttgaaacatctgaaacgtattggaaaaacaatgaaatttgcggtgctggcagcagccattgcaggattggcgcagacagccggggtagccgacgccgcttcgcttcataccgccaaggaaggtgataccttctttttacttgctcaacgttacggggtatctgtagaagatctgaaaaaggagaacccggatgttgccgccagcaatatatatgcaggagtgcaaattaaggtgccggacgagaacaagttaaaggccgcttcggattcgaagcctcagcttctttccgagaaagcgccagcaggtgacggtcaacaggttgaagcatggggcaaaacatttaactacagcaaagtagttgacgtgaaggccacagcgtattccgcagcagccagtgaaaatggaaaatggggagcggtggactatttcggaaatccgcttaagctcggtacgattgcggtagaccccaacgtaattccgttgggtacgaaagtgttggttacaggctattcccacccggggctgccggatcaatcttttgtagcggtagcacgcgataagggcagcgccatcacgggtaaacggattgatattttcattccaggcagcccatcttttgtgagtgactttggttttcagaatgtgaagctgtatgtcattgataaatag

SEQ ID NO: 2138 - DNA, 669 bp, Paenibacillus sp.
ttgaaacatctgaaacgtattggaaaaacaatgaaatttgcggtgctggcaacagccattgcaggattggcgcagacagccggggtagccgacgccgcttcgcttcataccgccaaggaaggtgataccttctttttacttgctcaacgttacggggtatctgtagaagatctgcaaaaagagaacccggatgttgctgccagcaatatatatgcaggagtgcaaattaaggtgccggacgataacaaggtaaaggctgcttcggattcgaaacctcagcttctttccgagaaagcgccagcaggtgacggtcaacaggttgaagcatggggcaaaacatttaaatacagcaaagtagttgatgtgaaggccacggcgtattccgcagccgccagtgaaaatggaaaatggggagcggtggattattttggaaatccgcttaagctcggtacgattgcggtagacccaaacgtaattccgttgggtacgaaagtgttggttacaggctattcccacccggggctgccggatcaatcttttgtagcggtagcacgcgataagggcagcgccattacgggtaaacggattgatattttcattccaggcagcccatcttttgtgagtgactttggttttcagaatgtgaagctgtacgtcattgataaatag

SEQ ID NO: 2139 - DNA, 669 bp, Paenibacillus sp.
ttgaaacatctgaaacatattggaaaaacaatgaaattcgcggtgctggccgcagctttcgcaggattggcacagacagcaggggtagctgacgccgcttcgcttcataccgccagggaaggtgataccttctttttgcttgctcagcgttacggggtatctgtagaggatctgcaaaaggagaacccggatgttgctgccagcaatatatatgcaggagtacaaattaaggttccggatgagaacaaggtaaaggtcgcttcggattcgaagcctcagcttttgtccgagaaagagccagcaggtgacggtcaacaggttgaagcatggggcaaaacatttagctacagcaaagtagttgacgtgaaggccacagcgtattccgcagcagccagtgaaaatggaaaatggggagcggtggactatttcggaaatccgcttaagctcggtacgattgccgtagacccaagcgtaattcctttaggtacgaaagtactggttacaggctattcccatccagggctgccggatcaatcttttgtagcggtagcacgcgataagggcagcgccattacgggtaaacggattgatattttcattccgggtagcccatcttttgtgagtgactttggttttcaaaatgtgaagctgtacgtcattgataaatag

SEQ ID NO: 2140 - DNA, 849 bp, Curtobacterium sp.
atggaccagcacatcgatcgacggcgcttcatgacgctcggactcgccggagccgcgacgacggccctcggcgcgacggcgatcggcgcggacgggtcggcgcaggcagcgaccacgtcggctgccgcccctgtgctgctcgccgccgacgagttcgacggcccggccggcagcgcgccgaacccggggatctggcggtacgacctgggtgccggcggctggggcaacgccgagctgcagacctacacggactcgcggcggaacgcggcgctcgacggtgccggcaacctcgtgatcaccgcacaccgcgaggccgacggctcgtactcgtcggcccgactgaagtccgagagcacctacaccgcgcagtacggccgcatcgaggcgcggatccggatcccccgcggtcagggcatctggccggcgttctggatgctcggcgccgacatcgggcaggtcgggtggccggcgtgcggggagatcgacgtcatggagaacgtcgggtacgagccggggatcgtgcacggcacggtgcacgggcccgggtactccggcgctcagggcatctcggcggcgtacacggctccgtccggagcagcgttcgccgacgacttccacgtgtacggggtcgactggcgccccggctcgatcacctggacggtcgacggtgtcgcgtaccggacggtcacgcgggccgacgtcggctcggccccgtgggtgttcgacaagccgttcttcgtgatcctcaacgtcgcggtcggcgggaactggccgggttcaccggacgcctcgacgcggttcccgcagcagatgacgatcgactggctgcgggtccaccagaacgcttag

SEQ ID NO: 2141 - DNA, 849 bp, Curtobacterium sp.
atggaccagcacatcgatcgacggcgcttcatgacgctcggactcgccggagccgcgacgacggccctcggcgcgacggcgatcggcgcggacgggtcggcgcaggcagcgaccccttcggctgccgccccggtgctgctcgccgccgacgagttcgacggcccggccggcagcgcgccgaacccggggatctggcggtacgacctgggtgccggcgggtggggcaacgccgagctgcagacctacacggactcgcggcggaacgcggcgctcgacggggccggcaacctcgtgatcaccgcacaccgcgaggccgacggttcgtactcgtcggcccggctgaagtccgagagcacctacaccgcgcagtacggccgtatcgaggcgcggatccggatcccccgcggtcagggcatctggccggcgttctggatgctcggcgcggacatcgggcaggtcgggtggccggcgtgcggggagatcgacgtcatggagaacgtcgggtacgagccggggatcgtgcacggcacggtgcacgggcccgggtactccggggcgcagggcatctcggcggcgtacacgggtccgtccggagcagccttcgccgacgacttccacgtgtacggggtcgactggcgccccggctcgatcacctggacggtcgacggtgtcgcgtaccggacggtcacccggtccgacgtcggctcggccccgtgggtgttcgacaagccgttcttcgtgatcctcaacgtcgcggtcggcgggaactggccggggtcgccggacgcctcgacgcggttcccgcagcagatgacgatcgactggctgcgggttcaccagaacgcctag

SEQ ID NO: 2142 - DNA, 858 bp, Curtobacterium sp.
ttggaccagcacatcgatcgacggcgcttcgtgtcgctcggactcgcaggcgctgccgccaccgcgctcggcgtcacggcgatcggcgcggacgggtcggcgcaggcggcgaccggggctgcggccccgactgccgaacccgtcctgctcgccgccgacgagttcgacggcccggccggcagtgcaccgaacccggcggtctggcggtacgacctgggtgccggcggctggggaaacgccgaactggagacctacacggactcgcggcggaacgcggcgctcgacggcgcgggcaacctcgtcatcaccgcacagcgcgaagccgacggctcgtacacctcggcccggctgaagtccgaaggcgcctccaccgcgcagttcggccgcatcgaggcgcggatccggatccctcgggggcagggcatctggccggcgttctggatgctcggcgccgacatcgggcaggtcggctggcccgcgtgcggggagatcgacgtcatggagaacgtcgggtacgagccggggatcgtgcacggcacggtgcacgggcccgggtactccggtgcccagggcatctcggcgtcgtacacggctccgtccggcgcagcgttcgccgacgacttccacgtgtacggggtcgactggcgccccggttcgatcacctggacggtcgacggtgtcgcgtaccggaccctcacccgggccgacgtgggatcgaacccgtgggtcttcgacaagccgttcttcgtcatcctcaacgtcgcggtcggcggcacgtggcccgggtcgcccgacgactcgacgcagttcccgcagcagatgaccgtcgactggctgcgggtccaccagaacgcctag

SEQ ID NO: 2143 - DNA, 852 bp, Curtobacterium sp.
atggatcagggaccagccttcgaccgacgtcgcttcgtgacgctcggtctcaccggtgccgccgcgaccgcggccgccgccacctccgccctcctgccgggcacggccaccgcacgggccgcgaccgccgccggcacgctcctcgctgccgacgagttcgacggcgccgccggaagcgctccgaaccccgggatctggcgcttcgacctcggcgccggcgggtggggcaacggcgaactcgagacgtacacggactcccgccggaactcgcagctcgacggcacgggcaacctggtcatcaccgcccggcgcgaggccgacggcacctacacgtccgcccgcctgaagtccgaggggacctacacggcgcagtacggccgcgtcgaggcgcgcatcaagatcccccggggccagggcatctggccggcgttctggatgctcggcgccgacatcggacaggtcggctggccggcgtgcggcgagatcgacgtcatggagaacgtcggctacgaacccgcgctcgtgcacggcaccgtgcacggacccgggtactcgggtgcgaacggcatctccgcgacgtaccgcaacccgtccggggccgccttcgccgacgacttccacgtcttcggcgtcgactggcgtcccgactcgatcacctggaccgtcgacggcaccgcctaccgcacggtgacccgtgcggacgtcgggtcgaacccctgggtgttcgacggtccgttcttcgtcatcctcaacgtggcggtcggcggcggctggcccgggtcgccggacgcgaccacgcggttcccacagcagatgctcgtcgactgggtgcgcgtctcccagctcgactga

SEQ ID NO: 2144 - DNA, 879 bp, unknown
  environmental sample
atgctgcacgaccacacgccgaccgacgccgcccacaccgtcgaccgacgccgcttcctggcgctcgggctgggcagcgccgcagccacgacggccgccgtcggagcggcactgacgccggacgaccacgccgcggcggccaccacgacgtcgtccggaggggtgctcctcgccgccgacgagttcgacggcgccgccggcagcgccccgaacccggggatctggcggttcgacacgggcgccggcgggtgggggaacgccgagctgcagacctacaccgactcgcgacggaacagcgcgctggacggcgcgggcaacctcgtcatcaccgcacgacgcgaggccgacggcacgtacacctccgcgcggctgaagaccgagggcaccttcaccgcgcagtacggccggatcgaggcacgcatccggatcccgcgcgggcaggggatctggcccgcgttctggatgctcggcgcggacatcgggcaggtcggatggccggcctgcggcgagatcgacgtgatggagaacgtcgggtacgagcccggtgtcgtgcacggcaccgtgcacggacccggctactccggagcgcaggggatgtcggccgctgcgacgctgccgaacggtgcggcctgggcggacgcgtaccacgtcttcggggtcgactggcgccccggatcggtcacgtggctcgtcgacggcgtcgcgcagcgcacggtcacccgggccgacgtggggtcgtcgccgtgggtcttcgacaagccgttcttcgtgctgctcaacgtcgccgtgggcggcacctggcccgggtcgccggacgcgaccacccggttcccgcagcagatgttcgtcgactgggtgcgggtctggcagcaggcctga

SEQ ID NO: 2145 - DNA, 897 bp, unknown
  environmental sample
atgacgaacgcccccactcctgaccaccgcacccgccccgtcctccgcgacgcggacggcctcgaccgtcgccgcttcctgacgctcggcctgaccggtgcggctgtcgcgtccacgaccgccggagccgtgctcgccaccggcgccggcgcgcaggccgcgaccccgtccaacggcgcggtgctgctcgctgccgacgagttcgacggtgccgccggcagcgcgccgaaccccggcatctggcgcttcgacaccggtgccggtggctggggcaacgccgagctgcagacctacacggactcccgccggaacagcgccctcgacggcgccggcaacctcgtcatcaccgcccgccgcgaggccgacggctcgtacacctcggcccgtctgacgaccgagggcaccttcaccgcgcagtacggccgcgtcgaggcacggatccgcatcccccgcgggcagggcctgtggccggcgttctggatgctcggcgccgacatcgggcaggtcggctggcccgcgtgcggcgagatcgacgtcatggagaacgtcgggtacgagccggccgtggtgcacggcaccgtgcacgggccggggtactcgggcgcacagggcctgaccgcgtcgtacacgcagccgggcggcgcggcgttcgccgacgacttccacgtcttcggcgtcgactggcgccccggctcgatcacctggaccgtcgacggggtcgctcgccggaccgtcacccgtgccgatgtcggcacgtccccgtgggtcttcgacaagccgttcttcgtcgtgctgaacgtcgccgtcggcggcacctggcccggctcaccggacgcgaccacccggttcccgcagcagatgctcgtcgactgggtgcgcgtctggcagcaggcctga

SEQ ID NO: 2146 - DNA, 876 bp, unknown
  environmental sample
gtgcagcacgacgaccagcagcagaccgaccacccggacgacggggccgtcgggatcgatcgtcgtcgcctgctgacgctcggactcggcgccgcggctgccctcggagcagcgggcgtggcgggcctccgtcccgaggcggcacacgcggcgaccggccccacgctcctggcggccgacgagttcgacggcccggccggcagcgccccgaaccccgacatctggcggtacgagctgggcggtggtggttggggcaacggtgagctcgaggtctacacggactcgcggcggaactcggccctcgacggcgacgggaacctcgtcatcaccgcgcggcgcgaagccgacgggtcgtacacgtcggcgcggctcacctcgcagggcacctactccgcccagtacggctggatcgaggcccgcatccggatcccgcgcgggcaggggatctggccggccttctggatgctcggcgccgacctgccgcaggtcgggtggccggcatgcggcgagatcgacgtgatggagaacatcggccgtgagcccgccgccgtgcacggcaccgtccacggccccgggtactcgggcgcggagggcgtcagcgggactgcgaccctgccgagcggtgccttcgccgacgacttccacgtgtacggggtggactggcggccggggtcgatcagctggacggtcgacggtgcgacctaccggaccgtcacgccggccgacctgggcggcgaccggtgggtgttcgacaagccgttcttcgtggtcctgaacgtggcggtcggtgggggatggccgggctccccggactcgtcgacgcagttcccccagcagatgaccgtggactggctgcgggtctggcagaacgcctga

SEQ ID NO: 2147 - DNA, 1974 bp, unknown
  environmental sample
atgaaaccccttcacgcgcaataccttttctgctgtgccaccctgagcctgctgtcgccgctgcctgcgatggcctggagcgacctcaccgtctttggcgatagcctgagtgatggcgggaacgtcgggcgctttacctatgatggcgcgacccatccgctctatgacgagatcgtagcgcagtcgctgggtgataacctgcgcccttcatcgcagggcggaaacaactatgccgaaggtggcgcagttgcggtgcctgcgattaatcccctgtttaacactcaggatcagcttgataactaccttgcggcgcggggcggacgggctgatccggacggtctctatattcactggattggtggcaatgatttagcggcggcggctcttgcccctctcgctgcccggcagatagtggataacagcgccagtgcagcggcctcacaggtcagccggttgctggatgccggagcaggaacggtgattgttccgacggtacccaatgtaggggcaacgcccgccctgctgcaggcgattctgcaggtgcttggcccggcggcacaacctgctacggcggcgctgtttcagtcgctgagcaccactactacgcctgaccgtgccgcaagagagcaggcgattgaaaccgcgcttggcgaggcggccggacaaatctcttcaatcccgctgatccgggatgccattgcgcagcagctgattgccgcctggaagttactgagtcaggaggcggcgacactcaccgaccgttacaaccaggctgaagagcaagggctggtggccgcgcgcgggaacatcgcgcgggtggatatcaatggcctgtttaatgaggtgatcgataatccgggcctgtatggactcacgaatacggccggaatggcctgtccgccaggtgtctcggcgatggactgcacctcatcgacgacaggattttcgcagtcacagcagtatctgtttgcagacagactgcatcccagcccggcggtccatgcgctgatcgccgattacattcagtcggtgctgaatgcgccgctgcaggtggctgcgctgagtcgggcgccgtcgatgctggtgggcgatgcgcacaatacgctggatggacatctgcagcagcagcgtcagcagcccgctaacgccggggagtttacggtcttcggcggttatgccggacagcagcgtgatttccgcggtgacagcctgcaggatggcgatgcgaccagcgccagcggcaccgtgggtgtgggctatcagctgaccgatcactggcaggccggtgccatgctctctacgacctcgcaacgtcaggatccctcgtcgcgctttgattaccgtttacgcggcaatctggtggcgctctggagtcagttgaattatctcgatcggggatggattaatgcggatgcccattatgcggatctcgactttgatgatattgagcgtcagatcaggctgggaccggcgacccgcacggaaaagggcaacagcaacggtaaggtgctggggatgcggctgcagaccggctgggatttgccgctgggtagttatgtttctaccggcccggtggccagctatgcgctcgactacacccaggtcgatggctataaagaggagggcaacagcagcacctcaatgcgctttggtgaccagacgctgcactctcaaatcggtgcagtgggctggcgtatcgacagcaaagatttactgatcaatccctgggcgcaggtcagttacaaccatcagtttggcgacagcgattcggctgtcaccgccggactgaaatcgacccgcaccgcctttacccgcagcagcgatgccagtgatgataactggatcgatatggctgtgggtgcgagcgtgccgcttggcacctcggtgaatgcctttgcgggcgtctcggcggtcacaggcaacagcgacatgcatcaggtgacatggaacgtcgggcttaacgcccgcttttaa

SEQ ID NO: 2148 - DNA, 1974 bp, unknown
  environmental sample
atgaaaccccttcacgcgcaataccttttctgctgtgccaccctgagcctgctgtcgccgctccctgcgatggcctggagcgacctcaccgtctttggcgatagcctgagtgatggcgggaacgtcgggcgctttacctatgatggcgcgacccatccgctctatgacgagatcgtagcgcagtcgctgggtgataacctgcgcccttcatcgcagggcggaagcaactatgccgaaggtggcgcagttgcggtacctgcaattaatcccctgtttaacactcaggatcagcttgataactaccttgcggcgcgaggcggacgagctgattcggacggtctctatattcactggattggcggcaatgatttagcggcggcggctcttgcccccctcgctgcccggcagatagtggataacagcgccagtgcagcggcctcacaggtcagccggttgctggatgccggagcaggaacggtgattgttccgacggtacccaatgtaggagcaacgcccgccctgctgcaggcgattctgcaggtgcctggtccagcggcacaacctgccacggcggcgctgtttcagtcgctgagcaccaccactacgcctgaccgtgccgcaagagagcaggcgattgaaaccgcgcttggcgaggcggccggacaaatctcttcaatcccgctgatccgggatgccattgcgcagcagctgattgccgcctgggagttactgagtcaggaggcggcggcactcaccgaccgttacaaccaggctgaagagcaggggctggtggccgcgcgcgggaacatcgcgcgggtggatatcaatggcctgtttaatgaggtgatcgctaatccgggcctgtatggactcacgaatacggccggaatggcctgtccgccaggtgtctcggcgatggactgcacctcatcgacgacaggattttcgcagtcacagcagtatctgtttgcagacagactgcatcccagcccggcggtccatgcgctgatcgccgattacattcagtcggtgctgaatgcgccgctgcaggtggctgcgctgagtcgggcgccgtcgatgctggtgggcgatgcgcacaatacgctggatggacatctgcagcagcagcgtcagcagcccgctaacgccggggagtttacggtcttcggcggttatgccggacagcagcgtgatttccgcggtgacagcctgcaggatggtgatgccaccagtgccagcggcaccgtgggtgtgggctatcagctgaccgatcactggcaggccggtgccatgctctctacgacctcgcaacgtcaggatccctcgtcgcgctttgattaccgtttacgcggcaatctggtggcgctctggagtcagttgaattatctcgatcggggatggattaatgcggatgcccattatgcggatctcgactttgatgatattgagcgtcagatcaggttgggaccggcgacccgcacggaaaagggcaacagcaacggtaaggtgctggggatgcggctgcagaccggctgggatttgccgctgggtagctatgtttctactggcccggtggccagctatgcgctcgactacacccaggtcgatggctataaagaggagggcaacagcagcacctcaatgcgctttggtgaccagacgctgcactctcaaatcggtgcagtgggctggcgtatcgacagcaaagatttactgatcaatccctgggcgcaggtcagttacaaccaccagtttggtgacagcgattcggcggtcaccgccggactgaaatcgacccgcactgcctttacccgcagcagcgatgccagtgatgataactggatcgatatggctgtgggtgcgagcgtgccgcttggcacctcggtgaatgcctttgcgggcgtctcggcggtcacaggcaacagcgacatgcatcaggtgacatggaacgtcgggcttaacgcccgcttttaa

SEQ ID NO: 2149 - DNA, 1974 bp, unknown
  environmental sample
atgaaaccccttcacgcgcaataccttttctgctgtgccacgcttagcctgctgtcgccgctgcctgcgatggcctggagcgacctcaccgtctttggcgatagcctgagtgatggcgggaacgtcgggcgctttacctatgatggcgcgacccatccgctctatgacgagatcgtagcgcagtcgctgggtgataacctgcgcccttcatcgcagggcggaaacaactatgccgaaggtggcgcagttgcggtgcctgcgattaatcccctgtttaacactcaggatcagcttgataactaccttgcggcgcggggcggacgggctgatccggacggtctctatattcactggattggtggcaatgatttagcggcggcggctcttgcccctctcgctgcccggcagatagtggataacagcgccagtgcagcggcctcacaggtcagccggttgctggatgccggagcaggaacggtgattgttccgacggtacccaatgtaggggcaacgcccgccctgctgcaggcgattctgcaggttcttggtccagcggcacaacctgctacggcggcgctgtttcagtcgctgagcaccaccactacgcctgaccgtgccgcaagagagcaggcgattgaaaccgcgcttggcgaggcggccggacaaatctcttcaatcccgctgatccgggatgccattgcgcagcagctgattgccgcctggaagttactgagtcaggaggcggcgacactcaccgaccgttacaaccaggctgaagaacaggggctggtggccgcgcgcgggaacatcgcgcgggtggatatcaatggcctgtttaatgaggtgatcgctaatccgggcctgtatggactcacgaatacggccggaatggcctgtccgccaggcgtctcggcgatggactgcacctcctcgacgacaggattttcacagtcacagcagtatctgtttgcagacagactgcatcccagcccggcggtccatgcgctgatcgccgattacattcagtcggtgctgaatgcgccgctgcaggtggctgcgctgagtcgggcgccgtcgatgctggtgggcgatgcgcacaatacgctggatggacatctgcagcagcagcgtcagcagcccgctaacgccggggagtttacggtcttcggcggttatgccggacagcagcgtgatttccgcggtgacagcctgcaggatggtgatgccaccagcgccagcggcaccgtgggtgtgggctatcagctgaccgatcactggcaggccggtgccatgctctctacgacctcgcaacgtcaggatccctcgtcgcgctttgattaccgtttacgcggcaatctggtggcgctctggagtcagttgaattatctcgatcggggatggattaatgcggatgcccattatgcggatctcgactttgatgatattgagcgtcagatcaggctgggaccggcgacccgcacggaaaagggcaacagcaacggtaaggtgctggggatgcggctgcagaccggctgggatttgccgctgggtagttatgtttctaccggcccggtggccagctatgcgctcgactacacccaggtcgatggctataaagaggagggcaacagcagcacctcaatgcgctttggtgaccagacgctgcactctcaaatcggcgcagtgggctggcgtatcgacagcaaagatttgctgatcaatccctgggcgcaggtcagctacaaccaccagtttggtgacagcgattcggctgtcaccgccggactgaaatcgacccgcaccgcctttaaccgcagcagcgatgccagtgatgataactggatcgatatggcggtgggtgcgagcgtgccgcttggcacctcggtgaatgcctttgcgggcgtctcggcggtcacaggcaacagcgacaggcatcaggtgacatggaacgtcgggcttaacgcccgcttttaa

SEQ ID NO: 2150 - DNA, 1974 bp, Pantoea sp.
atgaaaccccttcacgcgcaataccttttctgctgtgccaccctgagcctgctgtcgccgctccctgcgatggcctggagcgacctcaccgtctttggcgatagcctgagtgatggcgggaacgtcgggcgttttacctatgatggcgcgacccatccgctctatgacgagatcgtagcgcagtcgctgggtgataacctgcgcccttcatcgcagggcggaaacaactatgccgaaggtggcgcagttgcggtacctgcgattaatcccctgtttaacactcaggatcagcttgatagctaccttgcggcgcgaggcggacgggctgattcggatggtctctatattcactggattggcggcaatgatttagcggcggcggctcttgcccccctcgctgcccggcagatagtggataacagcgccagtgcagcggcctcacaggtcagccggttgctggatgccggagccggaacggtgattgttccgacggtgcctaatgtaggtgcaacgcccgccctgctgcaggcgattctgcaggtgcttggtccagcggcacaacctgccacggcggcgctgtttcagtcgctgagcaccaccactacgcctgaccgtgccgcaagagagcaggcgattgaaaccgcgcttggcgaggcggccggacaaatctcttcaatcccgctgatccgggatgccattgcgcagcagctgattgccgcctggcagttactgagtcaggaggcggcgacactcaccgaccgttacaaccaggctgaagagcaggggctggtgaccgcacgcgggaacatcgcgcgggtggatatcaatggcctgtttaatgaggtaatcgataatccgggcttgtatggactcacgaatacggccggaatggcctgtccacccggtgtctcggcgatggactgcacctcctcgacgacaggattttcgcagtcacagcagtatctgtttgcagacagactgcatcccagcccggcggtccatgcgctgatcgccgattacattcagtcggtgctgaatgcgccgctgcaggtagctgcgctgagtcgggcgccgtcgatgctggtgggcgatgcgcataatacgctggatggacatctgcagcagcagcgtcagcagtccgctaacgccggggaatttacggttttcggcggttatgccgggcagcagcgtgatttccgcggcgacagcctgcaggatggcgatgcgaccagcgccagtggtaccgtgggtgtgggctatcagctgaccgatcactggcaggccggtgccatgctctctacgacctcgcaacgtcaggatccctcgtcgcgctttgattaccgtttacgcggcaatctggtggcgctctggagtcagttgaattatctcgatcggggatggattaatgcggacgcccattatgcggatctcgactttgatgatattgagcgtcagatcaggctgggaccggcgacccgcacggaaaagggcaacagcaacggtaaggtgctgggaatgcggctgcagaccggctgggatttgccgctgggtagctatgtttctactggcccggtggccagctatgcgctcgactacacccaggtcgatggctataaagaggagggcaacagcagcacctcaatgcgctttggcgaccagacgctgcactctcaaatcggcgcagtgggctggcgtatcgacagcaaagatttgctgatcaatccctgggcgcaggtcagctacaaccaccagtttggtgacagcgattcggcggtcaccgccggactgaaatcgacccgcaccgcctttacccgcagcagcgattccagtgatgataactggatcgatatggcggtgggtgcgagcgtgccgcttggcacctcggtgaatgcctttgcgggcgtctcggcggtaacaggcaacagcgacatgcatcaggtgacatggaacgtcgggcttaacgcccgcttttaa

SEQ ID NO: 2151 - DNA, 1974 bp, unknown
  environmental sample
atgaaaccccttcacgcgcaataccttttctgctgtgccaccctgagcctgctgtcgccgctgccagcgatggcctggagcgaccttaccgtctttggcgatagcctgagtgatggcgggaacgtcgggcgctttacctatgatggcgcgactcatccgctctatgacgagatcgtagcgcagtcgctgggtgataacctgcgcccttcatcgcagggcggaagcaactatgccgaaggtggcgcagttgcggtacctgcgattaatcccctgtttaacactcaggatcagcttgatagctaccttgcggcgcgaggcggacgagctgattcggacggtctctatattcactggattggcggcaatgatttagcggcggcggctcttgcccctctcgctgcccggcagatagtggataacagcgccagtgcagcggcctcacaggtcagccggttgctggatgccggagccggaacggtgattgtaccgacggtacctaatgtaggggcaacgcccgccctgctgcaggcgattctgcaggtgcctggtccagcggcacaacctgccacggcggcgctgtttcagtcgctgagcaccaccactacgcctgaccgtgccgcaagagagcaggcgattgaaaccgcgcttggcgaggcggccggacaaatctcttcaattccgctgatccgggatgccattgcacagcagctgattgccgcctggcagttactgagtcaggaggcggcggccctcaccgaccgttacaaccaggctgaagagcaggggctggtgaccgcacgcgggaacatcgcacgagtggatatcaatggcctgtttaatgaggtgatcgataatccgggcctgtatggactcacgaatacggccggaatggcctgtccgccaggtgtctcggcgatggactgcacctcctcgacgacaggattttcgcagtcacagcagtatctgtttgcagacagactgcatcccagcccggcggtccatgcgctgatcgccgattacattcagtcggtgctgaatgcgccgctgcaggtagctgcactgagtcaggcgccgtcgatgctggtgggcgatgcgcgcaatacgctggatggacatctgcagcagcagcgtcagcagcccgccagtgctggcgagtttactgttttcggcggttatgccgggcagcagcgtgatttccgcggcgacagcctgcaggatggcgatgcgaccagcgccagcggcaccgtgggtgtgggctatcagctgaccgatcactggcaggccggtgccatgctctctacgacctcgcaacgtcaggatccctcgtcgcgctttgattaccgtttacgcggcaatctggtggcactctggagtcagttgaattatctcgatcggggatggattaatgcggacgcccattatgccgatctcgactttgatgatattgagcgtcagatcaggctgggaccggcgacccgcacggaaaagggcaacagcaatggtaaggtgctgggaatgcggctgcagaccggctgggatttgccgctgggtagctatgtttctactggcccggtggccagctatgcgctcgactacacccaggtcgatggctataaagaggaaggcaacagcagcacctcaatgcgctttggcgaccagacgctgcactctcaaatcggcgcagtgggctggcgtatcgacagcaaagatttgctgatcaatccctgggcgcaggtcagctacaatcaccagtttggtgacagcgattcggcggtgaccgccggactgaaatcgacccgcaccgcctttacccgcagcagcgattccagtgatgataactggatcgatatggcggtgggtgcgagcgtgccgcttggcacctcggtgaatgcctttgcgggcgtctcggcggtaacaggcaacagcgacatgcatcaggtgacatggaacgtcgggcttaacgcccgcttttaa

SEQ ID NO: 2152 - DNA, 1974 bp, unknown
  environmental sample
atgaaaccccttcacgcgcaataccttttctgctgtgccaccctgagcctgctgtcgccgctgccagcgatggcctggagcgaccttaccatctttggcgatagcctgagtgatggcgggaacgtcgggcgctttacctatgatggcgcgacccatccgctctatgacgagatcgtagcgcagtcgctgggtgataacctgcgcccttcatcgcagggcggaagcaactatgccgaaggtggcgcagttgcggtacctgcgattaatcccctgtttaacactcaggatcagcttgatagctaccttgcggcgcgaggcgggcgggctgattcggatggtctctatattcactggattggcggcaatgatttagcggcggcggctcttgcccctctcgctgcccggcagatagtggataacagcgccagtgcagcggcctcacaggtcagccggttgctggatgccggagccggaacggtgattgtaccgacggtacctaatgtaggggcaacgcccgccctgctgcaggcgattctgcaggtgcttggcccagcggcacaacctgccacggcggcgctgtttcagtcgctgagcaccaccactacgcctgaccgtgccgcaagagagcaggcgattgaaaccgcgcttggcgaggcggccggacaaatctcttcaattccgctgatccgggatgccattgcacagcagctgattgccgcctggcagttactgagtcaggaggcggcgacactcaccgaccgttacaaccaggctgaagagcaggggctggtgaccgcacgcgggaacatcgcgcgagtggatatcaatggcctgtttaatgaagtgatcgataatccgggcctgtatggactcacgaatacggccggaatggcctgtccgccaggtgtctcggcgatggactgcacctcctcgacgacaggattttcgcagtcacagcagtatctgtttgcagacagactgcatcccagcccggcggtccatgcgctgatcgccgattacattcagtcggtgctgaatgcgccgctgcaggtggctgcgctgagtcgggcgccgtcgatgctggtgggcgatgcgcacaatacgctggatggacatctgcagcagcagcgtcagcagtccgccagtgctggcgagtttactgttttcggcggttatgccgggcagcagcgtgatttccgcggcgacagcctgcaggatggcgatgcgaccagcgccagcggtaccgtgggtgtgggctatcagctgaccgatcactggcaggccggtgccatgctctctacgacctcgcaacgtcaggatccctcgtcgcgctttgattaccgtttacgcggcaatctggtggcactctggagtcagttgaattatctcgatcggggatggattaatgcggacgcccattatgcggatctcgactttgatgatattgagcgtcagatcaggctgggaccggcgacccgcacggaaaagggcaacagcaatggtaaggtgctgggaatgcggctgcagaccggctgggatttgccgctgggtagctatgtttctactggcccggtggccagctatgcgctcgactacacccaggtcgatggctataaagaggagggcaacagcagcacctcaatgcgctttggcgaccagacgctgcactctcaaatcggcgcagtgggctggcgtatcgacagcaaagatttgctgatcaatccctgggcgcaggtcagctacaatcaccagtttggtgacagcgattcggcggtgaccgccggactgaaatcgacacgcaccgcctttacccgcagcagcgattccagtgatgataactggatcgatatggcggtgggtgcgagcgtgccgcttggcacctcggtgaatgcctttgcgggcgtctcggcggtaacaggcaacagcaacatgcatcaggtgacatggaacgtcgggcttaacgcccgcttttaa

SEQ ID NO: 2153 - DNA, 1974 bp, Pantoea sp.
atgaaaccccttcacgcgcaataccttttctgctgtgcgaccctgagcctgttgtccccgttacctgctgcggcatggagcgatctcaccgtgtttggcgatagcctgagtgatggcggcaacgtaggccgctttacctacgatggcgcgactcatccgctttatgacgagattctggcgcagtcgctgggcgataccctgcgtccctcatccctgggtggtaacaactatgccgagggtggcgcggttgcagtgccggcgatcaatccgctgtttaatacccaggatcaacttgatagctatcttgcggcgcgtgggggacgggctgacccgaacggtctctacattcactggattggtggtaatgatctggcggcagcagccctggcgccgctggctgcacagcagattgtggataacagtgccagtgcagcggcctcacaggtcagccggttgctgaatgccggggccggaacggtgattgtgccgacggtgccgaatgtgggagcaacgcctgctttgttgcaggcgatattgcaggtacttggcccggctgcgcaacccgcgacggcggcgctgtttcagtcgctgagcaccaccaccacgcctgaccgggccgcaagagagcaggcgattgaaaccgcgctaaacgaggcggcaggacaggtctcttcgattccacttatccgggatgctcttgcgcaacagctgattgctgcctggcaattactgagtcaggaggctgcgacactgaccgatcgttacaatcaggctgaagagcagggtctgctgacagcacgcgggaacatcgcgcgggtggatatcaatggcctgtttaatgaggtgattgataatccgcgtctgtatggactcagcaatacggcgggcatggcttgcccgccaggtgtctcatcaatggactgcacctcctcgacgcctggattttctcagtcacagcaatatctgttcgccgaccggctgcatcccagcccggcagtgcatgcgctgatcgccgattatattaagtcggtgctgaatgcgccgctgcaggtggcggcgctagctcaggcaccgtcgatgctggtgggcgatgcgcataacacgctcgacggtcatctgcagcagcagcgtcagcagcccgccagcgctggcgagtttactgtgttcggcggttatgccgggcaacagcgagattttcgcggtgacagcctgcttgatggcgatgccaccagcgccactggcaccgtaggtgtgggctatcagctgaccgatcactggcaggccggcgcgatgctttccgccacctcgcaacgccaggatccttcgtcgcgctttgattaccgtttacgcggcaatctggtggcgctctggagtcagttcaattatctcgatggcggatggattaatgcggatgcccattatgccgatctcaactttgatgatattgagcgtcagatcaggctgggacccgcgacacgtactgaaaagggcagcagtgatggcaaagtgctgggaatgcgggtacagaccggctgggatttgccgctgggtcgctatgtctccaccggcccgatggcaagctatgcgctggattacacccaggtcgatgggtataaagaagaggggaacagcagtacttctatgcgctttggcgaccagacactgcattcccaaatcggctccgtcggctggcgtatcgacagtaaggatttgttaatcaatccctgggcgcaggtcagctataaccaccagtttggtgataccgactctgccgtcaccgccggactgaaatcgacacgcaccgcctttacccgcaacagcggctcgcgtgacgataactggatcgatatggcggtcggggcgagtgtgccgattggcgcatcggtcaatgcctttgcgggcgtctcagcagtggcaggcaacagcgacacgcatcaggtgacatggaacgtcggacttaacgcccgcttttaa

SEQ ID NO: 2154 - DNA, 1974 bp, Pantoea sp.
atgaaaccccttcacgcgcaataccttttctgctgtgccaccctgagcctgctgtcgccgctgcctgcaatggcatggagtgaccttaacgtctttggtgacagtctgagcgatggcggaaacgtaggacgttttacctatgatggtgcgacccatccgctctatgacgagatcctggcgcagtcgctgggtgacattctgcgcccctcatcccagggcggtaacaactatgccgagggcggtgccgtcgcagtgcccgcgatcaatccgttatttaatacccaggatcagcttgatcgttaccttgcggcgcgcgacggacgcgccgatccggacggactctatattcactggattggcggcaatgacttagcggcggcagcccttgcgccgctcgctgcgcagcagatcgtggataacagtgccagtgccgcggcctcacaggtcagccggttgctggatgccggggccggcacggtgattgtgccgacggtgccgaatgtcggggcgacgcccgcgctgcttcaggcgattctgcaggtgctgggtccggccgcgcagcctgccacggcggcgctgtttcagtcgctgagcgccaccaccacgccagatcgtgccgccagagaacaggcgattgaaaccgcgcttaacgaggccgctggtcaggtctcttcgattccgctgatccgcgatgcccttgctcaacagctgattgccgcctggcagttgctgagtcaggaggcggcggcgctcaccgatcgttacaaccaggcggaggaacagggcctggtggcggcacgcggtaacatcgcgcgggtggatatgaatggcctgtttaatgaggtgattgataacccgcgcctgtatggactcagcaacacggcgggcatggcctgtccgcccggcgtctcatccatggactgcacctcctcgacgccaggattttcgcagtcacagcaatatctgttcgccgaccggctgcatcccagcccggcagtgcatgcgctgatcgccgattatattcagtcagtactgaatgcgccgctgcaggtggccgcgctgagtcaggcagcgtcgatgctggtgggcgatgtgcagaatacgctcgatggccatctgcaacagcagcgccagcaacccgccagcgccggagagtttacggttttcggcggctatgccggacagcagcgagatttccgcagcgacagcctgctggatggcgatgccaccagcgccaccggcaccgtgggtgtgggctatcagctgaccgatcactggcaggccggcgccatgctctccaccacctcgcaacgacaggatccctcgtcgcgctttgattaccgtttacgcggcaacctggtggcgctgtggagccagttaaattatctggatcggggatggattaatgcagatgcccattacgccgatcttaactttgatgatattgagcgtaaggtcagactgggaccggcgacccgcacggagaagggcagcagcgacggcaaggtgctgggaatgcgggtgcagaccggctgggatctaccgctgggccgctatgtctccaccggcccgatggccagctatgcgcttgactacacccaggttgatggatacagagaagagggtaacagcagtacctcgatgcgctttggcgaccagacactgcattcgcaaatcggctcggtgggctggcgtatcgacagcaaagatttagtgatcaatccctgggcgcaggtcagttacaaccatcagttcggcgacagcgactctgctgttaccgccggactgaaatcgacccgcaccgcctttacccgcagcagcgggtcacgggatgatagctggatcaatatggctctgggcgcaagcgtgcccattggcacatcggtgaacgcgtttgccggcgtttcagcggtgacaggtaacagcgactatcaccaggtgacatggaacgtcgggcttaacgcccgtttttaa

SEQ ID NO: 2155 - DNA, 1974 bp, unknown
  environmental sample
atgaaaccccttcacgcgcaataccttttctgttgtgccaccctgagcctcctgtcgccgctgcctgcgatggcatggagtgaccttaccgtatttggtgacagcctgagtgatggcggcaacgtaggacgctttacttatgatggtgcgacccatccgctctatgacgagatcgtagcgcagtcgctgggtgacactctgcgcccctcatcccagggcggaagcaactatgccgaaggtggcgccgttgcggtaccggcgataaatcccatgtttaatacgcaggatcagctggataattaccttgcgacgcgcgacggacgagccgattctgacggactctatattcactggattggcggcaatgacttagcggcggcagcccttgcgccgctcgctgcacagcagatcgtggataacagtgccagtgccgcggcctcacaggtcagtcgtttgctggatgccggggccggcacggtcatcgttccgacggtgccaaacgtcggagcgacgcccgcgctgcttcaggcgattctgcaggtgctggggccggccgcccagcctgccacggcggcgctgtttcagtcgctgagtaccaccgccacgcctgaccgcgccgccagagagcaggcaattgaaaccgcgcttaacgaagcagctggtcaggtcacttctattccgctgatccgcgatgcgcttgcacaacagctgtttgccgcctggcagttgctgagtcaggaggcggcagccctcaccgaccgttacaaccaggctgaagagcaggggctggtggcggcacgcggcaatatcgcgcgggtggatatcaatggcctgtttaatgaggtgatcgataacccgcgcctgtatggactcagcaacacggcaggcatggcctgtccgcccggcgtctcatcaatggactgcaccgcctcaacgccaggattttcacaatcgcaacagtatctgtttgccgaccggttgcatcccagcccggcagtgcatgcgctgatcgccgattatattgagtcggtgctgagtgcgccgctgcaggtggccgtgctgagtcaggcaccatcgatgctggtgggggatgcgcagaatacgctggatggacatctgcaacagcagcgtcagcagcccgccagcgccggagagtttacggttttcggtggctatgccggacagcagcgagatttccgcggcgacagcctgctggacggtgatgcaacaagcgctaccggcaccgtaggagtgggctatcagctgtccgatcactggcaggccggtgcgatgctctccactacctcgcaacgacaggatccctcgcagcggtttgattatcgtttacgcggcaatctggtggcgctgtggagccaagtaaattatctggatcggggatggattaatgcagatgcccattatgccgatctgaactttgatgatattgagcgtaaggtcaggctgggaccggcgacccgtacggagaagggcagcagcgacggcaaagtgctggggatgcgggtgcagaccggctgggacttaccgctgggccgctatgtctccaccggcccgatggccagctatgcgctcgactacacccagattgatggctacagagaagaagggaacagcagtacctcgatgcgctttggcgaccagacactgcattctcaaatcgggtcagttggctggcgtatcgacagtaaagatttagtgattaatccctgggcgcaggtcagttacaaccatcagttcggcgacagcgactctgctgttaccgccggactgaaatcgacccgcactgcctttacccgcagcagtggctcacgggatgataactggatcaatatggctctgggcgcaagcgtgcccattggcacatcggtgaacgcatttgccggcgtttcagcggtgacaggtaacagcgactatcaccaggtgacatggaacgtcggacttaacgcccgtttttaa

SEQ ID NO: 2156 - DNA, 1974 bp, unknown
  environmental sample
atgaaaccccttcacgcgcaataccttttctgttgtgccaccctgagcctcctgtcgccgctgcctgcgatggcatggagtgaccttaccgtatttggtgacagcctgagtgatggcggcaacgtaggacgctttacttatgatggtgcgacccatccgctctatgacgagatcgtagcgcagtcgctgggtgacactctgcgcccctcatcccagggcggaagcaactatgccgaaggtggcgccgttgcggtaccggcgataaatcccatgtttaatacgcaggatcagctggataattaccttgcgacgcgcgacggacgagccgattctgacggactctatattcactggattggcggcaatgacttagcggcggcagcccttgcgccgctcgctgcacagcagatcgtggataacagtgccagtgccgcggcctcacaggtcagtcgtttgctggatgccggggccggcacggtcatcgttccgacggtgccaaacgtcggagcgacgcccgcgctgcttcaggcgattctgcaggtgctggggccggccgcccagcctgccacggcggcgctgtttcagtcgctgagtaccaccgccacgcctgaccgcgccgccagagagcaggcaattgaaaccgcgcttaacgaagcagctggtcaggtcacttctattccgctgatccgcgatgcgcttgcacaacagctgtttgccgcctggcagttgctgagtcaggaggcggcagccctcaccgaccgttacaaccaggctgaagagcaggggctggtggcggcacgcggcaatatcgcgcgggtggatatcaatggcctgtttaatgaggtgatcgataacccgcgcctgtatggactcagcaacacggcaggcatggcctgtccgcccggcgtctcatcaatggactgcaccgcctcaacgccaggattttcacaatcgcaacagtatctgtttgccgaccggttgcatcccagcccggcagtgcatgcgctgatcgccgattatattgagtcggtgctgagtgcgccgctgcaggtggccgtgctgagtcaggcaccatcgatgctggtgggggatgcgcagaatacgctggatggacatctgcaacagcagcgtcagcagcccgccagcgccggagagtttacggttttcggtggctatgccggacagcagcgagatttccgcggcgacagcctgctggacggtgatgcaacaagcgctaccggcaccgtaggagtgggctatcagctgtccgatagctggcaggccggtgcgatgctctccactacctcgcaacgacaggatccctcgtcgcgctttgattatcgtttacgcggcaatctggtggcgctgtggagccaattaaattatctggatcggggatggattaatgcagatgcccattatgccgatctgaactttgatgatattgagcgtaaggtcaggctgggaccggcgacccgtacggagaagggcagcagcgacggcaaagtgctggggatgcgggtgcagaccggctgggacttaccgctgggccgctatgtctccaccggcccgatggccagctatgcgctcgactacacccagattgatggctacagagaagaagggaacagcagtacctcgatgcgctttggcgaccagacactgcattctcaaatcgggtcagttggctggcgtatcgacagtaaagatttagtgattaatccctgggcgcaggtcagttacaaccatcagttcggcgacagcgactctgctgttaccgccggactgaaatcgacccgcactgcctttacccgcagcagtggctcacgggatgataactggatcaatatggctctgggcgcaagcgtgcccattggcacatcggtgaacgcatttgctggcgtttcatcggtgacaggtaacagcgatcatcaccaggtgacatggaacgtcggacttaacgcccgtttttaa

SEQ ID NO: 2157 - DNA, 1974 bp, unknown
  environmental sample
atgaaaccccttcacgcgcaaacccttttctgctgtgcgatcctgagtctgctgtcaccgttgcccgccgcggcatggagccacctcaccgtctttggcgacagcctgagcgatggggggaacgtagggcgctttacctatgatggcgcaacccacccgctgtatgacgagatcgtcgcgcagtcgctgggcgataccttacgtccttcatcacagggcggaaacaactatgccgagggcggcgccgtcgcggtaccggtgatcaatcccctgtttaatacccaggatcagctgcaaagttatctgacatcccgcggcgggcgggctgatcccgatggcctctatatccactggatcggcggcaatgacttagcggcggcggcgctctcccccctgactgcccggccgctggtcgataacagcgccggtgcggcggccttacaggttagccggttgctggatgccggcgccggaacggtgattgtgccgacggtgcccaacgtgggggccacccccgcgctgttgcaggcgattctgcagacgctcggacccgccgcgcaaccggccacggcggcgttgtttcagtcgctgagcacccgcaccacgccagaccgggccgcgcgcgagcaggcgattgaaacggctctgggtgaggcggcggggcagctttctgcgattccgccgatccgtgaggcgctcgcgcagcagctgatcgctgcctggcggttgctgagtgaggccgcctcagcgctgaccgaccgttacaatcaggccgaagaggaggggctgctggcggcccgcggcaacatcgcacgggtagatatcaatggcctgtttaatgaggtgatcgataatccgggccgttatggactcaccaacaccgccggcatggcctgcccgcccggcgtgtcgtcaatggactgcaccacttccacgccgggattttcatcctcgcagcagtatctgtttgccgaccggctgcatcccagcccggccgtccatgcgctgatcgccgattacattcagtcagtgctgaacgcaccgctgcaggtggcggcgctgagccgtgccccctcaatgctggtgggcgatgcgcagaatacgctggatgggcatctgcagcagcagcgtcagcagcccgcagaggcgggcacgttaaccgtttttggcggttacgccgggcagcagcgggattttcgtggcgacagtctgctggatggggatgccaccagcgccaccggcacagtgggtgtaggctatcagctgaccgatgcgtggcaggccggcgcgatgctctccaccacctcgcagcgccagcagccctcgtcgcgcttcgattaccgcctgcgcggtaatctggtggcgatctggagccagctgaactacctcgaccacggctggataaacgcggacgcccactatgccgacctggatttcgacgatattaaacgccaggtgaaactggggcctgcgacccgtaccgaacagggtaacagtggcgggaaagtgctcgggatgcgggtgcagaccggctgggatcttcccgttggccgttacgtcacgaccgggccggtggcgagctatgcgctcgactacacgcgggtcggcggctatcaggaagagggcaacagcagcacctctatgcgctttggcgaccagacgctgcacgcccaggtcggctccctgggctggcgtatcgacagcaaagatttgccggtcaatccctgggcgcagatcagttacaaccatcagtttggtgacagtgattctgcggtaacggccggactgaaatcgacccgcaccgcctttacccgcagcagtgatggcagggatgacaactggatcaacatggccgtgggagccagcgtgccgctgggtgccgcagtgaatgcctttgcgggcgtttcggccgtggcgggtaacagtgagacgcatcaggtgacgtggaacgtgggagtgaatgcccgtttttaa

SEQ ID NO: 2158 - DNA, 1974 bp, Pantoea sp.
atgaaaccccttcacgcgcaaacccttttctgctgtgcgatcctgagtctgctgtcaccgttgcccgccgcggcatggagccacctcaccgtctttggcgacagcctgagcgatggggggaacgtagggcgctttacctatgatggcgcaacccacccgctctatgacgagatcgtcgcgcagtcgctgggcgataccttacgtccttcatcgcagggcggaaacaactatgccgagggcggcgccgtcgcggtaccggcgatcaatcccctgtttaatacccaggatcagctgcaaagttatctggcatcccgcggcgggcgggccgatcccgatggcctctatatccactggatcggcggcaatgacttagcggcggcggcgctctcccccctgattgcccggcagctggtcgataacagcgccggtgcggcggccttacaggttggccggttgctggatgccggcgccggaacggtgattgtgccgacggtgcccaacgtgggggccacccccgcgctgttgcaggcgattctgcagacgctcggacccgccgcacaaccggccacggcggcgctgtttcagtcgctgagcacccgcaccacgccagaccgggccgcgcgcgagcaggcgattgaaacggccctgggtgaggcggcggggcagctttctgcgattccgccgatccgtgaggcgctcgcgcagcagctgattgctgcctggcggttgctgagtgaggccgcctcggcgctgaccgaccgttacaatcaggccgaagaggaggggctgctggcggcccgcggcaacatcgcccgggtagatatcaatggcctgtttaatgaggtgatcgataatccgttccgctatggactcaccaacaccgccggcatggcctgcccgcccggcgtgtcgtcgatggactgcactgcttccacgccgggattttcatcctcgcagcagtatctgtttgccgaccggctgcatcccagcccggcagtccatgcgctgatcgccgattacattcagtcagtgctgaacgcaccgctgcaggtggcggcgctgagccgtgccccctcaatgctggtgggcgatgcgcagaatacgctggatgggcatctgcagcagcagcgtcagcagcccgcagaggcgggcacgttaaccgtttttggcggttacgccgggcagcagcgggattttcgtggcgacagtctgctggatggggatgccaccagcgccaccggcaccgtgggggtcggctatcagctgaccgatgcgtggcaggccggcgcgatgctctccaccacctcgcagcgccagcagccctcgtcgcgcttcgattaccgcttgcgcggtaatctggtggcgatctggagccagctgaactacctcgaccacggctggataaacgcggacgcccactatgccgaccttgatttcgacgatattaaacgccaggtgaaactggggcctgcgacccgtaccgaacagggtaacagtggcgggaaagtgctggggatgcgggtgcagaccggctgggatcttcccgttagccgttacgtcacgaccgggccggtggcgagctatgcgctcgactacacgcgggtcggcggctatcaggaagagggcaacagcagcacctctatgcgctttggcgaccagacgctgcacgcccaggtcggctccctgggctggcgtatcgacagcaaagatttgccggtcaatccctgggcgcagatcagttacaaccatcagtttggtaacagtgattccgcggtaacggccggactgaaatcgacccgtaccgcctttacccgcagcagtgatggcacagatgacaactggatcaacatggccgtgggagccagcgtgccgctgggtgccgcagtgaatgcctttgctggcgtttcagccgtggcgggtaacagtgagacgcatcaggtgacgtggaacgtgggagtgaatgcccgtttttaa

SEQ ID NO: 2159 - DNA, 1761 bp, Pantoea sp.
cagggcggaaacaactatgccgaaggtggcgcagttgcggtgcctgcgattaatcccctgtttaacactcaggatcagcttgataactaccttgcggcgcggggcggacgggctgatccggacggtctctatattcactggattggtggcaatgatttagcggcggcggctcttgcccctctcgctgcccggcagatagtggataacagcgccagtgcagcggcctcacaggtcagccggttgctggatgccggagcaggaacggtgattgttccgacggtacccaatgtaggggcaacgcccgccctgctgcaggcgattctgcaggttcttggcccagcggcacaacctgctacggcggcgctgtttcagtcgctgagcaccaccactacgcctgaccgtgccgcaagagagcaggcgattgaaaacgcgcttggcgaggcggccggacaaatctcttcaatcccgctgatccgggatgccattgcgcagcagctgattgccgcctggaagttactgagtcaggaggcggcgacactcaccgaccgttacaaccaggctgaagaacaggggctggtggccgcgcgcgggaacatcgcgcgggtggatatcaatggcctgtttaatgaggtgatcgctaatccgggcctgtatggactcacgaatacggccggaatggcctgtccgccaggtgtctcggcgatggactgcacctcctcgacgacaggattttcacagtcacagcagtatctgtttgcagacagactgcatcccagcccggcggtccatgcgctgatcgccgattacattcagtcggtgctgaatgcgccgctgcaggtggctgcgctgagtcgggcgccgtcgatgctggtgggcgatgcgcacaatacgctggatggacatctgcagcagcagcgtcagcagcccgctaacgccggggagtttacggtcttcggcggttatgccggacagcagcgtgatttccgcggtgacagcctgcaggatggtgatgccaccagcgccagcggcaccgtgggtgtgggctatcagctgaccgatcactggcaggccggtgccatgctctctacgacctcgcaacgtcaggatccctcgtcgcgctttgattaccgtttacgcggcaatctggtggcgctctggagtcagttgaattatctcgatcggggatggattaatgcggacgcccattatgcggatctcgactttgatgatattgagcgtcagatcaggctgggaccggcgacccgcacggaaaagggcaacagcaacggtaaggtgctggggatgcggctgcagaccggctgggatttgccgctgggtagttatgtttctaccggcccggtggccagctatgcgctcgactacacccaggtcgatggctataaagaggagggcaacagcagcacctcaatgcgctttggtgaccagacgctgcactctcaaatcggtgcagtgggctggcgtatcgacagcaaagatttactgatcaatccctgggcgcaggtcagttacaaccatcagtttggcgacagcgattcggctgtcaccgccggactgaaatcgacccgcactgcctttacccgcagcagcgatgccagtgatgataactggatcgatatggctgtgggtgcgagcgtgccgcttggcacctcggtgaatgcctttgcgggcgtctcggcggtcacaggcaacagcgacatgcatcaggtgacatggaacgtcgggcttaacgcccgcttttaa

SEQ ID NO: 2160 - DNA, 1983 bp, unknown
  environmental sample
atgaaatcctttcacgcgcgacacctgctcgccggtgcggcaatgaccagtctcggtatgctctctccgttgccggcagcggcctggagccagctcaccgtttttggcgatagcctgagcgacggcggtaacgtcggccgcttcacctacgatgcggcttcccatcctttgtatgacgagagagtagcgcaacatctgaatgagaccctgctgccctcatcccagggcggcagcaactatgccgctggcggcgcggtggtcgtgccgctgctgaatccgcagttcaacacgcaggatcaggtcgatcgctacctcaccgctaatggcggccgtgccgatggcaatggtctctatattcactggatcggcggcaacgacctggccgccgccgcggcaaatccgctgaatgcggtgcagttgattgataacagtgcccgtgcggcgtccgatcaggtcagccggttgctggcggccggggccggtacggtgattgtcccgacggtgcctgacgtcggggcgaccccggcgctgttacaggcgattctgcaaccgctgggcccggtcgcggaaccggcgatggcggcgctgtttcagtcgctgagcactgttaccacgcctgaccgggcggcgcgtgagcaggctatcgaaacggcgctgcaagcggcggccgatcagatcccggccattccgctggtgcgtgaagcgatcgcacagcagctgtttgccgcctggcagctgttgagcgacaccgcggcgacgctgaccgaccgctataaccagctggaggagcaggggctggtggccagcggcggcaatatcgcgcgggtcgatattaacggactgttcagcgaggtgatcgataatccgggcctgtacggcatcagcaacagcgccggcatggcctgtccgccgggcgtctcggcgatggattgcacctcgtcaacgccaggcttctcgcaggcgcaacagtatcttttcgcggatcgtctgcatcccagcccggcggtacatgcgctgatcgctgactatatcgagtcgatcctggatgccccgttgcatgtcgcggcgctgaatcagtcccccctgatgctggtgcgggacgcgagaaatacgctggatgggcatttacagcagcaacgtcagcagcctgctgacgccggacagttcacggtgttcggcggctatgcgggtcagtcacgagattttcgcggcgacagtgatgcagagggtgatgccaccagtgccaatggcgcgatcggtatcggttatcagctgaccgacagctggcaggccggggcgatgttttcggcgaccacccagcgtcaggacccgtcatcacgtttcgattaccgtctgcgcggcaatctggtggcgctgtggagtcagttgcggctgtttgatcagggctggattaatgccgatctgcactatgccgatctcgatttcgacgatattgaacgtcaggtcagactgggaccggccacccgtaccgagcagggcagcaccgaagggaaactgctgggaatgcggattgaaaccggctgggatctgccgctggggcagtatgtgtccaccggtccggttgccagctacgcgctggattacagtcaggtagacggctatcgggagcagggtaaccgcagtagcgccatgcgctttggcgatcagacgctgcattcgcaggtgggttctgtaggctggcgcatcgacagcaggcagctgttgattaatccgtgggcgcaggtcagctacaaccatcagtttggcgacagtgattcagcggtaaccgccgggctgaaatcaacccgcacggcgtttacccgcaccagcgactcaggcgatgacaactggctggatatggcggtcggtgccagcgtgccgctgggtagcgcagtgaatgcgtttgcgggcgtttctgcggtggcgggcaacagtcaatatcatcaggtgacctggaacatcgggctcaatgcccgcttctga

SEQ ID NO: 2161 - DNA, 1974 bp, Pantoea sp.
tttcacgcgcgacacctgctcgccggtgcggcaatgaccagtctcggtatgctctctccgttgccggcagcggcctggagccagctcaccgtttttggcgatagcctgagcgacggcggtaacgtcggccgcttcacctacgatgcggcttcccatcctttgtatgacgagagagtagcgcaacatctgaatgagaccctgctgccctcatcccagggcggcagcaactatgccgctggcggtgcggtggccgtgccgctgctgaatccgcagttcaacacgcaggatcaggtcgatcgctacctcaccgctaatggcggccgtgccgatggcaatggcctctatattcactggatcggcggcaacgacctggccgccgccgcggcaaatccgctgaatgcggtgcagttgattgataacagtgcccgtgcggcgtccgaccaggtcagtcggttgctggcggccggggccggtacggtgattgtcccgacggtgcctgacgtcggggcgaccccggcgctgttacaggcgattctgcaaccgctgggcccggtcgcggaaccggcgatggcggcgctgtttcagtcgctgagcactgttaccacgcctgaccgggcggcgcgtgagcaggctatcgaaacggcgctgcatgcggcggccgatcagatcccggccattccgctggtgcgtgaagcgatcgcacagcagttgtttgccgcctggcagctgttgagcgacaccgcggcgacgctgaccgaccgctataaccagctggaggagcaggggctggtggccagcggcggcaatatcgcgcgggtcgatattaacggactgttcagcgaggtgatcgataatccgggcctgtacggcatcagcaacagcgccggcatggcctgtccgccgggcgtctcggcgatggattgcacctcgtcaacgccaggcttctcgcaggcgcaacagtatctgttcgcggatcgtctgcatcccagcccggcggtacatgcgctgatcgctgactatatcgagtcgatcctggatgccccgttgcaggtcgcggcgctgaatcagtcccccctgatgctggtgcgggacgcgagaaatacgctggatgggcatttacagcagcaacgtcggcagcctgctgacgccggacagttcacggtgttcggcggctatgcgggtcagtcacgagattttcgcggcgacagtgatgcagagggtgatgccaccagtgccaatggcgcgatcggtatcggttatcagctgaccgacagctggcaggccggggcgatgttttcggcgaccacccagcgtcaggacccgtcatcacgtttcgattaccgtctgcgcggcaatctggtggcgctgtggagtcagttgcggctgtttgatcagggctggattaatgccgatctgcactatgccgatctcgatttcgacgatattgaacgtcaggtcagactgggaccggccacccgtaccgagcagggcagcaccgaagggaaactgctgggaatgcggattgaaaccggctgggatctgccgctggggcagtatgtgtccaccggtccggttgccagctacgcgctggattacagtcaggtagacggctatcgggagcagggtaaccgcagtagcgccatgcgctttggcgatcagacgctgcattcgcaggtgggttctgtaggctggcgcatcgacagcaggcagctgttgattaatccgtgggcgcaggtcagctacaaccatcagtttggcgacagtgattcagcggtaaccgctgggctgaaatcaacccgcacggcgtttacccgcaccagcgactcaggcgatgacaactggctggatatggcggtcggtgccagcgtgccgctgggtagcgcagtgaatgcgtttgcgggcgtttctgcggtggcgggcaacactcaatatcatcaggtgacctggaacatcgggctcaatgcccgcttctga

SEQ ID NO: 2162 - DNA, 1983 bp, Pantoea sp.
atgaaatcctttcacgcgcgacacctgctctccagtgcagcgataaccaccctgagtctgctgtcgccgctgccggcagcggcctggagtcaactcaccgtgtttggcgatagcctgagcgacggtggcaatgtgggccgcttcacctacgacgcggcgtcccatccgttatatgacgagatactggcgcaacagctgaatcaaaccctgctgccgtcttctcagggcggcagtaactatgccgccggaggtgcggtggcggtgccggcgcttaatccgcagtacaacagtcaggatcagctagaccgttatctggccgccagtggcggtcgcgctgacggcaatggtctctatattcactggatcggcggtaacgatctggctgctgccgcagccgatccgctgaatgcggtgcaggtgattgatcacagtgcccgctctgcggccgaccaggtcagccggctgctggcggccggggcgggtaccgtggtggtgccgacggtgccaaacgtcggggcgacgccggcattactgcaggccattctgcaaccgcttggcccggtagcagaaccggctatggcggcgctgttccagtcgttaagcagcgtcacaactcccgatcgggcggcgcgcgagcaggctattgaggcggcattccgccaggctgcggatcagatcccggccattccactggtgcgtgaggctatcgcccgccagctgtttgccgcctggcaactgttaagcgacaccgcggcgacgctgaccgaccgttataaccagctcgaagagcaggggctggtggcaaccggcggcaatatcgcgcgggtcgatatcaaccggttgttcaatgaggtgatcgacaatcccgttcagtacggcatcagcaacagcgcaggcatggcctgtccgcctggcgtctcggcaatggattgcacctcggccacgccgggtttctctcaggcgcagcagtatctgtttgcggatcgtctgcatcccagcccggcggtgcatgccctgatcgctgactatattcagtcggtgctggatgcgccgttacaggtggcggcgctgagtcagtcaccgctgatgctggtgaaggatgcgcgtagtaccctggaaggacatttacagcagcagcgccagcagcctgcggaggccggacagtttaccgtgtttggtggctatgccggtctgtcacggaattttcgtggcgacagttatcaggatggcgatgccaccaccgccaatggcgcggtcggcatcggttatcagctaaacgacagctggcaggccggggcgatgttttcagcgacgtcgcagcgtcaggagccttcgtcgcgttacgactaccggctgcgtggcaatctggtggcgctgtggagtcagctgcggctgtttgatcagggctggattaacgccgatctgcattatgccgatctcgatttcgatgatattgagcgtcaggtcaggctgggtccggccacccggactgaacagggcagtaccgatggtaagctgctgggaatgcgaattgaaactggctgggatctgccgctcggccagtatgtttctaccggtccggttgccagctatgcgctggattatagccgggtctcaggctatcaggagcagggcaatcgcagcagcgccatgcgctttggcgatcagacgctgcactcgcaggtcgggtctgtcggctggcgcatcgacagcaggcagctgttgatcaatccgtgggcgcagatcagttacaaccatcagtttggcgacagtgactcagcggtgacggccgggctgaaatcgacccgcacggcgtttacccgcaccagcgaaacaggcgatgacaactggctggatatggcggtcggggccagcgtgccgcttggcactgcggtaaccgcatttgctggcgtctctgcggtggcgggcaacagcgaatatcatcaggtgagctggaacgtcgggctcaatgcgcgcttctga

SEQ ID NO: 2163 - DNA, 1029 bp, Curtobacterium sp.
gtggccgccgtcgggctggtggtggcaggggtcgcggctccgggttcggtgcagcccgcctcggctgccccgatgtggcccgtcccacagccctacccggtgccggacgaccccgccgaatcgctcgccgacctgccgccgggcagcgagtacgtcgcgctcggtgactcgtactccgccgggtacgggctcggcgatcgcacccgactgcccacgagcgcgtgcgtgcagtcggcccgtgactacccgcaccggctcgcggcacggttcggcctcgacctgaccgacgtcacgtgcgccggcgccacgagcgaggacgtcacgaccgggcaccagttcaacggcgtcccaccgcagatcgagtcactgtcgtcgcgcacccggctcgtgaccctgacgatcggcggcaacgacgccgacctgttcggcaccgccgcgtcgtgcctggcgatctcggccgacggcccggtgttctccggacgtgccgcgccgtcgtgcgagagcacgctcgtgcaggacggtgaggaccaactcagcgccaagatccagtcccgggtcgcgctcgggatcgccgacaccctggcagcagtgaaacgggccgcaccgaacgccgtcgtggtgttcctcgggtacccggcgatcttcccggacaccgagcacaccccggcgaagggctgcttccgctcggcgctcgacctcggcaccctcgccgggtccttcccgtcggacaccttccccttcaccgacgacgacgtcgcgtacctgcacggcgtgcaggaggagctcgacaccgtttccgcttccgccgcggacgccgccggagtccggttcgtcgacgtcctcgaccgcaccgaggcccactcggcctgcgccccggcggacgagcggtacgtcgcgggcgtcagcctgaccggctcgagcgacctgcgacgcatcgacctgcaggccggcgccctgcacccgaacggccgcggtgtcgcctacctcaccgaccagatggccgacgcgatccgggaactcgccggctga

SEQ ID NO: 2164 - DNA, 957 bp, unknown
  environmental sample
atgtggcccgtcccgcagccctacccggtgccggacgacccgaccgaatcgctcgtcgacctcccgcccggcagcgagtacgtcgccctcggtgactcgtactccgccggctacggactcggcgaccggacccggctgcccacgagcgcgtgcgtgcagtccgcccgtgactacccgcaccggctcgcggcgcggttcggcctcgacctgaccgacgtcacgtgtgcgggcgccaccagcgaggacgtcacgaccggacaccagttcacgggcgtccccccgcagatcgagtcgctgtcgtcgcgcacccggctcgtgaccctgaccatcggcggcaacgacgcggacctgttcggcaccgccgcgtcgtgcctggcgatctcggccgacggcccggtgttctccggacgtgacgcgccgtcgtgcgagagcacgctcgtgcaggacggtgaggaccagctcagcgtgaagatccagtcgcgggtcgcgctcgggatcgccgacaccctcgcagcggtgcaacgggccgcgccgaacgccgtcgtcgtgttcctcgggtacccggcgatcttgccggacgccgagcacaccccggcgaagggctgcttccgctcggcgctcgacctcggcacgctcgcggggtcgttcccctcggacaccttcccgttcaccgacgacgacgtggcgtacctgcacggtgtgcaggaggagctcgacgccgtgtccgcatccgcctccgacgccgccggggtgcggttcgtcgacgtcctcgaacgcaccgaggcccactcggcctgcgccccggcggacgaacgctacgtcgccggcgtcagcctgaccggctcgagcgacctgcgacgcatcgacctcaaggccggcgccctgcacccgaacggccgcggtgtcgcgtacctcaccgaccagatggccgacgcgatccgggaactcgccggctga

SEQ ID NO: 2165 - DNA, 957 bp, Curtobacterium sp.
atgtggcccgttccccagccctacccggtaccggacgacccgaccgagccgctcgccgacctcccgcccggcagcgagtacgtcgccctcggtgactcgtactccgccggctacggcctcggcgaccggacccggctgcccacgagcgcgtgcgtgcagtcggcccgtgactacccgcaccggctcgcggcgcggttcggcctcgacctgaccgacgtcacgtgtgcgggcgccaccagcgaggacgtcacgaccggacaccagttcacgggcgtccccccgcagatcgagtcgctgtcgtcgcgcacccggctcgtgaccctgaccatcggcggcaacgacgcggacctgttcggcacggccgcgtcgtgcctggcgatctcggccgacggcccggtgttctccggacgcgacgcgccgtcgtgcaagagcacgctcgtgcaggacggtgaggaccagctcagcgtgaagatccggtcgcgggtcgcgctcgggatcgccgacaccctcgcagcggtgcaacgggccgcgccgaacgccgtcgtcgtgttcctcgggtacccggcgatcttcccggacgccgagcacacccccgcgaagggctgcttccgctcggcgctcgacctcggcacgctcgcggggtcgttcccctcggacaccttcccgttcaccgacgacgacgtggcgtacctgcacggtgtgcaggaggagctcgacgccgtgtccgcatccgccgccgacgccgccggggtgcggtttatcgacgtcctcgaacgcaccgaggcccactcggcctgcgccccgcgggacgagcgctacgtcgccggtgtcagcctgaccggctcgaccgacctgcgacgcatcgacctgcgggccggcgccctgcacccgaacggccgcggtgtcgcgtacctcaccgatcagatggccgacgcgatccgggaactcgccggctga

SEQ ID NO: 2166 - DNA, 957 bp, Curtobacterium sp.
atgtggcccgtcccgcagccatacccggtgccgggcgacccggccgagccgctcgccgagatcccgccgggcagcgagtacgtcgccctcggtgactcgtactccgccggctacggcctcggcgaccggacccggctgcccacgagcgcgtgcgtgcagtcggcccgtgactacccgcaccggctcgcggcgcggttcggcctcgacctgaccgacgtcacgtgcgcgggcgccaccagcgaggacgtcacgaccggacaccagttcacgggcgtccccccgcagatcgagtcgctgtccgcgcgcacccggctcgtgaccctgaccatcggcggcaacgacgcggacctgttcggcacggccgcgtcgtgcctggcgatctcggccgacggcccggtgttctccggacgcgacgcgccgtcgtgcgagagcacgctcgtgcgggacggtgaggaccagctcagcgtcaagatccagtcgcgggtcgcgctggggatcgccgacaccctcgcagcggtgcagcgggccgcgccgaacgccgtcgtcgtgttcctcgggtacccggcgatcttcccggacgccgagcacaccccggcgaagggctgtttccgctcggcgctcgacctcggcacgctcgcggggtcgttcccctcggacaccttcccgttcaccgacgacgacgtggcgtacctgcacggcgtgcaggaggagctcgacgccgtgtccgcatccgccgccgacgccgccggggtgcggttcgtcgacgtcctcgaacgcaccgaggcccactcggcctgcgccccgcgggacgagcgctacgtcgccggtgtcagcctgaccggctcgagcgacctgcggcgcatcgacctgaaggccggcgccctgcacccgaacggccgcggagtcgcgtacctcaccgaccagatggccgacgcgatccgggaactcgccggctga

SEQ ID NO: 2167 - DNA, 1038 bp, unknown
  environmental sample
gtgctcgcggtcctcgccgcggtcgtcgtcgcgccgtggggcccggtcgcggtcgcaccgaccgacggcgccgtcgcggcgccgatgtggccggtaccggagccgtacccggtcacggacgacccggcggagacgctcgccgacctgccgccgggcagcgagtacgtcgcactcggcgactcctactcggccggctacggcctgggcgacccgacccggctgccgacgagcgcctgcgcgcagtcggcgcgcgactacccccaccggctcgcggcgcgcttcggactcgacctgaccgacgtgacgtgcgcgggggcgaccagccgtgacgtcgtgtcggggtaccagttccgcggggtgccgccccaggtccgggcactgtccgaggacacccggctggtcacgctgacgatcggcggcaacgacgccgacctgttcggcaccgccgcctcctgcctggcgctgtcctcccgcggcccggtgttctccggtcgggacgccccgtcgtgccgcagcaccctcgtgcacgacggggtggacgacctcgacgtgcgcatccggtcccgggtcgcgctcgggatcgcggacacgctcgccgcggtccgccgggccgcgccgaacgcagtcgtggtcttcctcggctacccggcgatcttcccggacgcggcccacacgccggcgcgggggtgcttccgctcggcgctcgacctcggctcgctcgtggggtccttcccgcgggacacctacccgttcaccgacggcgacgtccggtacctgcacggggtccaggagtcgctcgacgaggtctcggcgtccgctgccgaagcggccggcgtcccgttcgtcgacgtgttcgcccggtcgcaggcgcactcggcctgcgcgaccgacgacccgtacgtcgcgggtgtctcgctctccggggcgggcgacctgagccgcatcgacatggtgcccggggccctgcacccgaacgggcgcggggtggcgtggttgaccgggcaggtggcctcggagctccgccggctcgaggactga

SEQ ID NO: 2168 - DNA, 1056 bp, unknown
  environmental sample
gtgctcgccgtcgcggccgccgcggtcgtcggaccgtggggcgtcgtcacgggtccgtggagcgcccccggtggtgctggcggggacgccgtggccgcgccgatgtggcccgtgcccgagccctacccggtcaccgacgacccggccgagaccctcgccgacctcccaccgggcagcgagtacgtcgccctcggtgactcgtactccgccggctacggtctgcccgacccgacccggctgccgacgaacgcgtgcgggcagtcggcacgggactacccgcaccggatcgcggcgcgcttcggcctggacctgacggacgtcagctgcgccggggccacgagccgcgacgtcgtctccggccaccagttccgcggggtgccgcctcaggtccgggcgctgtcggagcggacccggctcgtcacgctcaccatcggcgggaacgacgccgacctgttcggcacggccgcgtcgtgcctggcgctctcgtcgcgcggtcccgtcttctccgggcgcgacgccccgtcctgccggagcacgctcgtccacgacggcgtcgacgacctcgagttgcgcatccggtcgcgggtcgccctcggcatcgcggacacgctcgccgcggtgcgccgcgcggcgccggacgccgaggtcgtgctgctcgggtacccggcgatcttcccggacgccgcgcacacgcccgagcgcgggtgcttccgttccgcgctcgacctcgggtcgctcgcggggtccttcccgcgggacacctacccgttcacgaacaccgacgtgcggtacctgcacggggtgcaggaggcgctcgacgaggtgtcggcggcagcggcggcagcagcgggggtcaccttcgtcgacgtcttcgccgactcgcaggcccactcggcgtgcgcgacggcgcggccgtacgtggcgggggtctcgctctccggcaccggcgacctcagccgcatcgacctcgagcccggggcgctgcacccgaacgagcggggcgtcgcctggctcaccgggcggctggcggccacgctccgcgggaccgccggctga

SEQ ID NO: 2169 - DNA, 1038 bp, unknown
  environmental sample
gtgctcgcggtcctcgccgcggcggtcgtcgcaccgtggggtcccgtcgtgggggcgtcgaccgacggtgccgtggcggcgccgatgtggcccgtgccggcgccgtacccggtgacgggcgacccggtcgagaccctggcggacctgccgccgggcagcgagtacgtcgcactcggtgactcgtactcggccggctacggcctgtccgaccccacgcacctgccgacgagcgcgtgcggccagtcggcgcgggactacccgcaccggctcgccgcgcggttcgggttcgccctgaccgacgtgacctgtgccggcgccaccagccgcgacgtcgtgtccgggtaccagttccgcggtgtgccgccgcaggtccgtgcgctgtccgaggacacccggctcgtcacgctgacgatcggcggcaacgacgccgacctcttcggcaccgccgcgtcctgcctcgcgctgtcgtcccgcggcccggtgttctccggccgggacgcgccgtcctgccgcagcacgctcgtgcacgacggcgtggacgacctcgaggtgcgcatccggtcgcgggtggccctcgggatcgcggacaccctcgccgcggtccgacaggccgccccgaacgcggtcgtggtgttcctcggctacccggcgatcttcccggacgcagcgcacacgccggcgaagggctgcttccgctcggcgctcgacctcgggtcgctcgtcgggtcgttcccccgggacacgtacccgttcacgaacagcgacgtccggtacctgcacgggattcaggagtcgctcgacgaggtctcggcgtccgcggccgaggcggccggggtgccgttcgtcgacgtgttcgcggagtcgcaggcgcactccgcgtgcgcgaccgaccgaccgtacgtgtcgggcgtctcgctctccggcacgggcgacctcagcagcatcgacatggagcccggcgccctgcacccgaacggtcgcggggtcgcttggctgacgcggcagctcgcggcggagctgcgcacgctcgcggggtga

SEQ ID NO: 2170 - DNA, 1455 bp, Pseudomonas sp.
atgtcgtcacctattcgcaaagccatcaattcagacgcattgacccgcttggctcaagccatcgcggtggctgtgtccgccactttggcgggctgttcaagccatgtgccgcagaccgaagcgacacacacaccgaatatcgccgcgcgagccaagcaaaaaccaatctggctcagcgaaaaaccaacaccgcaagttccccaggacgtctgggagcgcatgcgccagggcttccagttgcaagacaacctgggcgtcaacccgcgcatcgagcagcagcgcctgtggttcgccagtaacccgtccttcctcgaaaacgccggcgaacgcggcagcctctacattcactacatcgtcgaacgccttgaagaacgcaacatgccgctggaactggcgctgttgccagtgattgaaagcgcctacaacccgatggcctattcccgggccgacgcggtgggtctttggcaattcattccttccaccgggcgttacttcaacctgcgtcaaacccgtttctatgatggccgtcgcgacatcaccgcctcgaccaccgcggccatggattacctgacccgcctgcacgacatgttcaacggtgactggctactggccctggcggcctacaacgccggcgaaggcacggtcagccgggccatcgagcgcaacgagaagctcggccttccaaccgattattggaacctgccgctgccagcggaaacccaggcctatgtgccgaagctgctggcgctgtcgcaagtggtgttggcgcccgatgcctatggcgtgaacctcaagtcgatcgccaacgaaccgtacttccaggtcgtcgaaatcaaccagcgcatggacctgtccaaggttgccgcggtggccaacatcgacgaagacgaactgttccagctcaacccggccttcaagcaacgcactaccatcgacggcccccagcatctgctggtgccgacgtccaaggcgcaactgctgactgccagcctgtcgaccatgcgtcctgaagagctgatcagccagcggccgctcaagccggtgttcgaaggtgccgacgacagcgaaatcgccagcatcaagcgcgcctaccgggtcaagcgcggagaaaatctggcctccattgccagggccaacaaggtcgacgtcaaggacctgcaacgctggaacaagctgaacggcaagaacctcaaggtcggccagacccttgtgatgcaggacaccagcaagcgcagcggcggtcgcatcaacactgtcgtggcggcgaacagcaaaaccagcggcaagtcagacaaacagaaaccgcagacccagtacaaggtccagcaaggcgactcgttgtacatggttgccaaacgtttcaatgtcgaaatgcaacacctcaagcgctggaaccctcgggtaggccaggcgctgaaaccgggtcagatgctgacggtttcttccccgcattaa

SEQ ID NO: 2171 - DNA, 1455 bp, Pseudomonas sp.
atgtcgtcacctattcgtaaagccatcaattcagacgcattgacccgcttggctcaagtcattgcggtggctgtgtccgccactctggcgggctgttccagccatgtgccgcagaccgaagcgacacacactccgaatatcgccgctcgagccaagcagaaacctgtctggctcagcgaaaaaccaacaccgcaaattccacaggacgtctgggagcgcatgcgccaaggcttccagttgcaggacaacctgggcgtcaacccgcgcatcgagcaacagcgcctgtggttcgccagtaacccgtccttcctcgaaaacgccggcgaacgcggcagcctctacattcactacatcgtcgaacgccttgaagaacgcaacatgccgctggaactggcgctgttgccggtgattgaaagcgcctacaacccgatggcctattcccgggccgacgcggtgggtctttggcaattcattccgtccaccgggcgttacttcaacctgcgtcagacccgcttctatgatggccgtcgcgacatcaccgcctcgaccaccgcggccatggattacctgagccgcctgcacgacatgttcaacggcgactggctactggccctggcggcctacaacgccggcgaaggcacggtcagccgggccatcgagcgcaacgaacgacttggcctgccgaccgactactggaacctgccgctgccagcggaaacccaggcctatgtgccgaagctgctggccctgtcgcaagtggtcctcgcacccgacgcctatggcgtgaacctcaacccgatcgccaacgaaccgtacttccaggtcgtcgaaatcaaccagcgcatggacctgtccaaggttgccgccgtcgccaacatcgacgaagacgaactgttccagctcaacccggccttcaagcagcgcaccaccatcgacggtccccagcatctgctggtgccaacgtccaaggcgcaactgctgactgccagcctgtcgaccatgcgtcctgaagagttgatcagccagcgatcgctcaagccggtgttcgaaggggcagacgacagcgaaatcgccagcctcaagcgcgcctatcgggtcaaacgcggcgacaatctcggcaccatcgccaaggccaacaaggtcgaggtcaaagacctgcaacgctggaacaagttgaacggcaaagacctcaaggtcggccagaccctggtgatgcaggacaccaccaagcgcaaatccgggcgcatcaacaccgtggtcgcggtgaacagcaagaccaatggcaaggcaaccaacaagacgcaacagacccagtacaaggtcaagcaaggcgactcgctgtacatggtcgccaaacgcttcaacgttgaaatgcagcacctcaagcgctggaaccctcgggttggccaggcgctgaaaccggggcagatgctgacggttgcttcgccgcattaa

SEQ ID NO: 2172 - DNA, 1458 bp, Pseudomonas sp.
atgtcgtcatctattcgtaaagccatcaattcagacgcattgacccgcttggctcaagccatagcggtggctgtgtccgccactctggcgggctgttccagccatgtgccgcagaccgacgcggcacataccccgaacatcgcagcgcgagccaaacagaagcccatctggctcagcgaaaagcctagcccgcaaattccacaggacgtctgggagcgcatgcgccagggcttccagttgcaggaaggcctgggcgtcaacccgcgcatcgagcaacagcgcctgtggttcgccagcaacccttccttcctcgaaaacgccggcgaacgcggcagtctctacattcactacatcgtcgaacgccttgaagaacgcaacatgccgctggaactggcactcctgccagtgattgaaagcgcctacaacccaatggcctattcccgggccgacgcggttggcctgtggcaattcattccttccaccgggcgttacttcaacctgcgccagacccgtttctacgatggccgtcgcgacattaccgcgtcgaccaccgccgcgatggattacctgacccgtctgcacgacatgttcaacggcgactggctgctggccctcgcggcttacaacgcgggtgaaggtacggtcagccgggccatcgaacgtaacgaaagacttggcctgcccaccgattactggaacctgccactgccgtcggaaacccaggcctatgtgccgaagttgctggccctgtcgcaagtggtcctggcgcccgaagcctacggcgtgaacctcaacccgatcgccaacgagccgtatttccaggctgtcgaaatcaaccagcgcatggacctgtccaaggttgcagcggtggccaatatcgacgaagacgagctgttccagctcaacccggccttcaagcagcgcaccaccactctggacggccctcagcatttgctggtgccgacgtccaaggcgcaactgctgaccgccagcctgtcgaccatgcgtcccgaagagctgatcagcaagaagtcgctcaaaccggtgttcgaaggcgcagacgatacccagatcgccagcctcaaacgcgcctaccgcgtgaaacgtggcgacaacctcggcaccatcgccaaggccaacaaggtcgacgtaaaagacctgcaacgctggaacaagctgactggcaaggacctcaaggttggccagacgctggtgatgcaggacaagaccaagcgcagctccggacgcgtcaacaccgtagtggccgccaataccaagacgaatggcaagacggacaccaagaaaccgcagactcaatacaaggtccagcaaggtgactcgctgtacatcgtggccaagcgtttcaacgttgaaatgcagcacctcaagcgctggaacccgcgtgtcggccaggcgctgaagccgggtcagatgctgacggttgcttcgccgcactaa

SEQ ID NO: 2173 - DNA, 1452 bp, Pseudomonas sp.
atgtcgtcatctattcgtaagtccattcattcagacgcattgacccgcctggctcaagccatcgcggtggctgtgtccgccacgttggcgggctgttccagccatgtgccgcagaccgaagtgacgcacactccgaatatcgcggcacgcgccaaacagaagcccatctggctcaccgaaaagcctgttccgcaaattccccaggacgtctgggagcgcatgcgacagggtttccagttgcaggacaacgtcggcgtcaacccacgcgtcgagcagcagcgcctgtggttcgcgagcaacccctcctacctggaatcggctggcgaacgcggcagcctctacattcattacatcgtcgagcgcctcgaagagcgcaacatgccgctggaactggccctgctgcccgtgattgaaagctcctacaacccgatggcctattcgcgcgcccatgcagtgggtttgtggcaattcattccgtccaccggccgttatttcaatctgcggcagacacgtttttatgatggccgccgcgacatcaccgcgtcgaccactgcggcaatggattatctgacccgcctgcacgacatgttcaacggtgactggctgttggcgcttgcagcctacaacgctggcgagggcacggtaagccgcgccatcgagcgcaacgaaaaactggggctgccgaccgattactggaacctgccactgccggccgaaacccaggcctacgtgcccaagttgcttgcattgtcgcaggtggtgctggcaccggaagcctatggcgtgaacctcagcccgatcgccaatgagccttacttccaggtggtcgagatcaaccagcgcatggacctgtccaaggttgcggcggtggctaacatcgatgaagacgagctgttccagctcaatccggcgttcaaacagcgcaccaccatcgacggtcctcagcatttgctggtgccgacatcgaaagcgcaactgctgactgccagcctgtcgaccatgcgaccggacgaattgatcagccagaagccgctaaaaccggtcttcgagggtgttgatcgcaacgagattgccagcctcaaacgcgcctatcgggtcaaacgcggcgacaacctgggcacaatcgccaaggccaacaaggttgacgtcaaggacctgcagcgctggaacaagacgtctggcaaaaacctcaaggttggccagacgctggtcatgcaggacacctcgaaacgtggctccggacgggttaataccgtcgtggcggcaaacagcaagtccgccggcaagtccagcaaaaaggcgcagactcagtacaaggtcaagcaaggcgactcgttgtacatggtggccaagcggttcaatgtggaaatgcagcacctcaagcgctggaaccctcgggttggccaagcgctgaagccgggacagatgctgacggtgtcctcgccgcattaa

SEQ ID NO: 2174 - DNA, 1464 bp, Pseudomonas sp.
atgtcgtcatccatacgtaagtccgtcaactcagatgctttgacccgcctggcgcaagccattgcggtggctgtgtccgccacgctggcgggctgttccagccatgctccgcagactgaagcgacgcacacgccgaacattgctgcgcgagccaagcagaagccgatctggctgaccgagaagcccacgcccgtggcgccccaggacatctgggagcgcatgcgccagggcttccagctgcaggaaggccttggcgtcaatccgcgcatcgagcaacaacgcctgtggttcgccagtaacccctcttttctggagaatgccggcgaacgcggcagcctctacattcattacatcgtcgaacgcctcgaagaacgcaacatgccgctggagctggccctgctgccggtgatcgagagcgcctacaacccgatggcctattcgcgcgccgatgccgtgggcctgtggcaattcattccgtctaccgggcgttacttcaacctgcgccagacgcgtttctacgatggccgtcgcgacatcaccgcctcgaccaccgcagcgatggattacctcacgcgtttgcacgacatgttcaacggtgactggctgctggctctggcggcctacaatgccggtgaaggcacggtcagccgggcaatcgagcgcaacgaaaagcttggcctgcccaccgactactggaacctgccgctgccggcggaaacccaggcgtacgtgccgaaactgctggcgctgtcgcaagtggtgctggcgccggaagcgtacggagtcaacctcaacccgatcgccaatgaaccgtacttccaggtcgtcgaaatcaaccagcgcatggacctgtccaaggtcgctgcagtggccaacattgacgaagacgaactgttccagctcaacccggccttcaaacagcgcaccaccatcgacggcccgcagcatttgctggtgccaacgtccaaggcgcaactgctcaccgccagtctgcagaccatgcgcccggacgaactgatcagcccccgctcgctgaaaccggtgttcgaaggcgccgatccgtcggaagtggcgcagctcaaacgtgcttatcgggtcaagcgtggcgacaacctcggctccatcgccaaggccaacaaggtcgaagtcaaggatctgcagcgctggaacaagctgaccggcaagaacctcaaggtcggccagactctggtcatgcaggacaacaccaagcgtgccccggcgcgcaagtccggccgggtcaacaccgtggtcgcggcgaataccaagaccaaaggcaagaacgaaagcaagcagcagacccagtacaaggtcaagcgtggcgacacactgtacgtggtggccaagcgtttcaacgtcgagatgcaacatctcaagcgctggaacccgggtgcgggcaaggcattgaaaccggggcaaatgctcacggtttatcagccgcattga

SEQ ID NO: 2175 - DNA, 1467 bp, Pseudomonas sp.
atgtcgtcatccatacgtaagtccgtcaattcagacacgttgacccgcttggcgcaagccatcgcggtggctgtgtccgccacgctggcgggctgctccagccatgctccgcagactgaagcgagccatacgccgaacattgctgcgcgagccaagcagaagccgatctggctgactgaaaagccaagcccacaggtgcctcaggacatctgggagcgcatgcgcggcggtttccagctgcaggacggcctgggcgtgaacccgcgcatcgagcaacagcgcctgtggtttgccagcaacccgtcctttctcgagaatgccggcgaacgcggcagcctctacattcattacatcgtcgagcgtcttgaagagcgcaacatgccactggaactggccctgttgccagtgatcgagagcgcctacaacccgatggcctattcccgggccgacgcgtcgggcctgtggcagttcatcccgtccaccggccgctactacaacctgcgccagacccgtttttatgatggccgtcgcgatatcaccgcctcgaccaccgccgcgatggattacctgacccgtctgcacgacatgttcaacggtgactggctgctggctctggcggcttacaacgccggtgaaggcaccgtcagccgcgccatcgagcgcaacgagaagctcggcctgcccaccgactactggaacctgtcgtcgttgccggcggaaacccaggcctacgtgccaaaactgctggccttgtcgcaagtggtgctggccccggaagcctacggggtgaacctcaacccgatcgccaacgaaccgtacttccaggtcgtcgaaatcaaccagcgcatggacctgtccaaggtcgcggcagtggccaacatcgacgaagacgaactgttccagctcaacccggcgttcaagcaacgcaccaccgtcgatggccctcagcatctgctggtgccgacgtccaaggcgcaactgctgaccgccagcctgcagaccatgcggcctgaagaactgatcagtccgcgttcgctgaaaccggtgttcgacggcgccgacccaagcgaagtggcgaagctcaagcgcgcctaccgggtcaaacgcggtgacaacctcggctccatcgccaaggccaacaaggtcgaagtcaaggatctgcagcgctggaacaagctgactggcaagaacctcaaggtcggccagaccctggtgatgcaggacaccaccaagcgcaccccggcgcgcagcggtggccgggtcaacacggtgatcgccgccaacagcaagaccaaaggcaaggccgacagccagcagcagacccagtacaaggtcaagcgtggcgacaccctgtacgtagtggccaagcgtttcaacgtcgagatgcagcatctcaagcgctggaacccgggtgccggcaaggcgttgaagcctgggcagatgctcacggtttaccagccgcactga

SEQ ID NO: 2176 - DNA, 1431 bp, Pseudomonas sp.
atgtcgtcacctattcgcaaagccatcagttcagacgcattgacccgcttggctcaagccattgcggtggctgtgtccgccaccctggcgggctgttccagccatgcgccgcagaccgatgcggcgcacacgcagaacatcgccgcgcgcgccaagcagaagccgatctggctcagcgaaaaacccagtccgcaaattccccaggacgtctgggagcgcatgcgccagggcttccagctgcaagacgggctgggcgtcaacccgcgcatcgagcaacagcgcctgtggttcgccagcaatccatctttcctcgaaaacgccggcgagcgtggcagcctctacattcactacatcgtcgaacgccttgaagaacgcaacatgccgctggaactggccctgctgccagtgatcgaaagcgcctacaacccgatggcctattcccgggccaacgcggtgggtctttggcagttcatcccgtccaccgggcgttacttcaacctgcgtcaaacccgcttctatgatggccgtcgcgacatcaccgcgtcgaccaccgccgccctggattacctgacccgcctgcacgacatgttcaacggcgactggatgctggccctggcggcctacaacgccggcgaaggcaccgtcagccgggccattgagcgcaacgaacgcctcggcctgccgaccgactactggaacctgccgctgccctctgaaacccaggcctatgtgccaaagttgctggcactgtcacaggtggtgatggcgccggaagcctacggcgtgaacctcaatccgatcgccaacgagccctacttccaggtcgtcgaaatcaaccagcgcatggacctgtccaaggttgctgaagttgccaacatcgacgaagacgaactgttccagctcaacccggccttcaagcagcgcaccaccctcgatggcccgcaacatctgctggtgccgacctccaaggcgcaattgctgaccagcagcctgcagaccatgcgtcctgaagaactgatcagcaagaaatcgctcaagccggtcttcgaaggtgccgacgacagccaggtcgccagcgtcaagcgttcctatcgggtcaagcggggtgacaacctcggttccatcgccaaggccaacaacgttgacgtgaaggacctgcaacgctggaacaaactgagcggcaagaacctcaagccgggccagaccctggtcatgcaggacaacagcaaacgcaactccgggcgcgtcaacaccgtgattgcagccaataccaaaaagcagcaggccaagtacaaggtccagcaaggcgactcgctgtacatcgtggccaagcgcttcaacgtagagatgcagcacctcaagcgctggaatccgcgtgtcggccaggcgctcaagcctggtcagatgttgacggtggccaatccgcactaa

(The sequence listing continues in the following parts.)

The invention claimed is:

1. A method for enhancing the resistance of a plant or a part thereof to at least one pathogenic fungus and/or Oomycete, the method comprising introducing into at least one cell of the plant or part thereof at least one exogenous polynucleotide encoding at least one polypeptide at least 70% identical to a polypeptide having the amino acid sequence set forth in SEQ ID NO:2635 or a fragment thereof, thereby enhancing the resistance of said plant or part thereof to the at least one pathogenic fungus and/or Oomycete compared to the resistance of a control plant.

2. The method of claim 1, wherein the at least one exogenous polynucleotide comprises a nucleic acid sequence at least 70% identical to the nucleic acid sequence set forth in SEQ ID NO:783 or a fragment thereof.

3. A method for producing a population of plants, each having an enhanced resistance to at least one pathogenic fungus and/or Oomycete, the method comprising the steps of:
   a. introducing into at least one cell of each plant of a plant population at least one exogenous polynucleotide encoding at least one polypeptide at least 70% identical to a polypeptide having the amino acid sequence set forth in SEQ ID NO:2635 or a fragment thereof, as to produce a genetically engineered plant population;
   b. inoculating each plant of the genetically engineered plant population with the at least one pathogenic fungus or Oomycete; and
   c. selecting plants showing an enhanced resistance to said at least one pathogenic fungus or Oomycete compared to a control plant or to a pre-determined resistance score value;
thereby producing a population of genetically engineered plants having enhanced resistance to said at least one pathogenic fungus and/or Oomycete.

4. A method for selecting a plant having an enhanced resistance to at least one pathogenic fungus and/or Oomycete, the method comprising the steps of:
   a. providing a plurality of plants each comprising at least one cell with enhanced expression and/or activity of at least one polypeptide at least 70% identical to a polypeptide having the amino acid sequence set forth in SEQ ID NO:2635 or a fragment thereof;
   b. inoculating the plurality of plants with the at least one pathogenic fungus and/or Oomycete; and
   c. selecting plants showing an enhanced resistance to said at least one pathogenic fungus and/or Oomycete compared to a control plant or to a pre-determined resistance score value;
thereby selecting a plant having enhanced resistance to said at least one pathogenic fungus.

5. A genetically engineered plant having enhanced resistance to at least one fungus and/or Oomycete compared to a non-engineered control plant, wherein the genetically engineered plant comprises at least one cell having enhanced expression and/or activity of at least one polypeptide at least 70% identical to a polypeptide having the amino acid sequence set forth in SEQ ID NO:2635 or a fragment thereof.

6. A nucleic acid construct comprising a polynucleotide comprising a nucleic acid sequence encoding a polypeptide comprising an amino acid sequence at least 70% identical to the amino acid sequence set forth in SEQ ID NO:2635 or a fragment thereof, wherein the polynucleotide further comprises at least one regulatory element for directing the expression of said polynucleotide within a plant cell, and wherein the polypeptide, when expressed in the plant, is capable of enhancing the resistance of the plant to at least one pathogenic fungus and/or Oomycete.

7. A genetically engineered plant cell expressing a construct according to claim 6.

8. The method of claim 1, wherein the at least one polypeptide at least 70% identical to the polypeptide having the amino acid sequence set forth in SEQ ID NO:2635 comprises an amino acid sequence selected from the group consisting of SEQ ID NO:4202, SEQ ID NO:4203, SEQ ID NO:4204, SEQ ID NO:4205, SEQ ID NO:2637, SEQ ID NO:4206, SEQ ID NO:4207, SEQ ID NO:4208, SEQ ID NO:4209, SEQ ID NO:4210, and SEQ ID NO:2660.

9. The method of claim 1, wherein introducing the exogenous polynucleotide into the at least one cell of the plant or part thereof comprises transforming said polynucleotide or a construct comprising same into said at least one cell.

10. The method of claim 1, wherein introducing the exogenous polynucleotide into the at least one cell of the plant or part thereof comprises subjecting the at least one cell to genome editing using artificially engineered nucleases.

11. The method of claim 3, wherein introducing the exogenous polynucleotide into the at least one cell of the plant or part thereof comprises transforming said polynucleotide or a construct comprising same into said at least one cell.

12. The method of claim 3, wherein introducing the exogenous polynucleotide into the at least one cell of the plant or part thereof comprises subjecting the at least one cell to genome editing using artificially engineered nucleases.

* * * * *